United States Patent 10,221,454 (METHODS AND COMPOSITIONS FOR SCREENING AND TREATING DEVELOPMENTAL DISORDERS) - sequence listing, part 17

SEQ ID NO: 144 - DNA, 609822 bp, Homo sapiens
tctcctctcttttggaaaccggagaggtggagggagggcaacaccgctgcaaaggagaggcccgccaagtctgcccgcctgcaaagtgttgctttgacacattcttattatggaagttaagtaaaaatatagacatattaaaaaataactccggacgtggagctgctacggagaaggaaaccgggggaaagaaaaccagtaggcaggccaatggtttttcggcagcgcgctggcaagtttgtggaacactttctaggaattaggtcttttcctcccccttcatcatcttgacttctgaaggaagaacttggctttggattgcagtggagcctaaggagagagggttagacacactcgaataatccctctggctgggctgaatttgtgggaatttaggaagccagagtgctggaaatacagcagcctttgaagtaccctctgttaatttggatggatctcagtgtgccccgttcgagacctctccaccaaccccttctgatcttgcgatttgctcttcttgactttaattagtatctaggaaagtctaaactttggacctacctctttttttgatactcatttttgtacttttgctctctgggattggtttcttaaagaatctggatcctttttaatatgtcaaaatgagtctgctgatgtttacacaactactgctctgtggatttttatatgttcgggttgatggtaagttaaaaatgctttcatctttttttgcgccccccaccccccaatcccccaaaaccatttctttttgaatttgatgtgggttataaatgaaatgacattatgtctgttagtccgttttggcccggcacgggctccttgggggcagaggttttatttaagtcttttgtttctaaactgctgtaagtggaatgtgttggtagtcacctattgttgttattgttgtaatttacttcactaattaaggagttggataataaatgattgggctcccagttttgttagaaaaagaaatattacagtcaatctcctgcaagagcctaatactattgtgcctgctctctatttgatgtttgctcttgtgtctgaactttggctgagacattcaagtgaagaaatacagtaatagacactctaaggaaggttcagtgggttaggaatttgagactgagatcaatgtgtatcacctgtgtgccagtgaatgctctcctagcgttaaatcgaatgaagaatttagatcctagggagaaaactgtcaaaagtgagactgggcgaggctccacgaagggggaagcatcagctatgggctggccacaggagtagaacacttagctcagtccccagtgggcaaacacaatggggaccttaaacaggtgctggaggtgtctccctctaggttgagtcagtctgtcaagcccacagcattctgcctctgattctcttgtcttttgttccgatttggtttactgggatattttcacaggatgtcaatttcttgtgcgactattgcaaaatccttttttgtggttcttttgaatgaagagtggaaataatcattaacatgctttttggtttgtattcaaaagaaaaaagttaaaagaatatttgctgttaaccttctagaggctttaatttttatatcgatggaaacaactggtataagggagtactagatattttttttttctaactggattgcagtactttaggtttttagttactttctgtacttgtaaagaacctaaagggtattagtctaactgtttgagccatcacaatagcttgttgccacataaactttcctccagcatttgcattgtggatgaattcattatttgggacactgcctattttggcccatctgagtagctaactttgttcctggcagctactgctgcatagagcccaatgtattggactcaaaaaggaaggctttctataaacatgaggcaatacagaggagtttacctactgtcaagtggctgttttcaatcatggactacatgagtacctttgccccccagcgatagtgagggagggatgcgtgtgtgtgcactgcttctctcttttaccagtctaagcagtagatgtttaagatttaattattgtgaattatactatggcaacatctctaattatttttcatgcatttatttttcagtacattaaaatacgtgtacattaccgtaacaaaataggtttacctatttgtcccaggtgtgtttgattttcatgataagaagaatttggtataacttttaaaagaatatgtcctcataaatcatgaatttacatatctcaacagaaatgcatgtgtaaactatacattagactacaaaattatcaccaagggtttttttatataagcgtttttaaatcagtgtgttgctaggaggaatacaattaaattgctcagtggaagtgacaggaaatcagaagagcttggtgttacagaatgtaattaatataccagggtgtttggagatatatgaaacaaatgcaattaaccagcttgctggagcagcagtagtaagacaccatttctgtctgccttccctccctccctcctttcattcctccctcccttctttctctccgttttattcctctctcccttctttccttccttctctcccacaccacccttctcctgcccccaaagacaacctagaacctttgttctgatttaacattgtaggataagggggcagtttgtgtctgggccacaattatgcagcagaactcatagtaatgtagtgaaaaatgccaaaattgaggagttgacactgaaaaggcaatattaaatttttgtgtgtgtgaaactagttttgtatttagcatctgctgtgtcaaaagcaaaggaaaccctggacactcttactaaattaatatgtaaatcatacgtttgacattggattgcctttggatacttcagaatgacagtttctccacggggatggttgaaaatttgggatgtggagaacactgccctctaggctgtttcagcactttgagactcagtgttcacatatatagtgaagaggttggtttgtaggttctctaagctttgttactcttccaggattctatgatttctatttacttattcttcttagaggtgtgtgcttatactccacatgaatttcaaatgtacagaagcctgtaccatttcaaagatatactgaccatccttgtgctagacacagatattaattttattcagtgacaaatgatacatatatttgcattgatatttgcttggtgggttatttatatgtgcatttttatagtatatgaaaaatggtagcgttttgccacctcatagaagctatctgctaatattatttataatttttcagtattgtgtccctgtagcaatccatagagagcaaatattaagttagttgagaaatgtagataaacttttctatttgggatgtaaataatggttttcttattgatgcagattaatcacatctagacttttctgtatgatcatataggagaatgtatgttaaggttagcctttgttttccagcttttctttatttttgaataagaatagggttttgcagtcatttatgggaaattaatatgaactatggcaacacttttaaattacatctatatgccatatattacatcaatctgataattttataatacttgtgaaaaggtgttttaaaatgagaatgtttttctcatctttaccctttaactattcttaaatgaaagtggcacacatgatattaggggagataaatatagtaaagataatgtatgtgcatagtgcagatgtagaatctcatagaggtttatacatgttgctaaagtgctctttttcagtaatgggcttattatcatagccatatgtagtctatttcagaatttaaattatatataagtaacctgaaatgtgtttttgaagctatgcagtaataccatgtttgaattggctttgtttgaataacctttgatgctacgcaacatgtggaccataaaaaaaaaggatttcttagaacattaagcaaaaatattgtaaaaaaaaaaagtaatgattatataaaaagagcagttctggccatctcatccctgagcagcttgtataaaatagcatgtttgacgataaaaatatagatatgtaagcacattgtataagttgggatacatacatagcaatgaagggagctgatgtatgtgggatgtgtgtgtgcctagtaatatctgctgaaatagttccggcagtctacaggaggtacatttacttcccatgtgcaatttggttttcgaagagtattagaaaaaaagattatcatcttatttactatttctcctttttctcctttttttcctccttctcctctccttctctttcttcttctcattcatcgtctctttccttttcttattctcctcctctttttttcttttttggatctaatgaaaggaattagagaaacacttgaagagtgaagaagataggtgagggtgtttcttgaatgataatttagaaaatctgcatttaaaggaaaaatgtgaataatattttacctttaggtatatccaactgggattttgactttctcacttttaccccacaatactatatatagctttatgcaaaatgttttgcacggatcctatcattttccagtttacacaagtaaaagtcgtcatatctgagttcaagcaaacagtggagatttatagagtgccattttacagatttatttctaaagaaaagtattgctgtatttcttaaaggttctccaggtatagatctatcaacctaaatcaatacattggcatagatattgcttttctccttcttctcttctttttttttccatgtgtgcctttattagctgagccactacttgagggtttaaggtctttgtgaggggcttggaacacccaatgttgggggagggaggcgggcggtagggaaagtatctgaaaggacttcctgagccagctgtaggcttttcttcttcttgtaaaagaattactatataaagaatgaaggaatgattataaactctttttaaaaataaatacctatcaactctactgttttagtagtgtgttatacaatgatagaagcatatagcatctagggtagcatgcttacccagaatacttgactcaacacagtgttggagtaacggaggcctcaatccttagtgttttctcctccatttgcagccaatccttaggctctttcatctaatcacatgaggtttaaatacatgtttggattgataattctaaaattgccctaatcattgcatggagggatataagatccatcagcacagaacttggctgttgtatatactgttgatctccagtgcttgcatcagtgcttgacatactcacctgactacttgacgtctttgcttcatgtccaatgagaatgtacaaaactcaagcctaagacagaatcttctctttctagccattcccatcacagtaaatggcttccaccattcataggctttttcatgacccccaatgaggaaccatttttcacttgttctcacaacttgtattcaacttgttctcagaattgtgcaaccatcactacaatctaactttaaaatgttcttaattacccaagaaagaaactatgtagcttgttccaccatccctccaccaaccacaagaaatcaccactctacttctgcctctgtggatttgtcttttctggacattttatatataaatgcaatcatacaatatatgatgtcattttgtgactagcttcttttctttagcgtaatgtttttaagggtcatccgtgtcatagcatatgcatcagtacatcattcttttttattgccaaacaatattccttatcatctatcctttggtttactagttgatgaacatttaagttatttccatttttggctattatagatattgctgctttgaacatccacgtactaacttttgtgtgaacatatgtcttcatttaacctgggatggaaatgctgggttgtatgtttagtctgtgtttcacattttgaggaactgcaagactattttccaaagcagctgtgctactttacattgccattagcaatatatgaagtagatattttcttttaattgatcatggaaagaaagagtcgaagggccttatgagttgggtatgatgttttgaagtgaaacaattttatattatactaatctgtctcaaatccccaatagtcctgatttctaatcccttcagtggttgttgtcttctaagtcttcctcagttgcctcgtaaaactttacaaagatagtacctcagttgaacttgtcacttttagcagagatctcagcaatagtaaatataaatcatagaatgatagcatctcggagccattatgaatatttgcagctatattgcacaactctcttattggttgggcacatggagaactgaagcttagagattttatgtgccttgtcacagatcccattgctacttagtggtagagcagaaactagactccagggatgcttcatctctgtaccaggcttctgcctatgagagactgtttctggattcttagccctggaactccttaacaagaattccaggctcttgttactgaaaatgaccagctattttctgaagagtccatgagaaaatgagcttgaatatgtttaggttattcctttgattcaacacatgcatattgacaacataacttgcttggctctgtgaagaacatgctgacctgtgaaaatattcccacattcaaggaagtcatgacttggtagggaaggtaccaaatgttcaagtcactagaataaaaaaagtagtgtctgataagtaagaagtttgaaggtgtacacagtatagtcttgagaactcagagaaggaataggtgatttccagctggtacaatctgggaagggtcaacaccaaatgggtctcttaacctggaccttagaggaagagtgggattttggtgggcaaaaagattggaaattgaattccaggaaaagaagtaaccagaaaaatggcatgaagatgacaaaggggtgctaaggaaatggcaagaagtctagattgattgcaacatagtttgcctgtaaggaagaaggataagatggttattgaaagactactgagcaatcactactgaatgagtatgaacaagtaatttaacctttttatgcctcagtgtccttacctgtaaaatgggcatggtaataatgtatatctcatacagttataatgagaaataaaatagttttaaaaatataacgatatataggcagggcatggtggctcacgcctgtaatcccagcactttgggagggtgaggtgtgtggatcacctgaggtcaggagttcaagaccagcctggccaacatggtgaaaccccctctctatttaaaaaaaatacaaaaattggctgagcatggtggcaggtgcctgtaatcccagctactcaggaggctgaggcaggagaatcatttgaacccaggaggtggaggttgcagtgccaaaattgtgccattatactccagcctaggcaacgggcaaaactccgtctcaaaaaaatatatataatgatatatataaataaataaatatatatataaaataaagatgtatataaagatatatatgggctgggcgcggtggctcacgcctgtaatcccagcactttgggaggctgaggcaggtggatcacgaggtcaggaggtcgagactatcctggctaatacggcgaaaccctgtctctactaaaaatacaaaaaaataattagccgggtgtggtggcgggcgcctgtagtcccagctacttgggaggctgaggcaggagaatggcttgaacctgggaggtggaactggcagtgagccgagatcgcgccactgcactccagcctcggcgacagagtgagactccgtctcaaaaaaaaagatatatatgatgccatgaacagtgtactttataaatgccactcaagcataacttattgttataattagtagtatttttattagattattattccctgcctagtatgaacaaggaaaataactagaagaggactttgctatcagactaattatggactacaattggggtgcatgttaggacaattttaataagatttttcagctgtgagtcttcaggtgactgattaagaatttttgttgcctcttaagggaacttatcggtggcctcgcctacacagctgtgacagttgtgctatgacatgtgtgtttccattgcatcataagctgattacaaaacacatgtgattcccaagtgaaaggtgcgacgaatgaagatagtaaacaagagaggaatcacacaaatggcaatttgttagcaagtagaccatgcttgtgtaagcctgcattttggttcatgttggctgatttacatttcatcctggataatttttacctggtgctttgatataacgtactgtggagataaatcttgtgtaagacaaactaaataaacactttgagaaccgaagacctaagtaaaaattaacatttggtatccactcactaattcgttttctagatagcccccttagcttcccttcatttagtataagacattgaatctaataactttttataattatccattagttacatttgcacaatgagtagttatgcatatcagaaaggatagcctgaataaaacaatatcattactattgtggaagtgacatacctttggtgaccagatctctggactgcactgttagcttccctagtggattgttaattgttctaattgccttagaaccttaccaaaaatggtttcatttgactgtgtaatttccaaggtctccatgaaccttaggttttattatcccaagtacttctgtttaatgttccaacatttattgttatatctgagaatttttaaagaagaaaatttagcctgggctcggcgcagtggctcacccctgcaatcctaacaatttgggaggctgaagctgaaggatcgcttgagcctaggtgtttgagaccagcctgggcaacatagtgaaaccctgtctctacaaaaaagaaaaaaagttagctgggcatggtggtgtccacttgtggtctcagatacttgggaggctgagatgagaggattccttgagcccaggaggttgaggctgcagcgagccatgattacaccactgcacttttgcctgggtgacagaggccccgtctccacacacacactcacacaaatttaggcttgaaaagaattatccaaaaccataaacatccatctttaaaaacaataacagtctattgtctaatatgcatgtagcatatctgtgttttggtgtgggttcaatgatatggctatggatatgcatgacagccaaaattaactagtcttatgattcacatccactctcattcattaatgaccagtggtacttaggctttccttatcaataaatggaattttaaaaatttaatactaaggagacaatagtcttaggtcaatgtgcttagtttctggccactataactagaaccatatgcaacatggaaattttagctcaggagagggggttaacagccactttttaatttctgttgtaaggattgatgtgggatctctttccctagactttggttccaagctttttggaaatgagctggagaacatggaatataactcaactatcccactgaaaggcttttcaagtttaagcaaggaacacccagttgaaaccagactggaatttaagggatttggaccaaacctctgcagcacttataaccaattaaaatgttcataagtgtgattcaaaaagggagaattttgactttccaaaaaacttgagttaagagttattcattataaaggaaagtttataagtttttataaatcaaggttagagtcgtacttagaagttttataatacgtatatttccaaatactagcaaatgctagaatatgattaaacttatttagatatatccgattattataaaatatagatttcagggttagagtaaattaggggaaatttagaatgaatctagcaacaggcactcttgtattttatatctctattataaagtaaattttaatacgttgccagataacagtacagttattgaaaaccaagcttattattgttccattaaatcagagacagcatttcaccttcctcatcttaagcatttcaccttcctcatcttaagtatataaccgtttgtgtattctaagtacctttgaatgccagcaacaacaagctattactcaaacgccaattgttttagtgcttcttaccccatctctatcatgggttagcgtagaaactgagtaggagaaatgtaaccttttaaaaagaaaatgccatttctgtttctttactactctaataaacttactttcatttaaaaaaagaaaagaaaatgctaggtacaacattctcagtctttgcttttgtgtgttttttttttttgttgttttttggttttttttccccatgcaaaattgactaagaagagttacaacatttaatgtggtggtctcaaaacatttttttttttttgcattgtaattgttttcgcataatttcaagagttaaacaataataatgaaaagatgtttcaggccacacagcgtggctcatgcctgtaatctcagtactttgggagactgggaggatctcttgagcccatgagtttgagatcagcctgggcaacatggtgaaaccctatctttgcaaaaaaaaagaaaaaaaaaaaaattagctgggcatggtggtgctcacctgtagtcccagctacttgggaggctgaggtagaaggattgcttgtgtctgcgaggtcaaggctgcagtgagctgtgagtacaccactgcattccagccagggtgacagagggagaccctgtctcaaaaaaaaaaaaaaaaattcatcaaatgggcatatgagccctgaactcacaaatcaagttgtcattcagttgaggtttaaggcctccttttctgcccaaaaccagatttaactgggttattcctcactggctatcatgaaacatgtaaatacatttcatagctaagtatgtttttaagtgtttcagtcccacctttctgatttgaaagcctgaataatgtcaacttttaatactaaagtgaaagaaaaaagaatcagaaaatatgtacaacatgtgggtacagattttgggcaaatatagctcttacccccttgcctcccacctccctgtacacatggcaataagactattatgaataaactgaggtgtttgatgcctgccctctactcacaatccaacagacaacttgtattttaagaaccctttccaggctgggaattcttattacactttcctgttaaactgtagcacctgtgatgttcatcacttggatcttatgaaactctccagatttttgaggctctcagtaaatgtgtctcatcatggtaaatttaaattccaagtgtattcaacatttcttttcagaaagcagtttttaagttttgaagcagcggctacacatgacatgcaaataaaatgaccaggcaattgcttgtattgtctgtctgtatcaggattcaattctaagctttccaaacatggatctctataggaggttatgcctaatctttgcatttgaaatggtcaaggaggtgcaaggatatacctgggaggggcaatctccctgaactataaggggaggggacgaaagagtgtgttggaaaagtgaaaaactgaacatttgaatgaagtcggttggattagcatttgacactcaactatacagcaagcggacacgctgatatttagttctatggattgttaacattcacataaaacagaattatttagcatttactgaaccctttttgataatcaatttgggatcaaatgcaaaagaacatgtgtctgctttgtatgaccccagattcttccgttttctctttgagcagatgacatgccttctttactgactgatgttggttgctaggagaagtgcactggtttagtcccttcttatccagcagtaaaactaaagagtgtatttagtaagagaaagaggcagaacacagtacaggccatgaatcatgacttgtctccaatatgtccactttgctcccattttctttccctttaaaaacttttgtttttaccaatgatgctttctttcagccattatctataatccttttggagcctgaggggatgagggttgctaaagagaggctgtgctgctgagagtccactcagagcaataataaaagccttgagagttattcatggggccacattagtgagaatgccctactcagtgaatagcatcagtcagctgcctttgagatcgagtgattaataccttctgttttgaaggggggaaaaggcagacaagaaaggtcttcatactactttggctattttgcaaattagatcttacatattgtcaaaccttttgacaaagaaattgctaaaatgtcaatacctgcaatagtcttttttaaaagctagtttttcatgaaactgttaattgtggctactgtcaaatacaattgaaacggtaataatatcccaaatgaacactgaaaaaaatcagttagccattcttagattttggcagtgtttatgatgacatcaaactaagaacgtgatgttagtgatcatattcagaatgttatctaggcagatctatttgacaacagccaaatagcatttttgtttgtttgataaaagaactaattgcaatactcttgagagtttacagaagcagctaatgagaaagtgttaagggtggcaggtgttagtttcccataagcactgggatataagggacagtctgtgaattacaaagaagttgttatttatatatgtatgcctgtatgtttgtatctataggctggttcagcatatgggattaaaaagtggtattattataatcctcatgacctctccttttatcttttgattatattatgtacatggcactgttcaaataaaattgctcaaggtttattaaacttgtcaaccatctgagttgcatagttagaaaagcttctggttttggtggcctgagtgtggcagctagaaaatccaagggaatgctttgccatactgtttttcagcatgattccaacattaagcaggctgttaatatttagacagtaaattaagccatgtctttgtttttaaaaagtcattctcattctattcttcattttacattttaaacttattttttatatagcagcttagtctggcccttctgtatatactcatgctcattccaaaggctttactttcatctgaatatgagaacaaacaacatgttaaagactctgtgtgatgcttcctgtcatctgttttcactctgtggaagtgaaatatcttgttaagagggggtaatacccaaaggcaatcagagataaaaatgtaacgatttggtgggtgatgtctcaagatcagctttaagtgaggtctgatttaacatctttattagtcatttaaaagggaaatgataaagaaattgtaaatctcaacattggaataccatcagaacctcccctccctgtccctgaaatcacatataatgatatacaaaaatttaggcagcagaaaatattagtggagtaaaaactaatgctttatttggtatataaatgtaaactaattcttcagggaaataatcagaaatctagaaatctaactagagggagaagccagcaaagcaataacactgaaagggccctggggataagtacaggagttggcgcaaggagagaatgtgatttagattaggagtgttatatcccagtttaaaggtcatgcgattatagtgcccatttagggagtattgcatcactgactagggagattctctttcaatgaatgtggcttaagtgcagttgaaatacttctttcattttgtacttcattgccagaacatgagagagattttggcagaatagaaacaaggttagtacaaagagagattctttaggaagatgcttgtctacttaacactagagaaggattttccattggaaagttcaagtagttcctttttagagtgaatatagcatcttcaaaaccaagaccaaattcataaagccttccaagagaaatttctaccatctgtcagtatacagcaaagcccatgtttgtgttttagttcattttatatgtactgtattacacatattagggcttaattaaggttgggtgaattaaattgatctattaaatttaatagacaacttgtatgcagaaacctatacaacgtatgccatctgaccccagataaattcaagagtaatattttctgtggaagtcaagggtcttccttccagtagaagaaagtattggatggagtagggaagcatagacaatgactcttcagatgaagtgtgtcgcatttaccacattcctggttaataaggatgctaggtctgatgataaagactagagaaggttgtacaagtgagattctctgcttgctgcacaattatatgttgttccttttccctagtcctcagatagaaatcgccattttttttctcctgatgtaagagagtgatagaaatagaatggagccagcatctcagtaaaacagaagtaaaaacaagttaagatgggcagtgagaggtaatggaggccaattcctagggcttctgattggttttattttgtcaattttacattcccatcaatgctgtggggctacttcatagccaacatttgaaagcagatgggcatcctgccgtaatgtcactgcagccagtgacagagaggcgcctgcagtccacaaaatctcgcgtgtatgtgtgtgtgtgtgtgtgtgtgtgtgtaaaacttggttaatgtgtcattcatcagtaatgagattagagccctcataataaagtccctacatgttaattgtggaattatggtgcaacaataagtagagaaacactcattctttaaaaaaaaaaactaccagatacaaaatctattcatttggaactcacccttctgtgatttttattcactacttttacagttaattttttaaagattttcttttattcagcttccactgcgtcttcccactaacatcaaacccttctgcatccagtattcatcattttgtaacaaagagcatataaatattataagggatggtcttgatattaggggtgtctatataaaatccattctactggtctagtgattgggccagtaaattgcatactgtattgataaaagggctttcattctcataatagtctgtgaactcactggggactccttttctggggagtcatgtataaatgatgagaactatacaaaatctcttgaggagtttatcatagaaatagaggtgctggaaaagaaaatatggtagactcatactcctttttgccttgattttctaacacgtcatcctgtcacaggatttctgcataccttgattccatgtgagggttataaagagttagagaaaaatatacatttggaagactcatttacgcataatatatccacatataaacttccatgaattggattggattataacttgtgtgaaataaatgtaacaaaaccacatttttgaccctgaggaactaatcaaagccagaggctaactttattacacccattcctgattggtttatttctgtaaatttatataactacgagatgatttcttactttttcgcttctaattttaagttttaaaagtaaaattaaccaaaagaatgtttataaggtgaactttggccaaatgatgattgtcataaaacgtaactttttaagtagttgtgaaatgcaataaattgaaaagataaatagagaagttgaactgtccttacaaatgactgcacaataccagcaatgtcttttgagagaggatttaggacatagtgtgtaggtatttatctcacacaaagagaaaaatttccttccgtgggaaaacattagatcataggaaggcctgaaatatctgagttgcagctttgtgaaaccacactcagtctaaacaagttacaacaagataaagtcctcagaatacgaggaagggatgatgactacaaagatccaccactgtgtttcccagcttttttctctaatgtagctaagactttctttgatgaagtcatcctttcttgatccatttgtgtaaaaacttgtcccccaaccaccgtttgttaagggaggcagtatttagcaaacttggtagagtttataaagacctaattttgttggatgagattcactaggattagacaacaaattaaagacaaaatgacatatattagtaactgaaagatcttgcttattattaatatcttaattcatgcagtgttttttttacttataagaagacaccgtactgtataacattccatttgagattgttatgttggcaacctcttatttctttgaaattgtgtgggcaattcaaaaaaattaaagacaggataatatagagaactgagcatttaggaaaaaaattgtatatttgatgtaaatttcatagttttaaatccacagataactcaaaactcagacacaagacatacaatattttggcaatttgtgttaaggctgtaactttttttcaaatgtattattgcttaatatttctaacatgaaacctaaggtgcttgaattgaggccatgtcgtaatccagggaagatgttttataaatcaaggaattgacatgtaatatacacatatacacagatgaatatatacatgtcacacatatacaaacatatgtctatgcacacgtacatacatataattttgtaaaaaaaaagaccaagttcataggaatgccatttgacccagagatcccattactggttatatacccaaaggattatcaatcatgctgctataaagacacatgcacacgtatgtttattgcggcattattcacaatagcaaagacttggaaccaacccaaatgtccatcagggatagactggattaagaaaatgtggcaatatacaccatggaatactatgcagccataaaaaaggatgagttcatgtcctttgtagggaaatggatgaagctggaaaccattattctgagcaagctattgcaaggacagaaaaccaaacaccgcatgttctcactcataggtgggaactgaacaatgagaacacttggacacagggtggggaacatcacacactggggcctgtcatggggtgaggggagcggggagagatagcattaggagatatacctaatgtaaatgacgagttaatgggtgcagcacaccaacatggcacatgtacacatatgtaacaaacctgcatgttgtgcacatgtaccctagaacgtaaggtatatatattaaaaaaagaccaagttcaaaggctttggcacatctgtcttttagtcattgcatttttgtgagttaattactaatgtggaagctataccttttagattccagaggattttttttttttttttttttgagatgtagtctcgctctgttgccaggctggagtgcagtggcatgatctcggctcactgcaacctctgcctccttggttcaagtgattctcatgcttcagcctcccgagtagctgggattacaggcacgtgccaccacactcagctaatttttgtatttttagtagagacggggttttaccatgttgaccaggatggtctcgatctcctgacctcgtgatccacccacttcgacctcccaaagtgttgggattacaggcgtgagccaccgcgtcctggcaatatattttaaaaaatatgtggctgacgggttgataggtgcatcaaaccaccatgacacatgtatacctatgtaacaaagctgcacgttctgcacatgtatccagaacttaaagtaaaattaaaaaaaaagaaaaacatgtggctggattttgattgaacgttaatgttatttggggtgtatgtgttgtttttttcattaaaaaggagaatactcggatgttttcctaattgttattaagaaaattcttagattattgggacaacaaagttcttcaaagtctttcactaagcttccaagtatcacctgaataaaataggtgaatagaaaactgagcttagatattttttgcttgatagccatctagttttattcagttgccttgagacaaaaaatggaaattgaaaagtataatacactaatgtttagttacctggaaagttccagctaaatataagtaatattcacaatagcctgctattgtaattttaaataaaatattattgtgtgccatctggaataacttgtacacctcttctgtaactttccagctcttgtgagggttaataaagatctcaagtgatattttcagaatgcttcaaaaagtaattgaaaaaatgaacctatgaaatatatcactaacatatagttgcttttatttttatttatttatttgtttttgagatagggtctcacgcctctcacctaggctggagtatagtggtgcaatcttggctcactgcggccttgacttcctgggctcaggtggtcctctcacttcagcttgagtagctgggattataggcctgcaccaccacacttgggtaatttttttttttttgtattttttgtagagatggggtttcatcatgttgcccaggctggtctccaactcctgggctcaagcgatccacccacgtcgacctcccaaagtactgggattacagaggcaagccgccacacctggccttagttgctttttaattgcatgttgttttactatttccaagtttttgaccgttattgttaattagttagcacacaatcacatgtatatattaattcattagaatgtatttactgagcatctgcaatgtgctgaatacttgtaacagtgtggtgagtttttactttggtgagaaagacaaataatcgtgctgaatatgtttatacctgtgattgaatttttaagtattatgaaagaaaaatatagggtgtcataagcagattataaaatctatgaaatttagatttttgtgcctggagaactccctggggaagtaacaattatgttgaggactggagatagctatgtgaagagtgagatctgagaaaagaattctaggtagaaggaaggtcccgaagtggacagggattggagtccctttgaaagcctggaagaaagtcaagtggctggtaaagctgcaagcagtgaaaggtggaagaaggctgggctggatgacacagattatgtaggtaatgataaaagaaaaaggtaagtacatttaaatttcaagcagtgtatttgaacatttaaggattcatgatttggagtagcactagcctataaggcgtaaaatttcattgagaagggcaagaggggaatcttttataaagtgttcacataagcaagacaaagaaaacaattttggttacagtggaaagaccctatttaaaggttagttggtggtttctgattgttagtttctagtttcaatttactattgatgttgggctttgatttattgatgtgggaatttaaattgccagagacaccccagtttaatagtttcccaattacaattttttttaattgtctccttttgatcagcctctcatttatgagagattgaccaaagtttgggcataagcatcactctctgtcactgtcttggctgggttgtctttatctcagtgtaaaactcatacgtcatgacatcaggctcattgaagaaaggttcttatttttgctcatctcatttttgttgctttaatcacagtgagaccatctggcatacccttgatggctgcacacatacatttgagacccttcagagtatatactacaccaggggggttacagtggtgactatcaggagaatactaccaagagactgaagtatgctcctcagccaaggtcatcacaaatcaaaccaactagtatttctatggaaataaaagaaaaataaagaccaatgactagagcaaactataaattcagtctctgagtccagagggtaattagtcaagacttctagatttgagttcaaataatgttttcctggtttgcagtttgagtgtctttggttatagcattgggtgtgttggtgaactcctggagtcatgcacagatcaggaatgagggttgtcctctgaaattatgccaggctacccattccagctcatggcatttcaggaacagaggagttcttgttcttagtaatcccaagttggaaaaatgggagaaaattgaattggagaaacctagaagaattccgcatctagtccattctacaggtggaaaataaaactcgagaacaatgaacagagctacctttatttcattgatatttacctaattcacttgttcttaacacttgtatttggattgctcatgaaaaatttcataagacactaaacacagctagccattgaaggagttcaataaatgtcacctcaagctattccactttggtatattgatcactttgagctaaagggacttgaaaaatagcaaatgcagagagaggctttccctagaccacctcctatttgccaaatccagatccaccacagcagctcaagtgtcatcagtcactaccctaccccatcatcttatttcatttgtgtttacaggtcaggcaaatatcaaagttatcacagaagcaaagaaactgaaaagctaaacattattcttccctctctgtctttttctaaattctgtaactaacaggcaccaagcaatttatgtttactacatattttactctttggttggagttattgacttaaacatctagcagagataatacaaacccatctgaccagcaacccaggaaaacctaacattttttttttttttaaagagacagggtcttgccccgtcaccaaggctggaagacagtggtgcaatcatagctcaatgctgcctcgaactcctgggttcaagggattcttctgcctcagactcctgagtagctgggacgacaggtgcaggacatttccagctcattcttttttaattttataaatttgtttagtaatatcatcccaaaatatcacatacacataacatacatatgttcatacaaagacatgcatgtacatacagacggaagcagataagttgttgatttaaaagtcatttattaggagaagtctgaaggtcagtctaaattgttggttgccctggagttgctataattgcaaggccattaatttggaagccctttgtttcttaccttgttctaagattctttacacatgttcagctaacctagctaaacctatggcttatttccttaccttttttaaaatttttaactttttttcctatgtctccaaataatacctggggagaatctttttacaaaaagggcagcaagggtaggctgggtttcctggaatgccataagaaaaacaaaagctctgagtggtttttgaaatcagtaacggattcatcttccttctgtctgtaggtctggttgattgtccagtcagtgtgagtggggaaacaattcaggaatggctttcagaagattgtttttagtttttttgagctttttctggcacatatgtgaaccaaatggggacttatcaccatggatcgtgtcctcacaatgataccattctgcctcttgcatccatttttgagcttcccttggtcctgtcaacatgtctttaacaggattactgagttccgggtggaaccaattaacatatagggacaaagcattttctatgcaggacaggaataccgtttattattcatctgagctcaagactttgagcaaggaataacagtggttataaagcagacctggttgatctgacatccttttgtcaacactgatctggttctttcttttttttccctttgaggtgagcaggtaaaccagtgaaaacattagtagattcaaagtaggcaaaggataatagagagaaaccgagagtttagaggtctctacatgtcagtcaaaactgcatcctatggttttgaggtgtttgggatcccttttgatgtatgtgccctatagatgagcagttttacttaggttaaaactttcccattgtggccaccaaaattctacattatatttgttaagattcacccatttctctagaaaagcacaggttccaagatggagtcttagactctctggatttaaataaactcattatttctgtcttctgggaacctttcctaccagaggtgtttaaacccaattcagtttctgtctaacccagtcaggcacctaaaggctcctgacagaatgcagtgcagtttctattaagacttccaaacctagttcagatttttaaaaaatactcaaataaactcagagaacaggacccaagttgtggaactcgtgtatccaagaggacttagtggtgatgacctccaaatgtataggaagaaggagtgagcagaaggggcacagctgggtacttattcctgtttacttaatttctcccagaggtcatgattgtgtggtagcctttaggtcacacttctgacaccagagcttatgaaaaaacaacttaagcatatttaacttttaaaaagtttatctgggcatccagtggcccataaattggagttccaccacactgcaaggtacttagcactccaccaggagggtcaagagggggaacttctataaagtgtttacagaagcaagacacacaaaaaaaatgccagttttgattgatttgagtggaaaattcctagtgagaggttagttggtggtttctgattggtgcagttttaagtgtcagtttgctatttacattgtgaattagtttgtatatgtatgagtttaaagtgccagagctaatctagtctaatggcctcccagttacattttttttaataataaagattctgaattttatcccaaggataataaaaatacattagaggaatattatactgctgtgggaatttacaggcagctaaggcctactggtgtctctgaatactgtagagcatcatcaatttttagctcagaagtaaactggtggactattaaagcatatagggtgggaactgaaaacatcatgagggtgggagcaggatctagaagtggacagcttgggttgagttcagagtaaggtttcgccaagggctatgcccatctgccacccctaaccagttacatgaaatggctgggagaggagtgtacgtgtctgttttctaaaagctctctcatgcaattcttgatgtgcttagatttgataatgtgaagatggtaaggaataaaataggaggaggttgcagaggaactggaaatcagtaagacaggagcaaagtgtgtgaaaagggggtgtgtttagggagataattaggagtttcaccagaaaaataaaaccatttcaagtgtgtgctgcaagacagggaagctgatggaagtttgacagatctcctgacctcttcaattcccataatcatgtaactctttcttcctttctcctggattataacttacttgaattgtagtaatttacatatgtgctttatgactcacacttacgttaggctacttcgtgtgaagagctctttgctcttaacttgatattgtttgtagtctgtagcaaagcaacgtatacataaggaagtgtttaataaatattcgttgaattcaatcgagatggcccatttaattcagctcttctttctctctgcctattctagactcagccaaaactactggtttccattggttttgctgacttcatcaatagagggtgcaaattaaaaattactctacttatcatctcctgaacatatacaatttatgtgttcaaagtttgattgggcaattgcctatctatccttgtaagtttaaaagctatttctcatttaagaacattcataataaacactttgcattgtacttgttagtgcacatacctagatgaagggtaaatctattttcttcatgttatctttaaagcctgcagaaaaattatatgcttatgttggtattgttaagctataatgtcataaaaggtaaatgcttgtgttcattgttttcacttattatgctttttgttataaacgtttgattttatttttaaaattaccttaaaaatgtattaaattgtattgtttattcctttcaaagaaagaaaagtaaggtgtaaacattagtttataaaagtttgtaagacaaaattcaagcaaaggaaaaaatgagtagtgaaatatatttttatacaaattgcaattttatattacaaatatttaaataaaattaatacttggatgtatcttttttttttttttttgagacagagtctcactgtgttacccaggctggagtacagtggcacaatctcagctcactgaaacatccgcctcccaggttcaagcgattctccagcctcagcctcccaagtagctgggattacaggcatgcaccaccatgcccagctaacttttgtatttttagcagagacaggtttttgccatattggcccggctggtcttgaactcctgacctcaaatgatctacactccttggcctcccaaagtgctggcattaaggtgtgagccaacacacccagcctataaaaacatatttcatttcagaataaaaagtgtagtagttttgaagagctaaaaaatttgggacagatagatccttgaagcagaaaccaatctatttcataatgatttgtgcttccttactcaaatattttgattttcttctgagggaaaagggagaatgaattattttctatgacaagatatttgtaataattatactctggtattcacaggtatcattttttcataaggttgatggccaccaaggaatatggaggtcttgatagctttaattctcagctgaaagcaaaaatgggtttttggaaactgatcagaattgcatgacttcccagatttggaaaggagaggtgctcacaacatatttttattcaatgattctaatgtaaagtggatctggcctaatcaagggcactaagtaaatcaactagaaaaaatacatcagagggaactgcatataaaataataataatcacaataatgtttagtaatactatcacagtcttttcccaaggagcttcaagcacttggcaattgtctcattaattctcagaagctccctgggaaagagtagagcaataaatcacatattaaagagacgttttaaataacagagtcagtcagattcttaataaacagaagttggtcaacaaaagttggaatccagttttatggaaataaattttgtctttttcttaacaagtaatgaatgaccaccaaaaactttcttcaaaattaattgtgaaaaatatcctattgtttctctttgtattttttgtatctaaacccaattacctgtcattcttgtgacctattttcaaaattccattaaagtcagcaagtaacaaggtttcttgcaatctttagtcagatgtcatttgagtattggtgatcaagattgagagtaccttaaatgagaagtttcaatcaatggccatcatccatgctattgattaaatactttgttaccttagtaatggcccaaatttaaacatttcttaaaattggttaattttaaggagcaactaaaatagtaaaataatgttattgtttgcattagtaattagaaaattattgaaatatgaagtcaaatatatgtttctctttgaaaatagtgcctcatgctattatgggatatacaaatgaccttaccactctgaggtcagagttcaaattaagcctcagtcctaagtaaattgagatgaatggtttggtctttgtccctagtgtaaaatagtccatatcgcaaaatcaagatacatctgtttttgcaaaattggcgtaattggcattctcccaggactttgctggcatcgaagccgaagctatttcttactacaaaggaaaatgcttttctaggtcatgggtttttaaaaaaatgtgtataaaaatggctcagaccatgtctgttcacttgtgacaagggtgaattatgtctcatcataatcaatttggtgatcgataacagcacagaaacaatctagtatgtttattaagttgggtgtgattatgggaaatcgcaagataaacagatggaataattttgaagaggccacttccttgtcttagtagtagttttataagtactttcattcaattatattgagaaaaatcaagattgcctttacattctagttaactaaattattcatttatgtcaaaacctttaacatttaaatgcataattatattagatgtcaaaagacattggtaataataactctgacaacattaactgcagttggaaaaaaattggcttcaaagtcaactctttgttctatagtttcctgtattaattatagtctaatcatataatttctttaaaaatgtgttatcaattagaaaaattttgttagacagcaatctctatgtgaaaaaagtatttgtatttggtatttcccagaaatcatataacaatgtgagtacaatcaaaggactaacagtagggaaataagttaatgtatagaggtatatatgttaatgttaaataggacagtactttaattatataatctgtatttcttagggggagtgattgcttttatttttggttttaaacactttttgatagtacaagtaggcaatctaaagaatttgtagggaatgattgtttagtgttatgtattgggagattagattaagacatagtacagttacttaattatccttctattttctccaaagaaaagaaacagacaaatctttggtatccttgcactacttttaaaaatcaacacccatttttagtttgcaaatgtttgactcttcatttgcttttagtttaaatattttaagaaaagattcttttcccctcccccctccacccctgcaacacacacatacactcacacactctcacacacacacactcacacacacacacacacacacacacacacactgcaaaacaaaaacacaaaacagcttgcctttgttgctaggccatagcactttttccaaagatttcaaaaactgtctgtacttgatttttcgtgactgcataagttgtagtattggatttatcaaagcttccctttgcaaaacatcctaactgaagccagagtccctccaaacatgtaataatttatagtgagtagaattttaaggtaatttatagtgagtgagcactagtcttccatcagtttaaaactcaacactcagttttgcttattcccaaactttgtatttactttttactacttgcccctgatatttttattaacgtctttatttaacaaaagttaagtcagcagacaactgtgagtacagaaaaggaagcattttatccctgtataccgaattagaaagaactgatatatgtgtcatatatgtgtctctaaaataagctgcgcttgaattggatatgcataacagactgaaaagataggggaaaatatcacaggatttttgtgagaatagcattaagcaaggtaacatgtgaaaatagctaacaccgtgcttgatatagactcagtgctgaattgagtgtttgttttttcttttcataaattctttgatgaaagtcacatgttttctactgatatattgtctttagcctcagtggaccttagaaacagtagacgcagaccttcagaaaatagatgagaaaaccatggctgatgttaaaataagaggcatcagaggaatgcgccctatatgtactgttttctttcaaagctaccaggttatcccaattttaaagagcatgctgaggatgtttcagaacttttttcttttttattttattgatgagtactttaaaatcataattattagttttttctagagtatacctgtttaagacataaacatcagttctaaatcacgtctaagtctttgctttatttgtgtttctctttgtgttattattactttatttattcttggtacatttttagttctcaaaatgcttagaagtgtatatttgtaaaattttccaaaaacacaccattagtcttctgtcattgttttcataaagttgtaactaaagggaagaggctgccctttatttttgagtgctacttttctctcaccactgagagtgcacaggcttttggtttaatatttacatcaagggggtaagccttaattgatataagaaaatatatttttgtgacaaaagaaagctttatgtcttatgtgtttgaaaggaaataaaactaagacaacttttgcctacaagtttccttctattgtgtcatgatttctcaagggaagtgatagaagccattttattttgactcttttaaaggagaatgaacgaatcaccaccctattaagaatataatctttgtttaaatgaacattgcatggaataaagcagaatctttttttccattgctggtttctaaagcctcttatctctgcctaactcttatctctcactaacttgcctgttagtcacgtaacaggcaagttcaaaattcaccccaaagtatgatataaatatatcttaaaatataattcaaactcattactgatttgtgagaaagaatgaatggcaacaaaagagcatgagggagggcagaattggaagtagaatacgtgaataaagtaatgtttttgtgaacattaaattcaacataattccacagtatagtgcccagcccacttccgcaggctagtatgtttctaggcttcattaaatagaacatattatctaaaataaaggtgggcacactgcagcctctggactgctgcttggttttgtgatccgcaaactataataaatttttttacatttttaagtcattagtataaatcaggagtagaatgctatttcgtgactcataaaatttttattcggttgaattttcttgttcactaataaagttttatttgagcatggccacgctcaattgtttaagcacagtctatggctaccttctttctaccaaggcagaattgagtagctgtggcagacgctgtgtggctcacagagcctaaatatttacagtcttgctcgttaagagagagtgtgctgatctctaatttaaactataagggcactacgtgtgcttaatgtgtgctctcaggcagtatgcaaaaatgctaaattttaagagagagagaccattggaattaagtgaaagagttcacttaggagaaggaagaggtctgaatgtgtttaagacaaataaaaatatgaaaaatagttgaaagaatgaggatgctttgttggcaaagaagtcgattgggatcatgatattcttcaaatcttcataatcatgtgggagaatgactggacttgtcatatttaacacaaaggaacgaaattggagttaaggtcataggtggacattttactgaaatatatattgattcaatgaagaaaataaagaatatactaataaaattatactttgatggaatatctttgttcttgtaagtcagtgacttctagtacttcagtcattcatgcatagactacttgaacattttgttgacacatctggtggtggttagattgaataactttcttattctttaattaattcagtaaacatgtattcagcagctcctttgtatgaaacactcttttaggcactgggattagagtggtgagcagcacggaccaggtgcctgctcttcttgcactgtcttgatagagtccttgagggggagagacaatatgcaagcaagaaatcaaggtgttggtagggccacactttctctgaaggctctagggaagagcgctgatatgtgttgaattgtgtccctccaaaaatgtttgttaaaatcataacccctggtgcctcagaatgtgatcttatttggaaataaggtctttacagagagagtaaaattttaaaagggtcattatcatgggcccaatttcaatacgactggtgtccttataaaaagggagaatttggatacggagacacaaagagaatccatatgaagatgatgagaggttggaataatggatttctaagccaaagaatgccacagattgccagcaagcccccagaagctgggaggagtggatggaagagattcttcctcctgttcaatagaaggaaccaactctgccaacatcttggatttggacttcgtagcctccagaagtgtgaaacaataaatttttgttgtttaagccactcagtttgtaataattgattacaacaaccctaggaaactaatgcatcttccttgcctcttccagctttggtggcttagatgttcattggtttgtggcagtataactctatctccatcttcacatggacttttccactgtgtgagtgtgtgtgtgtgcgtgtgtgtgtctttttctatctaaggacattttcattgaacttagaacccaccataattcagtatgatctcatctccatccttcccttaattatagatgtaaagatcttatttctaaataaggtcatacgatggcattgtggatgggcatggattttgcagggggacacactattcaacccactataactgttatgccaagagagttgtcagcaaagggggcaggagtgatatcaaatgaaggtaaaggaggcatggaatgggatagatagggtattgtggatcccagttagcagtctggattttgttctaaatataaagaaaatttcttggcaggttttaagctgagaagtagcacaacttgatttacatttcaaagaggtatctcgggctattgcgtagaggatggactgtgatggggaaagagtagaaacaagggcaagctttgtgggtccttgtgagaaggagtgagaggtgctcagtacaaataagaaacaggccaggtttggaagacttgccgatggattcgatatacaccagggtgtaatgaatggtgtcttacagaccggggaaaagtcataagtggcttctttatccatttttgtttactcatatatttatatgagtaccagcagactaagtctttcggaagccgcagaaggttatgctgtgaaaggaaagtcccttctgactgtttctcgcagtctctttactttaagaacagctactgttagcagttttatctacatccttctgaggaaatattttacatagagcattctctttctaagaaggaatataccttctcctaaagtagggctattcttcttccataaaatccaataaatgaacatgtttccaggcccggaaaacttacattttagaaacacctgctcattcagtaaaaatatgtcagtaaagtctaaaatagcattaaattaaaatgaaaccggtagttttatgatacatgtcctttacgattgttgtataatgactacttgtaaagttagctaagacttcatagcctaggctctatgcctagaaaataagaaaaacaccttcttccccattcgcaaaactcataaatgaaaaatgaagtggattttgccatccattgtttctcctgtcactcctttaagatgagtgatgctgttttggaaagcatggctattaagcagcttgcctgagggtcacggagcctgttctgcagaatccatttgaggggaaggctggagttggttgtgtgtgtagattctgtcttctgccagccactgctgtctttgctgttccagggtctttctaggccatttaaaacgtgattaggaaaccatcagtttcctatggcaaagggattgcgcataatcaagtttccttacttgcacgaggctgagccctgtcctgtggagtctaccttccaaatcaataacaaatctatccaccactctcattcctcacaagtaacagtcatcttctagctacactgacattattctagtctctagaacaggagtctccaacccctgggccccggaccagtaccgctcgtgacttgttaggaactgggccacacagcaggatgtgagcggtgggtgagagagtgaaacttcatctgtatttacagcctctccccctcgttcgcattaccacctgagctccgtctcatgccagatcagcagttgcgttagattctcaaaggagcgagaaccctgtttgtgaactgtgcattcgagggctctgggttgcgtgctgcctatgagaacctaatgcctgatgatctttcactgtctcccatccccccagatgggactgtctacttacaggaaaacaaactcaagactgtcactgattctacattatggtgagttgtatacttatttcattatatattacaatgtaataataatggaaataaagtgcacagtaaatgtaatgctcttgaatcatccccaaaccctcctcctgccgcccacactactccatggaaaaagtgtcacctgaaaaaccagtttcaggtgccaaaaggtggggaacttgtgatctagaactgaccaaggccttttgcatttaaagactacttgtgctggacactatgccaggaatgttcttttccacttcttaccatggctaattccatttgtctgtcaggactatgcttaaagaaggctttctcctaataatcaaattaagttcttcctgttatatcccccttgattgcatttatcataatttcgaaacatatacacaatgggatagtaacctccttcagtctctgttttgtttgcaagtatatacccagtgctgagcaggtagtaggtgctcaacatatatttgtgaatgaatatattttctgtttaatatgtagtagagagtataaacttcatcacccttggtttgtgtgctttgtggttacgtcttatattaatctgtttttctttaaattctagattacatttacatttatttactataaacataccaaaataaagttcattttgtatttcagaagaacaattaggacatcatcatttagttcaatgcaatgagtagcagaagtcagaaaggaaattatttttacaaacatgaacagaaaataaatctgctaggcctttatgatgtttataacattgtagcttttgaatggttttatggttaggtattgagggaaaggcttaatagatatgaaaacaattgccctttaaaaattacagcagacaagtatttaatccaaagggggctaataaattgctcaagggaaaagggttgtaattatctttaatcattcccattaaaaatagtctttaacaggttgaatgcatttaactcagtgttctgaataccaggtaaacattggccattatttttctaatgtttactttgtcataagaaatgagcagagtgagaacacatttttatttgctaagagaagaaagcatattgtttcttaagtcacctgtagggcgaagtaaatatgcgaggaaatagtctccataattgtttaaaattcattgaagattgcttttctgtacaaaagaggggaaaagattgtgagaagcacattacagaaaacaaagatcaatgggacaatatgattaatttgaaggtaaagtaaggaagggctctcatttttcacccagtgccaatttgcagtaaacctaagcatttcatcaaagggttgctgttaaccactttaaagcaatccactttcctggaactggaacctggggccttcctgagtcctccttgagcatacagagttgctgtgatccatcttctcttcttttctgtcgacatgaatagtaagtgatttcctccctagtgcattatgaagttgtcttatttaatgtttctttctggggactgcacagcttgaccctcacactgaaggtgaccagatagaattgtcctgtgggcatggtgcaattctctacccttgaacgtggaattatgcagagtagtgaagctttatgcctagttggtgatcatgacctggaaacatacacaaagaaagggataaatgaagtttgttaactagattacatgttttaacttatttaaaatgagctattttgataaacattttggttaaaatagtttaatagaaacgtggaagtgttttacatcaccagggaacatcctgaatgtacaaatgaagacattttcattaaacaggtgatgttaataatttatttttatcactagcactgtgactacttatgaattataaatgaaaatttacatttagatttagcatacatactcaagcgtgtcctgattgttttcacaaatgttagtgggtgaggtaatggcactttatgtttccacactgatagggctacctttaaactgtctccagaagtgttaacttgcagcctctcaccttccttttctctaaggttctgtttaaaatatgtccccttctgcctgtgctataactctaggacataaaagaagtagttaggaacagatgatttttgatgtgttgtgtttccatgaacactaatgcaattagtacatccctgagagggtctttgtatttatctattatattttgaatgaatcaaggcacagtcttttctaacacattagggaatctattagttcacctagtttgctgacagatgtttcctttaggatggaagaagaaccgatacagctagttcaatttagaaaaagttatgtcctgggtgaattcatgactttctattttctctcccatttttacaataacccttcctagagaaagcatcacctttattgtttgatctccccttctgtgatgtatattgctcactgaaatattcagtataaatgaataagtgatgaatgaatgaatgaatgaatgaatgaaatcctttgaagaaataatgccattttagcacaacataaatgtctctaagggcagaatgagatgacggtgaggcaaccttttcttccaaaacttcgagtatttaaaatgctacatgtggatgttgccttgtttttgtttgcatagtcttgaaaagaaagacctaaagatggcaggcttcatattttaactgttttccactaaatgcttttgttatatttgtcgtattacttaaaattttgtagctggaaagttgaacacatcaaaacctggcttttagaaaatgattaataaatcaaaaaggtgaagtcactttgtgtctagtcattaaaatatatacacatgtacataaaacgcatctctttatatatcagcattataatttatatgttgacattccatattagcattatagaacaaccgaccaggttttttgggactcatatctttccaactaagttcacgtgagagtattttttatcgttgaacctgtatctaaaagtatagtgtgtggagtgctgtacagacatagggatacttcagatgaaaatactgatgaatttcagtcattgaggcaattgggaacttcagtaagattttaatttgagagtaatgtgttccctctgtcaccgaggctagacactacctgttgagattatttgagattcctgttctcagatatatcaaagacttgaagcggggtagggtaggggagaggtgctcctagtaatcactatggcagggttgggctttactgtatgtttcctttactcaataaactccagatgagaataactaacagaaaaagtaacttttttgcatttaaatgttgatatatacaacaaaatatgctatttttttatataggaggaatggttcaaatatacactactatttctttctttctcctttttttttttttttttttttttgagatggagtcttgctcgtgtcacccaggctggagtgcaatggcacaatctctgctcactgtaacctctgcctcccaggctcaagtgattctcttcctcagcctcccgagtagttgggattacaggtgcccaccaccatgcccggctaatttttgtatttttagtagagatggggtttcaccatgttggccaaggtggtttcaaactccggacctcaaatgatccacctgcctcggcctcccaaagtgctgggattacaggcgtgagccaccacacctggcttacatactacatacatactatttcttatggcatcctaatgggacttaaaattactgttctttgctgaggtaaggaaatattgggaaaaaaagaaaaaaaaaggaaaaacacaaaggagatattaatagtttaaaacagtttgaaaaccttgggcacattttattatcttatagttttatttagaaagacttattgtctttccatagtttatttttaactgtatcataaagtatataaattctgtattttctcctgtattgatggttattgtccattttagtgtgttatcttatggtttctgctttgttctatgaagactctttaactttttagggatttaattagactggcttttaaattatagcacctaattcaaatatttaaaacttctttggggaaggaacatattttagcatacgtggtactaaagcatttaacaacagtttatgtttttttcttttttcttaaagtttgtgtttttaagcgatattctaaaatgtaaataaaataagtaaaatgagaggaaaataaattttttttctgttattctcataatgagtaaatttttctctcattttaagctatgtctcaccaaccacctataaattatttcaaactcaaattatatggaatctttacaaatgattgccttaaaacttgaataaaactgttcaaataagtattagttataatttctaatagaaataatgtagcactttgcattacaaataactaaagcataacacacagataaatctatatgaactttaataatttgccctaattaaagctataagcttggccttacagacaattttgagttttcgtgtgtttttttaaaaaataagtcaaaattataggttttcagttttgccttatggatataagcaaactgatactgattagtgcagattttgttaaagctgcagaagctaaagtttttaaggaagggattagataaagggaaccttcagagatgatactgaaacagctcacttcaacaaactggtactccttactgataaatgtgctgtctcctgagctaagtcttaggcaaaaaaacacaatgatgacatacagcacgtgtgaaatagatattcttgccttttgaaaaatagagtgcaaaaactttcaattatgttttgaaagccttgagtactgtggataatgatagtttcctgtgcatctatacaagcttttaaaatctcagattcctcatctgtaaaacagaaatcattacacaaagcttgtggtgagaatgaaataaaataatcttggtaaagcactggtgtctaaaagttcaatgaattatagccgtattaataatttctgttgttattattggatattattatagtatcattgaaagtgaattaaacatatacatataccagggtactgtgctggacgtcagaaataagttaaatattccagaagaaacaagatctttataaataatcagaattctaggacaataatggataaacgacttctgagttattgtatacaagtgaccggcaagccttgtcaattctagcttcagttaaagtgggtgattgctggggtgcgtcttggcactgaggcataaaaggttagaggagaaaaaatcagctgggactgtggtaaaatggaagctgggaccttggtccgtcgtcaactggactctccagtcttgtagtcttgtccagattttcaagggttttgtttttcagagtagcatgcagtcctcttgactattcatatatacacacaggtatgttcttatccatcaaggtctgctctttgctgtaacagaggtgtggaatagataggagtcttggagtgtactggtggctcagctgcatagagaatcattcctgggtattctagaatctctgccagtttctgtctctgctttctccttgaggccaggattgtgaaagtgggcttttaaccaatactttcacaatttaaagtcaccttttgtgagcctccttggcactcaagtctgccccccagcacactggcatctagtacacacacacagtaactttgtttcagtaattaatcacattattgatatcagtgaggtcactgttttcacacaagagccaattaaaagtaatttattgactacattttatttccactcatatgtatacacctcaatgcagcaccttaaataattatattattacaacttactttgcctttgctattgaaaaggaaaatatcattgagaaaatactgctttttagctactgagccgtttataaacgtccagtttaaaaacatatttgaaaacttacaatgtaaacaaaacactcctagcttatatgttttagttgacacatgttttcctgggatactttgtcccaaacacctgtctaagtatgctacatatgtgaattcattttcttctcataacagggggtaggagatattatcatcaccattttacaccaaggttcgggagttagcaatttgcccacagttacacaacccctgagactggttctcaaatttcagtccagagttcatgttcttcagtggccctgccatactgtcttacattgatatggtgctttggcattcaaaaagtgcggtttgcatgtctgatctcatttcatccttaacatagtatgtggcagcagatagaattttcaatccactttacagatgaaacaactgaggctcagagagacaaagtgttctagtagcaaatgtaaaacagagttgggcccaaaggtattttgttttattcattgactggtgtgtgtcactggctgtcttagggctgaaatagaaatggatcagggcctcccacaccccgcaactcaccagtgctaccagtttcccacagccctttgatttctgcagctgggtttctctagttagtttgaacactcagtgacctggccacttgtctttcatatcttactcttgccagaattgtagaaataggttctatatttaattattttattgattgattgattgattgtgagacagagtctcgctgtgtcacccaggctggagtgcagtggtgcgatctcggctcactgcaacctctgccccctgagcctcctgaaggcttctcccgcctcagcctcctgagtagctgggattacaggtgcacaccaccatgcctggctagtttttgtatttttagtagagatgaagtttcaccttgttggtcaggctggtctcaaactcctgacctcaggtgatccacccacctcagcctcccaaagtgctgggattacacgcgtgagccaccgcacccagctgctatatttaattatttaattcaactattaatactttgtgttatactttatgaaggaactttgatgtttctgtttcataatgttaatgagactgacgttacaggtatccttcattccaagatagactacgttccagatttaatgattttcttggctagccttccgggtttttcctaacaacaaaggtcttcctgaggccaattcatcatgtggctacattgaataagtgaatatttctatttgatggtgacttcgaatttgagaaaaaccccacaaaacttttaagtataatcaagatctactatgtaagaagtatggccgtaagttaatgaaagcaacctcgtaagtctcatgtgaaagtagtttaccatagtgtttgccttcatatgttcttagtcccttctttattaatttatttttgttaattactgtgtcctcataatgatgttcattccacaggtagtgccgtccagtttgcttataggggaatgttgaatctgtgaccttaattatggatcacagtggaacttctgtgaaagtgaatgtcagtgctagccaggggctgtgttgtttatatcacgtaggctcaagtgaataaattagcacatagttctgaaattcagaagctgattttaagaacatattgatgaaccaaagttgtgtctcaatatgactttgtggttattaggcaaactcttttaattccatagaggacagagggtagctttttccaccatacagtgttaaataatattctcgctccgtgtttgtgaactgaaacaaaagatagattgaattgtaaagctctcttgacaaatgagcacgttttactttcttcctgtatttttcttctcttggcttttgtgtcctgtgctttttcccaagcagtgttatgcaaatgaaccaattaatggtagataaaatggtcttcctacctcgctgtgtctgtaactagaaggacaacaccgtaagtcacgtacctattcagcgggttctataggccactgtgagggtctgattagcttgactgtggaagacaatcgcagaggcatctgcttggttaattttgagagcaaatttaccagatggaggctgaagatttaagtgattagaaggtagtagattggaatacaaattggattaaaagaaattagattgatataaatcgaattgagtcacaacagtttgtgttgttcgtaccaagggccagcagattatgggagaagcagatgctccaatgagataggaattgatgtggctttgacagtccatctgcgaaggtctgaatatcgagtacatccctaatctccctctccatttatcaatgccataatgttaattagtacttcattcattaagttacttacaggagaaaaaaatctcacccctatcccctctctgctcgagaatttgttattttgccaagaactggaaagctctcttcagctgagctagctacagttgacggtaagggtagacctgtgtccttttcctgatgcatacaactgcctgtggtatgaatgcagaaagcttgaaaacatttgctcgtgtgtttctcttcataaatatatagttatttggaagcttacattattgcttaagcattattccactaaaaaggagtggatatattaatcggattacataattatgtatattttacattatggtttttataaggtattcgccggagttgcctgttttgtttaatggctcaagtatttgacattaatattgagtggtatttttcctccttgaggggaaagatgagaaaaattttgttctcatgattctgtgtgtttatactcacgtgcatgtttgttgtgtgtttgacatctatgggctagtttattagattatggaaaattacaggttactgacactatcaagtattttgatatccagtgtttgcctctgattgttatagaaaaaaagttaaatgaaataaaatgaatataaacacatcactgtaaatgcttgtacttatattgggaatttgattctttacaatccaaggggcattgacacaagagtctcattattacgccattggccacagcagtgaaattcagcagaaggcaattctgtcttggatgccatccaaaggaactgagccagtggagatccaaaggtgatctcacctctgaggcagcttgagagtgtgcactctaaggatagccatgaagaaatgcccctgtgtattcataaccatcaggcaaatacaacttctggagactaacgtgatgagctgggcaaaaatggaacatcaaatcctgtgatgcaagaagcatatcattaaaggttgtgccaagtcattcagaaataatcatgatacaggcaagtgtgggctgcctgccagtgtgtgagcacgaagaatttctatttttgttatgttgaagggaggcagtggcttgtgcaaaagtgtgttaagtattgtaacattcttagtttactgaagaaaattctatgagcaatgagctcttcaggcaatgtgcttaatgtagaagtgctatatagctataaatggagatgtagacacagatacatatggctgttccttattcaggctgacctggaattctcctgcatcctccccaaactccaatgcttgggtggttttggtaatcactcttaatattggctaaagaatccaatactttaaaattccccataccttcacttcagaaggagaaataccctgccctccaggaaccaggactgaaactgaggtctgtgagaatccagattctatgcacaccaactgcataggccctatgtttaaaaacaatgcagagccggtatttctaattgtatactaattgatataacttggtcataataagagactgttttaagctgtattccaacaaaatttaaaaaggagagggaaaaacactaacagattagcctgcaaagtataaagcatagagcagaatcacttcttgtagtaaagaaaaattgctaacatttgttattgctattgtgatagtgattaagtgccatctaaaaataatttagtattcagaggtcactccttgttcctgttttgacacttcagttttcagcctaattgtcagttgtctaattggtggtggttgtcttcattaagaaacatcagtacatcaaggtagtgctcactgagcctggcaaagtcatggattatgctcttagccctgcctgtgtttctgtgactgatcattgggtatttcatatcttttttagcccctgtgaggataactaaagaaattagttggttgtaaactaatgataacagggatacaacctccccatttcctgattgttgatgaactttagactgttgatatatttctcctgtgaaacatatcaaaagatatattaattaacagatatatatatatatgtatatatttacactcatatatacaatttctttcagtgtttggtacatttgattcaaatgctacatagtaacattctatatatatatatatacacacacaatagtgtattgtatgtacactctagtatgtacaaatgtacttgtgatgagtgaatgtgtatttatgctactacacttaaaacatttttttttttggctaatctcacaaggaatgtccagagattaaattgaggcccctatttaataggagattctttaaaaaatatatacagtatttaaatgtactcacaccaaatggaaaaaaaatcagccagattatatcagtgcctccatcatcatttcgggattcatatctgaggcagttggcccatggacctgatttcaatatgggcagtttagatacatatgtcaggcacaagctacctcgatgaaatagagaactctgcatctcatttctccccctgcagtcagcgtattttttcaaattttcagtgaactaaaaaaatgagaaacacagccaagttctaatatagtaagtgatgttctggcacctttgaccataaatcagtgtcacaaagacctcatggcagcctgagtaaattctgtccaaataaacgctgagccccagcgtggaggttcagagttttgtacttcatcgtaacactcatgaggcaacttgtatgattctggatgcgtaagatgaacttaggaaagtcccaatttgtaagtcaatttgatgaataagtagatttattctggccaagggagtataaaaatttagaaaaccccataaaagtttgagatttgcctgggcaacctactttgtgtttgtttaaagaaaagcaatcactaactgttccaaaatccgtttgcattttttctaggaatggagtgatgaggaaagggaaagaacatacctggaagagagaaacgatgaggcatttaggataatgatagtgtgaaattatgtcgagagacacagatggtgactgtggaaatgagaggcagtcagttccagacacaaacctggagaaagaaggaagaatccacagaaatgtatgcctaagcggttatgatagaaatggaagagttaaaccccacaaccgggattctgagcattagggacctggagaaagatggagttgatgtcaggaaggagagatgatgaaatatgggacgaggagagaggtgagggtttcattcttagatagatgaaccttgagttgatgactgagcattcaggtggtcacccgaacaaagcctagaactttccttagctggagatactaaacccacatttggctgttgttgtcatagagataatacctgaacaccatgagagggaatgagttctctgtggaatgagtgaattatcttcattgaagggaagagtagacatctaaggcatacataccttgggagctgttaactattgggtcagaaattattagacaattcacacttctagttcactagtttacataaaactcaaatatttttttctgttatttataatggaaattcgtaacaaaagtaaccagtaataatgttcttttaaaaaaaatttcaacagcagtgagcgcatcactaaaacactaaaattcagttattattgcctcatttgaaagtggggaaaattacgtggaatattaggcaaacatcattaaactcttaacatttgtatacttttcattttcttccagattttcagttgctggttgtttataagatccaacttatcagagtttgatatattgaatattttatggtaaaggcaacttcctacattttagaaataccaccctgttcgaagctatcattattctgtgtttcacaaaacttatcactttacatttttatacctctgcctgccagcatttttctttccttttagcataatccagaataattctgtgttccactcttgtgctttgtgacaagaaagcattgcatttcgagagtggctggaaggaggttaattccatgtccacatggtaataacctggggaaacctggggatgatcagtttcatttgatccctcctctgataaggcttcaaagtaaatgggctgagtggaaaacaacattattccataacttttctctaagctgcagatgttttttgacagactcaaggaattgagactcatatattttagtgaaacataattcaagcagaaaaagatcatttgaaaacgtttattgcactcacatttgctgctcttctccattcagcagaaaaataagctcttttttctctgtgcacacagaatcttttaactgaaaactacactcagtatttgtgttgcagcagtgatgttatctgctggtcattttgctctgaaacagaagacatctcctgaaaggaaatttaaagttttattaaatgggtcactaaaaagccatcaatagatatcataaatagacacaaatgaagagaaagtagatccccaaatgaaaagtatcctgatcattaaagtaacttatattctttatctactaaaataactcaagtttgcaatctaaatgtaaccactttgcatagccttactacagttgtcacatcaaaactgttatgattggccaaataaaactggagaaaatgtttttattaaagacgtaaatttatacttatttattattttaatgcattgcataaagtgaaggcaaaatacaactccaaaattttctataagattctataattttgtaaacagagcttattccaaattttagagctatttgcaactgataaaacatagcctctttttcaagctattttatgtcacaaatcttatctaaggtgtttttggtggagtaaacacttaacaatttaggtgtatatcctccaaatacccctgaagaaatatgatgctgtcacttctgttcagtttggccaactgtgaaaatccattcattgtcagtatggtacaaagacaaagccataagcccgagttgtatttggatacctttataagcctcctttgtttccaagatacaaacttcaggaaagatctccaaaagccattgtacaatattaaataagccaactcgattatggccatttccaccatccaagaggaaatctttcttttcatctttgggatcagtatactcatttttgacttgggccttttatttaaagatacacaatttcataaaggtgtcatttagaaatttctaggaaaagttattgctttaaaaggatgagaatgattttgttttgaccatctcttgaaactactggtaaaagtgcatttcagataatattcccattcctgtcatctcataagtcatgttattgtgccctcaataaagtttatttaatatcccttagttatctctaaacttataatggaaaagcaaccaaaaaaataaatagatgcttcctatgcattaatcatggagtcattccaagatttttataatgaaaaataaacagcgttggtatatatttcagtaaaatagtttagagggacacagagttattaggcatcaacatttgctttaaaaaggccgttatcttatagatcgtggttcattgtttttaggggggttacagactcctttgagtttagagacagaggttatactaataaaagagttatacattataataatgcttatactagtagggaacatttattgagtgcttgctgtgtactcagcacatggaaaaatctcattcaatcttctcagcaatgttattcgactgatactgctatgttttatacatagggaagcaagatgcagagaaggtaagaaatttgcctgagttcacacttcttttcggcatttgaaaaagaaatttcaagtcagtcctactgacagatgatttctattaactaccaaaaatatactttatcatttcttaaaaacgaacatgcacatatctgcacaaaattttgcatccggtgcctgcagtaccatcccttacctccattccacataaaccaatccatgatttatgaatcacatttttacaaataatggagtaatgcaatgatatttgcaccttaggccaaattctgtagtaaatgaatgttgattagaaatgaacaaggctaaaatcagtcattgtgtgcatcccttggacatgatgcaactaacgcgtttggctcatgaaggctataatttttctggtcgtgatttagccattattcctttaagaaactattggattgtaatcttattttccatctgtcttttaaaaatcctttctatacttatataccaaaataagtttgtctgaaatttcaggtaggatcattgaatctcaatttaactttattatgaaatattttggggtacaggaaaatttatcaagagtttctgacaaatgtattaactaagtatttaacaaagcttagcacacacatgcataaaatatcattgctggtgggaatggtgttttttagacattgacactgggtcttttggcatcttcagttactaagattaatgctactgctacagaattttcagaatatagaaacagaaggaaatataatagaaagtcaaaatgatatcactccattcagagtttatttaagtaaaatccccttttctggagacacactcatagtcttcattaaataaatgtcaatggtttttagaaaattaaacattattagacaatttaatgatttttgagattgtttcattgcatcaccttttgtaaagccaaatgcaatttcaaaccacatgaaaatattataaatatgataataacaagccagattttaaagctgtcttcctggaatagggattgtttttgtcattgaaaggtaaatctgcataagccatgaaaacctctgattgggcagtaaatcacactttaaagaataccttcaaccatgtaagatgtagcaaattgatttgaaatagtattggatgaatatccaggttaatacattggctcctcactgaattgttggaaatgaatttataaagtagaagagtaatttgttattaagaggaaaatcccccctaacagttttctagaaaccttcagattaggagtttcaaaatttatcttcaatattatatatacatgtgtgtgtatatacagatatacacacatatatacatgtacacatatatacatatatgtgtgtgtacatatacatatgtgtgtatacatgtatatatacatatatgtatgtattcatcatggagtcataggaatgttgtatatatatacacacacacatatatatagatgcacacatatataaagacacacacacatacataagaatatatatatttctattgtatattcatatatatattcttagttgtccacctgtggttcgattgccttcagcttctgactctaacttacacaaaccaagcctgcactccctacgggtgctgaggctctacctgtcactggggcccacttgctcagacagtcagtggctcaattttgatgtgggcagccaggaaattgaatagcattttaaaaatgtgattaagacttagctgataaaggcactgaataacatgcggtagtggaggaaaaaacaggggaaaaagtgttctaattttcatatttttagcaatttctgttaatggtagataagtaaagacctgagatacaattgtgaaattcaggttgaaagttttatgaatctttattacttaccttcacctgaaagatcaactcattcaccctaattaaggaaggaaattttaaagatctttgctgaatgctgaaggttttattttacataattaattacatatctatttatttgttacattttattttattttaagttctgggatacatatgcaggatgtacaggtttgttacgtaggtaaatgtgtgccatgatgatttgctgcacctgtcaatccatcacttaggtattaaccccgtaagcattagctatttattctgatgctatcactccccacgctgcccctgagagaccccagtgtgtggacatatttatttttaagatacctatccaatatagccagttagtctttggttaaaatgatttgtagagcaatgcatttactgacaatatggataaattttatagaaatttaggaataaatttctaaggtacgttttcagtcttttaaatcattgttaacttttggagggttttctaagaattcatgtgatatccattgcttttgacagcagatacaagacctacaaaggccaacttttgtaatctatacatttatcaaaagtatgaacagtaatctaaagtgtgtattttttaaagtatgtaccctgtgttcataaatttaaattgctactcattatgctttcttttagatatgtctgttaagatatcattaatgtgacagccataaagagtatgatcatgctacagaacaatgagactgtagcaatttactcttccacttacctcaagtttgggatgaataaatagtacaaaaaaccagtttaggtaattgcttaaggtgatataactaaccatatattggtccagataaaaagccaaacaaaaaacaactgaaatctagtgcttgggattttctaataatattttagacttctaaaatgtgggtaagaagaaaaagtcatcctgaaaacagagcttggacccacagctaagacaagtatatccttctagttttggttgtgagaaagaaacttcagttctttagtactctatttttcctcctcatctataaaataagggtttgtaaaaggacctctgatagcttaatcttctgttttctgcatctggaaagcaaggtcacagagatgttgcagggtgctattttgtacaactggaaactttcagaatcaaggctgcctgttgagtttgacaaacctcttttatccttatcagttccctttcacactataagccctttagttttaggacactgaaaagttattttgaaatttttctaagaaataagtagagtttctaggtctcaattttgattttgtttcaaatttagacttattaagatggcactgctgtgcttccagaaggaataataatcttataaatttatttaggccaatggcaaattaggaagtctcctgagagagttttagcaaatttcaaatggataaaatggacttcgtgttttccaaatattgatcttctcagcatatcctaccacatcactggacctctagaaaaaaaaagttatctcataatacttttctattccctcctccctcataagcaaagtaagctggaatttaatcatcatgaagaattcaaagatggaaaagttgttatggacagacttgatggattgatggcatgattcattaattccattaaattgcaaattaccttagctcactaatcaatgtagacagcatttgcagtggcactgagatatgtttccttcagtgaaggaaattttgaattggatatatttttgactaacgataaatagtaacaactaattctttggaaatctagtgtaaagctatcagcctggtccagctaaaatgtatcaagcaataaaacattaatgtcagaatcatcctcagcaaagataaactattgactattgtcaatgggattatagagttttatgggctaaattttggaaataaagtttagagttggagtatttgtcatgttttgcagaaggagaaaaaaatactacactgaacgcttactgcccatcctggtgatccatatatatgatttcttttaatcttctaaaccactcttttttttttttttttttttttttttttttttttttttttttttttttgagacggagtttcgctctgtggcccaggctggagtgcagtggcgcgatctcggctcattgcaagctccgtctcccgggttcacgccattctcctgcctcagtctcccgagtagctgggacgacaggcgccaccaccacgcccggctaactttttttgtatttttagtagagacaaggtttcaccgtgttagccaggatggtctcgatctcctgacctcgtgatctgcccgcctcggcctcccaaagtgttgggattacaggtgtgagtcacagcgcccggcctaaaccactctttatagcattgatgtcctgatctacctgttacaaatgaggcatgaacgttaactgatcaataacctgtgttctttatttgtaccacactgcctccttcctattgcgatgtgtcaggcaaccttcaccttttcgtgtagtgctactgtatctgtcatatcagcaggtggctctgatcacattcagaattgaagtaatcctggagaatcttcctgggttaattctatttatatcgttttggggaacaatattttgttaaaacagacatagttatggctagaacatactgttacatacatttttaagagagaaaaatgaacacagcatagaaattttgctggaggaagtatatttcacactctgtccctaatttgccgagaatttcttcggccctcagaaaaatttagaacagcttgaaatacattgcttggcttgtggagggactaatagctgatagggctatccagtttgtaaaagaaaaataaaacttggttcaaggaaatactatactccaactcaatgaggcagagacatttactctgtaacacatgaaatgaaatcaacaagtattctaggtgcattttcctcctttattatactacgtgattgaaatctcttcctgaaaacaaatgttctctggcactcactgcgaatgagtggttactgactaaagaaaactaaacttaaccatattcatgaattataatttatacatcaccttcaaaaatttgaagtgctaatataccactcaacgttgtaaaatatcaaatattttatcaaaaatcattacaaaatcattgtttgagagtctctgagaagcagaaataatccattatgcaaattaaggtgcttagaacattattcacagatgcgtctgcatctggctgacgaacttgatgatgctgtggaatgctacatctagccaggtctaagtgtgtgatcttctggtaagcatggaaaaaatgcagcttcttggaacctttcgctggtaatttctgatgcaccttgttcactatggagactaagaatctggtggccaggtaaggtggctcatgcctgtaatcccagcacttctggaggccgaagcaggaggctcgcttgaggccaggggttcgagaccatcctggccaatatgacgaaaatccgtctctactaataatacaaaaaattagccaggtgtggtggtgcgtgcctgtagtcccagctacccaggagtctgaggcacgagaatcgcttcaacctgggagacggaggttgcagtgagccaagatcataccactgccctccagcttgagtgacagagtgagtctctgactcaaaataaataaataaataaataaataaataaataaataaataaataaaaagaatctgtattttaaagaaatatcttagtgttcacttcggcagcacatataccaaaattgaagcaatacagagaagattagcatggtccctgggccaggatgacaggcaaattcatgaagaattagaaaaaaaaaatcccagatgattctgatgcaggcagtctgagaatcaggctttgaaaaacgaggaaaatgttttctgctgaaattatgactagcgacattcatgtgatacattttattgaaatgaaccttagaagaggtctttggaattagcctagatgccatgtgcattctttacttggtgctccattcatttctaaagaagcctggcacattttggattaaaggtcatgagttctaattctgcttctcctatctattcaattatggacaatttatgtgacaatttcacaacttactttcttggacagtaaaaataaacatttggatgttcatctttaggatcctctgaacaatttttgttatctctcttttattataaaagagagaaagaatatatatagtttatatattattaatatatattattttaattaaataatatatattttaatatatattattatatataatatataaatttgtatatattttaacaatatatattattttaattaaaacttgactgattgcccaattaataattgagatataaaaagataccagacatgatatcagtcacaagcgaaattagaattgtagatagttattttcatacatcgcttagtatatctgttctaataggaatctttgaataatttctcattatatgggcaataataacattgctgtcaaactaattttcatttgaaatctgtagaagagatatttataaatttataaatttatttataaaataaatttaaattaaaaatgaactttgtaatggaaaatgatatcaggtactcttgagcagggtgggcaaaccttggtaaatatttcaagcttcacaggctatgtaagttttctttgttaccacttcctcctcctcatcccccttctcttccctctccccctcctcttcttttaaaaacattgttagctcagagccatacaaaaactgatgtgagcagtgcttatcaaacggtattgtgcatacaaatacctgatgaagagaggggaatcttgttaaaacgcagattcagatttcagatatgctggtatgggcctaagatcctctatttctaatacacctttggatcatgcttttgttgctagttgaggggctcacactttagatgtccaaaatgttgaggttgagctgtttcatggcacttcctgtgatgaacaacccccactcccccttactgttttgttctcagtccccagtgagttttgctgacaactcagctttattttttgaccaaataatggagttgttttagccaataacatagaatacccagtagtttagtgctccttgataatcttaaaggcccaacatctttgggaatatgatgaaagctacacccccaaccccacaccaccactactgcctcccccttaacaataatactcatttccacacacagttttaaagattccaaagacttatgcattgggtccatcgtaaagaccactgctattgttatgtaatgtctgaatttaagaaagctcagaattaatccccatatttttaataacattgtaaaacttagattgtaaagctgtatttttgtatatctatgtctatctttctaatctatctttctctctctctctctaatctatctatctgggtggtgagacctttaaagttcactttatgtcctaattatctattgcaggcctgatgatttcattagaacctaagattataaatgaagaaaacagtgttaactgttgttaggagtgagcacaaattgttacacaccttttattaaacttgttcacagtgctcttttatctatcaaatttttaaaaattgctggagatataattcatattccacaaaatttacccaaagtataaaatataataatctttattacattcacagagtaatgcaaccatcactgtaattaattttagaatattttcatcatccctaaagaaatcccatccccattggcagcacttgcccagacccccttcattccccacttccataccccagccctaggccagcattgatctacattctatgtccgtggattttccttctctggacatgtcatataaatggaatcgtacaatatatggtccattgcaactagctcctttcacttatattttcaaagttcatctatgttgtagcatgtattattaatacttcatttttaaggctgaataatattccattatatggatatggcacattttatttatccattcatcatggatatttatgctgttgattctttctttgttatccattcagttggtagacatttgggttgtttctacttttttgactattgtgaataatactgctatgaatattcatgagtaagttttgtgtggatgtatggtttcattctggggtgatatatatctaggagtgaaattgctgggtcgtatggcaactacatgtttgacattttgaggaacttccagattgttttccaaagtgactgtatgatttaaattcacactagcaatggatgaggctttcagtttttccaaacccttgacaatacttgttattttacattgctttgattatatatgtcctagtgggtgtgaagtgtatttcattgtagtttcgatttgcatttttctaatagctaatgatgttgagtatctctttatgtggttatggctatttgtctaacttctctgtcaaatttgtttaactacttattctaatcctttgcctattttaaaatttgattatttatatttttattgagttatgagttctttatatattctagatacaaatccattattgggtatatgatttgcagattatttttctgattctgtgggtagtattctttcaagcacaagtatttaaaaattttataacatccagtttatctctttttttcttttgttgcttatgcttttggtatcatatccaagaagccatcacctaattcaaaatcataaaaaacttgcctctataatttcttgtaatcatttcatagttttactttttatatttaggttgtagatgttctttgatgtttttattaaagtaggagtaaaattacaagaagagtgtcctgatatgacagtactataatctttatgtaacatagtttacatatattgtaatgataaatgagtaaaattcttcgtgtgctcattggacatactggagtttaattttattgctaaatagcttagctattttttcactttttcttttataaatcaattattttatattttatttagtaagtattagcatatttcaggtcttattcagcccttatccaggcctactgcctaataagttagtgcacaagttgatatagtaaatagcaccctagtagctatttacttgcttacttttaatagtagaacagttttgcagtagggagaatgtaggttactgtgcatagggagattcatggagaacaaaggggctatctaaacagatgattgtaacctactatatgcctgttacatgaaaagtgacataaaactcttgatgtattttaagatcagagtctacagctatgtgtccagacctttacattgagaatatgtttctgatttgcaacctacttctattcagccactcatgtttaaatactttggggtctttcttgattatgaatttaaaaattcattgttacttttgtattctgtaaattcctcattgctttaagacccagtactcatgatctatatcctttattattgtgatgtatactgtaattacctatctagatgctttggatctctttagttttttttttaaagttctgacctgtgaacagtaaattactcttttgctttagatatctaacacttgtaatgtatacattcttttttggtctgatgtgattaaaaaaatagcaacttttaagagttattcctcttcaaaaaaataaagttcatttaagactaaattaaattccctttaatacattaaaacatgtattttcaattaatactgagagtgaactgaggtaacattgacaagtaaatattactgctatctgttgaagagaaatgtgctcatattaggtgattggttggaaaatcttatataagagcaaacttttaagaagtgcttatctatataatcattatgtccccatatatggtgattcctctcagcatctcctttttatttacttggagcagctggtagaacattttcatgaataatggtaattgataccatataaatgaaaaatattcaaaataacacattatgcaaaaatttgattgtgaaatatcaacagagccttctcttcctatttcttttcttttctttttctttttttttttttgagatggagttttactcttgtcactcgggctggagtgcagtggcacaatcttggctcactgcaacctctgcttcctgagttcaaacgattctcctgcctcagcctcccgagtagctgggattataggtgtccaccaccctgcctggcaaagtttttacatttttagtagatatgaggtttcaccatgttgggcaggctggtctcgaactcctgacctcaggtgatccacccacctcggcctcccaaaatactgggattacaggtgtgagccaccgtgcccggcctctctttcgatttcttacgccccttatggccccacttttattgcattcacagggaagtcactggtacgatctatctttctttgtactgtgcatggtgatataccaaattctgtcaagcattttgatatggtatatttttccttcttcttttctacctaaaccatcatttcccaaagtcaggttctttttatttttctcttgaactatttaagtaaatcacaactgtcttcgtgtctccgttgctatcccttattgataatacagactacaagtatctttcgattgtacagacagtcatgtcactgcccccttaaaaatctgtgagccgtgtaaaagaatagtcatacccctgagcatggcacaaagccttgtctcaggctccaagactgtcttaaaccttttcttgctgtatcagcttccttcctgattatgaaatgtaccatgcacgtaactgtcatttccttgtccttttgctgatggtatctcttggcatgatgcttttttcttttagttgtcatttttcattctttacggctcaatctaaatgtaatttttttcggggaagggatctcttattatgcttaatttagggttaacttttactttttttctttctgcctatagtgcatttcttatatacctctatgcagcgtattgcattttaacatacggatttatacttgagctcttcagtcaaacacacctgagttcaaaatcctgcctctgctgcttgcctcatctacatttctgggcaactgacatcatttcctaagcttttgcctcatctgttaaatgcagataatatttgtacataatttacaggtctctttttgtgttagtctgataacatattggcagcacattaaatgctatctatgtgtgtcttctagctgcttgctgacgtggctttcttccccagtgtataataagcaatctgaggacaggaaattagtcttactcatcttagtacccatgctgatcccagaagaacaagaaagtctcttgttctcttttacttttgcttgtcatgattcatggaacacattaaacctaactcctttgagttaacatattaatttattggtatcgccctatcctgcaaaggagttgagatgacttatgagatgcatacacaaaacgaaacataaaataatgttcagttggataatcgaagagtttaatttccccatcaggaacccaagtgaaaccgagggtttagataaggaaatgttaaagcttgtctttattccgtcatgttttgtaggatcgcgtcttcgccaggaggactttcccccgcggattgtggagcatccttccgatgtcatcgtctctaagggcgagcccacgactctgaactgcaaggcggagggccggccaacgcccaccattgagtggtacaaagatggggagcgagtggagactgacaaggacgatccccggtcccacaggatgcttctgcccagcggatccttattcttcttgcgcatcgtgcacgggcgcaggagtaaacctgatgaaggaagctacgtttgtgttgcgaggaactatcttggtgaagcagtgagtcgaaatgcgtctctggaagtggcatgtaagtgaacataatgaacctcatgtgcacatttacttttatttatttcaagtaagttttgatgtgttcccatagacgctgaaacctaaagaatcaatcaacacactgcataattttacttggtcttcttcagagaagtctggtcaagatagtatcaagccagggtgttgtagtaagtttgtttatatgaaatcaagatgaccaatatgttattataagaaagcaggccgggcgcggtggctcacgcctgtaatcccagcactttgggaggcggaggcgggcggatcacgaggtcaggagatcgagaccatcctgggtaacacggtgaaaccccgtctctacaaaaaatacaaaaagaaaaaaaaaattatccgggcatggtggcggcgcctgtagtcccagctactcgggaggctgaggcaggagaatggtgtgaacccgggaggcggagcttgcagtgagccgagatcgcgccactgcactccagcctgggcgacagagcgagactccgtctcaaaaaaacaaacaaacaaacaaacaaacaattatgccttaaaatttttgcactcttcagcttccttgttgtcatgtacgtcttcaaagataagagaattgggagatttcaggatgctggaatcttatgtatatagctatatatattttctcctaaataatagctcatgggcctgtgtctttcttttggtaaacaaaattgtacttttctttctttcttttttttttttttttttgagacagtgtctcccgctgtcacataggccggagtgcaatggcgcgatctctgctcactgcaacctctgcctcacgggcttaagcgattctcctgtctcagcctcccaagtagctgggattacagacaccaggcccagctaatttttgtatttttagtagagacggggtttcaccgtgttgcccaggctggtcttgagctcatgacctcaggtgatccactcgcctacaatttcttatgtagctatcccaatgaagtttttcgttctcaggcatctgcttctgatttacagtttgtgctaagaaacctggaacccccggatgctggaaatgtataactccaataggaaaagactaggagaatcctaagacccatattttttattttttgtgaagtgccttgagctatgagcagtaggactttagttaacaatgggattttgtactggccaccaaatagttttatttttataaaatgatacttcaaaaagccctcaaattaaatgcaatttgaaatacacacacaaaaattcaagaatgcaaatatccatacctgttccatttttgttttgaaatatctaattttggaaacttttcaaacatattgaaatacctcaataccaaattttattgatttttttcccccaacagacccttttatggtgaatatgactggcattattctcccattttcaagataaagaaaatgatgcccaaaaagtttaggtgaccaagattcagacaataaattaatggggatgctagaccaggtcctgaatcttctaatttttatttttagggaattgtgtcatatttgaagaaacactctaaatgaaatctggtctattttaaatatataaaaattaagaaattttaatttttcatttttaaaattctatctactcagcagcaaataaggtgtttaaatccttaacaaaattttacttttcaaaattaaagtatataaaaattgacctgtcattttgttgtttcatctaaaagaattgctttcttttctaattgcgtcattaataatgaatcaaactgttctggtgggaatattttaaaccatgatttttgtgtgtgtgtgtaatgtgacagtaattttttttattttgaagtaaatgagctttaagaaatacttgaattactcatgacctagagaggaaaacaagaaggcttgcaaattggattagggagtgaataaaatccctttttctaatgccatgtcaacagttcattccatttgaggcatcacaaggtcaaataatattcatttatatgttgctcatctctttccattcgctcatcagtcttctatctttccttatgtgtttcataaaacatattaatatggaaatttgggttaaagcattgtgatttttcactacctattggtaactaatatgtattttcataaaatgacagaggaacagctgtagaggaacaacttcagattatgttaaattggccttcatattttagaaaactcaacataaatactcattgtggtgcattcacttagtttattaatagaaggcggatatccactgaaagaggtgttaaggaatagcaatgaagacacattccaatgtattctcaaagagctcacattctagttgggatgacaaacatgtaaataaagagttactataataaattaaatatacaaacaataaagcctattataaagacatgtaaaaatactacgcaaatccggagggaagacatttaattcttcctagataggtaagcttaagaaatgattctaagaggatacattactttcacagtgatttaaggtcatttaagaatgtcccaggtggaaattgaagtgaaagaccatccaggtagaaagaatggaagcttaaatgaacactgtgtattcggagaactgccaggtgtctggatatgaggttgagagcagagtaaattggaaaggtaggcatgtgctgaataaaaatctaagctattttgttatgagaaaagagaatctttgaaagagaattgaagattgcattaaaggtatgatgattgaagtcagagaggcattaagtagctgtcaaataattcagaaaagagttgatgctagattctgaactgaacatagcagtgaagattgaaaggaggaaacagcttgaaacatatttaggaattataaactatgtgacatgatcaatgagaagtagaggatgattactagatttgttttgttttgttttgtttttggttaagtgactgggtatatagtgctaccatccatagaggtgaggggcaggtacaggagaaataactctagggaacagaacagtatggtaaacgttagctgtattgtttgacataccaatgaaatagtaagcttaaaatatctcaagtttcattaaagaaacagcttcttctagagttgaggggagaggtctttctgagataggtgttgaagccacggaagtatatagaagtagatgtgatttccaggcaggctgtgttcagggagcagttaataagggctgagtccaattccagtgcttagaacagtaatatttagtggtggtcaaggcaagaaatgctcatgcaaaaggatcagtctcaggagaggtatcagagtgatagaatatgggcagtgaagtggcaagaataatcaaggaatacattaaaaaataataaaattggggccaggtgtgttggttcacacctgtaatcccagcactttgggaggcccaggtgggtggatcacttgaggccaggagtttgagaccagcctgggcaacatggtgaaaccccgactctactaaaaatacaaaacttagccaggtatggtggctggcacctgtaatcccaactactcaggaggctgaggcaggagaatcactcgaacccaggaggcagaggtggcagtgagctgggatggtgccaatgcactccagactgggcgacagagtgaaaccctatctcaaacaaacaaaccacaagagtactaaacatggttgacacgatgcaaatcccaaatgatgatcaaataaacagtacctgtgggctccagtgatggggacagaacagctgaagagcgagtagtggtgggatggaagtagcaaatgctgccgggtctttcctagaatggagctctgaatggagcatggagaattagagcagggtacctcaacctctgcattactgacatttgggatcagaaaattatttagtgtgtgtgtgtgttgcgtgggtgggtggattgtgctaggcattgtaagatgtttagacatacctctggcgtttgttcacaaggtgccaatgggattctccctagccctgttgagacaaacagtatgtctccagacattggaaatattcctcaggagagaaagtcagttgagaaccactgacctagatgtacctaagtagtcaagaatgtattgatatgtaggacataaacatgtcacaacttttatcataaaatgattattgattaaaaatatggaattttttttactattttttattcacattagttgtcatttttaatttcaaaaatgttcgattctactatgatacgaaatgtggaatgttattgataaccatctgtcttgactgattttttggaagtcagccagttctttaccatactgcattcattttggtgtttgttttcctttaatacatgcttcacctttatgttctggaacaatacagcagagggaaaaaaattcaggaccaatcattgcaatgaatcacctcaaatttgcttttatttttttcttagtttgcaaaaaaaaaaaaaaaaaatagctatccagaaagtgttttttgagtcacttgacctcaaaaataatctctaggcaaaaaatgttttttaaatagttagaaaacagttgcagagttaataagcaagaggcctggtagtcaaaaagctaatacatagttttccaatgggaccaccaggagagccatggtgtagctggtgcagataaagtttccgttctgaacactggcgctccctgtttatggagcagaaggagcacagggggtcctcacagagattgtagctgcctgtgatgcagctgagtcagtggcagcctctagagatggcagctgtagccccaggtggcaaatagatgacagcagcttgatctatcgaccagggtaagagggggttctggcctaaatgaaaattcatgaaaaattgatgaagtccccagattattttttccgtttccttttctcagcactgtgccagtgcagagagtagagattaaatgaggtgctgaacgctttagtggcaaggaggttgtggttcaaaggtcaggggtcacatagaaaccaatctttttttttttttcttttttcttactgctaaagcaaaacacaagaaacttttcagattagctgtgatttacctttgctttgataaataaaatgactacatgttcaaaagttggcttttgatgcagttacaagagagaacagatgtgattcataattcaagtatggaactggaaatagattgaattccatgacttcaggatgattattttttctttttctcttattttttgtcttctgtatgaagactcatgctgtatgaaagtcatttagagaagaagaaggtcttgcattatttatagggttacagattgcgagaatagcaaagctatggaacactgtccaaacataatgctcctgtttgcttaaatagaaaattaaattgatggtttatctgtacaaagaagagaggctacagaagtagactgactttagtatgagagggcacaggtggcactgaaaatgaagacaaggtaaagagcttccttgatctcctcaagttaataaatatgtaaatgtttgttttttattttattttggctgtaaatgcatcttatctaggcaaaatacctttacacatcataaagacacaagataaattaaattgcaaaaagatcaatccatagagagctttttaaaaaaaatgcttaattgagatatatttaacataccatatcatttactcatttaatatatacaagcaatgtttttggtgtattcatggggttgtgcaatgaacactataatcaaatttagaacattttcctcaatcctaaaataaactctatacccattagaactcagttcccattcctgcaccctctcaccccagccctaagtaaatgctaatctactttctatagctatacattttcctattctggacatttcatatgttagaatcatacaatatattgtcttgtgtgactataatagcatcttttccttaacattaatgttttcaaggatcctgtttgtttagcatgtattagtactttattcttcattattgctcaataatatttcatggtatcaacataaccactttttatttatccattcattgtatgatagacatttgcattactcccactttttttctgctatgaacaatgttgctatggaaattttgatacacatttttgtgtgcacatatggtttcatttgggtattctcataagtttatgcctaagagtagaattgtcgagtcatatggtaactgtttaactttttgaagaatatatatgtaattattattaagtgtagattaaatgatatttactggtgcattgaagtaactgtatccaactcacctctcaatatgaaacacagtcataaaacatttctactgttttatccatattattatgtgactgttatgttagattttctatgtcgtatgtccataatttcaggtaagagtcaactatttaaaaatatagaacaattaaccatatggaaacaacggatggccacaaagttcctaataaatccttgtgtaacttctactagactgttttcagtttggtcccaattaagttggataatcttactgtttgagtcttcacttcattttctgttctgtttgtatttgttctgaaagctggcaatttgtcttctcagaagctgacgttacccttcctgagaataactgacagtactttcttcattctcgggttactttctcttccaaatatactgaggttttttctttcacttgtcaggttcagactaagaaattaatgaacaattatactagaagtcagttaagtaagtctaagagtgggaaaacaaagaactattatcattctctatctttcttaaaacaaagaagcacacaaacaaacatatcaacttaaatgcaaactccgtggcgatgagttggactggaactaatatttacaggtgaggaccaaaaagaatataggagcaactttcgttttttgtaattttctccatttgcatttctacaaatgtcaggtgagatttcatatatttttggtggtgatggtgggtggtaggggaggaggatacttacacagctgaaaaacgctccctagctccaggtacttcacaggataatgctaatatgttattttggctgttttgtgagtgtgccttttaattttgccatactccatcaaatactttcaaatgcagtctctcctttgatcttcacaaatgaaggtgtgaaattgctacacctggggaacgtgtatgaatttgtgatctatttaagtatgtataatgctgtattttgatacgaggtttatttctgttgattgaattaactgtattcaaactctctctcaacaagtctcaagttgccattcactgacaattagcctgaattaactctgactcccaggaaagcacataaatgaagtgaagtcattgtgtcctctacttttcaaaaatttattcccataaacagtataattctgagtatgatcctgaggtctgcagtcaagtagatcctatccataaaatgacaaggaaacatattcatagtgatactaagagttcaggagataaaatatgttgaggtctgctccggttttcgatcccagaaacccttttcatataaagttaagaaaaataatttaggattttgaatttatttcttactgtaattttttgtttgtttgtttgttttgagatggagtctggctcagtcacccagactggagtgcagcggtgtgatctcagttcactgcagcctctgcctcccaggatcaagcgattctcccaccacagcttcccaagtagctgggactacaggcaggtgccaccaaacctggctaatttttgtatttttagtagagatgggattttgccatgttgcccaggctggtcttgaactcttggcctcaagcaatcctctctcattggcctcccaaagtgctgggattacaggtgtgagccaccgtgcccggcctcttactataaatttttaatttattaaatttcagctggtgtgtagatgcaagttgattttactgaaaatgtaggtaggttgacattagcttaggaaatataatttcgtgcagtaactcatatgcttttctcccaggatttgtgtttcggcagaatacagatttccaatttcccttctttagatctataattacttaaggaaggttacacttcttttaagcatgagtcagtatatatgataaggcctttacagaattatagaagtaaaaacaataggtgaagttttgtttaactatgaaagtttttgctttatagatgtttctaacagtctatgatttagctgctaagggatgaggttcaatagtattaagatattctctccactatataccattagaattgatttttcctcttaggagattttcaaaagcaattctgaaccacccatttctgaattaaaaatacttatacatttttgtcaattagatattcatccactttttgtcactgtctcccaaaaaatactctatgaaagcattactgagccccaggttgggttgtttctctaaactatttgaagttttctaacatagtcctcctttgtctactaagacgtcagtagtttaacaactctggatgtcttagtctgttcaagctactacaagaaaataccataaactgggtagctttttaggaaaataaatttatttctcatagttctggagcctataagcctgagttcagagagccagcatggctgggttttgtgaggccccacctcctggttcatagacggcatcctcacaaggtgaaaggcactaatcccatttagaagagctctgtctcatgacctaatcatcttccaaacgctccaccttcagtgacatcaccttcagggataagatttcaacatgtgaattttggggggatataaacgttctgaccacagctctggcctttggagagacttcaagcaagggttgtaagagaggcaggtgtttggatgcaatgacagacagggcctggaaattgagcttaaattaacacccaagtagagaaaaggctgttctttctcaccgatattggcagccctacacatttgtcggttcctcatctgaggagttaaccaactgcgaattaaaaataatttttaaaaactaacaaaaatataccaacaagaaatattacaaatcatgtggtatagcatctatttgcatatcatttacatagtattaggtattataagtaatcaagagatgatttaatatatacaggaagatgtgtagctatatgtaaatactatgccattttataaaatggacttgagcatccaattcaggggtcttgagaccagtctcctctggataccaaggaacgaatgtgcctctttctgagagccaggccgtttcctagtaatgcaactataaaggcaagcatcacattttttgtgtgtgattatctaacatttaagtctgaaccaagattttggaataaacgttacagtatctatatatggaaatgaaatgtaactattttttccataacatgaggtatatttgatataaaccattttatataaatctgcctgcctcattttctttcttcttgctttctttgcttattcaaattgaacaagtacattatacatatatatgtgtgtgtgtgcatataaacatacatatatttttttcttaacatgaggtatatttgatataaaccattttatataaatccacctacctcattttccttcttgctttctttacttattcatattgaatgagtatattatacatatatgtgtgtatccatgtttatatatacatatgtatacacatatgcatatatatgtatacacatatgcatatatatatgtatacacatatgcatatatatgtatacacatatgcatatatatgtatacacatatgcatatatatatatgtatacacatatgcatatatatatatgtatacacatatgcatatatatatatgtatatatgatgtgatattagagatgtgatcccactcactgtgttgcctaggctggtctggaactcctggccctatgtgacccccccctaccttggcctcacgaagtgctaggattacaagtatgagccatcagggccagagaatactttctcttaaatcaatgtttaaacatctttgttgggtttcctaatcgttaagagtaaaacgggttaaagagcacctctggtgctgggctgcatatgaggagtctgagtcgcctcaggtggcagtgaaccttccaccctggtgatgtagggtaggggccttcagacagggcatactgcaggagtgaggaggggccgcaagttgcttctaggtgagtctgaatgaaagatggacttagaaaactggaaagaagtataaaagcaaaaccctgaggttgtgcttggccagatttcgagcacaaataatgtattagcttaattggggagtagatgtagggtagtagagggagataatttaaatagcgaggtagaaattagtaatgactaaacgaattgatgagctttcatgttatcctagaacccaagggagcactgtttgatgtgggcttgttatttggaagtgaggtgtaaaaggagacatgataaacacagtgtggggtagatgggagcccaagagtgtggagggaggaaatctactgtatgttcaggtatagtaggatgaggattaagttgattaattaagttcagaataggaaaagaggagataaaatgttgaaaaaaaaggttgatagaaatttaaaaaacgcatctgtagttcaagtgaagatttaaatttagtttgctagagttttgtacagtaccttctactggtcggtactcacctaggtgttaggatacagatacttagaacaagctttgtttgatgggtatagagtttcagctggcaagatgaaaaagttctagagatctgttacacaacagtgtgaatatacttaacactactgaactgtacacttaaaaatggctaagatggtatattttatgttgtgcattttttttgccacaattaaaacatgaaaatattaacaaaacaaataaaccaccaccacaacaaaaaccaaggcatggctcttgccatcaaagaacattcaataggatggtctagaatgtggtatatgtgagagtgagggaggaggagttgctctggtgtgaaatacagaggagaaggaggctgactctgcaagagaatgtggaacaggtgaaatgattttgctagggagaaaataattaataataatctctggggcttgctaagggccaggcttatttctgtgtttcacacttatggctgattcagttctcaaaacaaatctaaaatttgggtactattattttctctctattgtatttgaggtacacagaaaggagagctgggatttgaacgctggcagcctagctctcaagcctgctttcttaattactatgctaagcatcctcactgatttacttgaacaagcaaacaaaatcatttgacacttaaaagagtcattagcattgccttaggtattttacccagaaacagttattcaattgtataaatacaatgatgacccctggaataggtgaagtccaagagtagcattttggcgcaaacaattctgtgattcctgggatatgacggaaagaaacaacagaaagagtaatcttttctatttttttatttagttacatattgacatttgagagctcattagtttattccagtaatttgattttctctgtacagttcctagttgtcaaatattagcatcaagaaaatccatcactttcagttctcattgacatgtttgcaggccaaagcagcttggagattaagaatccaatttataagacaagtcatctatcattgaatatccaaagataacttgactaagttttatagaaaaagaaatatgataatagcaatgatatcttactactttaggatactttctggagttttttgagtcattaacatatttatatgcattatttcattgctatatgtatttgtggacatttgctgacttagatagtttcaaagttcaatacatagtatcattaacattggtctatttgactttcaaattactctttttatttttttatatttaaaaatgaatcaaaggaggaagcatagccttttcaaccaatgatgctgaattaaatatccacaggcaaaaatataaatgaacagaaccttgacttaaaccttacaaattatgcaaaaattaatctgaaatggatcatacagttaaatgtaaggcataagactatatatatataaatatataaatgtaaatataagtatatatgtatatacatatatatatatagagagagagagagagaggcaagttctcactctgtcactcaggctggagtgcagtggcgtgatcacagcacactgcagccttgacttcccagactcaagtgatccttccacctcagtcttcccagtagcttgtgctacaggcatgtgtcaccaagcccagccaatttttgtactttttgtcgagatggggtttcactctcttgcccagactggtctcaaacttttgagctcaagctatccaactgccttggtctcccaaagtgctggaactacaggtgtgaaccattgggcctgacttaaaactataaaatgtttaaaaaataacgaaggagaaaatcctttgtgtctagaatttggtgaagaataaagcattaaccaaaagacaaaattaataaatttgactttattaaaattaaaactttaattcttttaaagatcttgtttatggaaaaaaaagacaagctacatacagggagaacatacttgcaaaccacatatctgaaaaaagcatatctagaatttataaagatatatcaaaattcaacattaaataaaactaataatctgacatcctttttattttaaaataagtatacacaggaagtatgtctactactagagatactagtagtatctctcttagatcctgtgaatctatacttagtacaaaataaaatattaaaattagttgtcgagctatcttaagtagacattaataatatacataaaaatgaatttggaactgaatcgttctttggaaagcatttgaatgtttgtttttcttaaatattgatgaattcatattttgagtgtccatgatctgttaaaaatcttattcaaattcatgtatttactgttttaaatttatacatttaacttgtgatacattctgtgtacagtttcatgaatttatcttcatatctttgatttttgttacatcgcagttttttagtttaaggatagattttatttcattttcttttttaggggaagggaaagaaaagagaggaatgtttgttcatgggagtttggcaagaatgcccaaaacatgacttaatgagtagagtgcattatggagctggcaagaagtccctactttaaacgaggttaataaagagatgcaatgcgtcttgatcctttgctgctaaaattatgcatggattattgtgaatatttctaagtacctgtttaaattcaccattacaactgaaatgtcactatcggagaaagatcagctgggcgcggtggctcacgcctgtagtctcagcactttgggaggccgaggtgggcgggtcgcttgagcccaggcgttcaagaccagcctgggcagcacggtcaaaccccatctctacaaaaaaatacaatagttagccgggtgtagcggtgctcacctgtagtcccagctagtcgggaagagcccaggaggcggaggttgcagtgagccgagatcgcgccgccgtcgcattccagcctgggtgacagagcgagactcgtctcaaaaaaaaaaaaaaaaaaaaaaaaggagaaagatcaaggagttttggggggtggagggggggacgcaggggccggagtctcgccttgtcgcccaggctggagtgaggtggcgcgatcttggctcactgtagcctccacctcccggattcaagcgattcacctgcctcagcctcatgagtagctgggattacaggcacccgccaccacgcctgggtaatttttgtatttttagtggagacggggtttcaccaggttagccaggctggtttccaactcctgatgtgggctgatgcgcccgcctcggcctcccaaagtgctgggattacaggcgtgagccaccgcgccctgccgagaaagatcaaggatttaagactatgtcccaagaaggaaaagctaaaggaataggaattattgttccaggagcattaaagacatcagtagatcctatcgttcctacccggcacctcaagaactattctcccaaagagagaatacatttattctatttaaccttaagaaagaaaaggatcagtggataaaagtttcagcttttcctcggtgtgccatacggtgattatgctatatgtgttctttcctgggatcttaaggaactgtgggccaaccaaaacaacataacctaataaacctaaataataaataaacctaaaaagttgcataaaatatgttttgatatggctttgccttacgtttttcctcagaggaaaactgaatctccaggataatgaaacaaggtaacaagacagttctgatgccctttcagttgcagaataattctcagcactttcctatacacaaggaattcaataaagtagaaataattttcttaaacttagcattatcactgttttgaaaagtccttgaaaaaatcccgtttgtgcatacgtcttgcacgtcttatttcaaaatccattgagattgtaagcaattaaatcaattgcattttgtagaccaacccctcatttgtaacatgtaattccccaggacccatgtgtccagattcaagagcagcttgatagaaagactgatttatttttattttcttcctgggtctgctttgaatattcttaaaagaaggaggaaaatgctgtgtttaatattcatacaggattttgtattaaaagcagcttctctcaaaagcctgttgttaagaaggactacctataaaggggtcaacttgtgaaatccttcctaagtacttatttggttcttggggattgatggataagctgatggagtctaatcttcaaatgtgtatgtcattaatagagatgtaagaatctcaatgtgctttgtcttttcctttcctgacacattataaggaaaagctttactaatgaagtacccaatggcaataacccattatatgctagaatctctctttgtatcagatgacatgcaaatgaactgttctatttctgtggagaaagagagacaaggagcggtctagttaatcatacttgaggactgcatggttgtcttctgggaaatattatcatgattcattcttatttaagggtcctcaccctatgcataagaaaatctcccattcattccatttgggtttgatgttaattataggggcattaacggaagctttctcataagaaatgaatataggattaaatcagaaaataataaggcaacctttagatgaatcaggtcatgatagagctatacatgtagaagctggcaggttggaggaagtttagagatcctcagtccctttgttgtttagatatggaaactgagtcctggaggagtgaagtgacttaactgaagtcccagctgatgagaggcaggcatgagatgacaaacgaagtagcctctttcatcgggcagcaatgtagagaaagataattctgggagtttaagagaccacgttctgaccattttctactattaactactcctgtgatttggggcaaaccttttaccttctctggatctgttttcttaaatttgaggtgagactagactaagcatttgccctctggaaaaggggaaatctaagcaagctcctataggagattagtgtgtgattattattccagcttagttcattggaaaaaagatatttctaaggtatcatgtatattttgttttcaaaattgaagacaccagccttggatatcaaataaatttagtagcacttttaagctaaccttttccctaagccatgaaaagacttttttcttattccagaaaatattttattttatttttatagcatttctttatgtgtcttatagttggcaagtaattgataatattgctggtaaaatgaggcatttccttaatcttacatgtcttgagaaattagctgttcatgtatccatgtctacacagtcctcgttcaccttgtgaccatgtaattaagtcatttttcttttccaatcagccattcaggtctaaggcaaatggttttttgaaagattatgcacaccttgtaccagtacttctggtccctttaggtttaaagtgtacaagtagagattcctagtatatcaactaaattattttcttcctttaaaagagaaaataatttttttaaaaaagcaaagaagtaatttttttactcatatatttgacttacaccttgtatataaaatgttttgttaggtgaaatgtattttatctatttaccaaaacattttcacccaaatagcataattttacaagtagcagtcatatattaaaccaacatcacatttgtcctctctttgaacccacattatctgaactactgtaaagatctttttcctgtgagtgtttttattttattcatttttttaaaaatgttatttattttgtgttatattatcttcctggttatatgtaacatctttccatcttagatatgttggaaactccagaaaagttttaaaaaattaccaacagaaataaacaccacttcttccattgtgttttaatttcatttctgtcaactgtatgacttgaatagacaatctgtggaatgaatttagttttagtactttaataaaataaaatataaaaatactacacatgtaagtaaagtaatttagagaaatttcagaactagtttttctatttttcaaagaatatttagaaagcttaaataatagcttgcacatgtactcagaaaataggagtcatctaaattgcaaacttgtttaataagttcttccatatatgagcgctatgtcatcttcaaagttttcatataattggcatagtgctaaatattttataacacctctgtaaaataagttaaaatatttttctgccacaaaacattgtttttttagctttctaactcttgtgatatctttgtgaatattagccctttctctactttataaaccaagtaacaaatacaataagcctcacattttacatagtaaaaataagcggaatcatcattactccgtgaactaaccgaacttttatagtccctttaaaaatgttcatctgttgttttgtttgggagtttaaagatagtttattctgcatttaaagatactgtttatttcagtacatagatgcatttgaaactagaaagcaaatttagaatacttttgtatttgtttgtgattatcagtccaagataaaaatggtttatcttatccaactagtctttctttacctataccagagtcctcagttggagtgacctttggagtggctggtgtcttgggtgatgtagttaatgagatctagcgacatcatgaccctgaccccttcgtggccctgactcctctcatccatcttcttaaccccacaaggctgcaagtcagtgtgtagaatcaggattaaacaagtgtgaataaacaagttcaagagttttctgcagggctgccagtgcatggcagtagcaaagtaagacacagagaacttaatacctgaaatgctctttgtgcacctccacgaatcctgttggagaaatcagtaatgtttgtggtcagcgtagtgcgtctaatctcctcagttcgctccattcctggacagtgatggcagttggtctttataatcacatagctgttggcacattcaatgaaagcatggctgatctatcacttacccaatgtcacacattgctaaagcttttatctcattaactgtgattaatgtttgtatggcatgggcttgtcatgtaactgttcatattcagcaattgtgaatcccttagtttacttgatgactgaagggtatttctcgtttcagaagagaactttatcttaggggcccagcagcctttttgcaagccaccattgtcacatggcttgagaactgtgtgatgtagcccttccttggctccttctccattactgtccttcagggtgttacttgccattaaacttggacacttagaaaaaaatacaagaaatgtagtagaacttcaaggaagtatttacctgtaattctttcgtctaaacattgcttttctaatatgatttccaattaagtctgtgttcccaaagtcagatggaaaggggtagagatgatggatgcaggtattttcttgcctttggctacggttcttgtctttttctgtgctatgcttggcaagtctttcgccttagcccagggcagcctttggtaagttgaccagtcagtgattaaacatatttatttagttcagtgggtcagagctattgcgacagatagaaaattactgatggattatcaatttcagcacctctgacatctggcctcagtgtagtccatcatctgaggactcataacacattttcttcaacaataacatgctcagctacctgtgtgatcacacagctgaatatcggaaagattttgttcagatttaataagacaaaagttgcagaaatcagacgagttctgcacctatacttgagaatctaaaagcacccagtggtttacacacaaggctggaataagaactgacttgcactgtaaatatgctttgttgatttttgtgatatttttataacatttttacacttacattttggatttgatgaaatagttacttggaattattttggaaacaatgtgacatataaaaataaaaatattacttgtttcaaaatattctattaaaaaatttaaggcattaaaataatggttttaaatgtttggtctactacagtgataaaattaccaaaataaaaccccaactcaaatacctatgatactaaatcttttaaattataaacaagatgtgaaataagatttgcaaaatttttgtgtttattgttattgctgaatggttcttttaacccaagggagttctagtaataaagaataacaaccttattgcaaatgctaatctaacacagaaatgtattctattcctctgtccattttactatatctcagtataattttcttcatatctgtatttcaaagttctacataaatttaagaataatcttgattcatttttcaaatgattaaggttagcagtttgttttatggtaagtttatgtcttttaaaaactggttatatttgttgagaaattaatagattgtggcagagaatacattgtaacttttattttggctttattctcatttgtaaatctttcatgtgattatccctaaggctttatactccttgcacctaatggcctactttctgatgagcctacatttaatatttatgtgtgctgtcataaaaatatttttgaagctaaaaattattcttaatcttcatatgatgcattttcacacattctcttgaattactaaactgataagaacttagaaatgttacctttgttcacaaaataaggattgagctctttgacattgcagtttacatttattcactaatacaccagtgctatgtgccattaaattgaaaggccctttggaatgtccagctttttacaatgtgatataatgtggcaatattacaggttattgtgggccattatttattgtcaaagacttcctgatttgtcttagaattaagtgaggtttcttctatagttctgtggaaacctttagtagttgactatggcatttaattaacccatctctcctttgatatctcagagctggcttggaaaatgttgggatgaattctagtcacagaatatgctcagtaatttagattgggctgaaaaaactgctgtggatgttcaaaaaagacacaatttaaaaaatgagggagatcagattagaatatgagtttgatttggaaattcatttgagcagttgtagggaagccattgtaacattttttccttaaagattaatccctataacaattagaacactaaacatttattggttttaaattcttaaatgtgatgcctagcacttatgcttcctcagatgttttacacagttattttaaaattggagatgctccctacgtgcactctatttcgcttgatgcccaagtttccttttgattttactctacgccattgacttctctctgaaatgacatgtattataaactatacatgacttgtcaggagcaggtcaacagatatttttatgtaaagcaagcatgcaataacagaaaagttatatacagtcacgcattgcttaacaacagggatatgttttaagaaatgagacattaggcaatttttacattgtgtgaacatcatatcctgaacttacacaaacctagatggcatagtctactacacaccttgactataacgtgtagcctattgcttctagcctataaacctgtacagcatgttagtatactgaatattgcaggaaatttgatatgatttggctctgtgtcgccacccaaatctcatcttgagttgtccacttggggagtaagggacctggtgggaggtgattggatcatgggtgagggttcctgtgtgctgctctgatgaatggtagtgagtgagttctcacgagatctgatcctttaaaagtgtttagcacttcccccttgctctctcttctcctgccaccttgtgaagaaggtgcttgcttctctttgaccttctgccatgattgtaagtttcctgaggcctccccagccatgcagaacagtgagtcaattaaacctcttttctttataaattacccagtctcaggtagttctttatagcagtgtgaaaacagactaatacaaaattgtaatacaattgtaagtatttgtgcacctaaacatgtgtaaacgcagaaaaattacaataaaaatacagtattataaccttacgggactatagtcatatgtgcagcctgttgttgtttgaaacatcattacatggtgtatgactgtatattattttagcataaagattacatggatcaaaccagtagcatgaacacttgttcttccatcaaaattaatcaacttagaagaaaatatttatgaatgtaacttgatatgggtcaaagtttctttaggtaaagaagcacggaagtaaaatctccagatgctttcacatagaaacggatcttatctgttacctcacagggaaactgagaaattaagcaaagtaatgcatatgaaagtacgtcacaaactataaagagctgtaacaatgcaagtattttaatgctgtgtgagttttttggtacagaccaagaaagaaagaaaatacatagctatccatttttagaggctctggactggcagtctaagagttgcggttttatggaattcacatcgacatgtaatgatttttcatgtgagcacattgacattgtccagtttcatatagtaaaatgtaattcagaaagacactgagaaccacagttttaaagtactgccttccttctaatgttcttgtcattcaaatgtccttgaaagcatttgaatcagtaattttgaatgactgttatgatagaatgtttaataaaccctattaagcatgaattattttcttcacttctcttacaatactggattagtgttttgaatcatcaacaaccttgatttctatactgaaattccattttgttagcatcatgatgaccgataatgattacaaatgtgtagagtaacaattattttaacgtgtaatagacattggcatttattccatgtgtccggcatgaacatttgtcctacgggcaaggtagtttggagagatatggcaaagaactaagtcaatgatgttgatatagcaatctaataactttactttgatgacctaaaaagatttaggcattgggagaatctggaaaattatgaagcttctaaaatgtgtcctgaagagattcaaaggaaatcacatttttctcctgctctggattgattcatactataatttacctctcataaaactgatcatatgttaatattaagttaatagttgtaagttgatagtaaaattttaaatgtggagtagctgcacaaaatatggaagaaaagaatttgcttttattctgtgaatttaagattagcctgacgtcgttatgctcattttagcagttgcaaagataaaattcattggcatagctggaattacagtgataggagttggctttgaagaaaaatcaactttgccacctattgccttgtctgtattcaaaatagtatacattttagctaagtttgaatgtggacttaaataaaaaccaaaactaaaagataagaaaaagcaactgagcagctttatactgagcagaacagggaacttaaacaggcattggtattttgaaattgatttacatgtagccagctttgtttaccatactccttacccttagaaacccaaaataatttcttattagtcagtgttatgagcaaattaatggtggaaagaatgcagatgttttattattattattatttttgagacggagtctcactttgtcacccaggctggagtactgtggcgcgatctgggctcactgcaacctccacctcctgggttcaagcgattctcctgcctcagcctcccaagcagctgggattacaggcacctgccaccatgcgaggctaatttttgtatttttagtagagacggggtttcaccatgttggccagtctggtctcaaactcctgacctgaggtgatccacctgcttcggcctcccaaagtgctgtgattaaaggcgtgagccaccgagcccagccaaagtattattatgctgacctgaatacatgctcaggttttgatattcttttaaaattctttcatattctgtcagcataatcattttaactaatatccatttcactatgaattcatgtaagtccttcattggttgaaactgagtggggaatggaatatcctgattttaaaattttctgcttaatgatacctattacatttttaattggcttctactggaatggggaaatacaattggattttgcatccagcaatcttactgacctctcttgggttctctgtgaaataattgttttatctgcaagtaacgaaaatttctcctatttgaataaaagtcttatttacttaaattaaataataaattaattaatattttctgcttaactacttaagccagatttgttttgtttaagccaccatgctctgttgaaatttttcttgtaggtattgttttatattatatattagtgttggaattgcttggatgattaagatctcatcagggtaataattctaagtgtcagttttctctatattatagaattatgaatatactatgttactctacagtgtaaaattcagttttcatccacataaattgagctttaattatgttctggaaattttcatacacatttcatcttcactgcaagccactgatatttagaattttattattattattctttttgaggaaatttaatggcagggtagatttttttaaaaaaattgcccaaagcctaacagctagccagaggggatttttgaatttccatgtgttagttcaatgacctggatattttttccacttcacacaatatctagagtgtttaatgtaaggaagaattcttaggattgatctctttgtgaatataaagtgcaacgagactttctgattatgggagttcaggatcttgatttactgagatgtaactctcttgttctacacagatgaagtagataactatttttaaacactgaaaggtgtgtgtgtgtgtttatgtctaaagagagaggaaggtagtattaaatattaatctgctccccaactctaaaaatgtagactctttgatttgtggtcatgaacatattttcttgtttgatttcaaatttcagtctagtgtcccttgccccttaggctgcagatgtcaatttgtggtcatccatgccgatgtgtaaatgagtaagtgttgccccggcaaagagctgaggttataatttagccgtcgctgcccctttgcttttgtgtggattaaaatagctactatgtaaaatcttcattaattttcatattcggagtatatgtagaaatccacaaagttagctaatttaaaatcagattattattacactcatagtaaacccatagagaatggccacttaaaaggctgaagtcccgtcaaacacctttttttaaagggatgacaacataaaaaatgaaccaatgatgcctcaccttctcagatctgttccacatgtggtgttgtggtaatattgtgagcactgaagtattaaaacagttttgtcttgtgttccctcattctgacaggccaatgacataatgtcgacaagccatctctgatagattcaaaattgaaagtgaatacactgcctctttttcctagttcacactaatggtgtttgagtcaacgtgctaatttcactgcttccaacatacagtcctccctagtaagtctgggaatagcttgtgaggggctttttttttcaggctgcaaagaactgtttgatcaaagtcattactttgttattaaaggagaagaatggagaggaatcagcaataaaagcaaagacaagtttaggatctgaactctgaaaagcagtttgccaataaagatattaactctatatgatttaatatttccacaacaatgttaatcagttgattttcataaacatacatggactgggagtattaacaatagtaaaggaagaaatttagtgttctgtgaattgatttttagttctatgccatattatacagtcctataaaggaagataataagctataaaaggaaccagaccttatcacccaggcaaatttttgttggtttgtttgtgttttttctgcagcagtttccaggaaatcaaaagttttgcttctctggctatataattcaagatgattcatcaaattattgcttttacaaaggtgcaaaaactttgaggagttagaaaataattgaggttgattattggagcactttggaagtattttgttcatttatttatttaatcactgaaatagttactagagctttctgtgaatttagcttgttttggtgtgtattaaggtgtggcccttgccttttgactgcttgcacactaatttgaaaaattagacatacacatatgaaactgtttaacaattctagagagtggacaagaaaatgataaacgtaggtaagggtagaggacagcagctttcatatatatatatgtatctatatagatatatagataatctatatgtatctagatatataatctatatagatacatatctatatagatgcatatgtatctagatagatatataatctatctatatagatacacatatctatatacatagatatataatctatctatatagatacatagatacatatatagatacatatatagatacacatatctatgtagatagatatatagattatctatatagatacacttgtatctatatagatagatatgtagataatctatctatatagatatatatgtatctatatagatatatatatgttcacaatggtgtgtaaaacatacgtgtgtaaaacatttgaaaaactgctttcttgcaataaaatcctactggaaatcccagtgcccagtgtctagatgggttaaaggcagatattttctgctcctttcgttctggatacttcaaagttcaaatgattgaaaattatttttgtaggatcagggaggcttgagccgaatgaaagatatgagttagaggaggtgatgaagcctccttcttcagaagatgtcttttgaatggaacaaaatttgaaaaattggaagagaggaaaatggagcatatcagaaggaaatagcacggtgaaagtagacatttcaagccgggaaagagtagcgtttttggactgtgagaagacccatgtgataggagtagagtttatattactgattcatgaggagcctgggttaggagaagccaagctaacaggagccacaaatgccaggcatagatatttcgaagaccatccaggagtcagtagtatgtatatattcaggaacctttgaaaatggacatgacacaatgtgatataacataagttatataaatgtggagttgtaggagtgggttactgtgcaaaatataatcagggtaggaaaaacttgaggggtctgttgtattcttgcattcacttttggtaataggtatactggcttcagaaatagtagtgcagttaccttaattttagtcataaactaagtatacaacttgtttaggcaaccatttttagttccaattaaaagtaacaaataaagtatccattataatttcttacagtttccaaggtcttaccctctcttcctccctcccttcttccctttaccttttctctcttcttactctctatctttattctccctttctttcttttttccccctttctttcctttttcctcttcctttcctctttctgtatctcttcctaccatataatatcctggacttttactcattataaatacttaactctaatatgatatgattatatcctcatattccagtaacatcagaattccaatgggaagaatctaggcaattttaagatatataatttaaataatggcatgtccctacttttgctcattttccaggtagtttttagatacaagctttctttgctatgaaacctggaactataataaaatttaggccagatattcacacttagtggaaaaaccatattaactataatagttgtggtctgtctgcaccacgccaatcacagtcacatgagtgtctgtggatttctgcttctaagggtgctgtttatataaaccaggtgactatagtgaaggaagagatttgcttttgaagcataaatcactacaaatttcaacctgtccaggacttatatcatctgtaggtgtttgttttgttaattactttgcatttcattcagatgtggtgctattgctttagtattctaagattaactctgctgaatttgggggtcaaggtctctatcatttgtttcactgataggcacacaatattctttcttcttaacgacgaaaagattgatcagtgaaagaagacaaacgctgaccaagctacacatcggtatttatgtccgcgtgcctgatcaaaagtgtgatctgagtgaatctaaacttttcagcatgaggaaatatgaaaaaaagtgtcttagatatagaaaaagtttgcttcaccataattataatgctttttcaatacaggtatttaccagttatttagtatataataaagttgttgtatatatataacttaactgaagtataagttgattaacagccaattttagagtgcaatttttagtaattcatatcataaaataaactatatacaattgtcataaaaatatggctatgtttagttcacttctacttctgaagtactattagttgtttcacttatataattaaaggaaaacatgtttgcagagtctagagcctacaaattcaaaactggttattatcatttattcagctcccagcgattgcacacatttgaccctaaatgacaaagtaaatgaaagccctttttcaaagtaatacaatcagttcaaaaaatattgtgctaataaagttatacattctaattgaaagattgatggcaatccatttagttgttactaggttatttgtgacagacagatgcagagtaacctcattacagtcagaattgtgatgacttgtagctgaggagaggaataaagctttaaaccattgtcacagtccctttccaaaacgtattcaaagatgatttaaaagaaaatatatgaccattaaatagaagttcgaattggttacctaggagtgttattatagaagcaatgaagtaatcatctgtttgatccacaattggcctacttaaaattcacaaatcagatttacagattccaatttgtgtaagagaaaaacagtgccaaatactggattaaaaagattatcccttgtggtttggcatttttagttcatatttttagttgttttcttcttgatcatcaaatatatatcggcttattttagacatttctgcccacaatcaccagttcatgataaattattccacagtattcatttgtacgttgtccaatagtttaaagtcaggctttcagcattagtacccaagggaactctatcaacattctgaagttatgtaattgagaaaaagaaggaatatgggtggatatatatatatatattttttttcctttgaaagatggtgaagtctttgtgggatatatttcatgtatatttgattttgaaacttcttttttttttttttttttttttttgagatggagtcgcactctgtctcccaggctggagtgcagtggtgcaatctcggctcactgcaacctccgcctcccgggttcacgccattctccagcctcagcctcccgagtagctgggactgcaggtgcccgccaccacgcccggctaatttttttgtatttttagtagagacggggtttcaccatgttagccaggatggtctccatctcctgacctcatgatccgcccgccttggcctcccaaagtgctgggattacaggtgtgagccaccacgccaggccgaaacttctttttttcttaatgaaaaacaaggtagaaatgttgacctacaggaagctccacctgctcctcatagtcttcctactgcaatatttgcatgtatttctaaaatttcttatgttcaggagcaccttttttgtttcaaatgtgacagtccggtgctatgcttggcacataaaacccgttttattctgatcacttctcatttgtggtttaatcttgcgcacagttgtccttgcctctctcctgtctcagcatttgagctttctgttactcttgtacatactgaactttttcttgtgctcctcactatcaccaccatgtcttttattatagatatctttcaccatgaatccttttattatagattatttttcaccatgaattctaaaattctcttacattgacaaaagtactctttgcaagaagactatttaccaacttgaaagaaggctaattctatttttttaagtgaatttctcaaaagaagattttcattgtgtgggtaagtcagttaaatatctattgggtatttcttatccgctagtaaacttaaaaaaggtgttctttctaaggtagtgtctttccataaagttgacattttatctttcctaatcaggaaaattaaggcctcattcccttgtaggttgtgttatcagttaaggctaaagttttgacttatccaagcaggtgaattaaagaatatgtaataatagagtcttaaccaacagaacaccagtcagttgagaggttgtgtgttgaggtgaaagaccaaggactgaaatgggaatgaaggaccttccattcaatcctagttatagatcatttaccaaagattacttactagctatgtaaggcctcagacaaattatttagtgtctgagtcacagtttttcgcctataatgttaaccagctttgatggttctaaacttataagggtgtggtgatacttatattttataattaaacgtgatttattcatttatgattcattaagatagaaaatgtttcaaaaattatacttacttctcatttatttaagcaggtgattatgggaggacttctagatgccaggtgcatatccaggtgttaaggctatgtcagcgaataagctagaaaaaggcctcctagagcttatattctcagtgcttacctattcagtgcagaagcttgaaacctatatgaatgtaaacacagtagtcctttcctcattgctttctaggggcgctatcctctcattagtcatttaggagacctcttggttatcagatcaaaaaaacatggtatatactgtacagtataagctttggtactatccctggtttcagatatccaagtgggggttttcgaatgtatccctcatggataagaagggactgctgtacacaaaaataaaactactcaacatttcactattaacaatatgtggatgactaattttttgcacgtttttgtgtgtactgtgttttgcaatatttttttcagattgctggtgtagtccatctattttgctttcttgtatgaattacataaatattttcccatattatgtttttcttcaccatgatatttaatggtggacctttcatcccatgttctgtgctaattttcttaattctttgtcattggatatttaggatgtttctagtttttcagggttgcatatgaatatatgaactatgaagaacataccgtgatacaaatccttgtgctcaaccttggttatttcctttgaataaattcatacagtagaattaccagtcagtgagtatacataaaaatttaaacttccatcaaaaaatatctgaaaattcaggcttactcatttcttttccttggatattttcctttgctaatatgataggtgaaaatattattgcataataattttactttttatttctagtgaggctaaaagctgttgcgtgagtattggcttaatctttctctttttgtgaattgcctatttatgtttaagtgttttctccttttggagtgctctttttagaaacttttacaactgtctttttttctactaattatttctttatttttagtaataattattaattattactaattatgtgtctttatttttcaactttattaatgtttacttgtcaagtaaaacttgtatatatttatggtgtacagtgggatgttttgatatatgtacacattgtgcaatgactaaatcaagctattaggtttatgcaaaagtaattgtggttttggaccatgaattttaaatcattataactaggctcaaacacatctttattaatcaaaataggaactattacaatcaacacatttttgccaatgagaaataagtttgtttattcctgtagcataaaaatctgtgattggggatttgacgaactcttggaaagcattttctgcattctgcaggttgtggaagcgtttttccctgcaaaaagttgtcgagatgcttgaagaagtgatagtcggttggcgagaggacaggtgaatatggcagatgaggcaaaactttgtagcccaattcgttcaacttttgaagtgttggttgtgcaacgtgcggtcgggtgttgttgttgagaagaattgggccctttctgttgaccactgtcaggtgcaggcattgcagtttttggtgcatctcatcgatttgctgagcatacttcccagttgtaatggttttgccgggattcagaaagctgttgtagttcagactggcagcagaccaccaaagagtgaccatgaccctttttttggtgcaactttggctttgagaagtgctttggagcttcttctgggtcccaccactgagcttgttgtcactggttgtcacataaaatccacttttcattgcacgtcaccatcagattgagaaatgacttcttgttgcatagaataagagaagacaacgcttcaaaacaacaatttttttttattattgctcagatcttgaggcaaccactgtgcaagctcttttatctttccaatttgcttcaactgttaaacaaccacagaatggttgacattgagttcttcggcaacttttcatgtagttgtaagagggtcagcttccatgatgactctcaaatggtcattgtcaacttccgatggccggccactgcactcctcatcttcaagcctctcgtctcctttgcaaagcttcttgcctcaccactgcactgtacgttcgttagcagttcctgggccaaatgcatggctgttgttgtgaattgtctctgcttctttacgacacattttgaactcgattaagaaagtcacttgaatttgctttttgtctaacttcatttccataatctaaaataaatatagaataaacagcaagtaataagtaattagcaaaaaaaaataaagtgagaaatgtgcattaaaatgatgtataacataaccacatttatttatgaatgcattccaatactaaacggcaaattttaacaatgcaaaagctgcaattatgtttgcaccaacctgatatttagcacaggcatcacctcacatacgtgtcttgtttaatggtgaaaatatttaagatctgagccattttcaagtacatacattattattaactacagtcaccatgctttatggagtttttattgatacgtacttcaatgcttggtatatatgtaacacattatcctctttccatgcacctctgtgtgtgtgcataaaggtttttcattttctatgtagaaaaacttcaaagtaatcgccatgattttctagtgattgctttaaaatggaaacatatatgattttccatcatttatatatgaattattttgatacactgacagtatggttagcattacgttgtgcaaacttctttcgttaactagttatggaagtgaaatttttttatttctgctgttttttcttattagagtattagaatttcttactgctttttcctttgaaatatatatattattggataagtttgggacactgccagccaaaagtgaaaatggcattaatgggactgagatgtacagatccagcatattctctatgtgggtatcatttctacctttctaattctaatggcttggtggaaccttaggcctacactggatctttggttgaaagatgctcccctccacacatacacacaaacctttccctctgagatatgctgaaggcatctgaattttcttccttagtattcatattttagagcaggcaaccaaaaaggctatgtataggcaggttcttttagccttcagtagcttgctgttttgttgtgttctaatggcattagatgtttctagataagtctgttctctccagatttactcatatctagcatgtttttcatacagattacttggctgtatccaggtggcatgtacgtttaagatagctgcattagtggttaaagaatgctaagcaaaaacaaaccaaccaaccaacaaacaaaaatcaatagtaaaaagagattggagatccttaggagatattaaacctgccagtaacataaggggaaatatgtaaccttcaagaatccataaacatgaaaagtaagttgttggtaagctctaaactcaatgagggaaggaactatgtatttctttacattaaaaaaacctataccacatatgaaagtgtctagcatagttatcaatgctccataaaatgtgttgaatgagtacagcatagtctccattctctttttataatttacttgtgagactagagaatttaggaaatattcttttgtttatcagatttgacaatttaatttttaaaataattaaattaattggaagaaaattactacaactttctggtagagtgtttatatacgtttgtgagtagctgtgttgttttaaaagagtaatattctaaaatagtgtcattaaaatagggaaaatacattattaagttataaagtgaattcatttgaaatcagtcatttaaaatatgtttaaactggattaatttgggtgcatgttttcctttagaataggacctaatatattgccatggctcactcttaaaattatgagaattaaaagaagcttattataatctttacccacaaaatgcatatgatttattatagggttgtgatttttatccaacactcttgtattgaatgatgatgtttaataatattgtaatactgtatgtcagaagatttattgtagttttgatttctctgagccaagagacagagtacttggatgtgttttggtggttgttgactgataagcaataaaatgatcctacatagacctcagtggtaaatgtttttccaactctctctgattaatatgggttttttttggtgtaatatgtcaattttatcagatttaaatttatcattaaactagctggtagtttcagcccctggaaaggctattttgtctgagctatcatattttaagcaatattatttataccacaaggaaggtcctgatgaaaaaaagtcattcttgattaccgtttgatcaaccaaaaatgtctctataacattagatgaaataaatgaactgtatagctgtaggatttgaaactttcaactattgcaaatagatgagtagaagtttccattcactaaagagtcactacatctcttttggccactgatttttttttttttaagtacaagagtctttattctctagagtgtgaaaatgtctacaatactgtgaggcactggaaaaatgaagattactaaagatgaaaaataattcatgtaaaccgtgtgtggtaagtttacaatatttttgagtttaattcaacaaatatgttttgaacatcttctacatgttaggcagtgtgctaggttgaaggtttacagaagtgaatacatcttaagagagagatgagtggagaggagatgtttatggttgctccatatgaaatagccaagcatagaagcatgctgtataaatgctccatgtacagttagctacgaataggagcatctaaataacttttaacttcttgcttcttataatcttcaatacgtctctgtgcttatttatttatatagcaaaatgcatcataggacattgtgtggcaattatggtttataagtacaatgtcaaagttttttgggggtcattgggagcaaaaagctgttagagatttgaaaggcaaacacatattatggaataaaaattttccatttttttgtcaggtaatattttgagagggtagcgatgaggccactggggaggaagagaatttaacatatatgtgattttcaaggtagcaaaagactctggaacccacattgtcccatttctatgaattgcatcatgcctttgttaaaatcactgtgctaacaataagatttcactcagggaaatcaaataacaactctattaagaactttgaaaccatcaaaagaaatcttgacattatatttatcaaatatttgaaatctacgtataaaacaaattatgattaggaaaggaattatgtggatgtaaagaactgtgtattttgcaaaaggcaaagaaacagcaatttagtactctgctctattaaaacacattccgtcctgggattcctttagtttttatatttattcctaatgaaaattcaccctgtaattttgcttggtattttaaaataacattactgagaaaattggacatatttagtagtacatagggataatttctaaaatacaactataagtatttacaaaatatagtaatttttagtgtcctaccatatttgtttgttatatatgttgggagagatgtcattttcttatctattttattcagaaggaaataaatctgatgatgctcatatattttcaaaattccaagcaaaattgttcagaaaaagagttggaaacaactgaagtttattctgttttatttcccaaaattgtatcatagaaacataaaaacaatctaaccaacatggagaaatcccgtctctactaaaaatacaaaattagccaggtgcggtggcacatgcctgtaatcccaactactcgagaggctgaggcaggagaatctcttgaacctgggaggcagaggttgcagtgagccgagatcacaccattgcactccagcctgggcaactagagtgaaactttggctcaaaaaaaaaaggaaaagaaacataaaaacaaggctaggtgatctttatgagaaaatgcttaaaagctatttccacagagtctttttggtctttttctccatgataggtaagcttttaaaaaccgaaagaattaaaaaatataccacacatttgactttttatttttgtagtaccgattttggtcaaagcattcttgaaaaatttaaaaacacatttgcgacttttaacctagtaatctattcttctcagagagcataataagaataccttgctttccaggtatctgggattatggtaccacaaacaggaaggagaaactgaaggataaaggttaacttaggattgggttttttcaagaagtttccagtgttggcacagacacaggctctatctatgcccctttcaattataaaccaacagctctgccgtgaggatatcgtgaatgttcacatctttacctgtcaacacttctgaaaccctttcagcacctatgtctcagtctattcttgatcaaagcatgacctgctcactaaagctttcataagataataatttaataagaaactcccagccagaagacaaaggaaaagattgtgaaggaggccactgctaatttccctccctacataatcaaatcagtacagctatccagccaggactcataacccttaataagtcactctactcgattaagagaaattgattttcctctactgtggatcatagtgattatgataaatatggtatctgccgttcactgcgctccccgggcccaccccccgtttgctgccagtgtccatctgtttgcaggacggcaggtaaacgagctagagagatgacgccgtgtcattaactgcagttggtatcagtgctttgacagctgtggaattgagtgtttccgtagatcagcctagaagcccgtataagaggcttgcgcagcaattacacctcctgacaactctaccagcagccttcaacatgcaaaactcctatgctgcgatttttaattgggaatagggaaagaaaacagataggtgggaatgactgcagtttgaactctagttttaggatatgaagagtgatgtatagaggccaaagagccacatgctaccttcactagattctaacttgatcctaaagttatttggagtctgtggtgggtatgtcttattgtgatctctgtaatcaagtctagatttccagagaaatcaatctctttttaatttaattaatttttttttagaaacagggtttctctctgtcacccaggttggagtgcagtgatgtgatctctgctccctgcagtcttgacctcccaggctcaggtgattcttccacttcagcctcctgaagagctgggattacaggcatgtgccaccatatccggctaatttttttttttttgtatttttagtagagaaggggtttcgctatgttgcccaggctgctgttggcctcctggaatccggcaatcttcttgcgttggcctctcagagtgctgggatttacaagcgtgagccaccacacccagccgcaatatcttaatacaccaatgttgactgtagaatgtttctgccctttcttctcactcacctgaagaatcttgaagcagttggttttattttaatcattttccatcactgtacatcattcaatagtgcttgatattttaacatcagtaaacaaacaaacaaacgaacaaaaaacaggaaagtaatatattctgtcagagcagaattattcaattgcttaaagttttcatataaactttccatgtagcatgttgaatgtttgtttctataattaaaaatacctaagattattgactgggtatctgaaagggattttatacagcacagtacatagagtagcaataataaagatatattttttaccagcttttgcctttgtgagtattttgggtttgggacatggttgtacatatttcctgtttatatattctacacataatgtggtattacagaatgacgaattatagaaagatctggaatattattcttaactaaggaggcagtaagataattaaggagacattgaaagtagacttcagagttcttttcataaaataatagatttatttctcttgattaaggtttttatttggcctaagtctgacttaagatttttataaattagcttcatcattaaataccaatgtactattttttatggtatactaaattgttgctccatttgagaatattctaatagtattagggaaagttagtcttgttaattcatatcttttcctatatatgaataagaaagggcataaaatatgctttttttttttttttttttttttttttaagaaatagggttttgctctgtcacacagactggaatgaagtagtgcagcctcaaactgttgggctcaagtaatcctccaacctcagcgtccccagtagctgggattacaagcatgtgccactacacccaattaattttttttttttttttgagactgagtctcactgtcaccaggctggagtgcagtggcatggtcttggctcactgcaacctccatctccctggttcaagtgattctcctgcctcagcctcctgagtagctgggactacaggtgcatgccaccatgcccagctaatttttgtatttttagtagagatagggtttcactgtgttagccaggatggtctcgatctcctgaccttgtgatccgcccgcctcggccttccaaagtgctgggattacaggcctgagccaccgtgcctggccacacccagttaattttttaaattattttttgtagagacagggtgttattatgctacccaggctggtcttaaactcctaacctcaagcagtcctcccactttggcctcccagagtgctgggattgcgggtgtgagcctctgcatccagcctcttttctaattttaaagatgaactggagagtttcactttattctcacgactcttattgcagagtctactctcctttaaagtaactttagtgttgttacttcttagcttttctcaagaaaataaagccatcacagtggaatttgatgattatttttttttgagacagggttttgctcttgttgcccaggctggcgtgcaatggtgtgatctcggctcactgcaacctgcacctcccaggttcaagggattcccctgcctcagcctcctgaatagctgggattacaggcatgcgccaccacgcccagctaattttgtatttctagtagagacggggtgtctccgtgttggtcaggctggtctcgaactctcaacctcaggtcatccgcctgcctcggcctcccaaagtgctgggattacaggcgtgagccagggcccccggccgtatatataacatcttaagcacatttaatttgtctttaatttgcatttaactttttgtcccttgagaaataacaaacaaaatgatgataaaagttgttaaaactctggctgtatccccactgatttcgagggacatcctcctgttatccaggggagtctaattgtacagtctgttgagcccggacaagtctgtgcttgagagaaactccccagacgactgcctgcctgtaagagacagtgaggaaacgcaaggcaggagacacattttcttcaattttatctgcgtaagcctgaaactttatgcattgaaatacagccagatatattcataatcatctcttagagcttggccatcccagtatcttcagttctgtgaccctgacagggaaggtcattggtgcagcccttccaagcaaatgcagttaaatttaacagaattttttttttcaatatgccagacacagtggtaaacgtgtaatataaagattgctctgacactcgtttgaatctgaacgactaccaggaaccttccttcttattatccaaagcctttctcttgcaattcactctttcttagcttttataataagggttgactacttgaaaatatggttcaattgtccttaccagcactataagcaattttagtttctcactagttttcatttgcttttcattttttgcaatgaaacccatcacagtctattgacctactacaattattaagtctattttatttgtgattatagtttgtgaaaatacaattaattactcatattatcaatgagagtacaatgtagcataatttccaccacacgttgttaatttaccaaactacttaaatctgatttacggatttttttctcgatagtagtttagatgccgtggtactttcaagatgatgagagaatcatgaacagagaagttcctttcaagtgaaaaatgcagctgtcgcagaatctctagtgtatccaggttagaatatttaaaactatgtattcatattagagagacatcatgggatatgataagcagaaaagagagacactaattgtgaatagataaaaggattcacatatgtcttaaaactttcaaataaaatatgcagagtgagtttttaaaacgtttttcctgtttatcccttgtttaatgttccgttttagttctaagtcgatcctacaactaataacagatatgaaaagacttggaatgattgtctctgtgttctttgtgccataatttaaagtggccagaagcaagcaagtggaataaacaggacaattgcagagtttatggaggattaggccaattgcaggcttccacacttagggaggagaaaacatcctcatgaatatgagattggaagtgtctagctgtgagaaaaggaaaaaaaaaatgtctgactctggctctgtgttgcaaagcatgagggtctctgtgctagaccatgacttagcaaccgcgctgtttttaaaagtatttgtgttgtaagaatttattatataattatattctattaaaggtagaataggagcaatctggccagttctaatcactgaatctatagtacaatttgagttgagatgaaacaaaaacagcaatagaggaaaatgttaagagtttttaatgttactgagagttaatctgattatgcttaagactgtggagttggagacaaactgcttccaaattccctgattaaaaaaaattgaaaaattttattttatacaagtaattttctgatgttgaaaaccttgtattatacctccaaaatctgaatgttttaacaaaaggaaaaatctccttccatgtactttattccattaatacactccattcatatttgaaaattattaaattttaaattcaatagtggattgtacttggagcagttcatctaaccagccatttacctagggtgtattaatactaagcagccttgcagccacatctaccaatgtattaagagcctactaataaaaatatgatttactgcctaaagtttctttttgcatccttcatcacttgtctgatttggaagtgtggtatataatgcagatatgaaaccagctcaaagttaacagttcatagctgtaaagatcagtgcatgctcacggcagaacaattttcagagtatgttggtattattaccattttgcactttctaataaaacgttttgttcatgtaggctgtatcttctgcactcaggctttaaaaagacctttcatccccactttctctgaagttggacagcagccgcagtagcagctgcctctttagtcactttgcttcccctcattttgataattatgggcaaaggtcaatcattttcccatcaaggcaaatcctgacaaccccacatgtcagagcctaagttatagatgacatgcttgtcaacaccaaaactcagagagtatatctttacctcctcatgaccagctgaaagtcaaaaccctactgcaaaccagaggcaggaggggatgaaagaagggtggctgtttgccctgactttgtcaactgcagacatagttccaggcagatttttgtaattttaaactctataaatgaacaattacattccactttatacacatgaactgtgagcgtcctgattgaatgcaaatgcttctgttaacaacatgacctcgtagtgccttagacggaaagactttagttttattgtggcgattgttcttaaacctagctgagttttttagattaagatgaaatgttttaaagctgggaggggggacaaataatgatcttttaaaataataactagattctgggtgaactaaaagcctggctaggaccattataggaatacagacactcaattcagttcagtaaacactgaagggataaggagacagacattttatttatatcatgaaattggatattaaatttgcactgctcagattatgtcagatattgatttagattcaattacataatacctcccagtatccctagaatcagcattcaaagaaatatgcattagtgagtatggtggtaactgggtgctaaaagcctaggccaagcaaatcacagaactacctgcaatggaaagtttgtgctccaagggtcctagggtatttgaatttctgaccatctatcaacatgttacctacatgtaccttcaatactcccaacactttgtcctcccagaatatgatatgaggttaaaatttagcccagggtcccaatttaatatctactgatggcgtccctttctttatataatcaaacatttttgtaaaattatttgggtaattttattacaaatactttttaggggctttctgtttcaaagaaacctataataactcttctttttcttcttgttagaacaataataaatcctcctatacagtaaatcattacctcctcacttctcacttgtttaaatcaaaatttttatttactgcattctatgagtgtcagatagtgagttacttacaagtatgctgtgataaattggtaataggacattcattgtcaggatgaaagaaaacattactttccaagaaagttatgacccaatgtgataatttaggattacaaagaaagtgtatgaagtatttcctgaaatgaacaatgtaatttgatcttatagcaagtaatatttatcccagattcttgagaattaaagtctgcatagaaatgtaatgcgttgtgagtctatgattctgtgttgtagctgagcagtacttactctttcctttatatgctaagatgggatgtacatataaagccccccccccttgtaataggcttataacagatgtactcttttataaacagccattatccttggacgtatatctgttcaggcagaatgacctactattggtcccactcttgaagaccattgctttgcttgtcttctgctctggtccattgccttgttgcctacattccagttgttcaccttccatgatgcccgtaagaagagagtcaaaggctgacaaatgcacaggtgttttctcacttttcttacatcctaccccctctcagttattcattatggtaatggcactttgtgatgtgcaatttctggatttatgacccattcttgataagcatgaatctggactgcctgtgcatctttgataaggttctagttggatagcagtgacctttctggatgtaattctgggaggaagattaaaaagcagtccagaaagtgacaggtttgggacaataacgtatgaatttggctctgctggcaggcaagagatgtaagccgtgataaattagaggcaaaccaaacaagcttactgaatgatttttcatttctgctacatccttgggtaaaagtctattgtatgaattgcactaatactgccatattcctctagccgtgtgttagactacttgtttactaattgcataaactggcaaattattccgttaatgtagttttacagtaaccaaaggctgcatactcaattaaaaatatgggcaccattttgcgtacttgtgctgtcttatacgttgaacagtcagtgagcatttggaagagagtcatccaaactcataaaaacctctctctctgtttctctctctctctctttccttccaccccctttctcatatttgtatgaaaagctattagaaatttccatatatatacccaaatcctgaggacatcttttccaagtttagagagttaaagatggattataaagagaatccatttatcaaggtaacttgttaatacactgtccttaatattcttctgtatttgataaagtcttaaactcttaatatatgttccatgttgaatatatagcagaaatacacttgtatagataattatgtttattacgtatttaaaggataagaacacgtacactgacgtgcaagcacatataccccttcagagaaagacagacaaagatttgttttcctccaaagtgatacttctgaggagtgctaatatataataacctaatcttaaggacatgactataataaaggctaaaaagcagttttgtcaggtggctttgtaaatctgtcttctttgctattggagcctgttgcttatacacacatggaatacaaaataaattgtccacgtagcaggcaaatcaatacgcggtggtccctaccaggattaatcatgggaggagttccatcaccactcacacatggctgcattcagggtgcacagggcctattacttctgcatctgtctttaaagggagccctctagagcttgctacaaggggaggagaaggcagctacctcttctgagggcctgaggtaggtcagacaccaggctaggcatgtgcacatacagagttctgttccagtctcaatgcaatgcagcgacctgtcgctagtagccctgtttttacaagtgaaaagagaagtgtgtttccctgccccttcctcagcagaaagtctggcactcagcagtcactctgtcaacggaaaacaaaatgaataaggccgggagaaatgaagtaactcacctaagattgtactaattgaaagcccagcaaatccagatttgaataggactctgtgtgtcttaataccagcaagcaaaccaataaacaaaaagcaaactgccagctgcagtaccttatgacagctttgcaatttacctaccagacaccattttcttaaacagcagcttttttttttttttttttttttttttttttagatggagtctggctctgttgcccaggctggagtgcagtggtacaatcttgacaatcttggctcgctgcaacctctgcctcccaggttcaagcaattctcctgcctcagcctcccgagtagctgggactgcaggcatgcaccaccacacccggctaattttttctatttttagtagacattgggtttcaccgtgttggccaggttgttcttgaactcttgatctcaagtgatccatccacctcagcctcccaaagtactgggattacaggtgtcagccactgcgtccggccccacagcttttttgaaatataattcatgtaccatacaactcatccatttaaagtgtcagacatcactttaatatttatattttatacttactataaactcagtatatataaaatcatagtgcctcttcttttagctgtgtttaatacttatggactgaagacctgttcatttttaacctaagtagagaaaatatagagtcgagagtatttttctcgcttgaaatcagtagtgcctatttttgctaaattttttgattcctaattattgctattcttcctgcatttctctgacatccatcatttcttgcccatttttttttcatattttttagtattctggtgccttcatatttttaccatactggtgtgtcaggcattgggactattcttagaagttgttttgctactctattccactctgtaaacttacggaccattgaattgtcctaaaacatttactttctccatgacacgtgctattcttaaaataagttatgtcaggttaaattaaaaagaaaggccttcaatgactgtcagtgtcctgcatgatccgatcttaccttatttagacaacctttccttttgtaattcctatcagaaaatgccttttctgcacagaccagccacttaatgtctcacttacagtaatgtttatttctaactttgtggcttatctgacttgtttaaccagtttactctcccttttatttccctaattaatatgacccaggatgagaattaaatagtatttcctttatcaaggcttactctcccacacattctcctaatacctttacctaccttgcaatcctgctgggcttgcaatttgtcccccatatttaactcttggcagacagcggtcccatatttttttcctcatgagtatttcctatgtggacatctcgactctctaacaattttaaatttcttgagaatctgttccgtgcctgatttctccctcagcagctttctaccctctttgcagtatgttcttcttaaaataatacattttgatttgtctcaactatatataaaacgcacatgcataggcatatgtacatagttttgtttgaaaagaaaaaagatttacaatttatttaaactttgtaaacttcaaataaaatattggatcaactacattaactcacattggaaaggactctactgatgaaaaatatgacaaatatatggcactggggttttaatgtaaagttagtcactaatttttagaaagtaagctgactgggagaaggaggtgtagataagtagattttcatcaattccaagatacatgcttttgtgataaacttaaatataatttagttttctatcaggcctcaaataccagatagttgtgggccttgtgaaataattttttattaatgccttgccaagtggaacatgatgataaaaatggatagtagctacttctctcatcatttttttgtcttattttaatctctctaaaggtaaaaacatatattatgataggaagtagtcagttgccctggcacatttatttttttgtcattttctcttaagtgttagtattatatacaatgaaggtacttagattcaaattgaaatgaataaagttaattggctttatacctggtttacagttcagagtctctatgatagatacctggagagtgactagtatagtttagctgggtgtgcatgggctgaatggataatatgaagattacatttttatgggagtccaacaaaggagttctaagtaaaagtgatctgtgagccttaaaaaagtattaaaattaaataaaatgaatattgattcctgagaaacatgtttgaagtttgaaccttctggctctaacaattatggttaacaaaaaaatgtgtatttatattttcaaggatattattgtgatttcttgtagctaacgttctgaaggaaccgctgtattttaagtcatgtcttttggcttgacttttttatatggcatgaagttctaaatagctttatacaattaacagaggcattatttttaaatgttaactaggctaggttaatattgtttaggcttttacgtgttttaaaatactcccacatactctaaaaattaagcaaactatagaactatgatggatctagtaagggagcacttttcttggtttatcatcattttttttgcctccatcacacatcgactgaatgagataatcgatggaaagacttgaaataagtgtggcataaacacatcagtttatgtgtttctagaaaagatcttttctgtcacagcaaatgccatggtaaaattcttattttttaattaatattccctcatgttaacaatctaacagcatgcttattcatttgttcttcagtccagtgtggcattattgctgtttgttggttgaacattggctgtggtctgagacgcctggtatcttgagtttctgaggtgatgctgtcatgctcttcacctgcctgaggtggtgattagaaagcacagttacagccactgctcaagtcatctgaaaatttccttcctgctaaatgttacagggtagaggccattagttcttctacaagctacaaactcccagcctgctgccatgtcatgaagccagagaaatcaaaaagccacctactgaccctgcctattgtctgggcttgtcgtcttctgtcagtagtgtgccacaatcagcgagatacacatgtacctcctgcctgctcagggtttggccgccccctgctcccagcacctgtttgcttatacatgagctttgcatgtttgaatttaaatagacacaggagggtggagagagggaggaagggcgatgcctctgtcagccgtgggtcattactacagaggagacaaacccagcgagcagggaaactgggaagcctggtaacgtggtagtgggtgatgaaagatgagtattctccatggaaatcatttttttccccttttaaagttgaatggggtgggtgattattaagacaagattaataatcattttgattatcatatctatcaatagatgatttcttcaattacatagagaattataaatcagatgatgaattgtgacctgggtcttttccaaagttacctttccttgatctcttccaatgatgtcattgcaaaaaattgtctaatttatcaaaaaaacaacatgaaattcaggtatgcgtacaggtgtaaaaaggccaagatttggccaggcatggtggctcacgcttgtaatcccagcactttgggaggccgaggagggcagatcactgagatgaggagttcaagaccagcctggccaaaatggtgaagccccatctctactaaaagcataaaaaattagccgggtgtggtggcacgcgcctgcagtcccagctactcagagattgaggcacaagaatcacttgaacccaggaggcggaggttgcggtgagccaaaattacgccactgcactccaacctgggtgacagagcgagactctgtctcaaaaaacaaaaaacaaaacaaaacaagaaaaatggccaagatttagtaaatatgtacactggggactcatatctgggatatatgcaatatgcacctgtttatggtagaaatttttttacctaagaagaaacaatactatcatctttctatttcaacttgtttactaaattataattttcttaggtttagcaaatgctcatttagtaattgtgtcatcctgcatctgggcttctaggctttgaattagaaaatctgagactgcttgctgcctttggtatttattagttccatgaccttcggtgagttctttaatctgcctgaagctcagtatcttcatccacaaaaagggagcactggtgcccacttgagggggccctaaagggtggaaatttaatgacatgataattgtgagtgctcttttcaaactgtaatgtgttatataaacatcagatattgttactattaagactgatgtcatataagattaaccatggtctccaaaagatacaatactcatagtttcattactaaataaacttttaaagtaaaaccaaaatactttcaaaaataaattgtattaattattaccaccataatactgaaagttttatggaaatatttcctctctaaagcacaccgttgtatgttagaatgttttcctggtgtactcttttactatgtgtaatttaaaaagtaattctagactatcaagatagaattttattataatattactgcttaatatgacactttcttctaattttattgtgccaagaatttgtgcaaaagttacacaggcagatagttaccttcttttttcctttgggttttcaatacgtactctaacaaaggaaagatgaaagaaatcagggagaagatctggcatttagaaacacacactccctcccacacacacatccactccgaaaagttataaaggatctgttgaatttgggggataccttgaagaacttcaagctgtcaccatttcactaccccatgcggtttgagcaaatgagcagccttgaactttgcacacagagacgcgaggcctgggcagaaggcagtgcatctgcaggtccttgcatgactaatttcctgtcagcaagtgattttattatcatttaaataagaatggataataatagctgtaaacttggcagatggctgaattggtaaattttaaaggaggtaggtttgaaatacttctgtgcttcctccttcaatgccttcacccactccttaagccccgtggcaatcaactattttggttaccacttttgatttaaccactgtgttcattcctatcgattaaaggggctttaatagcacaatattgtgatggctgtttaagcagaggacatactgtgtttcattgcttcttatttacactgggcaagggggaagcccagttattggtaggtacttccctcttctaatcatttctgcatgaaactttttttctttctctcttcactcaacgcttaagaggaaaggaaaactacttgaacttcttagttcgtatttctcatataaagttaaaacaatgtataaaaagaactattgtgtattcagttctcatgttcccattccttaatcaacacaggcttatcaatacagcaataaatgaggacagtctgaagcacaggagagatcactaatattgcagccaattttctttcctaaaaagtacaggcgcaaaaataattcatatcagatgaggtcttacaaatattaaacaccattatgtcaagcaaataccgctaaatatgaaacaaaatattgactctattacataatatagttatggttaacaaaataaatctaatagggaattttaaactaccaatttagcttaattaaaaggtacaatttcctcaatcctgattaaataacagtaaaagcatagattgaatccactccctctgagatttttaaaagaatgtttgagaaagcttgatgttggagttataattacacaacagtaatctgcttattcctttgacttaaggtattaagatcgctactaaccaaagttcattaattgaaagcttggagacaaagtaaatttttttttttttttttttttgagacagtctcgcactgtcacccaggctggagtgcggtggcatgatctcagctcactgcaacctctgccccctgggttcaagcgattctcctgcctagcctcctgagtagctgggacaacaggtgcacgccaccacgcctggctaattttttgtattttttagtagagacggggtttcaccatgttggccaggctggtcttaaactcctgacctcgtgatttgcttgcctcgggctcctaaagtgctgggattacaggcatgagccactgcacccggcccaaagtaaattttaatggtatctcgcaaacatatgtgtgaagatagtagtatttaatgtatactagccatgttagcttggggaattagtatttatgcatgcccttactaagctttcttagcaggtgtcttcatgcttagaaaagtcaacttgcaacccgtgtgtaagacaaaacatttgtcacgagttcagtacttgtcaagtgggatgtacattctcagaggtcaatagtggcttataggagatttagatgtgtctgttggcattaatcagctacacacatcactctcatccaactcacagcttgaacttccttacctaccaatatctgtgttggctgcctgaaaagcaaactgttgagcaacagatttaagaatagatgattgacttggttccattcaatcttgtcccagatgtgatctctattaaatattttggtgattaggccttattcctattttgctttttttttttctgcttttgtgattccattgtccattagtgttgtggttctcatttcctttctctctaaattctgcatatttatttgttaatgtactgtatttagtgtactgtttaggcgggattacaaataacttgtgaaataacaggaaaattgatgaaaaaagaaagagcaaaagacaatgcttcctcaggaaaatgtcacattggatgattattttatttgttcctgattttttccttttctgcagatacatgattatataattgtttcagttatatgaaacaaaaattagatgtggaggaaaactctaaatagggaactctaatgttcttttaaaatgaagaatttaacgaaaacactcaaaactcccctgctgggctcaagcaggttgaaattaattcaagacggcagataaaatttttaaccaggccgagtggagatgacggatgtgacagctctcagttaaaatgtcttttagtggcgaatgcatgcatattagtcaagggatgtgacatagctgtcccgggtgagagaaaatgaaccaatgaccatttgcattgagaacaaaagaaaaattctttatagcaaaacgtaaagaaagacaagtaacttgaggtttcatatttatttgttcgtgtttgacaatatttttggtaatctttttactgcaagaaaacctctgaaagttagcacaaacatatgtttttaagcagtgattcttttctttctcctccatatatcagaaaataaatgttgagtaaaatgtctgtgcccaggaaagtcaggtaaactatttttttttcccttgcaaagaacaacagaaaagtatctgtagatggtcatacttcaaaagttgtagaaaaaaagccttaccaactgaaaactcagtttcaaatttgcctacatgaataaaatattggaatgagaagcctttttttttttattataagaacactggctccctacttttcttctttctaataataagacaatttggttgtgtattataaagcaaagcaaataaaacaaaaatggatgtgattctatgacagaatgttatagggaaggaaaattatttggaaactacaattggcaggatttgaccatgtgaaagtcaagtttaattaactttaggaacagatgctttcaagacatagcagttaccagttagagctacaagtataattgagttttatagtatagggtttatttttccaattaaaatcaaattgcattatcataattttgttattagaagatgtaacactctggcttaaaaggggtactcaaatgtagacctagatcttgtcctcttttgatcaaaagaaaagaatggacaaagatgtattttagtctcaacattaaatacaatttccactttagaaggtagttgttacttcctttaataatgtatcctccccaaaatggtatatgagaacataaaaatttattacaacattagagccaaaaatagaatacaaatatttgtatacaaatattcagtgatgctaactggattcagaaaatgctaccgaattaaaattataatttatctgggtcttcagtgataaataggaatcccttacttaagggagatgaagtttatttaaggcgaggtaaatggagaagtaagtttttctcctgtatttttggccttttcttgtctctcttttctggaattatcaagctttctctcattcagatgaatgctttgtgaatcttctctttttgaatctgcagtgtaattctatgtggacagacagctttctgttaacatacactattttgacagactacaacttgatttgctgttcaggctttgactatattcacattatggcttaagtattttctttcatagtcatttaccaagtgcccaacacatttttaaatcagagaaaaatacattttatttactttccatgccgagctcagcaagaaatggtattttctcctatgtcttgcattaaaaattgcatttgcaaatggcatatttagatgatgttgaagaaattaagcaatatcagttgtaccttttcatagtgtaaacatgtaaaatttctttaaataggaaaatactattggttttcttggaatcgctcccatttaaattctatcctttagatttttttcagtccaatgcctttgcaaatttctagtacacactttctactactgtaactttagtacatcctcagttttactacattacttgaaaacatgcatttttaacaatctcctgctcttttgcttttgattttctgggcatattcctgttactcaatgtattcattcagcagagtacatttatgctacaactatggactacctgttcacagctgtagattattcagaatcttcttgatactgataatatcttcttatttacagtttgctggtatactgagaaaatgcagtagaataacggaagtacaatgtaagccatataaatcatttaaaatttactaggttccatagtaaagaggaaaacaaaacagctaaaattaatttaatactatatttagcctaatatcccaaattttatatcaataggcaatcagtaaaacatattaatgaaatatgttcattcttttttattatactgaatctttgaaacccagtgcatacttaatacttgcagcacatttaattctaactagccagattttggtgatcaacagccaccgctgactgtggccaccatactggatagtgccactctaagaccttgatactcaaagtgccccatgaacagagagcatccacatcacctgtgagtatgttcgttgtatcaaatctcaggccttatgccaggcctactggatccaaatcttcctttcaacaagatcccgaagttactggatgcacattaaagaaagaaaatcactgcatttctggtttcccaaatgtatagaacattggtgttaatattactgcctatgacatagattcttttccaaacagctttattgagataaaattcatattccttataactcacccttttaacatgcaaagctcaatttttttagtgtattcacaattgtgcaactatttcagttatctaacttgataatatttttcttaccccagaagaaacacttctacccatgagcaatcactcagcacttccttctttgcccagtgactgacaaccactgatctactctatctatggaattgccaattctggacattttatataaatggaattatttaaggtgtggtctttcagtctgtctcgtttcacttagtataagtacattgatctgtagtctttatttcttttgatgcctttgtctagttttattaaaggagtttaaaaatgcttcttcttccagtttttggaagagtttgtgaagaatttgtgttaaatctcctttaaacgtttggtagacttttccagtggtgctgcctgggccagagattttcttgcaggacgttgttttggttatgaattcaatatcgttactggttatatgtctattcagatttttttattttttcttgtttcatatttgatggattgtatctttcttagaatatgttccatgaatgaaatatggtcattaagtgaattgaaaaaggcaaacacttttcctttaccattttcccatgtattttgcagtcaagatcattctttgtaattaccattgtgacagtactacaaccaaaatgagcctttagaagtgtgtaatttctgaaattaaatttatctttatgaattttcgaccaatgctgaatagagaaagatattttattttgccacagttgacttcctagttcctgatcacatgcaataatgagaggaagccagactggaaaaagatgtctccttactaaaataatggaagaagtagcccccattccttccttcgaaataacaacaacaattctaccaacacgcaaaaggtcagagccacattttcatggtataaatgacatctaggttaaatccttatattctgtcttggatgaaacttgatatgattcaatccaaccctccatctaataatgattctttgacatttctattttataatcgggttatagccctttaattttcttgaatgtttactataacaagacaatcacctctcataaaccaatctactctattattagataagtctaaaatttaggagaatctttcttattttaagtagaaaactgtctcctttctatacacatttagttctggctctgccaatatgagcaggatggaacaagcttacttcatctgctacttcacagcccttcagatatcagaaaaagcagtttcttcttaatagactgctaacagaattataatgggatcaaactgaaaaaaaaacttgtgagaacataatctacactaataataatcccctaatgcacttccacttgaaaaaatacacatagtttaatgtatcttctatcaatttctaaacatgggtttttctttcttagtacgaaactgttaaaaagcaatcaataataaataggtacagaggaaaaaaacaggcagtgaggtatgtttagctaaatatgtcctcaaagtgttgattttaaaatggcttgtttttagacgctggtgaggctgtgaagaaaagggaacatttatacatccttggtggggatgtaaattagttcaccactatggaaagtagtttggtggttttggaggtttttcaaatagcttaaaacagaatgaccattcaaaccaacaatcccatttctgggtatatatccaaaagaaaacaaatcgtccaaccaaaaggcgcatgcactggcaagttcatcacaacagtattcacaatagcaaagacatggaatcaaccaaggtgaccatcggcggtggactgtataaagaaaatgtggtgcatgtatgccatgaaatcctatgagccataaataaagaaaatcatatcttctgcagcaacatggatgcagctagaggcttatcttaagtggatcatggcaggaacagaaaaccaaatactccatgttctggtttataagtgagagctaaacactgggtactcaggtacataaagatggcgacaactgaaactggggacttatagatgggggagagaaagagtcagggaagggttgaaaagctacctattgggtactagactcagtacctgagtgatgggattatttgtactccaaacctaagcattacacagtgtactcagttaacaaacctgcacgtatactccctgaaactaaaagttcaaaaataaatattcatttttaaatttgggaaaataaataaataaataaataaataaataaaatggattgtttttgaggcaatgaaattactggacgtatggtcagtgctcagtaaactttagatgactgtggtatataggaaggcaggataatggtcctcaatgatgtctgagtcctaatccctgaatatatctgtgcatatatcagattcatagcaagggggaattaaattagcagatggaattaaagttgctcatcatctgactttaacatagggagattatcttgaatcatccaagtgggctcagtgaaatcagagagtccctaaaattgaaagagtggagggggataagggatcagagtcatctgatatgagaaggacttcacttgctctagctggtttcaaagatagaagaaagtgcctgccaaccaggaaataaaagtaacctttagaacctggaaaaggcgagggaacagatagtcccacagaacctccagaaaccccgtaaacaacatgatcttagcccagtaagactcatgcagacttctacaggtttctatgataaatgtgttgtttaagctggtaaattgtagcaatttgttacaacagcaacagaaaacgaatacacatgatagttatttaacagaaaactaacacagctactctgttctggattcaggtctaattactaaaacagttcttttgaaagtcaccagttatctccatgttattaaactctgcacattttcagtcttcgtttgacccctcaaaagcacttcatgtcgttaactattccccctttcctctttaaagtacttgttatctttgccttccatggtctttcacttccttgctttctttttaccttcttgacctctttcgtggtcccttttacagctcagtccacctcagttaaacattttagagccttctcctcttcttgctcaggagctctcatctgtggtcattgcttttattgccactctttctagagagcatgcaaattttcatcttcctctgggcctctcttctgagttgtacccacataacccattgcctacctgaattgttttttctttgtcttaaaatttcttcatctcaacatcatccaaaccgaacttataactttcctgtccactgggcaccattctccttctcctttcaaatccaaggcaccttcagtattgctataaattttgtgtctttctgtactggttgagaagggttgagattgggtagaaaatgcatggcaaatgttgtcaggtttgattttactttagatcgtgttaaacaatgtaagattgtttatttatgcatatgaatcattttgtatttttcataattaaattgatgtcaatcccaattttattgaatcccaagtatcagctggctcagcagtcactaagaactgttgtgaatgtgctattgtacctatgacactggaaaaccattatgagttaaaccaattgtcatacatattagttatttgaaattcagtgggaggaacattttcctgtgtattgcaagttgctgtgagaaatgatcagttttctttcaaggatttcagttgtgtatgtgaaataaattcttaacatttttaagctcctgtaatattgcaggcattttactttagtaaaatagtaaataaaatatacttcatttaattttaacaaatttctgctggtgattagtactttttaatatatttattagaatattaattagaatatataaaaatatttattagaatatataaaaatattcattagaatattcattagaatgtataaaaaatagaattaagctagttaattattaaaaaggcaagaatttgaatagagttcttctgtttctaatgcttatattatttttatctatatcggttgttcccaaagtttggtccccacaacagcaacatcaatatcactcgggaacttggtagaaatacaaattcttggacaaccaccccaaatgtacttaatcagaaactctgggatggagcccagtaattggtattgaccaaacaggtgatgtcaatgatgagtctgcacattaaataggccctacagatgagtttgatacacactaaatgtagaaaaccatattgttataccactgattatatgtctatagaggtgatgcgcccctatctttcttattattctcctttgactcactgatttttgctgctaaagcagaaccaggaaataattcaatgttttattccaacttactaagagatcccatacttaacaatgagtattcctaagtatattaaggttagcatataattgaaaggttaaaatatctaaaattcaattgaatgttttcactgtaaactatattcagcttcattgtcttctgctgaaagtcttattttacttcattatggcagcttaatgattctccaattcccatgttgaatttccaaggaaagaaacttataaaaagtttatgctcggggaattcttttgctttctgtgtgggagtggagcagttctttacacatcttccttacctccattgaaaaagacaaggtaactgaaggctgttggagtccatggggtgaggacttgttagcaattagtaatatgtgaagaaactgtctgttccctattttttggtatgctgaccataaattgatttgagtattcttgctttactttattgtaggttgaagggagctattgcttatgaggaaattcattgtgttctaaagccaattctaaatcagagtttgagacactgtttctatattagagattatctatattttattctggagggcaaaaattgccacttagatattacatgtcagtgcatatatatttctaaatttctcaggggagttgtgggagataaacaataatagtacacagtgaaagtccttgaatacggccctgattgtcccttcttttagcctagatgttcatatttcagttgtttgatttaatgaatagaaagggaaacataataattacaactcaaaattctcatatgaaatgaatctaatctcattcaagttgtctagtccctaaacacagtcagtaaaaggatactttagagctgttctcttgcaggctgagccgaggagtgaaaatggttaactgaaaactttgaaggatatttaagttgaccatgtgcagtgcatgtattggacaccagccaggacccagtaaaccccctgtgccaacattgggtagaactcattgataaccaaaagcagttagtagaacctgtctcagtgagtacgttggtcaatacaggcttcatgggaatggcccctgttattaatgtttgaagactatgacttgcccttacatggctgtgatttagagaactacccactgaagtcactgatgtagttcagtgtgtgaaaaacagacggcaaaccatatgaggtaagttaatacatgtaactggggatactgcaggaaggagacagttgaattctttggagaaaaagtggtttacaaattgaatacattaaaaatgaatattattactggtttactcatcacataaagaatagggccaggggataaatacctctctagctcttgcaactcaagagatgtttttcatatcttagataataaatacttgcagtaggtttagctcataactaaaagtatgtgctaagagactcccctagaagagtttgtcttccgacatgctgaattgccctggggttggtggcagcttaataaaatatgtgagtgttcagtgcggagctgttaagttatttattccacttctgatactgcatgcatgaactgccactgtttgatgaatcactgaagagaatgggaactgacaaacaactcttcctttagcggctgatcacactgacagcatcaatagaaaaacacatcatgggttctaaaatgccacattttcaccgtttaccctgaataagacatgaagctctttaaggaaagcagtagtacgttatcattaagggccagctgacagagaggcaagtgtgctttgaactctctcaagtcatcattcttaatttcttctcttcttagatggaaggcccacccacatgggttctgagcaaggcagggactgttgcaccttttaaaatctcattgatagattggtttcatcaacacccatcctgactcctgcccatcgggagaagctcctattctcattagggtcctgtaatgtctgcagctaacattgttctcatgcaaatagaatgacacagaagatcagtgccatgaaaattcaatttcccccaaccatcattaccctttttcttttagttattcccactccaatctgcaggaggtaatgtgtgcaatctgctggtactgtgcaagatgattactacattttagtgatgaatttcccagctattgcactagggggtgttttagcaggttccctgatacacctaatgtagatgtggcagtagtccttgcagtccttacccagctcttccatagtggatttccacaaggagtggatgcctggtcagtagaacttgtattcaatactgttcattctttagtcatcagtggcacttgtgaaagtagtgatttgtttaatgttgtctgaaaaataaaaataaaatatatctctacctgtccaaattgaaggattaaaagctctgtcaaaagaaatgtagtaatttttgtctttagtctatgatcaaacttgggtaatttaataaggatgtaaaattcagggtagctcatataaacatattgaaattataaaagtgtgtaagttaaataaaaatcctgttttagaaagaactatggagaagtcctacttgtgtgcagctgaaaagtaaggtaattaccaaagtatatttcaaattcctatacttaatattatcctttatctttgaagtttcttcagcaatgggattaaatatgtaaacattatattgtcagtggtttattacgttttagaagttctttgtttcttctgaaattatccccttgcctcttcattagtctggaagttagctgtaagaaaaaataaagggagagagaatgaagaaaaaatatatagattcaccaggcattacagatttgtatgtatgcccctgttcaccacaaacacaaaacatgattatagtttctctggcgattattagcctaataataattgtaaagggcaactatacaaaacacgattttcaatgtaatttttataaaacttatttatttcacaaataaatagatataatctttcccagtgaataaaatactttacatatggtagcattttacgtacaaaggtgactaaaagaattcagagttttaaacatttatttgaaagaaagaatgataattattttataaagtttttttggaaaatacttttttcttacacatggtgatgatgtatttgtagataaattgtatttatgcaattccattcacatgattttgagatattttcattggattgattactggctgaattagacatttttaaattactgaaatgtaccctcttaataatatatccttataattatgtcagagaggctgatataatgaaaaaaggagtcaagttatttctttacctgaattattctgttctataaactgatatatgtaatacatttcagtaactgtggcgaaaccatttagactgtctatgggacacaccatgcagtttagatgtgagcagttgcctacatgtggtacagaaagtcatatttgaactacagttttagtaccgctactttaagatagattctgagcatgtaattactgcagtcttggcatgtaattaccccggagttacagtttatattgacctccagaaataatgagactgtaattttaaagtaaaacatagaacttgagtgtaaaattgtatgttgattttgaactgcttgcattgtgagtttgttctcctgaagaataacttattactatgataattatcccagtttcctatggattcagaatatgtagagtgttattaaagcatcctttatgactgagtggttaactggttccacagataggtaaaagaaggagtactccagtggtttgaaagaagctgctgattacaaaagctccctccctgtaagcttcatggcctgcacttctcagaaagatagactcaatggagcatgactgcctagggcatctgggtcccaggaggttttagttgtttgtttaggtgttgagaaaaacacattatgaccgtaataataattatgtgtttggaattggatttttgcatctgtaacacaaagttccatcttgcataaaatgcaacctcagcaccattttatgcttaatttgcatatgaagcaatatgggactattcaaatataggcttcatttgactacgtaccaccagtgttaatttagtatagtattaaatgtctctgatgaccactcttcaagcaatgtttggactctttattaaggacaaatgtgtgtacacactcttagatgatattaaaactaaggttaaaagattttaaattattttcagtagtgtgtcacttttaaatacttttgcataacctgaagagagtaaagtagttgaacattatttagatagtgatttcatagcaattggttttttattttctgaaatatagcccagagatattttattttttgcttattataagaaatcacatttcaaaatacacaattcagtttgaaaatcagtaagttagctttatttattcccaggtgttttctgaaaatacgttttttttttcttagcctttcttaaggcaagaagcagtcattcaatttcccttattcttttctctctccttcatctttctcctttcttacccctttttctgttgtcatggttttttactaaagcatgtagttcttcttctgtacagaaacattccatgtaatcctcaaattaataacttcatccaaattatctacaaagtcatggtttgacagtaatgtacccacaatatttctctagtgcaaattcagccgtaccagtaatgtgttaaaaagtcatctttttctaaagaagctatagatataattcatctcttcttgaattcaatttgtaaaaatttgagagttaacttatcatattttaacttggaacatttgcaaaccttcttatgtcatagcttctcagtattaaaaaaaaaatagggcatatggcagaaaaccatactctgtaaaacacgacagctcaggagaaaaaaataaaacagcttaagaacaaatattatgtccatacactaataacaacatggtgtatatttgtactgtattttttattttcaccatttaatttgaaattattggatggtttaaatatataattctgaatggtggatagatattaaaataatatttagcttcataagtattgaccttacacatttagatgtcctccagacaaagaatgaacatgaaggtatcgtgctaggaaaagaattaccgttgtcttctgtgtttcattaaaatagctttcaggcagataaacaactgtttccgtacgtaagatccaagaaataccattttatggatgccaagttcagcgtcttagtgagttctggaaacttacataatggaaacagtacacacctgcctctgtgtcactctctccctgattaaaagtgatatggctaaggacatgaagaaccatctccctcttttatgaatcaaataacgtatgctttataaatgttatgtatttattctttcctctaataaggctacacatgggtttaaagcattgaggcctgcgttagggagatcagcactagaggtcagagacattcagaatcctgcagtttagcatttagcaatgttactttcttttttcttttcttttttttcttttgagatggagtcttgctctgtctcccaggctggagtttagtggcacaattttggcttactgcaaccttggcctcctgggttcaagcaattgtcctgactcagcctcccaagtagctgggatcacaagcatgcgccaccatgcccagctaatttttttttttgtatttttagtaaagacagggtttcaccacgttggccaggctggtctcgaactcctgacctcaggtgatccgcctgcctcttcctcccagagtgctgggattacaggtgtgagccaccgtacctggccaagggtattacttttgagttttcaataaaggcagtgttacagattttgcttcatttgaattctatgcaatgtttttgtagttcctgatatcaaagatgtctatcagcttttaaaatgtatatagttaaaggattcctcttgccatctaaacatgcatcaagaataaagaatctatacatagattttacaaaagttattttatgttacataaatcattcagaaatttctattcattcatgtaaggcagaggcatagctgattctgatggtagtcctgctaatcattcaactgctaacttacagagagtccaataacccaatgtcatatgttgtgttgttgtgttgtaaaccattcatttcacaatgctgtgtatttttaaactctttaatcacagaggtcaactataattgctggcatcaatttagagtcctcctgctcttttctttcataatgttccattgtcgcatgctacagtatttataataatttgaaattataactgtatgttcatgtgtttgatgtctgttttctcaacctgactgacaattctatttgttttgttcaccaacttacacctaatatttggacatggtctgggacacatactaagagctcaagaaaagtgcactgaatactcatggtttataatctttgaactgaatatcttactgttactttttttaaaaaaaaatctatatttcaaacttatttctagcatagtcaaaaatggtttctctcaaaggatggatgtatagctaggcagacatacatacagataaaattgatatattcatatacacatagagttctgttcttaagttgtaattatgtttgaatcaactacatatttcatcaacttcccactgcatagaaacagtctgattagaggatccattctaatacagaaacatacatagatgtgtagagatgctacatgaatgttgatactctggttgtgatattgtgctataggtttgcaagatgtaaccattggtggaaactaggtaaagggtgcaatttatctttgtattgtttcttgtagctgggtacgaatctacaattatctcaaaataaaaaataaaaaagtggtatgtggcatttgtgtaaaaattgaaccagacgtagaaaatgaggtgtaaaacaactctttttattattactttagcattagtgacattccatatttatcatttgcacatttaaatagtagggccaggctggtataaagcctttttaccgtccgggagggaggtggggggtcagccccccgcccggccagccgccccgtccgggagggaggtgggggggtcagccccccgcctggccagcagtgctgtccgggagggaggtgggggggtcagccccccgcccggccagccgtgctgtccgggagggaggtgggggggtcagacccccgcccggccagccgccccgtccgggaggtgaggggcgcctctgcccggctgcccctactgggaagtgaggagcccctctgcccggccagccgccccgtccgggagggaggtgggggggtcagccccccgcctggccagccgtgctgtccgggagggaggtgggggtgtcagccctccgcccggccagccaccccgtccgggagggaagtgggggggtcagacccccgcccggccagccgccccgtccgggaggtgaggggcgcctctgcccggctgcccctactgggaagtgaggagcccctcagcccggccagccaccccgtccgggagggaggtgggggggtcagccccccgcccggccagccgccccgtccgggagggaggtgggggcggtcagccccccaacccggccagccgccccgtccgggaggtgaggggcgcctctgcccggcggcccttactgggaggtgaggagcccctctgcccggccaccaccccgtctgggaggtgtgcccaacggctcattgagaacgggccaggatgacaatggcggttttgtggaatggaaaggggggaaaggcggggaaaagattgagaaatcggatggttgccgtgtctgtgtggaaagaagtagacatgggagacttttcattttgttctgcactaagaaaaattcttctgccttgggatcctgttgatctgtgaccttacccccaaccctgtgctctctgaaacatgtgctgtgtccactcagggttaaatggattaagggtggtgcaagatgtgctttgttaaacagatgcttgaaagcagcatgctcgttaagagtcatcaccaatccctaatctcaagtaatcagggacacaaacactgcggaaggccgcagggtcctctgcctaggaaaaccagagacctttgttcacttgtttatctgctgaccttccctccactattgtcccatgaccctgccaaatccccctctgtgagaaacacccaagaattatcaataaaaaaataaattaaaaaaaaaatcagtgataatttgttgatatattcattagttgtccacattccctaactcctatatttttgtaaacttttaattgaagtataacatatatacagaaaagtaacaagaaggcttaagtatccagcttgatgaatttttgcaaactgaacacatctgtatcaccagcacctggattgtgaaatagaccatgaaaagcaccacagaagccctctcatgccgtatctcaatctttaccaagagaacctatcttctgactccatagagctgtcttcttttatccccaacttttctatttttaaaaatttcagtatatagaaatttcaaagagtaaagagtagcaagcattacccatcacctagatgcaatatttgttactattttgctgaagtctatctctctctgtatgtacaacacgtaccatttgagtgtgttatttgcagatggtgatactttacccataagtactccagcatgtatctccagccggatcaacatggcaaaacccactctctactaagaatacaaaaattagccagatgtggtggcatgtgcccgtagtcccagctgcttgcgtggctgaggcataagaatagctcgaacccaggaggcggaggttgtagtaagccaagatcctgccactgcactccagcttgggcaacagggagaaactctgtctcaaaatttaaaaaaaagaaaaaaaagaaaaaagaaagaaacattcttctacataatcacaatattttcacactcaggaaatttaatattgatataatcttattatttataaaaattccataaccagatatccccaattgattcaattgcatctatcataatgtttttgacacaagatttaattcgggattatgcattgcctttggcccaatatctgtttttccttttctcttgttctatctcttagtttgaaaactttttccagccttttaaaaaatatttaatgacacagaagtgttttttttgtttgtttgtttgttttaggcggagtctcactctgtcgcccaggctggggtgcggtggcgccatcttggctcactgcaggctccacctcccgggttcccgccattctcctgcctcagcctcccgagtagctgggactacaggcgccgccaccactcccggctaatttttttttgtatttttagtagagatggtgtttcaccggttagccaggatggtctcgatctcctgacctcgtgatccgcctgcatcggcctcccaaagtgctgggattacaggcgtgagcccccgcgcccggccgacacagaggtttttaagcagtccaggccaattgtttcatagatagatgcctcatacatatttatgtctcatagaaaaagttacaaatgtcaactcattgctatttatgatgtttctttattctttcttgcacttacatggttcagcatctggcccgtaggaggtaccaaatggtgataagttcattatactatcagtttaaaatcttgtctaccagctctgtgacaaactgtacaaatttgagtaagcctgttagcccctttagacctaaatatctcatctttgagtaaattgactggattatcttccattgataaaattgtgttatttatttaaacattgtatttggccatgttaccatatttgaagttagtattactaccatggaatggaaaattatataaatatttcatcatctagtattctgaatagagtatcaactaattgtacaatcttatgaatggttaccaaagaatttcagaacattctgtgtagaaaatatagtataaaaagtctttgcaattgctctaatttagacttccaagttgttaaaacatcttttgaagacctaggtggcctcactgctaggtatactctctttattcactttatctgttgcatcctttatagcctacttgggaactttttttccttgagctcccagcataagagaggctactggggtggcagttaaacccatatgtataattttgccctgtatttcatttcataaatatataagtctttttctgtattcttcaagacactgaattttctgcatgatatttaggccttaacaagttatggtagtttagaaaaagatatttaaaaaacattgtatcttgttgtgtacattagtactgttacaaaggttaatacatatttttttaatatgctgaattagcccttgggtcttctcacttaacaattttgacaaggttttatggaagttaccctgacacttccattagttattggacaactggaccttcttttctaattgtcttccaaaaaaggggacatgatgtttctctgccgcattaactttgttgtttcctgtaaaacttagcaggcaaaaatctgagcttgtaaatgagagacttgtcttcgtcttgatcagagacatgaaatttgcaatttaaatgagaaaaaataatgaacttaatgcataccttgaaagaagtgttgtaatgtgccaatttggttctcataaagttgattctacacatccctatgaaggtattgattgtgtccatgtagtaaagctgagggtgccgtgaactcctcagtgacttggcatttcatcgttacagacaatcagccttccaagcacttggcttaacatacctccagcccctaaatacatgacgaagtcagtggcagaatggctgtgcaagtagtctggctcttaaccttaatgctagccttggtcttatgaaatcttgttattaagaaaacctcatggctatatacagttaaaaatgaatgtcactgtgaaatctctacttttaaggagttatctggcctccattggtagtatttgcctactcatatttgtcaagttattctttgaaaactagcaggaagaataggaaataagaagtctgatttgaaatcttggtcttccttttcttatttcctttaccccagagacccagaaaatggagctagctacatttctcacacttactgtcatagttacatgtttatattctattagttgtaattatttttcacctatcctctcattagaatgttatacctatagagcagataccattccagttttaattttttgccccgactcctagtaagtacgtgacctattacagggaacttaaaacaaacaaaaagtctgctgagtctgggatgttttaaggatcgaaggaacatgttggtccaatttgccttcacagagggttacctctgctttctaccgaatgtgaattgctcccatgtgattttgaagaattccagtctacctcagggaaggaccacatgtaatgccagagtctgcaaacttggcagcttttaccctctctcatctgtgggattgttttgtcctgggtttagatagctaagtgtctgtaaaaagattctttttgtcattaaggagcaacaggaaatggagagcagcagtgactccatttccagtgtctaaagaagaagacttaagcacaaagtaaggactttccctctccacttgtttaatataatgctctgattgcatccacacgtatgcaaatggaaacattcagattccagctcctaaggacatgtgaataaatgaaatatgtgtccgtgttcttatttgctgagtgaatttatgaacaagtcaataggctgttacagataaagtgattatttaacattgtgttaaaaacttcacttggaaacttggattatttcttaatatttataattggctatcttagccaattatcttagatacctatgattaaaatagccctgtttgaatttttgtcttcaaatttgtcaagttttagtaagcatgtgtcattatctaccagaccacctctaaattaaaataaaaagagataatcagaatactgacttgccaagttgtttgtgaatcacacttaccaggtaccagatttgtagttaaactcctcccagaatttttccattagtgttatagaaatttcacatgctaaatacaatgcaagtatatactgttaaaattttcagaatatcgtttctgaaaattactttgctccctgcaaatccaccctactcacctgtatcatttgagtgaaaacttttctgtgtaactgtgactgagcagttaaaccagaaacctgctttaggtaaggactgccttgatgtttgcaatttttcccacttttttcttttcctttctttttttattttttcattttaaagataaaggtcactctaagaaggtagttcctgagttaaaagtgttccatagggttggggattacaatagaaacagacaccgttccccaccaagggggcaggagttgagcatgagcctccccactgtggtcgtcctggggtctctggggggtgggatggcatctgacagtgatgggcttttcttgatggcttcctttctttgtacctaactctggtccataaatagagcatcacatcatgctcccagactgacaccggggaagcttcataaatcagcaagtgagtgttccggcatgatcctttggccactgccttccctccagagctgacacctgtcaccttttaaagagtgtacattctctgtcactgtagctgattcctgtcttttctttattcattctcatatgctgcctaggtggtattatctgggtggctgcccatatattatttaaatcattaccagtatggcctaggtaggtttttaattatgcctaaaaacttgatagttccagatagttattgggtatacaactaagaatataatacaaaatgcattttatttttaaaagaacatacatatgtgtttaacagatctaattatatatatatttataatcaacaatagaatattgcatttaggtggcttataaataataccttaaagcacttaaaatgataagaattcttaagaatctgtaagaatctgagagttaaggaaagtgctttgaatatccttagactgttaccttttccaataagtcagtaagcattggtgatttgttaatattataaaatacgtatcttctctgtggcacacgtcactttattggagaaacatatgtgactcaactcaactgttatctggtcctattttgccctaattatggtttctatttaaatggcattatagaatcgcttagcttttaaagaggggcagtggaaaagatctgtaaaacttcagcaagtctataatctacatgagcagaaatttacctctcttaaatgtctacatattaatgacattaaaaataaaataatcgacccatgttggggatttctgtgctttccccaaatgaatgtttaaaattttattttgaattctattaaagtgaataatgaccacaaggtgtttgtaattggggagatagtaagtgcaaaatacaagcagagggtgcttaaaaagaacaaaaaaagtctgtttcttattgattggcctgtggtgggataaatgtgtggcttctgcctttaatggaagctgattgttcagggatgtgccggtgagactggtcgattcttgagctgttgtttactgggaaggacaatatgaattttctagagggatgattggtgggatgtcaaggctgtcacccttttctcctcgtcactgacagacagcccggtgacaattaccagtgatgggacattgcctgcactggcatatacactagaggatataactggcaaacaacaagagaggaaagcactcctggaaaaaagatataatcagcagttgtcaggactggttacatatctgatgtctgcataacagggccaaggcacattagctttaccactggggtaacatgcagcctgcttcgtcctgcttagaaaactgatcttagaaattttgggaagtttagaggataacaagaattgttggcattctttctacttgacagttaatataagaaaaaaagtattttacttattttttctaattaaaataaactttgggaaattcaaatggactggaaagtagatatttgtattctttacagaaatagttatatttgtggtatgtttcctcatgagttaacttttatgacttttcttgccaggcttctgttattggcaaaagtccaaatggacactaataagttgtgttgtacaggtatcagaatgagagactcaattccataattttgccagagaagcatcatttaaatggtggagtatgttctatgctaggtaggtagtacacagacatatccaccagattttctataaagattcttctgtcagtctcatgctgtctatttccttccgttccattgcttcggaatttcaaataagtttaaagaaaaagatcagcatttccaaagcctaccttaatgtgtagagaaactaatacctaaattagaccacctggaataaaagagccgtcaagtagctgtatttatttctcagcaagagactattctttgtgttaatttacaaatgtaacttatttaattaatcatgtttaggctaatcacctcttagagtcaatgtattctgctggaagtttactgtttggaaaaattcacaataagtatagttttatacagtcaaatttacatatttttgttctgtaggaattagtcatctctttccacccagggttttcttaacatcaaaatgaaaatgtctccgcatgctcaggtaagaagatttttgtcagtttcccaccaaaatatggactgggaacaccttgtaagcttctactcaaatgcctaatgaggattacttttttcataattggtcactgtagagatgaaaataattggctacctaatgttggttatctcctatctgtgtggcatccatgacttacatcagatgtatttctttttttgtgagaattattttcttaaatgtcttttctgatttttttttaaaaatgtgttaattacagaatttggcaaacattataaagtgcaaataacggtatgaaaatcatgcattattctaccattcagaggagtgcattgttaacattttagtattttttccatttggcttttgtttgaagattttaactgtttacatttgtgtatgttctgttgagtgttttcagtgatgccatttttcatcttgaatcaatatatagacaagtagtgtgattttggtagtgtccttttattttaaataagtaggttttaatactgctgagtgattacatatggaggttatttctggttgggcttataagattccatataaaagttataattaatttccttccttaaaccaagggctaattgattttccattgcactcattaaaaatagatacttagcttttcagaagattgtctcagaaacccaaggcagggcccaggccctctgggatgccatcaactgaccattccatcagtcctagaattgtgaccctcctacttgtcagaactgaagtatttatcccatttcccagcagataaacatttgcaaggcaaataataaattagccattaatcagaagaatgtttgcattcgatgaactctgaatggagtggagatgtcaggtagatagacaaggtaaatcaacatggcagaatcaatcacaaggaagagccagccataatttagaaagcattgacccaaatatttaacgactttggaaggtaagaacattttgtaaaggaagaaagctatttagaaaaaggtgtgggtagattttaataatagatagcaattaagttttaaacatttaaggcttcagcctaatgatagacatttggaagtttgatttgaaaaaagagacactgtcaaatatttatttttaaaggcccgtgtgttcaaataattttttctttcccaggagtgctctcatgaaatgtacccacattataattttttttcaaaaaaacaatttagcaagtatattgttttaaaagcaagaagtgaccttgttatgttggtgttctttgattcctaattgtgtttgccccttcatgtgtatgatgcaaagactttcagattgagagtctgaaagtcccatgtgttgagctttgcttggccacttaataatcatgtggtcctggggaagtaacttaaccttttatgacccgcaatttcctcatttgtaaaataggtcttggcaccattcatttttttacgtagaagacatatgtgtgttgtataaatttattctaaggcattattcatattttaaaattcttaaaaaaatcagttattgttacatatcttgttctcatgtctaatcagttagtgcatatcttgtttctgaaaatgttatacctaaagggattaaaaggctcagtggttataaaaaacaatattatttctcctaattctcatgaggttagaaactacaacctttgttttcttagaactgaccatcagggaaattgcttttgactccaaacacctaccatctggcatatcctatcttctcattataatatgtgatgcctaaatttgtgagacatcctggactctccacatgtgtgtttttcatttcttgaccccaacgtagaagaaaggatggaagtaaatggaataaacataattctcaccgttgctttcctagttcttcatttctcacctactcactttcttcccatgagtacaattctatcccccagttaggttgtgcagatgaggtatcttttcaagtaatgacacctttaaaccaaaacattaactgagtcctgggtgtccccctccccatagctttgcttgactaagaaaattcttctaatccgaaattttaaatgaaaacatgtaatgttgattaacattgcctgaagcacagagtacgattaaaatgttttgagattttagaatatataaatcactcatgcaaaaaaaaaagagttttctttatacaatctagaaacaattatattagcccgtattaataggcttcaaatgaaaaacattgaagccaatacatttcaactgggtgttcatgctacttgctgtggggttttttaaaaatttatttctagttaataccccttatccccatgccatctttgtctttctgtcttagcaggtaactttaacctaaatttcctgaagaaataggaagttattgtatgtgaattatttattgcttacctcaaaatttctccaaatcttcatttatcatttcctatttctgttctgatactcatgtctgtgactaacaaacctatctgcttatgtttatgattttcatttactccagtcgaaacctgtcaaatagctactttttcagtctcattctttattaattcttccttacaatataagcatacccagttctcctccatcttaaacacaggagagtatagataaaaagaaaaattctataagatttcatggagaaaaggaattatgtttagctttggatttcaaaaaggcttcataaaagaaatggcatttaaaaatatcctgaaacactaatattataaagcctgttttaacataaatactacttactgtcaccatacggtttttgtttttaaagttgctcacttctaatacctgaggctacaataaggcacataatcttcctaacagtttcaatttataactcatatttttcatgacaaccctgtcaggtaagttgtattactattctcattctgccgatgtggaaactgagtcaaagaaagattaaacaacctacctgaaactatatatttagtagtaattgttagaaccagagtttgtacctggttggctccaggttctgtgcctggccactattcttattgcttctccacatagtacttgcatatatgattaaccatgaagctgttggctttagaagtcttgcaaatccattttcagaattagtttgggtttttgggttttttcggggttttatagagcatcaatagggaaatagcatgaaataggaacagaaatgtagattggaatgataatgtagaggtccttaaattctagactgaagaattctgacttaatttaattggcacacgatgaggaatcgctcaaaattttgaacatgaagtgatattgttggatctacgtgttagcaacagtggacagttggaggcaggaagtgtgtgaaatggataatcatttagaagctattgcaaccgtgtgggtgagaaaccaggaagcctaaatcaggaaggtgactggaaaggagatacatttgtgagaatggtttaggtagcatttacaggattggccaagctgggatagtcatagatcaaggcaagcagggagagaggtgactccaagattttaaatcataacttagaagataaggagctgctatctgaacactgatcaaatcagcctgaatatttattaataatttgggaaatatctgccttggtacatgttgactttgatatattaatggaaatttcagataacgttttggaaacgtcattctgtaagtagggagaaaaatcagagacagaagtataattttggaagtatctagccaaaggaagttgaaaccatttgagtagatggaataatgaaagaatgaagtatggaagctgaggtggagaaagcctgaaaaattagtctgtggtaggacctccattaaatcagcaaatagcaggaacagaaagaatgagctgggtaagaagagctccaaaagattgagggagaactagaataaggaagaatcataaacaataaaaggaaagggaattctaagaagcaagagagggtcaaaattcatttacttcagagctaattgagaaaaaaaaggtgtttaattcatccaaaatctctaaagaaaaccttctgttggccattattacagataacctttaacaatgataaatgtacagtaactacttacatatgaatgagtcagtgaaaatactcggacggatttttccctttcggtgcattcagggtctgtgtggaagaattaatgctttcagaatatttgtttgtaaacacaccatctctaaagaaaattttagggtttctattgattttttgatcaggtgttcacatatgtttaaaattataatggaagtcaatagataaacgtgacttggtgtacaatatttacctatacatggcattctagaagcatatatcattagaaagatcacaacatagtttgttccattttatgaattgattcttatttatctctgctgccaaaaacttgtggatctcactagagccacacatgcttaaacttaaaaaacaaaaatattttagattagtgaaatccaaaatttacattttacattttttaggaataaactgcattatattaaaactgtatcactggtttgcttgctagatcagaataaattttgatccagaagtctgtgacctcttgtttggatcaagggttgtttcttatataaaacttacaagttcaatactgagactgaacaaagccaggaaacaaaaatataaatttgatatggtctgtttgtagaaaagacaataaaaatgttgagtacttatttacaaagcatgtcttcaaatttttctttaaagaatctgtaggtaatctgtattgtggattcattaagtttttgacttaaaaaaatggaaaaaacacaaaagtaggaaaaagagatttctaaaaggttattgttaccactggttacttgtaaacctacagttcactttgcactaaaactttggatatgtctcattgattagaattttataatataaaaatgcagccaaaatattttgagttttgcattttaacaaaatttcaagtccaaaacctctgaagatgttttttctcattgaactaggcaagtcggaaacatactcttaatcctgtcaatggttctgagagcctctctgctttaaatatatgataatactttgtttcatgtcatcttattattggtagtacagtcatccctcagcatctgtgagagattgcttccaggacctccaggggatatcaacatccatggaggctcaagtctcttctttaaaaaaagactttaaaagtactgtttgcatacaatcttgtgcatcctccttcatactttaaattatttctaaatcacttataatatctaatgtaatataaatgctatgtaactggttgttatactatatttttttatttgtattacctttaattgttgtatggctattcttaaattttttgccaaatatttttatctgagcttgattgaatccacagatgggggccattggatatggagagccaactgtggtttacagtctagttttctatttttctagttaaatatataagtagaaaattaaatttttaatcaataggcaaaagagagcaaggccatatactttacaaagaccatgaatgatttgtgaagtagatctctttcccccttcatgttttccaataagtcaacacaaatctctcttccatttataattatgtacgtatatgtgctaaataaatattatgcttcccattcatacttctgcaactccttcattattttctatttccttcattcagctaatatttttctgaatatttatgtgtctagaagtgtttaggttcaaagagagagcagtagacaataaagacaaagccctgtctctactgaacttcctggggaaagagctcgattgaaggcaaatctataaacaacataaaatttaagattaagtagacagtaaagacaacatcacagaagataaggggtagaacatgctgttgaggtatgggcgcgctacaaggtaggatagatgaagacaatggagaagagcaatgtgttgcatactatttccatgccatataatccagatttatcttacccctccattgatcgttttgccctgtagatctgaagtttccaatgcacaaagatacagtggcagaatacctcaaatctctctcaaatctctgccatttagaactttttgttgatgcctagatggttggctttgtttcttaaagggaaaaagtactctttcagtgtgtttgctctcaactcatgctcaacagcaatgatctcaaatctccaacacttgctcatcaaaaaatatatgctcgcgaatagatttcagtgcttcagattaatgaaaaaatacccatccttactaaacaggtgagaatgcaagctcaagagagccagcaaagagaacattttaaaaaatgttaggcactaataacactttgaataagtgtcattttttgaaataaattttataccccccacagtgtgtatataattatatattgccatgtacatattttaaaaaataatttacataggacatatttgactcagattgcacttaaatattctcttaaatatactcctgaagacattcttatttttagtgctttacagaaatattttgaaaataggaaggctactattagtaagagcaaattgaatttgagtttgatttgttaagaaatacttacgctgttctctctagtcttagtgtggtttcagcattagtcttactcgaggcagttgaatactgatatgattgcagataacttggcaatctgctaatggttccaggaggttcattttgatgtatttagtgaatcttaggtaggtaggtatgtactaacatatcatagtatgtggtacttactatatatattcctcttatttacagctagctacaaaatattgcttagaaacactgaaaatgaaaggctatttttttttaaaaatctgtcttttcctaataaaaattcaagagctttaatatttagtaactgcctttaggtttagtttgtcagtgcccttcacgcgcttaataataggcttcaaaactcctggtcacttgctaataactcttcacttctcgggagattgaattgctataggccagttttcctaataagcctgcaaaaaaaaaaaagttaaattgaagactcatgtacgtatttccttttcagctattttttatacattgccatgcaaatatatttcattttttcatatagctcatgaatgtgcatgaatacatacatatgcacttaacaagaattttgttttgaaaaaaaatactgtggtatatgagaaaaattgtaatattttaaatgaagatattagtaccagagaaatagctaatcaaatgtaagaggcaagaaaaaaaaggccacacattaaacttgtgcatcatcaagatttaaaaaattaataacattaaaaacagttggttaacattcttttcttttgctatctatgtcccgtttcttttaaaccttgaatgtaacatataacatttaatctcctataaaattgtaattattttccaccaaaacacaaatgagtaaacataaacaaaacagaaacaaagattggcctttatggaggaattacatgtgactacaagaagagattttaaacaactgctagggtgcggttaaactgtctcttacaagttgcggttctggatgtactctgttaaggagatagtttcatgaacaggagcccgtttgtaattagataaggaaaactgacagcagcagttgagttagtggctcccatggaatgacaggtattgactgaaccctgggctgtgtttgagatggggagggagtcgataaaagcatcagggcttgtttggagtaacactgccagcaatgctttaatttgccgcctggaaaagagccacagacattcttcccccatgtttagtgttgatgagatctaacacttacatttaatcttctgtttaccactaaaaacacttgtaagtggtatatggcaccacaaagaggaaatagaacagggaagcacattttgtataaattctatgttgcagcccaagtctagaaaaaaacacctcatttgaatcattgaatcaagtgtggaaggaaaagtttaacaacaacaaaaaatcagtttagaacaaatgttttaactgattttgaagaagagatagggagtagaaaatgtttctaaactaccttttgaattctctctctctctctctctctctctctctatatatatatatatgtatttttttttttttttttttgagacagagtctcactgtgtcgccctggctagagtgcagtgggatgatctcggctcactgcaaccttcacctcctgggttcaagcgattctcctgcctcagtctcccaagtagctgggactacacaaattctttatctatttttctatataccatattggtttaatgaaaaaaagactgtaaatggaaaagctgtgatgttcatagacacattagggatgtattattatctctacataatttaaagattcaattttgtactctgtttaaaagcaaatgtattcttattaaatacttcccagatatttttgaaatgtcttacataaaaacatatgtatatataaattctatgataaaatattaatgtatagttttatatgtggtatacactttgacccataatatctacccataaaaatccacaaaagcacccagattttaatactgaccattagagaactcaagcaaaatgatttttgaaaaagagttacttctggaccagatccaacctagctgcatttaacttgctgccaaactcaacagacaccattataaaatttgcacctacttattattacaaattcaagtaatcccctaactgtgaccttcagtgcctaattaaataagggcagcatttaaaaatactagatgacttcaatcttacttagttgccagtgcttaatgcttcccacctgttgtaacacagaaaatgcccaaggtagactgcaatgcctttggttttgccaggaaatttcaaaagcttagggttttgtagtgaatccacactaaactcctgttaggctcaattagatgatgtactgagattatctgacttgttgtggagataattactgtaccagggatgagaggccacccatgcttccaggggaagctcattgaggaggctctttccctatttccatatatattccaaagctgtgtgtgtctgtggaaaatgaattcaccagtgactgagaatacggctctgaatttattaaaataggacttgctgtgctgaaagaattttatttcggtatataattttaagcatggaaaattaaagaaaatcaagagataagtataatagctagtactgtctcacacacgcctaggatcccttagatgtgtaaaatgtatccccccttctaaagtttctgcagaaattaaagagcagaggaattaggatttaaccaaataaaatgtttcgcttgaaaatgcattaatgaatactgtaactaaaagaaaatgatgctcaatattcttgcttttagtgtttttcagaatgtatcaataatgttggatcgcattattttagtatatgtaaattttcaaatatttaattatagtgaaaatattttaaaatgcgaagtctcatatcaattacgtaacatatttttgcaccaagtccaataaacttgattcagtcagccattacataagtagggacaactgttaacatctctcttactggtacaatgattgattgtagttaggataaccctgagtacttcacgtttcacaaaatcagtatgattttagctatatctatcctactgttatgaaagtttttagtcaccttctgatattttgtagatggttatttctttgtatacagttgtttcatgcatagagcttcattttatttctttgcaaagaaatatttaatttatatttgtcagcttttgtaaccatgattaacaagactaattgagattaaagtactgcctatcaaaaaatttccaacagttgggactgaatatttgggcaattcatatgaatttatatttatggtggtggaaaaagccaaataattcagaatttacttgttcattcaacaactaatgtttgagaaccatacttggggttaagctgggacaacaaaagtatacacaagttcctttcttaaaggatcgcttgtctaggaggagagaaagacatgtaaataaatgattgtagagtacagtgtgatcagcacagtaatagaggcatgtgcaagcttgaacagttattctgaaggagggagcaattaattctgtctgagatgggacaggggaaggattgaattcgagcccgttcttttgaataatacatgaaagagcactagtccatcctcctaaattgagtagtttagccaaagagagctgccaacctatcgatcaactgatgagaagacagaacttagacctagcaggcctaaatgaatagtgagctgacacaagcaggtatcagtgccatttgtagctttatccctgaaactgcaatgagttggtgctctcaacaatctctccatagagactctgtgttcccacagctgaagaaactttatacaaaggtgttaagtaaagactgtggagagatgcaggtaactaggtggataaatggtattatatgagacctcctgaatgcaaaaacttttcataaaatacaagtcaccaaatctctttgaatgaaaattttatttaagcatttctgtatgtttggtaaggtattctccctatcttagggaatagaaggaataaacaaaatgaaacaaacaaacaaaaaacctttacttgattttgttctctgcctcaggtcattataatctacccggtcaggctccagactgtctctgtaatttcatactctgtaattcactgatgctggctcctgttttatcactaagccattaagctttctcaaaaataaaacaaaaaacaaaaaattgtatttgttctagcctccaaagctgaaacgttctttcctttatcttctcccccataagctttaaaaatttcaggaaatctagaattccacattctccaatgttgctgtagggattaccttctcaactggacatatgcctgggtggtctataatacttatgggctgagttatttcctcacaaacttcgaatgttaaaattctaaaccctagtgtctcagaatgtaactggatttggagacagggtctttagagaagtaattaagttaaaatgaggtcatcagggtgggccctagactaatgcaacgggtgccctcataagcagaagaaattagaacacaaacacacacagtggaaagaccatgtaaggtcataggaataagatggccatcaagggcagaggccttagaaagaaccaaccctgctgaccccttgatcttgaacttctaggatccagaattgtgaaacaatatatttcttttgtgtcggccacccagaatgtggtattgtgttatggcatccccagccaactactacaatagagatgacaggtattgtttgtgtatttcatcagttcattagcattgatgttttgttccaactggagtttcttaatcacctcttgtgaacatcatacagattactgttcccagagtaagcaccaatacattgctgttgaattgattaactttcttttcatgttttcaaatgatatgccacaattcacaagttgatttgcactgtgctgcttatcacattagcacacagcgtcaatttttctgctgtctttaaccaccatatatttcacattaggttgcatatgagcttagtatcttttcccttctgatcctggacatcattagataccatgaaacaactgaacctccaggataaaaatatttatagctctgctcattgaatgaagaggagcatgtttataagatggttttaatgaatgaaggctctggaggttttcttactgctggacaacataacctgaatctccagagctggttttcactaattacaaagtgtatgcgttttctccttataaatcttgcatcagctttatttttaaattctgagatttgtgaaatactgggtcttttaaatcaaaaatgcaaaactagaaatacagtcattcatttaccaaaaaattttgaagcagctatgcgtgaagcactgtgggagatagaaagatgaattagaagtggactttgccattaataactttacattatgataaagggaatattatatgcaaaaaaggaattatgagtgagtggaaaaatatatgatccagaagtgatgcagacagaatgtgaagaggtcaaaggatcacttctgtttatgggaaccaaataatgacttctggaaagttggtgattgattttagcatgcctaaaacagaggatggggtttgggtttgcacatcagggagatagaagagagaaaatttcaggatggtgggacaatgtgagcaaaaggtaagaaaatatatgtattttcaatccttatctggatttaaagaaaacattgaaataagtttgcttaacattagttaatccttcagtgttagctttaagaaattataggaagtaaaaatacatctactgtttctgagtatgggtttcacatgaaaatgtgctgcgtcttttatgtatacaatgaattatgaagaaaagctttggataatatttcaggacctataattggacaagtaagactgagatgatataatgcttatttttgcatcctcagattctagcatcatagatggcatgtagtagcttacagaacttcttgatgaattcgttgtaatttcagcttgaaatagctaagtagccatagaaatagagtataatgcatggagcagatatctgaaaacagatttggcaaaatttgacaagtctctgggttcagcgctgccataaacagaattgtcaaatatgattttaaggcttgaagctgggatgagaggtagaatgatagttccatcaaaaatgaggacaggagtcagtttattgaaagataatgacttcatttggtgatctgctgttggaaatataggatagtggataggcatcttagattcagatatagataaagtggagaattatctctttggaatggttgttacagacagattactgaaggggaaagtatagagagtcaaaggtgatgctgaagagcaggtttttagtgaatgagtatttttgaaggagagaagaaacggaagcatagaaggaaagaaggcagtagtcagacaaatagaaggtacatcaaaacgtcagtaacaaaaccacaatgtaataccacgttagtcctgcaagaatggccataatcaaaaaatcaaaaagtaatagatgttggtgtggatgcagtgaacagggaacattgctggtgggaatgtaaactagtacacccattatggaaaacagtgtggagagtccttaaagaactaaaagtagaaccaccatttgatccggtgatctcactactgggtgtctacccagaggaaaagaagtgattatatgaaaaagataactgcatgcacatgtgtatagcagcacacttcacaattacagaaaggtgcaacctacccaaatgcccatcaatcaacgagtgaataaataaactgtgatacacacatatatatatatgtatatatatgatggaatactagtcagccataaaaaggaatgaattaatagcatttgcagcaacctggatgagattggagattattgttctaagtgaagtagctcaggagcggaaaaccagacatcgtatgttctcactcacaagtggttgctaagctatgaggatgcaaaggcataagaatgacacaatggactttgggaatttagggggaaaggatggaaaggggatgaaggataaaagactacaaattgggtgcagtgtgtactgctcgggtgatgggtgcacccaaatctcaccatcaccgtgaaataacttgctcatgtaaccgaacaccatctcttcccaaataacctatggaaataagtttttttttttaagtcagtgtcataggaataggaggttagaagtagacaaaaatgtttaatgtcatggggagattaaaatgaagttagtggggaaagacctttggttttgaagaccagaagctttactggtgatcttgtaaagagcaaattctatagattaataactttagattctaactggtaacagagttaagaaataaatgagagattattaataaagtaggaggtgatggtttacaggatcagcaagatgagaagaaaggccctttggaatcaagggagagcatgcaggcaaggctgaggaattgaagtaataatagaaagctagtcagtgaagcagtactttagtcaaatgcaaaagagattatacggagcacagagggcagtctaggacttttacaaaactaaggatgttgatttttcccccatattgagagaattgcttttaatagtcatctctttaagtgtgttaacaatccttgaaggctgatattaataatttcattttagacatcaaaactgagatttttttttgagagtaagcaatgtgattccaaagatataacctggctttaaaacctgcagcctttctactattaccatcttgttttttaatgtttgtcctgactgattagctaattttaaaaatgctttaacttcctttgattaggcaatattatttatagattgaactggcttgctgaattgttacatgttacgtaatgtaatatgaaccatgtcaatgtcagctgattataactcacacttgcggtattcaagaggcaggaagtgaaagctataagttttctgtaatcattgtcacaaatgtaatcgcagctattgtttcttctgtaagattctcattgaagtaaatgaaaatgaagacaaatgaaaacgaagacatcaataagactgatccttcattgtaaaaagctaaaacaggaaagcagtatcaggattaaataagacatctatattaaaatatttcttctatgaagtggataggttagaagaatatgaaattattattagatcctcttaagctaacttatctatctagattaacttgaaactggccattcagcaaagtgcaaactattaataacacattcaggttaaaatgaaatatacctaagatttgtttttgccattcttaggcatccaaaagttctgattggtatcccaaaggcccaacatcccaattgtaccaaaactttgaatacagttcaaaataagtacacttaaaattagcaaagtctatgtcaaaacagtaaaatatccttatatttatgatgattgctttttatctctatagttgtttttggtctcgtttttacaggcaggtgaatataatgacttgttgcacttataaaatacttcagtcccactgcagaatctgtggatcatccttacagtcgctgcctcatgagcaatgctacatattagtattttttgaaaagactttaggcaatctcttcaattttatttattttggcacttggaatctctcttcatattaaattgtagaaaaagcagctctgtaattattttcagtccccaaaagttcagtcttttcaagaataaaaaagtgtattatgtttaaaatgaatgtatagaagtataattagtatatttgtattttctttcatcatagaccattgaaataagtagcagaaaatgactttgcttttttactttaaaactcagtaagggatgaaagttggtaggtaataaaacatattaaatgtaatcaagaatactgactgtctaaatgtacgctataaataaaattatttccaacctctctattaccataaactattagaatagtattttcaaagaaggtgaatgagtaagaccataatttttgtaacattaaacataagaagtcctagatctattatgtcttgcttatgtatcaattatctttgatattatgtggattcttcttctgaattatcagtgttactaaaaaaaagaaagagacagaaagatttgaaatgaagtaggcttatttacttatatattatttgctctgaagggtaaaagccaactaaatggacttacaaacatacggaaaaattaatgtataggatatttttccaaccaaaggattaaataatatgaaagagaaacactaatattagtcaaacagagctacctttaccctagagagttattaaagtctagatgtgttttatatgcaaaatggcctgtcaggattatggaaaaaaattctgacacctgcttctcatcagtgccccagaaacaaaggtgaagaaatgggtttctgagcatgggactgcattgcttcctgggtttgtcttaaaaatacatgtgtttttatgtggcattttcatacttatgtatgagtctttcattcgtttaaggcagaaaaagtgccagtaaaagtaaatgtctagtgctaaaacaaaatacacccttttcaggataaaactggcaacaagcattttattatgttgtaagagaacatttttactgttttctcatatactgttacatctctctacattctgtgttcaccaaaaatttaaaaatcactagtcctgaaattatgaaaatcggccactagaatatttgactaatatatttttagaattatagtcttacatagagccaaatagcagactagaataaaagggattattttaatatattttcaaacaatgcttggtaggaaatgataacatttctagttcaagatcaaatatttgaaacttgaagccagattacttttgtaatcttgtgtgtgtgtgtgtgtgtgagagagagagagagagagagagagaaagagagagacttggctttctgattcaaaatacagaactttttcttatataaaatacgtgtttaagtagacatactgtgtcagacactattaaaaaatgactgagattattccagctgaattagaacccttctcacagattatcacagtgatttggcccccgatgaaatttctgagaattttatacttgtgatgtaacaaattttgtaaatgattattgtactactttgttttggtttgaaattttaaactcttacaactaggtatgatagggttaacatgtggaacatcttgaagattatatggaaactgaagaagttacaggtttgctgagacaagaacactgaagataagatttgtaacactccctcttagaaatgaccatggaaagatgataaatgatatttacctcatatgtcatgataactgttttttaaagaagatatctgtgccctctgttatcaggggtatgggaacatgcatcacttacaaacactcaatcaccgtgacataaagaaatagcaaaccttgaacatgtcagaacagtgcctgttcaatctacttctgtttcttgaacaccgagtttattctcaatattgtatccccaaaacaagtggtctttagaatatgatgtttactttctggtgagacttttgtgaaacatgtaagcgggtatatgagtatacacagtatgtaacaatttaataaaaatatattttagaggcaaaaactatttcgatagaacagcaatgtatctgtagttgtatctttacttaaactgttaatatttattgaatgctttctatatgccagatgctttgctaagagctcatattaaacacaggctggtactgtttttactcccattttacagatacaaaaactgaggcataaagagattaaggagttcaaggtttcccagatgtagttctaccttaagtataatttaccacattatttgaattttctgatactaaattcaattggcttaggttactggtgttagcactcttgtccgtgatctttataaagtatacacttttcatctccatgaaaaagaggaagtagtttgggttgatttaacattgactttgaaatgacgtatttgttcttctgtagtaatatagtatttttctgggggaaaatttgacccttgtttctaaagaatgcatgaaatttctgcaaagatcctatctatattaaacatgggttgtattccaaacatttatgaaagactagtgtacaagtaaaattggatagttatctcaaagttactagaaaattctagctgtgctcagaaaaagtcttgttttgtaggtatttgcaactttttcagagttgcattatctgtgtgtaaaatataaacaagaattctgacctctattcttaactgttgcaccagatgtttctcaaaataaacgatattgtctgagtgctctataaacagattccaacctgaatgcctccttttagcgtccctcccaatttaacacataaatatgaactctattttcttttcagacaaaacctgtatagtgtaactttttttacgagaaaacagtgaaatgtagcattataatctgtgaaaaacaagcaggatcttggcaggcagagtctagcaaggaagtcttgtgttttggctgaacatactctggacttttatcttggctaaagctttttttaaaagaacatgccttaaaataatttgtttctgctgctctatgctagattttgaagagttttatttagtgcctggactcctggtctatgaggaatgtgaagtctgtatacaaaaccattatactgatgacactttaaggaacttctaagatggtagtaaatttgtgttctttatataaattatagaatgatgtacaagaatggttaggtaacctttttaaaaggtgaatagtcctgctggcaagaaacataaatatgaacctcagaaaaaaatgcatcacagaagtccatttttaaataggtgctcctggaaatatttcaaatgttgtaagcaaaaaatcaaaacacagaacttcaggaagataaaaacgaattaacaaccttgctttttgactatagactcccattaaatgctaaataaacacattatacatgtgtgggatatttatctaagttcttatggtcagttaatagtaatagaatacactgtaatactagctacatgtattaatgacttactgggtgacagacattttgcttcgagtatattatttcatttaatcctgaaataaccctaatcggtattgtaagtttaccatgaaaacagattaatgtgagcaccttaattttttgacctgttgtgccactggttagtccagtagagagccataaattgagcagagagccttaattgctcagggactcggtgataggcctaaatagtcatgagggatttcactagatcattcaactctttaaaattgtggcctaagacagataggaactgtgatctctagggataagaggctaatacattaaacttgtataccatcttgcttttggcatttaccatttcgcccttgtattccattttatctaataaaattcaaggcacttggagttttttaaacgtggatattgctgaaagtttcatctaactgggcaaaggctacaagttatgatttagttgttaattagacttaaagaacaaagctaatgctgttccatttagtgagaaaggcctctgaggacctgagaactgaccaatattggttctcctgctgggaaaacactatgcataaacaagtccccagggcttcattactgggccttttacacaaacacaaaatgcatcttagtttatttgaaaatccttacaatgaagctttattgcatatctataaatttttcacgttgacatgtcaaagacttgtaaaagtatactggcgagagaacgataaacattataaataacactttccctttaaatgtaagatgattgtagatagtacacagcatggtcataaaatgaatacagttctgtttggggaagcaattgtgggaatgagtagtaatgtctaaacaggatggcaaactctttattgagaaagtaagcaatgtaacattatttagcgaagttggatatgcaatttttgaagattaggagacaaggtatgtcattttatttggtgattttattaaaagacagttcaaaaataaattttaaatgtcaatatattctcaatgatattattctatctttgcaagtatttttagtgttctgccttatgtgtatgttttaatatgctgaacatgattctttatttaaaaaaagggaaagtacattttcctaagaatttaaaatgtaattccttcatttcataaagtccgtgggtcatactactacaaatttctctactttgccatgttttttatacatatttcttaggaccaattcctatagaataagtataactttaaatgttgaatgtagctattcaagtttggtcatcattggaatgttagtatttctatttatctaccaactaatttgaaccactgagtaaacattcttagctaaaaattgtttcagttattttctactggtcatgcagatatcaaatgtggggctctaaactcagttatttctcattaaatttggaaaatcttttccattttatgaacaaacacaattcctttttttttttttttttttttgagacagagtctcacccaggttggagtgcagtggtgcaatcttggctcactgcaacctctgcctcctgggttcaagcaactctggtgcctcagccccccaagtagctgggactatgggactgtgccacctcacctggcttatttttgtatttttgtattttaagtagagatggggcttcaccatgttggccaggctggtctcaaactcctggcctcaagtgatccacctgcctcagtctccaaaagtgctgggattacaggcatgagccaccaagcccggcccacatttccatttttaatatatactgtgctttacaaatattataatatgttttaaaatatgttcacagaagcacctggtctgtgaatggcatgccagcattaaaaaaaataagcattctttgaatatatatttagttttttaatgtggtaggaaaatcaaagccagagggagtagaaacaaaatttgtgattttctaaatacttcttggctgcagggaagaaaccacgtcccaggcgaagtcctacctaatttgatgataaaattacatggaagggattcttgttggcatgaggacctaccaagatggtcaacagataattcaaaaaaaaaaaaaatttagagataaggtcttgttctgttgtccagaccaggttgtagtgcagtggctctatcatagctcactgcagctttgaacacctgggctcaagcgatcctcctacctcagcctcctgagtagctgggaatacaatagtacaccaccatgcccagctaagttttttttttttttaaagacagggtcttgctatgttgcctaggctggtctcagacttctatctaacctcaagtgattccaacagataacttttgatgaatgtgagaacctttgtaatcttctatgtacttacattaaccaagtaatttcacagacaaatttccttctttttgctaattgggccatgaccttggagtagcaaagggtgaggacaggtcatgacctaatcagcacagggaaataaaattatatcatccctctggtttaagaatttgcaccatagggaattgctctttgaacaagttcttgttctgactgatgcaaaacccctgatgtttcttaaaatttatacaaatttttccagtttccataaaactggaagaaaaaaaagaataaagtgaagcctaccccctcctttttgaagttctgcatactaagtatagtgctactaggaattatttatttgacaaataagtattcatctgttttttaatgtgaaaatcaggaactatattttcagatatttagattaattttatattctgttttgtttttcccacacaactgtcaaaatcaaaagcaaataaaagcaaagtaacatgttgtgtgagatgacagttgatgacagacaccaatgggcatgaatattgattcaaatattttgtttttattatttcacatccaacccagaaacatttgtataataagctagttcttatagttacagttgacagtaggatcagtggcagcttaatccaatcaatcaatttacagacttgctccagattctctgggggtctctccactgaagatctcttcttgtcattggccccattcctgctaattaatgcctagttgtcctgtggtccctggacctactgttctttacgtaagttcacttatgccaaacttaacatggctattagttacctttggcagctcctttctttggctgttacttaatctcacttccatactttctggttacttcagactccttcttacattaaaatcttctgattacatatactagatttgtatttaagatttattttagtgactgcagaaaaatgagttcatttattcaactcaacaagttgaattcattacttgaattcattactgggaattcattaattgacatatgtatattcattgggtaaatcttgtttataaatctctttttaccaatttgaaaaagaactctaaaattttctggaatcagtgttaggttaactgtgattattagtttattctgtctttgacctgttttattgtttaaaactttgcctgaaatgattgatttttggccattaggacaaaatagaaaatataaaattgcattattgggttattagaaatatggcattggatgaaggaatagttatagtataaagcttgatttgtaatattttatttctatcacaaatgcatttttatagtaatcattgtattagtataaatatttaatttccattgttggaaattaaatattacatggctcttggaagaaagaatttcataatataggggcaatgtaattaggattttgcatgttggaaatggcagtaaaatctatcaatatattcccttttataaatctcaacccatgagagaaatgtggtgttgcttcctttcagtgcctaaccaccccttcaaatatgtttttctcctagtttcattacattcaggtaaataggacgctatacagagtataaatctaatattcttttttccccgttaaatttgccatatgagcaatttgtcattgcatctttttatattatatctgacttgtttacaaaatgtagaacattttattatcttgatttttacatgtccaatactttggtgaaatggagaattacaggaagtcaatcaatgaaatattaagcagttataaacagaatgatgtaaacatttttcaaaggaaattttatttaagttaggtttatatagctttttctctttcaaatgaaggtaaatgcactgatgagcagttcaagaaaaaaaatctaaactgacagtaaaattgcaaatgaaattaaggaaaaaggaacagataacacaaaataattttaaagattctcttctttttaacaattggacatttaaagttcctggaagtatagttcacagcaaacattttaaatctgtcttatctatattaataaaacattctaggcttgctttataagaaaactttttagaacgaaatataagcagttttagacttccagatatagcttataataattgtctgtacttgccttgcaaaattatattacaagaagaagcacacttgttatagaagtgctgaattgtatggaacctaaatctgtcaagttacctgtctttcaggtccgtctccccacctaccagacctcattatattatcccgaaaagaacacgatctctttaaggctaggcaagtattgcgctgatgagccagggactgcccaccaattggcaggcccattgggtgataaatgtccaaggacctctaggctgacgacacatttttcatcattaatccagcctattgtaaccagggccactcacattgattcggactagggggcatcatctgctgttaagagggtgatgactcgctaaaaatgaaggcctgaaactaatcaaatatatttagagccttccctggcaacttgctgggagagcagcagtagacagctaataggggagccccagacaggtagcgcggtgctcaccatgctttgtatgggaatgtgagaaatccatttggaagcctgttgtgtaattccagctattatacattgtagtacgaatgtctgtaggattagtccaatactacggtatttgaatgttgcattaaaaatgtagttgagaaataccctgctttttttttttttttttaacctggaactcaattacaaagaacagagaattcgcaaacccagatctctttggaattgctaaattgtttttgtgtttttgaaagtttgcaacagatggtttgagacatatgcttaatatttattttactgaagttgcaaaatttgatgaggagggcatcttttttttttccatttgcagaactcaacaaatagttatgttttgctcttttatactttttaaaacctaattaatgtgtacttaatcagaatatacttaaatacattgtggcagttcaagggcatatgtacatgttatttattgatttttattattaattcatgcatatatattcattttagataaatctttattattttaatttgcattaataaaaaatggcttgagttaagtcataggtggagttgcaaacttgtttgccttaggcaaatgtagaaaaatatgttctttatttcctgcttacacctgattaagcaaaatcaggtacaagtaggaaatagatttaactgattagactcgttcaatggaaaatttcacttatatattgagcctaatatatcaaaaaagggcaaaatatgagaacaatttggcttaattaaaaaaaaggagacctaatgaaattgcttttgataaagaagaaggtagagaaaaaaaaaacaagaaaaagaaaaagtaaaatgaataatgcagaccctccaattgttcaagcagtcctaatgttctacacaggaaaccactatcttctaaaatattttatggaatcatgaaaaaatatttctgctgggtgggaaggcttccgtgtgatttctcttgaagaaagtcttcaatcccattttgaaatctcaattcctccaaattccaaagctgaaatttcacacctttcatgtttgcaagttttaatgagaattatatgtatacttaggtatcaactgcttctagtgttggatgagcttaggtggaaagcttcattaatgagcaatagacaacctcactgaatctacttcgcaatgaatattcagtctggagttcatcttaactgggtccatgaggcacactgccaaaaagcaacttgctattaagcatcaggtaggagcagaaaagagactgggtaaaataattacgttctttaaaaaacaagtttgattatggaatctatttaggtcctgttggttctagtgaagttgagtcagggctagtaagaaaatgtctggaaaaagaggaactgatttgaacactgctgacctttatgcttctgccatcagaaagggggtgagacttcaacagccaatgcaaaggaagctgagaaaaaatcaatttagctttctctgctagacagaataaaggtctctaaagatatccatgttctaattcccagaaaccgtgaactgttattttatggctcaaaagggattgtacagatttgatttaattagggccttgaaatgggaggttatctcaggttatctgggtgtggccagtctagttacatgcacctagaatgtggagaaccttccccttttgtattcaaagggagatgtaattatggaaggcaggtcagagagatacaacattgctctctttgaagatgggggtgagggggaatgagctaagtctatttgtgtatttgtactccaggccctagctagaatgccagcttcacaggggccagaattttgtcctattcacatttgtatcactggcacccagtacagtgcctgacacatagtaggtgcttcataaatatttgattgaataagtgaactagtgaacaaatgaatcgattactacgggcacagtttttcaaattttgataacccataagcataaagaaattgcatgatctccttgttacttacattctttatttataaataatgtctattcatcatacattaaagcaaggggtgattgatagagaatagcaggaaggcctggtcagggtggtcagcactgagaaggaaacatttaagttgaaactcaaggatgagaaagactcagtcttataaagacctaggggaaggaaattttagacagcaaaaaccacctgcttaaacttcctgagatgaaaaagcagttggctgatttaaagcaatgaaagaaggtccggtggctggagagcagtgaacaaaggctagagttaactaatgggaggttagaaggtcattgtggcaatgtcccaatagtgggacacttgaggaccaaaggaatgagttcagattgtacatggctttttcagccgggccccaaaatatttcttagaaagacattttatttacggccaggcgcagtagctcatgcccgtaatcccagcagtttgggaggcccaggtgggcggatcatctgaggtcaggaattctagactagcctagccaatatggtgaaaccctgtctctattaaagatacaaaaaaattagccagacatggtgctgtgtgcctgcaatcccagctactcgggaggctgaggcaggagaatcgcttgaacccgggaggtggaggttgcagtgagctgagattgcaccattgcactccagcctgggcaacagggcgagactctgtcctaaaaaaaaagaaaaaagaaaaaagaaagacattttattttaccaagtattttgtaaaaatatgctctatgttaatgtccttggcattcaatggtccctaccctcaaagattccagactcaagggagacaagtgtgtaaacagataaataaaatacagggtgatacatacaaatgacattgtaaccaacagcaatgattcccagcaggataatattcagtggaagataaagtgtttgctcctctggtgaaagatattttatcatctcatgcaagattccttcctggatttttatctctttgaggcagtacccactccttcactttttcatgcaattgttttccctcttattttgccataccttggagtttttatctaacaagtcttaaatcatcattgcctgtttcccttggaaaccaaggagaacctggttgaacaccagttggggaaatagggatgttgcctgagcttgcagatggtaggagcagacacagtcagccaccagtctttaaatgacggtggtcaggaggtgaccagggagccaccacaagcatattcagagaaaaatcatataggcaagttcagctgtttttattacaggttgaaagtcagtgatttcttagccaaaatggttgatgtcttgttctttagctgattcatctattcatagcggacactcagtgactgaggctgtttttattctgatggactcagtcaccattttttttttttttttttttttgtgacagattctcactgtctcctcaggtctgagtgcagtggtacaattacggcccactgcacctcagcctcctgtgctcaagcaatcctcccacctcagcctcctgagtaggtgggacaacacgcttgtgccaccgtacctcgctaatttttttttttgttgtttatagagatgatgaccccactatgttgccaaggctggtcttgaactcctgtgctcaagtgatcctcctgtctcagcctcccaaagtgttgggattacaggcatgagccactgcacctggcctaattagttattctttatattccattgaaatatactcttagagatattgtaatggaaatattcttattacatattattgcatgcaacaagtaagtgaataaaagagcaggattttatttatataaatttaaaaattatacacttttagatgtataagtatgtataaaaacgacattagaaggagacacacaaagctatctactatttgaaagaagattgcatttggaaggtgttatgaatgactttccttctaacaatgtttttccaacattttaaaatgtagtagtaaagaaatatatgctaataatttgtgtgtatgtatatcctaactaacatattttatatatatatatatatatatatatatatatatatatatatatatatatatatattttagtttctataggtaaagggaataaagcaggaaacatttgaaagattccaaatctggttacttttggtaggtgtcgttattattaaatcaattttagagccacgaagaaaaacacaataaatgcaacttttaaaaatttcaaaaattaaatgggtatcaccccctcatcagtcatacaaaagttttccaaaaacaatatttatattgtgttatgtgcaggctgagggtcccatgaacagttcttttgtcttgcataaagacgatgctcctagtctacaggcagaccagctgttctttccattgtaaagctttatcagaagggctatagttcagctcctttcttagtcaccatatgactttggacaatgaaaatgaaaacaatcacaatgagaatgttcttaaaaggagaaatacctaaaagccattttattttctgagatggtatatggtgtgttagttaccagtaactggagggctgatatggttaagcacattgtgtctgaataacataccaactggcaagcgagggttaccacagacaccataggccaggcacaccttttgcccaccaaggcctcaaattccaggcaatgcataagtacacagtagcacaagtcttttggctgaaaggattatatataattcgaatgcaattattaaacttgctacctctgtcattgctcctgttctttctagttatcatatatgaagctcctactaggtgttcatcattatcactgacctaactagtgaagctatatgacttcattattcttataacaactttgtagggtaagatagtattaacctccttatgctcagtgtggaaaaccaaagctacagagattttatgtaacttgctcaaggtcacactgctcataaaatagaacaacctggagttgaacccagaactttctagattttgtgctctttctacaacttcacattctttttctttttagtgagggaatacctgaccatttcgccactaagaagttttataaatgttataggataatgtaagtggaaaatctttccagaaagcagcaaactccattgcagcgatttgtgcttaactgggaacttgagcacataataacaattacagtttaatttttcttattttttaagttatatttatgatgttactctttgtgcctctaaattgatttaataacaaggccgctgaacctttgaagaccaaggaacatgataaaatattttagaaactcatatatttttacatttgaagatataatatcaatttttcatatttaagttttacataaaagtatgttggtctgtttcctttcactgtatgtgacattgcaatagggcatttatttctgtgtgtcttagcatgtgcatattgaactgaacttgtgcatattcattgtatttgttgcctaaaatttatataatagctggatcttgattttgaagtcatgggtattatttccatgaggggaaaaaacacaaaaaactagacttgtattctaaaatctacagtaagaaacggtgagatataactgccaacaaccagcttcctaaatattgtttatctttagatttttgccttgatcttcaaggacaaaacaagttatgggtggcctaatgggttttactaacttaaaaattgtacatttagattactcacaaattcctaggattaaaacaaattatatatacaagctatttagagctaattgaggagtgtgtatgtttctcaatctacatttttaattaaagcaatagctttaattcctgcatgcctagataggtatgcacattttagaagtcaaagaaagagtcaagaatagtatcaacgatcagagggaagccatccaactgtgaaactactggtcattgagttttttctgagttttaaccatatgtgttaatagcatttgttatacaaaatgttgatcattgtgactgtacaaaatggtatcaacacattttctgcagtgcacaacacttctacctcatgatactttattctaatttgctttatctgattacatctacattttagagtgatagagaaatgctgaatggtttgaagaaagtcaaattaatgatacttctggaggggtgatatagtaacaactactagtgtttttaatatacatctgtcatccttttcattaaaacttagggaaatgagctgggaggaggttgttctgaaatatagttatttctgtccttgtaacttcatcatttgctttaaaaattattattcatagataatttgttttttcttagcatgagtaatgaaatctaagaaatctaagacagccctcaacttattacttgactccccgacttcattcttttccatcttccttcctctattctctctttccccattcccttccctccttccttcttcctcacattcttcttctctttctttcttctttatttccttcattcatcaaatatttattatagtgcctatcaggtgcctccctgggtgatggtagcagcttcatgaaatgaaatttttcaccttctcaagatcacatgaccaagtttaaggcaaaggccttaggacagaaaatactcatccaggacagtttctagcagagctgtggttccgaacttttccagcagagatgcccttatccacagtgtattttagcatgtaggaaaacataatctcagccactcacaggaatgtagctggattggttggcagcagagagctttcaatatcaagtcatggtgtaaagtcagttgggatttgaagggaggtatgtctccctatcatgacgttttgttttatgtccagcgaatcaataaaacaagtaatttattgttccagttccaaatatgcttaaagaataaaagcactgcacataaatgtgctaccctaattgtgtgaaggatttatgtgatttgtaaaatattttttgctagatcactttatccacacttctgattgtgttgactaacaaaattaagtaatctttgatgcaaacatgtcttgagggtgattgatcacactcagttcttgggggtggggtactgttacggcatattgagaatttgcaaataatcttaggttaagcatctgtttttttcttagactgcttactgtgtaaaaataaatcaggttttatatctttgggaaggaaaacctgaataaggaagattgatgtgtaaccgagttatcggaagccaatgatggtgctgaaatttaaaatgtcagttttacagtgtttgaatatagtttctctgtaaaagttactgaatcagacttgtctttttcaagaaaccaaatgccaatttattattcacatagatttcattttttcgtcccttatactacttcacatttttattgaaagaggcttcgaggcttctctttacaagacattttgataatgattgtgttgatagtggcggctgaaactgccgctgttggaattgatttagcagtattttctcattcagtttttgctgcaactctatgagacaggaactttattcacaccgattttgcagataagcaaactgaagtacaagtgaattatggatgtcttcaaggccacacagcttccaaaacttatgcccttaattatgatgcaaagttgcctctctgcatggaaaaagtaactttaataaaagtaaggcctctcttttggcaactatctcttttaggataaaatacagcccacaatttggcctggccttaacctcatgaacacaacttacagaggagataaatgtgctttatagtagaaagtaaataagaatgactcaccatcttggttatgtaaaatatattgaggtctattttgagttagggctcccagcaaaacctggtttaattcttcagtatcctaggaggaactagagatgtaggttcagcaacccagcacaactccatttttacctctgaacctgcttcctcacaatcaatagtaattccctgatcataacatggcattcagtgcatgcaactaaaatatgttactttttttttagcaaaatatgctacttttattttgttcacattatccaaactgtaagaatttttactttaaataaattatatttgatgcttaattgatagatgataaagaattaaggttcagctttttttgtccctcaacaaatatgtgaaatcatttttatgatgcatttatggcaagagttttgtagctttaagtgccatgtttttttgttaggcttttataattttaaaaatctatatgtttaagtttgtattttgaaactttttagacttctaggcctcccttcatttctaataaacatagaaaaatagttaataatttttctagaatatgcaattttcatccttccttttagaggtccaattgactatccagtgggccacctgacagcatgttttataatttagtgttttctctcgaattgtaaatgtgtccaccacaacaaaaacatacgcttcaagacagattatccatgttgttttgttgaaaggtgtaatactgcccaattaaattaactaaaatttaggtagggagataggaatgggtcaagattcgtatcagcagttcaactgaaacgcgacagtccactgattccccttgcggggcctgtgacaggggtgtagctcccctgttcagttgctgcggctgctcagacccctgacgggaggggagcacagaccggcaggtgcaggagccgggcggggcaagtgctctgggctgcagccccgtggtaggtagtatctaggagtggatgcctggggctccagtgttgcaatgctcttttagcctttctgtccgcagacagcttaagtgttaaccagctcagtggaaccattaccttttcaccagggcagagggctagtgtgacagctttctgtatcctgaattcttgtccagtgtcccagaaggatcgggtcacacatgggcttgaaggatgaatttattgagtggcggaggtagctctcagtggggagctgggcgggggcaatggactgggaagatgatcctcccctaaagtttggctgtccagcggccaaactcctctctgagcacccccagcagaactcagctttgtgttcacactccttctcttctctctctttctctgccgtgccgttctgctgttcatctgcttgtctctccatctccttgcctccttctctgctcctggagcctggggttgggagtttatgtgggtacaggatggggggacatggcaggccaaaaggcaactttttgggcttgaaaacagaaatgcctattccccctaagggcagcaggtatccagacttgagggtggggcctttgcatgggaaccttcctcttctaccgtatttccctgtctcctctccatatcacatgcacatgtagtcttaaaccagcttaataagttgcactattgtagaaacaattttacttttttaatgtatgggcaaaaataatactgccgattatatttcaaagataaggaactcactttgagtgaagataaggcaaatattgaaatatatagaaaggttctcacttgaaacatgcgtaagatcagggttacagggaataagaatgtgttagtttcctagggtgactgtaacaatttactacgaaatgagtggcttaaaacaacagaaatgcattatcttacagttttgggggactggaaatttgaaatcaagggacacactccctctgaatgccctgaggaaggatccttctttgtgtctccattttctggtgccctcaggcattccttggttgggctgcgtaactccggtctctgccttctcttcacatgctgtcttcgctttttttctgtcttaacatggtgctcttcctgcatctctctctctctctctgtttttttcttattttattttattttgagacagaattttgctcttgttgctcaggctagagtgcaatggcgcgatctcagctcactgcaacctccacctcccgggttcaagcgattgtcctgcctcagcctcccaactagttgggattacaggtgcccgccaccaagcctggctaatttttgcatttttggtggagacgggtttttaccacactggccaggctggtctcgaattcctgaccttgtgatccgcctgctgtggcctcctatagtgctgggatgacagggtgagccaccgtgcccagacctttcttactataagactccagtcttattgtattaaagaaccacctacccaagtatgacttcatcttaacttgattatgcctgcaaagactctataccgaacgtggtcacatttataggtactgggatttagaatttcaatatatctttttgaggaacacagtctcactcataaagaagataatatatatttttaaaatttttatattatttctttttggaataaggtaattttaatgctagccttttttgcatgaaattaatttagtagtactctcatcagaaaataattacttggcatttttaagtttttgatggacattctaaataacgttgcaatattcttgaattgatagagaattcaagaattctgtaatccattgatgaaaccattcaagaattccagaatccattgatgaaagaagaaaaacatagacaaacagctcaaaccaaggctatgcattatgtgggaccagctcgttaatggtacacagtattttttctgctttcattaatggattggtgatttcaaggacactaactaacctttgcatcataaacattttgtacctataaactacaaataaagaatatagtttaaacaatcgtatgcaaatatgggcataatattaattgaattgatttatttggcaacgcaaactatagttataaataatataaagactatttttatttatgttttgtttttctcacttaccacttatctgcttctctaatcgtctctcttataagagatctaaaattttgaaggagtttgggatatgggagcatttaactggacaattatttctttttctatctattttagttagaatcattctaaaataggataaactttatatgataccaaaaatccattcggacagtcacatttttcatagtaagcgtcaatttaaactaactcttctatatgacataagtcagaattaaagttttgatctgaattatgtatttagatgcttaaatgcctctcattaacttaaggtttttgctaatgcttctatcttttgttcacttagccatcattttatctttaaaatatgcataggaatgtacataagtggagtcataacatcatttttagataaaagttaaaaatgagactgtaattcatttttaacatatttgtatgttgtggctgtacaaaatccaaaagtattttcactctccaatggggatgatgtgcagctcccaaaatggaaatagaggtaacgttccagtgatcataaaaggacagtcataagcttttagtgtgcagcagttttaagactatcctcagttaatgtgaggcaattgcagattcactgcatctgagtttaaacctctcactactttgagtgaagtctattaatgatatgccttccatgcagctgacattttaagatccttgctgcttttcaaaacgcgtgggcactaaagatgtcttcttgctcttgagaattgatttcatacacaacaggagcttgtgatggattcgctcccactgtgggaattgtccgtgagtatccgagggcaggaattggctcagataaaggatctatcctgagcgctctcctgtaaagagtaagatgtgcgcattagaactagctgatgccgagtttaattcccagtctcttttgtgattctaaaccatttgacaagcctctgcctagtgtgagcagattgatcaggaaatttattcatttcatgaccttgtctactcatttatagctcttaaaaaagtacctcacctggaactcaaagctccctaagaatttaaaagttatgaatatatttctttcatctataaaactacattttgctttggataaaatatctagcatttgaggagaatttcatgttagcgcaattgattaggctctatgttacatagatacatcataaattgcttttataataaatttatgttttcttttgttttaaaggacatggggattgagttgcaaccaatagatacagttacacaagccggcatggtcaatagcatgtggatagctgataacaaacagtactagaattgtcagtgtgttttcattgactcctgacctgttaaaacttagctcctgaagacccattagactggacaaaatatacccatttgaatggacagaactaacaggcagatactattattataaagccataaatgagcaatcagtctcatatgtgtttgaagatagactatagattatggttctatgccttatgatacaattactgggttatttgtgtaatttgaaatttgggttttaagaaaaccatattttcttatttcttgaggagaagaaagaaaaccgatatggttggtcatagtaggtaatgagaaaaatggcagaagatgagttcagagagaaaggcatgtccagatgacattgggctgtgtaggttaaaaccttagtacttggacttcattttatctgccaaaagaaccactggagtgctttaaataataacctgatatgtttcatatatttttgagagatcattatggcttatgtattacaaaaaattctgcttcatttctgacaatttataaaatgatttcaagaaacagatctcacatgtgattctttgaaaagcaggcacgatcttctaaagtaaataaagatttttgtacagatattcatctattatctattaaaaactttattccagaattatctggtaatgttaatttcacacagccaatataaacagtaatgaagaaaatggaactcagttatttttgtttcatgatctatgaatctaagaccaaataaattataaaaaataactattcatttgccttagataatcaaaaaacatctctgttgctgattatcaaaatatttatattacaaaaaggttaatggattagtgtcacataaaaacatcttaactgaaggcaaaattgcataacagtattttacttttgcaatgccatctaattttcaatacgttcaaggtaaaaaaaagcaataaaatggaaatggcaataaacataattcattaggcacacactccactttatgagatgatgcaatgaatgtcattagacaatcaatttcttccctggttggtcatttaatggtagaaccagtgggccgattataacgtgggtatgccatattgacaaccgaggcaaattaatatagtggaaaggacactcgtttgagatttaggaagccttgatcagcctattcaactaaagagttgcacaaaaaccatgtttgtggagttagtttcctaatctacaaaattagaggattgaagtagatagtagatccaaaatgctggtccaaggatgaatgtcaggctggccttatcagaattattaggataacttttaaatacaattgattcccagattcttcactcagaaatacttacttattgtgtccagagtggggtctggacagagatttgtaaaaatcacccaggtgattctaatgtgtggggatcttttacaacagatggaatgtatgaccccaaaacatctttctttttgaaagaaaaatctttgaattctgtgtttctctaggctgtttccaagaatctttacattataaattaggctacattacatttgtggatttggtactaaagctcaagatttttttcttctgctttggaggtaagcttatgctttttctatagttagcagcatcctgcacagacatttgtacaaatatctcaattttccttcttcattgtggaaaattgagacatttgtacaaatatctcaattttcctccttcattgcagaaaatggcctaaaaatttgcatgcattttagcctagccattttcttctagtaattattcctaaattatgttcaaaaatgtatgcataattaatgttcttcaacatattttgtaatagtaattaatttaaaacattacaaatatctacaaacaagacataggttaaaaagaattttatgataataatataatattgttaaaaattgtcatataacaatacaatataccctacaggacttaaaatttctgttctagaacaatatttattgacataaaaagtattcaccatatattgctcggtaaagaaacatcaaatggtattcccctatgtttctaaagatgaaaaataaaatctcacaaataatttttttattatactttaagttttagggtacatgtgcacaacgtgcaggtttgttacatatgtatacatgtgccatgttggtgtgctgcacccattaactggtcatttaacattaggtatatctcctaatgctatccctcccccttccccccaccccacaacaggccccagtgtgtgatgttccccttcctgtgtccatgagttctcattgttcaattcccacctatgagtgagaacacgtggtgtttggttgtctgatcttgtgatagtttactgagaatgatgatttccagcctcatccatgtccctacaaaggacatgaacttatcattttttatggctgcatagtattccatggtgtatatgtgccacattttcttaatccagtctatcattgttggacatttgggttggttccaagtctttgctatcgtgaatagtgccgcaataaacatatgtgtgtgtgtgtctttatagcagcatgttttgtaatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctctagcacctgttgttgcctgactttttaatgatcaccattctaactggtgtgcgatggtatctcattgtggttttgctttgcatttctgtgatggccagtgatgatgagcattttttcatgtgtcttttggctgcataaatgtcttcttttgagaagtgtctcttcatatcctttgcccactttttgatggggttgtttctttcttgtaaatttgtttgagttcattgtagattctggatattagccctttgtcagatgagtagattgcaaaatttttctcccattctgttcactctgatggtagttccttttgctgtgcagaagctctttagtttaattagatcccatttgtcaattttggcttttgttaccattgcttttggtgttttagacatgaagtccttgcccatgcctatgtcctgaatggtaatgcctaggttttcttctagggtttttatggttttaggtctaacatttaagtctttaatccctcttgaattaatttttgtataaagtgtaaggaagggatccagtttcagctttctacatatggctacccagtttccccagcaccatttattaaatagggaatcctttccccattgcttgtttttgtcaggtttgtcaaagatcagatagttgtagatatgtggcattatttctgagggctctgttctgttccattggtctataactctgttttggtaccagtaccatgctgttttggttactgtagccttgtagtatagtttgatgtcaggtagcgtgatgcctccagctttgttcttttggcttaggattgacttggcactgcaggctcttttttggttccatatgagcttgaaagtagttttttccaattctgtgaagaaagtcattggtagcttgatggggatggcattgaatctgtaaattaccttgggcagtatggccattttcacgacattgattcttcctacccatgagcatggaatgttcttccatttgtttgtatcgtcttttatttcactgagcagtgctttgtagttctctttgaagaggtccttcacatcccttgtaagttggattcctaagtattttattctctttgaagcaattgtgaatgggagttcactcatgatttggctctctgtttgtctcttattggtgtataagaatgcttgtgatttttggacattgattttgtatcctgagactttgctgaagttgcctaccagcttaaggagatttggggctgagacgatggggttttctagatatacaatcatgtcatctgcaaacagggacaatttgatttcctcttttcctaatcaaatcccctttatttccttctcctgcctgattgccctggccagaacttccaacactatgttgaataggagtggtgagagagggcatcctgtcttgtgccagttttcaaagggaatgcttccagtttttgcccattcagtatgatattggctgtgggtttgtcataaatagctcttattattttgagatacatcccatcaatacctgatttattgagagtttttagcatgaagtgttgttgaattttgtcaaaggccttttctgcatctattgagataatcatatgttttttgtctttggttctgtttgtatgctggattacgtttattgatttgcatatgttgaaccagccttgcatcccagggatgaagcccacttgatcatggtggataagctttttgatgtgctgctggattcagttggccagtattttgttgaggatttttgcatcaatgttcatcagggatattggtctaaaattctcttttttttgttgtgtctctgccgggctttggtatcaggataatgctggcctcataaaataagttagagatgattccctctttttctgttgattggaatagtttcagaaggaatggtaccagctcctccttgtacctctggtagaatttggctgtgaatccatctggttctggactttttttttggttgttaagctattaattattgcttcaatttcagagcctgttattggtctattcagagattcaacttcttcctggtttagtcttgggagggcgtatgtgtccaggaatttatacatttcttctagattttctagtttatttgcatagagttgtttgtagtattctctgatggtagtttgtatttctatgggatcggtggtgatatcccctttatcattttttattgcatctatttgattcttctctcttttcttttttattagtcctgctagcggtctatcaattttgttgattatttcaaaaaaccaactcctggattcattgattttttgaagggttttttgtgtctctattcccttcagttctgctctgatcttagttatttcttgccttctgctagcttttgaatgtgtttgctcttgcttctctagttcttttcattgtgattttagggtgtcaattttagatctttcctgctttctcttgtgggcatttagtgctataaatttccctctacacactgctttgaatgtgtcccagagattctggtatgttgtgtctttgttctcgttggtttcaaagaacatctttatttctgccttcatttcattatgtacccagtagtcattcaggagcaggttgtttggtttccatgtagttgagcggttttgagtaagtttcttaatcctgagttctagtttgattgcactgtggtctgagagacagtttgttatcatttctgtttttttacatttgctgaggagtgctttacttccaactatgtggtcaattttggaataggtgtggtgtggtgctgaaaagaatgtatattctgttgattttgggtggagagttctgtagatgtctattaagtctgcttggtgcagagctgagttcagtttctggatatccttgttaactttctgtctcgtttatctgtctaatgttgacagtggggtgttaaagtctcccattattattgtgtgggattctaagtctctttgtaggtctctaaggacttcctttacgagtctgggtgctcctgtattgggtgcatatatatttaggacagttagctcttcttgttgaattgatccctttcccattatgtaatggccttctttgtctcttttgatctttgttggtttaaagtctgtttaagcagagactaggattgcaacccctgcctttttttgttttccatttgcttggtggatcttcctccatccttttattttgagcctatttgtgtcgctgcacatgagatcagtttcctgaatacagcacactgatgggtcttgactctttatcgaatttgccagtctgtgccttttatttggagcatttagcccctttacatttaaggttagtattgttatgtgtgaatttgaacctgtcattatgatgttagctggttattttgctcattagttgatgcagtttcttcctagcctcaatggtctttacaatttggcatgtttttgcagtggctggtaccagttattcctttccatgtttagtgcttccttcaggagctcttttagggcaggcctggtggtgacaaaatctctcagcatttgctcgtctgtaaagtattttattcctccttcacttatgaagcttagtttggctggatatgaaagtctgggttgaaaattcttttctttaagaatgttgaatattggcccccactctcttctggcttgtagagtgtctgccgagagatcagctgttagtctgatgggcttccctttgtgggtaacccgacctttctctctggctgcccttaacattttttccttcatttcaactttggtgaatctgacaattatgtgtcttggagttgctcttctcaaggagtatctttgtggcgttctctgtatttcctgaatttgaatgttggcctgccttgctgggttggggaagttctcctggataatatcctgcagagtgttttccaacttggttccattctccccgtcactttcaggtacaccaattaaacatagatttggtcttttcacatagtcccatatttcttggaggctttgttcatttctttttattcttttttctctaaacttctcttcttgcttcatttcattcatttggtcttccatcactgataccctttcttccagttgatcgcattggctactgaggcttgtgcattcatcatgtagttctcgtgccgtggatttcagctccatcaggtcctttaaggacttctctgcactggttattctagttagccatttgtctaattttttttcaaggtttttaacttctttgccatgggtttacacttcctcctttagctcagagtatttgatcatctgaagccttcctctctcaactcgtcaaagtcattctctgtccagctttgttccattgctggtgaggagctgcgttcctttggaggaggagaggtgctctgatttttagagtttccagtttttctgctctgtttttttccccatctttgtggttttatctaccattggtctttgatgatggtgacgtacagatggggttttggtgtggatgtcctttctgtttgttagtttttcttctaacagtcaggaccctcagctgcaggtctgttggagtttgctggaggtccactccagaccctgtttgcctaggtatcagcagcggaggctgcagaacagcagatattggtgaacagcaaatgttgctgcctgatcgttcctctggaacttttgtttcagaggagtacccagccgtgtgaggtgtcagtctgccactactggggggtgcctcccagttaggctactcgggggtcagggacccacttgaggaggcagtctatctgttctcagatctccagctgcatgctgggagaacgactactctcttcaaagctgtcagacagggacatttaagtctgcagaggtttctgctgccttttgtctgtgccctgtccccagaggtggggtctacagaggcacacaggcctccttgagctacagtgggctccacgcagttcgaacttcctggccgctttgtttacctactcaagcctcggcaatggcgggcgcccctcccccagcctcactgccgccttgcagtttgacctcagactgctgtgctagcaatgagcaagactccgtgggcataggaccctctgagccaggcacaagatataatctcctggtgcgccgtttactaagaccattggaaaaatgcagtattagggtgggagtgacccaattttccaggtgccatctgtcacccctttctctgactaggaaagggaactccctgaccccttgtgcttcctgggtgaggcgatgcctcgccctgcttcagctcatgctcagtgcactgcactcactgtcctgcacccactgtccgacattccccagtgagatgaacccggtacctcagttggaaatgcagaaatcactcgtcttctgcgtcactcatgctcagagctgtagactggagctgttcctattcggccatcttggctccaccccacaaataatttttttaaacaacctaatgcaaaagtaatttaatattaagctacttctatctctaaagaggtggaattacaaaatattattttgtttttatttagaatgccatatttttttcaaaatatatatttattgcttatattactgtatttaaaaaaaatcactcttatcaagtgtgtcagatagattagggagaccagggcataaagccacttttattcttctcaacctgaaaatgtaaagatccatttcaagacaccaagtaattgatgttagagcttcaagggacaggacagagcttgtcaagggaaaattagagtggtaaagctgacacccatacatgcaaggcccttaatctttctttctttctttctttcttttttctccttccttccttccttcttcttttcttttctttcctttttttcttttcttttctggagtctcactctgttgcccaggctggagtgcagtggtgcgatctcagctcactgcaacctctgcctcctgggttcaaacaattctcctacctcagcctcccaagtagctaagaccacaggtgcacatcaccacgcctggctactttttgtatttttagtagagatggggtttcaccatgttggctaggctagtctcaaactcctggcctcaggtgatctacctgcctcggcctcccaaagtgctgggattacaggcatgggccaccatgcctggccgatttttctactgtcaacttgaaaataagcatacttaatgtcagcatggacctgatttagccatgtaacatttggctgctgaaaaagcatgatgatgtgttttttgctcctggtcatcttctgtcaatagttctttattttgtcctagtttcatgttgtaattaatggaattatatttgaagagctcaaaatgaaatgcttaattatattcagctgcaattacagtgattaattgatccaaacttattagcatgacacctaaaggaaaccagttatataaaaattgtaggaggcaatactttgagtatgacactcatgtgagctagctatctagattaattctattttattaaattgtctaagttttacagcttctggaattcatattggaaacccagggtctagactaaactgttatttcataaacaaggacaaaagaaccgaaaaaagtaaatgaaatattacagacaggagtagttctccctcaaatgagattatctcattattttgaaattatttatatgtttcccagtttggatacattgtcagctcctgattatccatgccaaagatagctttaaatctccaaaaagagattttatcaaatctatatgcatttcccaaatcccaagaaaattatgagtcatagtttagagcatagacatcctgtttcagttaatgctttgtagggtctaatcatcatgtatggatgtgttcaatccccttgctctggatgctttcactggactgggtattaaaaagcaaattcttcaaactctgtacttccaccatgcctgcccacctcatttctttaatatgccaacctccttctcatactaatgtattttgtacatttctgcctggaatttttctcgatccttaggcttttcttgtttaattcctaccatccttcatagctcagctgaaattatacttttttttttttttttgaaatggagtctcactctgtaacctaagcttgagtgcagtggcgtgatcttggctcacgcaaactccacctcctgggttcaagcagttctctgcctcagcctctcaagtagctggtattacaggcacccacaagcatgcctggctaatttttgtattttttagtagagatggggttttaccatcttggccaggctggtcttgaactcttgaccttttgatccacccaccttggccttccaaagtgctgggattacaggagtgagctaccgtgcccggcctgaaattatactttcctgtagaggaagtataattaggttatcatgtcaccctcttcttttccattataagtattctgcagtcgtagtgacacatttatttgtgactgactaatgcgtctgacttttcctttacaatggaagtgctacagtatcaagagctgcacattttcattgacactctacatccagaatccaacacagaacacagcacattgaaagtattttattaaatgttcttgaatgagtggaattttcatttttctaatatcttttagcagtatgtttgatcgatttttgtttgttgtttgtttgttgagatggagtcttgctcttgtctcccgggctggattgcagtggtgcaatctccgctcactgcaacctttgccttctgggttcaagtgattctcctgcctcagcctcctgagtagctgggattacaggtgcctaccagcacgccccgctaatttttgtatttttagtagagatgggggtttcaccatgttggcaaggctggtctcgaactcagcacctcaagtcatctgcccgcctcagcctcccacagtgctgagattacagacaggcgtgagccaccgcactgggcctcgacttctttttagatagagtgcccattgttgctccttttcatccatctagtagttctccttcttttgcaatttggttaaatgattataaccaaacttattaagctttattttatgtgtaaaattttgagagaatcatcttgactgtgtgtatgtgtgtgtatatatatatatatatatatatatgtatctgtgtatatatatatatataatctgtatatatatatatatatatatatatctgtgtgtgtgtatatatatatatgtcacctgagtgctttcttttgggggtaaagtatttgactgagacactaaagatttgaattgttgttctgcattttactattgaccatgggccttaaggaagtcatttagctcctgttagcatcagtttgctgatttgtaaaatggttaaacagtagtatttgccgtctacaagtcacaaagctattgtgaagatcaaatcacatatgacattcaaaaatgctttgcaaatgttagccctttactaatttcagtccatatcaaaaatccacattgtgtagaaaatttgtagatctttgaaattacataatcttaaaaatatttgtgaaatacgagatgtagatctgaatttctttaagacaaagttctttagtaatatggaaacaatgacatatccaagcagaagcatagatggcaatagaatttgttcagaacatggcttcagaaaacatactaatagttctgtttttttgtttgtcttgttttgctttgagatggagtctcactctgttgcccaggctggagtgcagtggtgcgatctcagctcactgcaacctccgcctcttgggttcaagtgattctcctgcctcagcctcccaagtagctcggactacaggcacgtgccaccacgcctggctaatttttgtaatttttagtacagatagggtttcaccatattgtccaggctggtctcgaactcctgacctcatgatccgcccaccttggcctcccaaagtgctgagattacaggcatgagccactgcgcctggccgagaaaacatactatagcttttcacagacaaattggcaacttctccatacataaaaattacattttaactgcaaatgaaaatatagacatactaagagtaggtaaaaaattgattattaatttaaaattaatcattttaactcaatgctttacatatattaaaaagtattcatttatatatgtcattttttatacgaataaaatatttaaatattataatctctattattttaatatagttcaattagattccttgtggaaattataaatgattctctaaaaaaataaagtcattattctgtcaagatgattaaatggacattttcctaatcttctagttgaaccattgagtcttccagtgatgtatacttaaaatcatgtaagttataaataaactttcatggtaggtgtaactaacttcatctgactcatgaagagagattagtatctcttttatcatttagacgttaatgaactttcagtcctacgcagcaaagttacccattcatctttttgaaaaaaagatgaattattgttgaactcacctcctaagtattgctatgttgtataatagtagaaataatagtagaataatagtagaaaccatactttttctattataaaaaaatagaggaaatagattggaaaatataatctgaatgaagtcaaagttagcattgagtgttaaataccattgtcagtgtcctttacatatgtaatggtaaagctttccaatgcatcttgggttgcgtgagctaaatacttttggcaaggaaaacatcagttatatgaacactgcagacccacataggcctggtgtacagctttgtctttccatggctctagtggttcatacctctgctgcacttgttcttgactgggcaccctctgccagtgctgtgtgagctccccaattccttgctgtccttatgtggttccgtaagctgacatttcatcattcagaccaagtagatagaaggtgttgcttactcttttaaaatgagttgtataggattacattgttttatttgataaccttttggtaaatacagcagaaatacaacttcagccagtttaaattaaaaagaggcttttgttttaaagctagtaagggtgacactgatcgaatgtgaaagaaggaagcagaggctaatattgggattcaggctcaatccagtcttttgtgtatctcatatctacacctcccacaaatatttgttgtccgccccctcttctctctctctctgttttggtctctccctagattgatcttcttatatatcttcttgtcatgcatcttacctagtgttccccaaatgaaaataactcaatgactattctacgtcaagtgcccatccattcaccagttcaccaagatatgtaaaaacttggcagtttggaaaagatctataaaataacaattcccaaaagaaggggatttctgtgaagatacacaatagttgtccaaaaaaatatgctatatatttgttttaaaaaattgatagcccaatggactttttcttttttcttttctttttctttttctttttttttttttttttgagacagagtcttgctctgtcaccagtctgtactgcagtggcacgatctcggctcactacaacctccgcctcccagattcaagccattctcttacctcagcctccagagtagctgggactatagccacccgccactactcccagctaatttttgcgtttttagtagagatggagtttcaccatgttggccaggaggctctcgatctcttgaccttgtgatccacccacctcggcctcccaaagtgctgggattacaggcatgagccaccgtgcccggcccaatggactctcaatacactatcttactttaccctcctgtccaaaagcactaggtggaaaagagatgttacatttatttttaaaagttgagatatagatcatatccaaaacctgctatagaaatatactacattgtcaatatgaataattaggtatagagaatggcacctgcttaaaatcctttaatctcactgatttggtgtgtgttgtttccccagtgggttacatgttaccgataacctgtcagaatttgaatatcgcagaggattttcaaagtcagaagaactgagtaataaggagatgaaagactttttcagaagacttttttttaaatggaaacttatttttaaatatagaggaatgtaagaacttgcaagtaagagtgaattggtttgcaaagtagattctgttttcccttcatgtgagctttattggtttatattctcttcaaattttcttcatgtcatttggaaacaactgctgttcaaaaactatatcttcatatgcaagcatttactataaaacttttctttaatgtgtttaaagcatttctttttcacttaaacatttttcctttattttaagctagtgataagacagaatggtgatatgtccatttgcttcatttgatatgcacatttgttctatgggaaaatgtggtctactcctaatttcattttcgtttcctaaataagaagacccattaaaaagcagacatctggtgtacaaagcacttaaagctgtagctcccaaggagtgctttcttccctctttaaatatgcatgaactgttgttttggtaatccacttcaccctgtcaaaatagaatcaaatagaatatatgtgtgacctcttccccttctatcctgggaaaatgagtttcaagatcactgaggtgtacagtattccgaagccttcactttccgttttattcaccctgaaagctcttacagttacagaagcttaaagtttagctgaaatctactttaataatagctacactgttttagttatgaagaatgactctatgaactttaaatatttgaatcataaagaatgaatgtagactttcaaaaaataggctttgaaaggagtttaagaatatctgtaccttcattgatttttttatatcagttagagctcaaggtttttaatacagttacctcaaaaattctgtgtgcaaaatagttacatttaacggatattgaaactaaatatggttaacttattttcctaggagaagagaacaactaaaacaggcgcaataaacatttttctttttcagttgatgcacatttaatgtcagtttgcttccttgaaatttagacccacattccccaagattgagtcctgtagaatattaactttccatattcacctactctgttccatgcaaaaggatgacatgatcaaatggtacataccttgctttctcctatagattcataattgaaatttggatattatactttctaacaatgcttttagtaaatatatctgtgctagcttggttcacccaatttgcctaagtatatttaacacctaaacattaaagaaaaatcacttttgaaatctgtgacctagattatgtttatgtgcagattatatcagaaaatagtacaaaactttatgaagacaagagaagtatctcattttttcttccttctggtttggattgtttattttaataaaattatatcagtctgatttggttagcttggaatattgttttgttattgttctataagtagctgcattatccataatagttcatatatatcttatttgtgtgtgtcatcctcaatactgttcaaatattttaagggagacaaatggatacttttgcttttagaatctatttacaagttttattcttctaaatttcagtaaatgagtctgtgccacttctatgttttaaggtatttttggatttagagtacttctaaccaatgatcatgaaagtagtagtctattaattttaaatcatattttctaacattgtctattaatgtgtttttgacaaatgtgatgcctatgagaagacagcttcttcactagaggaaagtaaaaggagtttttgaaccttgatccaaatctctgaatttatttaccatgttgtcccaatcgaaaggcattgaacatagtttttcacaagccacaaatgtttgagtatcagagctgaaagattgcctaactaagtaaaatacagtatttacaggatgcttggggaaaagatatctggctaatttaaaattatgccagtgatattctttgcttatccatttgtgacaaatccttatcagccttagaaaatgcacataataaagtacagagaacaacatttgcttattctttaaacttatagtcttgtaatgctgcagtgctatcacaacgggtattaatgatcgttgtatttattgtatatttgagttaaatccatattaatcctagggtttatcttaaaattgtgtgtgtttctttgtttgtttgtttgatttatttggaaggtgttttttgtttttgttttattttagaactaaactcctcaaatgactttatttactagcttgaggtgtctttctcctaaaacaacagaaaaagtcatgatgaagggctgggcagaagaatcttgatagtttgaatttcaaagctacacagattatagataagatatactttatgttattagacatttatttttccctagataagaccgctgatagtggatgataagactgatgaataatatttgattagtcaagtttccatcaaatataggaaaagttttaaattgtagctataggtttaacataaatagccaaatttatcattatatgatttttttacttttattgtgaaaatttttaaacatagagtattagaaaaaagtagcataatgattgatacataatcatgagctagatataatcataagtaatattttcccacaatttttatctatccctcctgttctttactgtgaagtacattaaagcattcatttcactgctatatacttcattgttcacaaaatatatacagacctcttcccacaaaattattaaaatttattgtaggcactttgttttttaagtgggagataaaaaataattggaattactatgctcatgttgtttcattgtactgaaagcaaaaatggatttttttcaaagatatttcctcccattttacttttattaatagattctaattccgtcaactttgcgtaatatagaatgatgaaaaagccccttttcattccttctgatagcttttggattccattgctcagagaaagcttgtcttcaacaatatgctggaattgtgtgaagtcttgttatttttttttctccctgttcttcaaagtacaatttcttgaatgtacctgcagccgtgcattatcaggcaacctattttataaattccataataaattaaataagcacctctgtgggtcatttttgattaacctgatttaaaataaaatgatttactaaagatttagagggaggaaatactatgtgcttctaaatcaattctatgcatattcactgtcaaacaattgcatgtaatagtgtattaaatacacttaatagtgtaaaaaaagactcactgcaattgaattaacacttgcaagcttataataatgtttaaaagccacaaacattgaagtaaaattcatttttatccagaaatagaatttgtacatatgacttcctgctatggagattttatcacaggaagatgttcaagatgtttaatttaggacagcatttcttctaagttcagattataaggaggagcattttaattagaatagtatcatgagactcatgtaagcatatgatattacacatcggtattttccctatagtctggaacattactggaatgaaaatttagagatgcatttttacttctccagcacatgcaagaaataatacaacatgaatccttttttattttaggaatgttatacccacaaaacattgaagtatgttttaagttaagcaaacaacaagttttgaccaagaaaattagaaaattaaggttttcttagaaaacaaacaaaattatggcaagaaattactgtcctagtaaaataagatgaccctatatggaccgttgtacgtgaatatttatgtccttttttttttcagtttcacgtatattctttaatgaacacgagaatacagttttagttttcatttgatggcagttttcttcactctccatttcttcaccacctcctcctattttcttccccttttttctgctattcctccactcttcattacacctacatggcttagagttgctggtagattttggtgcccatgctaaaatttgaacagaaggaacagtataaagatgagctgaagtaaatcttgaacacctactattttgccttcttatatcatctcaattgacaaagtcaagattgcagactgccttgacttatgatggggttatgtcctgataaactcaaggtaagctggaaatattgtaagtcaaaaaggcatttaatatacctaacctacccaacatcatagcttagtctatcttaaacatgctcagaacacttccattagcctgcagttgggcaaaatcatctcacacaaagcctacaataaagtgttaaatatctcataaaatttaccaaatactgtactggaaagtgaaaaccagaacggttgtacaggtgctcaaatacagttgctactgaatatgtattacttttgcaccattgtgaagtcaaaaaatcataagtcggtgactgtgctcggttaaaaagtagtggttgctgaccaacttcatttttctttaacagcttcaattgtgatgtcaaagtaaatgtaacttttttcaacaaatttttgtcctttaatacaacaaaaatgttgcatcttaaaagcattttttaatgaaaagaattttaggcttacaattttcttgtaacagtggaaaatataggctctgattttcttttttttgtagtgcacaaaggtaccttttcttagtagttaagttgttttaactacctcaaaatataagttaaaaaataaaagcaagaaacatgggctaaaaatgatattgcaggtggtcataaaccgcagttaaaacatatgtctttaaaatattcacataagattcagacatagcattatacaactttttcattttgccttttacctccaattccatttagaacaattaagaaaaataccttcaactatattatttttatggcataaatgaatttgaacaagatatttcaaaaggtaaatattgaaaaaactctactgcaatgcattttgactcctaaaataggattgtgataaaataattaaattttgatattttaatgcacttgaagaaacacccagcacagcccatttctaaggaaagaacaagttaaggataacataaaatgaagttgactttttgtaaaggtgatcttttcacttttaaaacagcactcaatgattctgccagagacagtgtctacaagtgaaaacttgtttgtatgtgatgggtttgactgacaggttggatcaagttgaggtggggaattggggtggacaaaggagaggaaacaggttatgctattcactcaagtcaatcaaataacctgattgttctttcaactgccttactctgtcattgactgtcaagtcagtcaaaatagtgaaactagttttcgcatgtatgcagagatttattttatgacgctattacctcacccttgtaaacacagacataacaaatatctaagtccacatgttgaaaattatacacaaatattgcagatgtttatgggtgcagaggtatgtagaagagaaaacatgctgaacttaaagccaacactgtaatttcctaatgtttgacttcctatttgacagagactgatataattgatcaagcatacactaagatgcttctttagagaaacattcagcagtatttttctgtattatagtatccaaactagtaatatttacaggaattttatttttatttttgtttctttttttgagacagaggtttgctgtatcacccaggctggagtgcagtggcatgatcacagcttaatgcagccttgaactcccgggctcaagggatcctcccacctcagcctctggagtagctgggactacaggcaaacacaaacacacagctaatttttctatttattacaggaatattacagagagtttgcattaaatagctcagaaaacaaacagatattgtattacatgcacaaacacacacacacacacacacaccctttttttttaatttcaaaaattactttgcccactttttgatgtggttgtttgtttttttcttgtaaatttgtttcagttccctgttgaacaatgagaacatatgggcagagggaggggaacatcacacactgggacctgtccacctgtcccagggttggggaaaggggaggggtagcattaggagaaatacctaatgtagatgacccgttgatgggtgcagcaaaccaacatggcacatgtatacctatgtaacaaacctgcacgttctgcacatgtatcccagaacttaagtataataataaaaaaaaaacttgcaagattaaaaagaaaatcttaacaaaatccaaaaacactaaagtgagtcaataagaagacccaattatgtctgatctcttgaagttactctgctgaaatgctcaagtccaggttaacctcatcaatctaaatggattagcttaattcatttaaacttagaaatagttgaactactcatttttaggtctcatgcaatttacctgtgtgactcaacatcaaatctgtctgctaggttcatttggcatgttttgtccctaagatatctgccaaaccaatgcaatcaacctctcagaagcttttttcatatttaagaactgcttttaatttctaagccttcgccatggtttctgtcatgtatttctcacaaatgacagctactgatatggcagcagctattggttattgggagggagatgggactcaatgttatatagctatgtatcgttttgagattattatatgtacattacctaattctctcttcagaaacatcccgagagtattattactactattactatactccccagagtagtattaatactatactattaataacagtgtactataatgctaatattattactatactatgaacagataaatcagtggaggcttaaggacattaaaggaatggaccacattgcgccaggtgtggtggctcatgcctgtaatcttagcactttgggaggccgaggcaggtggatcacctgaggataaaattattcttttattctactaaaaattaaaaaaaaatatagccaggtgtggtggtgggctcttgtaattccagccacttgggaggctgaggcaggaggatcgcttgaacccaggaggtagaggttgcagtgagctgagattgtgccactgcaccccagcccaggcaacagagtaagggtaagactgtctccaaaaaaaaaaaaagagagagaatggaccaaattggactagctcatcatggtgacagaataggaaggggagaccagtgcttgctgcagtctggggcaccgccattctctccctgtgctgccaatttttcttccttctaggtgatatttatttcaacccgttgaaatcaagaggttattatttttactgacaatttattattgagattccctccatgaagaaagatcaagtttttacttcaaagggatggtaaaaaaataaaaattgtttaaccatccttgtcttaggcttgatggtgaaagtataaattaaagtaaactactgttttatctggtgaataaaaagcttgagctttattaagtgattttctcttggtattgggaagtgtatcttttactctagggttgttacttgaatcacccatgctagacagtttttttttttgagacagaatctctctgtcacccaggctggagtgcagtggcataagctcatctcactgcagcctggatctcctatactcaagggatcctcccacttcagcctcctgaggagctgggactaaaggcatgcaccacctggctaattttgtttcctttttgtagagacagggtctcactatgttgcccagattgatctctaactccagagctcaagggatcctcctcccttggcctcctaaattgctgggattacagacgtgagccaccacacctggcttacatagctttttttaaatacaagagcaacaacaataatataaacgaaagttattcttcaaacgtaacattaacctagatttatttgaagctgaaagtgaatgcaattgggtgtgccaaaggcaatgtgggaaaaacaattaattcctttttgttagaattggacatatgtattcgcaccaaatggaaccattgttagggcatattacttttctattagtttacttttctattagaatcattcaagcaaatctcaaagtttttatctgaaaattgttttgtttcaaatttctttaatgaaaatactgtaaggttggcttccacattaactacacggaaactaaagttactagaaaagacaggttagttattaaattgagaaagacattgaacacttgatggtaaggaattatgcaaacaagatccgggttttcctaaaattagacttttttaatgcaaaattactcttttgcgatctttttatgaaaataattaacttagcctttagcgtatctagattttgattttatgcattatttttagcaagtttctaagatactaccttcataggcaaattgatttttagttaaaaaagaaaacaatttgtgtgattgaacatgtgcttggaagttagtaaaaagaaaaatattgctttatttagaactgggatctactttctcactagttaagaatccttctaggcccattgcggtagcttacacctgtaattccagcactttgggaggccgaggtgggcggatcatttgagtccaggagttcgagacccacctgacccatggtgaaacttcatctctacaaaaaatacaaaaattaaccagttgtggtggtgggcacctgtaattccagctactctggaggctgagacacaagaatcgcttgaacctgggaggaagaggctgcagtgagccaagatcacgccactgtactccagcctgggcagcagtgagtgagactccatccaaaaaaaaaaaaaaaaaaaaaagacactaagctaaaagacactaagctaaaataaaagcctcatattatcttaaaaagtggggaaggatacacacttaggacccctgatgaggtccccttatcctttattgggtgctttaattatatgccttactttattctttgagtttttaaaacctcacctcctactttactaagaaaatagaggtggccacgctggaatcttttttcacctgtaagttcttaatacattacattattattttttttccttaaaatctcaggacagacttgactctactgttttaccccgccgaaaatcccgaattggtgtttctatttctcatcctgtcagccttctctggagtgttattttgtcgtttttgactttgatacctctatttgttttctctccacggattctttgtctccactcacaatctttgatcagcaaaaagtagattattccagtcttttaaattttaagaatctggcctctatccttgaggctctactgaaaccactctctccaacgtcctttaatgttttacccagtccttgttttctgtagctttcaaattattgactatcctgtcatctttggatatttttctttctttgaattcagtaatattatacactctaggttctcttcctatcatcaactttgctgtattgtttcttcttgccgaaattccatttcttttcatcgctatttattacatacctgctatgagtcgagtacttttagtgaagctggggatacaaaagtgactaagaaaatgtcctgctattataaagttgcattctggtgaaagagaaataaagtcaattaggaaacataaataatataatttaagttggtggttaaattctatgggaaagtattataaattaatggagtaggtggccagggagagctatttagctggagtggtcaggaatttcctttcttggtgagtggcatttaaatggagacccttttggcctctcttagaggctgttctataaagtcctgagtagagaaactagtggaagaaaacagaaccagtggaaagagtgagagacaagaatggtgaatctgataaaaatggattctttgatttgtaggagaatggtttgaggacatgggaaatgaaaaggtggagaccatgagttaactgtttctaaaagcaggctctgatatgcttgagatatgcgatattaaaaatgcggatattgtgacacatttgtatgctacatggaattacccaggattgagggaggcattacctgtgcagaaagggatggtaattgttggagtgaactccagcaatgttggtgctcttggtattttgttggttgtttttgtcaataatgtgatggtgatggtctaacttgtactttggtaagttatatgtatgtctatgtctttcagtagattaaaattaaaatatttcttactcttctttgtcctgcccatgattgccttttctaacatctagtgcagtgctcaaaagtgtctgtagattttggttgcctcatcattttcaaaatgtttctgggtttaagcctaaaattatatatgatttcatttaatgtgaacaatggccttcaaattaccaataccagttgcatctgaggcatattgaagagctttaaatccaagttattgtgtatgaaactagtgcttacaatataagcaggtggaatacatttagtctacttatatggaaaagctaaaggggaaaaaagtccacaaccgagtcatataatagtttttaacctaacttcctggtcagttttcagctctgcatagctactctgattgattgttgccccatcaactaatatgtttgaaaattcaaagtgaataataccatgaacaattcagtaatatcaataaggtgaagcctgattgtattatttttggaatatgattaaaataatgcaaaagaaataatccttgcccccccctccactttttttatttttgtcttcagcagttctgtggtttacaggtagcacatctgaagctgttatgcactggtaaaaccaatgtggattacaagaatacactattaggccctggtgacaggagacaaaagcaacatctgcttcctaggctttctgtgttacagaagagaaggcctgcccatcactatatgtaaaatcactgtattatccagtgcctggaatactcatattaggatctagaagctagttgggatttaattgtatttcaaattttagtataatactagtataatacttttatatcagtatcccatgttaactgtatatgcactttattattttaatatttaataattgaaatcaagtcttatgtatttatgtaaatttttatatgttacattcatatactgatgtttatatcaatttagaaaagaaaatgtgagcaattaattcttattaattaccttatatctggttttcgctcaagaaaataatacttaaatgaaatgaaatttatttgcttctaatgtctacataaaagacaaaatatccactagtgaatccacacagcatacaaatatatatgttaaaatttgcacaacttaaaaatatgcatactgtatttgtgtttctgttttctaaaataaaaaccttgggatttataaatattcctgaagaaattccttgtatttcctagctgaattagttctgagtttggcatttgctctttacagcctaaccagggagtggaccattagttttcctggagctttgggactttgggtttttgcctttggaaattaaatatgtaatattgctttgtctgggctggcttaggacaggatcctcccttcattccagggcaacgtcaaaattcacagaagagcaacagttcatattgtctattgaaatcaaatctgattcttccccctcccatctcccacgcctgcccttgggattgtgacatcattaccatctcaagaacccctagggttgttttccctgttaaaatgaagtgagattagggttctaggagagagcagtcaaatatttgagcactaatcatgcctggatgtcttttactaattttcaggcagtggaattcttttggtttcaagattacaccacagtcgtttaatgtaaatgtggacagaaaagaatacaattaggtgaatcgcacagacaatctgcttttttttcagcaatccttgaaatgaaagatgcatatattagaaggttatctggcatatgaaagggacatttatcccccaaggagagaaggaaactacttaaaagaaataaggttttattaatatttttcaattaaatgttgcactttctttatccttttgtaattttcatgttgacctatgtaagtgctttgttcatgtagcattcactctttcttggcaagtcatcagatggagcaagtttattgaaaaagaaacagaattaaaaattcaatgacaaaaattcaaatagtgtctgtttagagcttatcttcttaatgttagggcttttatggttattggttggggacttttgggagtgtttcttaatgctcaggtgggtgatgccagtatcaagggaagcaatggcgttactttaattccaagggttttgatgattgcattatgtttaagcattgtgaagatatatatataattttagcgtacaaaagtgaagcagttttgtgattgaattatttaaattagaaaagacagaatagcacaatcatacaaaatgaaaggtgctttctttatatcttctcccaaaatatggttaatggaaaaacaattactttttattatattttggtcaattttgtaatctatggtgataaacaatattcgataacctttattaaaatacatatttgggagaatatcatacatagaattatgactaatcatgaaaggctgaacagcattcaatgctattgtttttaaatctataaaatgaagaattgctgcctgacctgcaagatttcatccagctctaaaatcttatgcattctataatatgagaggagaatatttttttttttttttgagacggagtttcgctctgtcgcccaggctggagtgcagtggcgcgatctcgactcactgcaagctctgcctcccgggttcacgccagagaggagaatattttaatgatgtcaacagaatttacctaaacataaaatatgaatgtgaacctattatacctttatacattcctttttaatgaattactcaaaattgtgatatcatatatcagcaaaataataaattcaactatatattaaagagaaagtctcagatatttcagaatacttatttaaaaatatttctaccatgctttctgccaaaaatgaaatgtaattcaaaagcatccattggaaaaattaaacctctttctgccagaataatctagtgttagcatttcatgccttcttaaaaacagattttatttttcaaatcagtttgaagtttacagtgaaattgagaaggtatagagatttcccatatcctcttccccctagacatacataggccccctcactatcaacatcccacactgacgtggtacatttgttacaactgatggacttacattgacaaatcattttcacccaaagtccacagctgatgttagggtgttgaccaaaagagtcaaactctgtaaaatatttgaagagatttattctgagccaaatatgagtgaccaatgacctgtgacacagccctcaggagaccctgagaacatgtgtccaaggtggtcagggcactgtctagttttatacattttagaaaaacatgagacattaatcaaatacctgtaagacgtacattggcagttctgtctggaaagtaggggcaacttaaacgttttctaattggcaactggctgaaagagctaagctattatctagagacctggaatcagttgaaagaaatgcctgggttaccatgataagataagagttgtagagaccaaagttttatcaggcagataaaccctctaggttgcaggcttcacagagaacagacggtaaatgttcatcggacttaaggtctgtgccagtgctaatgctggtcagcttttcctgaaatctgaaagagaggagggaatgatgacgcatgtccaactctcgcttcccatcatggcctgagccagtttttcagggtaacgttggaatgccctggccaagagaaggggtccaaccagatggttgggggtccttaaaattttatttttggtttacatgggtacactattggttggtaggcattctatggacttggataaatgcataatgatatttatttactcttctggtatcatacagaataattccactgtcctaaaaattctgttctccatctattatccatcctttccactaacccttgccccctgaaaaccactgatcttttttaactgtctccatagttttatcttttccacaatgtcagacagtatggaatcatatagggtagccttttcagattgacttcttcagtaatatacatttaagtttattccatatttcattgtggcttgataaccattcctttgagacaaggtattgctttgttgcctagattgcctaggctggagtgcagtggtgcagtcacagctcacagcagcctcaacctcctgggctcaagcaatcccccaactccagacactggagtagctaggactacaggcacatgccaccatgcccagtgctttttaaattttgtatagagtcactgtctcatcactttggccaggctcttctccaattcctgacctcaagcaattctcctgccttagactcccaaagtgctgggcttataggagtgaccatcatgcctggccacttgacctttcttttttttttttttttttcatttttcttttgtgtttttgagagtgtcttgctctgtcttccagggtggatggcagtggtgtgaccacagctcactgcagtctcaacttcccagcctcaagcaacctcccatctcagtcccccaagtagcagggaccatactgtacgccaccatacctagcttttcttttctttttttttctttttcctgtttttgttttgttttgttttgtgtgtgtgtgtgtgtgtgtgtgtgtgtgtgtggtggtgataaggtctcactatcttgcccaagctgatcttgaactcgtgatctccaatgatcctcccaccttgggctcccaaaatgttgagattataggcatgaaccactgcacctggtgatagctcctttttaagtgctgaataatattacattggatgtaacacaagtccatatagtgtatctatctattcacctattgacatgtcagttacttcgtagttttggcaacattatgaataaagctgctataaacatctgtgtgcagttttgttgttgttgttgcttttcagctcctttaggtaaatgccaaacagtggaatttctacattgcatcataaaagtatgtttagttttgaaaggaactgccagactgcctttccaagtggctgtaccattttatcttctccccaacagtgaatgacagttcctgttgatccacatccttgtcagcatttggtggtggtgttgttctgtattttgcccagtctaatagatgtgcaacggtatctcattgttttgatttgcatttacctgacgacatatgatatggagcatcttttcatatgcttatttgccatgtacacatcttctttgataagatgtttgtgaaagtctctgacacaatttctaatcagatttttttttgctgttgagattttagggttctttatatacttgcataacagtcctttatctagtagatcttttacaaatattttctctcagcccgtgtttgtctattcattcgctagacatctatcatgtagcatatagtttttattttaacaaagtccattttatcaattttttatttcctagatcttgcctttgatgccatatctaaaaagtcattgacaaatccaaattcatctagattttctcttgtgccgttttctggaagttttatatttttatgttttacatttaggtctgtaattaattttgaggtaacttttctgaaggaaatctggtgttagcattccatgcctttttgataccatttatccctgaaaataaagtctacatcattattattttccattttgccaatttgattgggaattcttatgatttaaaattttcttaatagctttctattaaaatagatttgaatgaaaaaatatttctatgaggaacatttacatttctaaatatttgttttaatataactccaagtatattttaaatctaattttcttttttagaaacagagttcatttagtaggctaaagctactttcctaatactatggtaatatttaatttttttataaatataatttgtatgagtttgggcctttttaggcaaacagaccaccttggtcctctacatatactttctcccagtgtatattcagtatccgctatgtacatggcatcatagtgacgtagatgtttacactggagcaattctgttttctcctctacttgcagatagaggaggtggcagatatcttgagcaattatcattcatttccttgtgtctctaaggatgcacaatcatcccttggttccaggaccgcccacctccccaagaataccaaaatctgcagatgctcaagtcctgcagtcagccctgtggaatccacagacacaaaaagtcagtcccccatgtccttgggatcctcatccctctgtgtctggaattggtgggttcttggtctcgctgacttcaagaatgaagccacggaccctcacggtgagtgttacagttcttaaaggtggtgtgtccgcagtttgttccttctgatggtaggacgtgttcggagtttcttccttctgttgggttcgtggtctcgctgacttcaggagtgaagctgcagacctttgccgtgagtgttgcagctcttaaggcagcgcgtctagagttgttcgttcctcccgtccagagttgttcattcctcccggtgggcttgtggtctccctggcctcaggagtgaagctgcagacctttgcagtgagtgttacaactcataaaggcagtgcggacccaaagggtgagcagcagcaagatttattgcaaagggtgaaagaacaaagcttccacactgtggaaagggaccccagcgccttcccactgctggctcaggcagcctacttttattcccttatctgaccccacccacatcttgctgactggcccattttacagagagctgattggtccattttgacagggtgccgattggtgcgtttacaatccctgagctagacacagagtgctgattggtgtatttacaatcctctagctagatgtaaaagttctccaagtccccactagattacctagacgcagagcactgattggtgcgtttacaaaccttgagctagacacagggtgctgactggtgtgtttacaaaccttgagctagacacagagtgctgattggtgcatttacaatcctttagctagatgtaaaagttctccaagtcctcaccagattagctagatacggagggctgattggtgcatccaggaatcccaagctagacacagagtgctgattggtgcatatacaatcctctagctagagataaaagttctccaagtccccacctgactcaggagcccagttggctttgcctagtggatcccatgccagggccataggcggagctgccagccagtcccatgctgcgctcctgcactcctcaacccttgggaggtcgatgggactgggggccatggagcatggggcggcgcccgtcggggaggctcgggccacgcaggagcccaccacagtggcactcgggcatggcaggctgcaggtcctgagccctgccccgcagggaggcagctgagacccggcaagaattcgagtgtggcgcgggtgggctggcagtgctgggggacccggcgctccctctgcagctgctggcccaggtgctaagcccctcactgcccggagccgtcagtgccagtcgcccgctccgagtgggcccgccgagcccacgcccacccggaactcacgctggcctgcgattgccgcacacagcccgggttcctgcccgcgcctctccctccacacctccctgcaagcagagggagccggctccagcctcggccagcccagagaggggctcccacactgcagcagcgggctgaagggctcctcaagcgtggccagagcggacaccgtggccgaggaggcactgagagtgagcaagggccaccagcacgttgtcacctctcacctcgaatactgtatttttgacccactgttagctgaatccagtgatgtggaacccatggatatggagagccaactgtatagttatttgattaaatttatacttctttactgcctttcagaaaagttgacatttctgctgaaaagaagctgctaatctttacccagatagaacagagaaaatcagagttgaagggacatgtttagggaaacttgtacaatctaactttataaagcagcccaagtgtcacatgaaagtgaaaacacacaatgaaaatgagcatcagcctccagtaattctaaattttatctacaagtgtattcacaacttactttttgttattttttctgatgattagccaaaggtcagggatgattggcaggtacaacagttcaaatagaagtagttcacaaactgcctgtaagcctttcttgataaacagttttgatgaattagtaaataaagtgttttattttatacagaaatctctgtactttttcatatttgatcatttgtgcgtccagtgacatattgtagacatatacattcactgaacttattactggttgccaagatagtaatagcaaaatctcaaaagctgcatgacaggaattattcaaatagttctatatactgataaatcaaggtttaactatacaacaccctctagtccaatgaaagtagaaattacctgtgaaaattacaatttattttgaatgttcacaaataatcttatctttttatttgtaagtttgactcaaactataaactacacaaataaaaaagtaaaataattatagtaagtagccaaattttattctagttttcttgtttcattcaaattcagtttgtgctccttaatgataacactattgtcaataaaactttacactttaagtgactttccacagttttcccatctgataagaatggtactgataaataaaaaacaacatgcactatccatcttactttcatagactagagataaatcattatgaaccccaattggcagaggagaaaattcgggtgcagacaagttaagtcaggtggcagattcacacaggaaataaatagtggctatgctcgtataaaaacatcaatcttctgacctctaattcagggcttttccagcactgcagtatgattaatcaataccaggaagcaaactaagtatcaagaaaagatcatccatttgtatcagtctttcctttatgtggttggaatctaaaacaccaagtgcataaaggaatcaaaagtcggaagctttgaccatttgtgaacaatcttttctgtattattaacaggtctgatgataaacacagacatttactaggcccaaattgtgaaaaactttgtagacattttgctaatatgcgggaaataagctctttcttttagcaacttactttgattttcttttatttttatgctgctaagaaagcactcagatgcatgctgaaatatgtattaccttatggattgcagctggcagggactattagtgttaaagattcacacatttgaagtaagattggatacatttatatttgtgtcaggaaaaaaataataatagaatttaagaatttaaaatgtaaccaaaaggcagaatcatggcttttggctgaagagattagcagcattcttctctgttccctttttttctgaagcttagttttctagctaagttttggcaaacaaaattcttttctgtggtatgtattctattttaacatcttccactgaaaagaaaagataatgatataaataaagcaatttaaatcaagtctaaggtataggaaggtatttaagaaagaagcaaacattctctagatgttgttatccaaaatatattctcttttgcagtttactgaaataatttcttcagtgtgtgggaatttcctttgcatccagctttactatagagatgacatcacaccaacagtgacacgacttgtttacaagagggtggtataaacagcaaatgttcttccttaaaacagatttcttgttgaacttcaacagaaaaagaagcgtaaatgtagaaggaagaacaggagatagtctttaacatgtagggtaaaatctaaggtagaggagagagcagctgataatgtttttatgtgtttgctactttattaggaagtctacttccttcttttccatatctagtagagtcttcaagttgtacattgtctttatattaatatataatggcctattgtactatgtcttaatagtttcatatcttccctggtttacatgaattaaatgagagcggtaacatcagaaaaggaaagagagagagagtgaatatgtgtgtgtgtgcatgtgtgcgtgcgtgtttgtgtatgtgtttctgtgtctatgagagagagagagaaaagacagacaatgaaaatgaaaataaatatcttctccaacctatcttagccaactttctgatctaggatgttaggacagtcactcactgaaggaattttagttatagcaaagcgtcatccatctttttcaactgtgttaactttaatttcccataaataataatagtttgcagaatacatctcagattgtacctgaccatattgcaaaataataatttgcttcttgtgtaagaatcattatttaagactaaataaaactaggtataagtaaaataaattaaattcagccctttgaataatcatttagatcatgactgctaactgtagtctagtactaattaaagacctacatggttatttttcttagaacgtgagaagtcttaggagcaactgtttgaacaccctgatctggagggaggagtccttaccaggagatttctggagctgggtgtggagggtagttcagtttccacacattagcccataagagaaaatcatctgggtaaaatagggtgactattctggacacggtcatggctttgctactatagtcccctccatttttcttgggagatgcattggtgcttcgcaaagctgtgcagtcattgaaggtgctcagcactggtttttgtcattaaaatacttgagcttgaaacccagcactgtcaatttagtgagcgcggccttacacaaagttatctaatttctctaagtttcagtgttatgatctatgacacaggttagtaatccctcctttataggaatgtttaacattaaataatgcattaaaagcactttagatactattaatctcaaggcaaatgtcatgttatgtggtatggggcatataagtttccctggcattctcaaaacctgaaccctacactccagctcaaagctccttatagacaaggaccatattatgaaattctgttgtgtttttcatagtataggatgtacacattgtgggatttcaaaattggattgcttcttggtatcaagtatccaaattgctcagagccatagtagtaaaacaatggagaaacagtagtgactgtatcattataatatacgtaagtgttcatgttagtttgcttaacatttattgaattcctgatacataaaaggcctcaggctaaattttgtcaattatataaaagtaccttttcctcaataaaggcaacttactggaagaatcatgttttagtgggggaaattaacatataggctttataaacaaatgaattaagtgctaaagagatgaacaagacacatattgtaagatatcagaaggagaaatgataggggaagacagtagttgtcaggaaaacatggtaaaaatacaactgttggacttaggaaggatttcagtagtttaagagacaaaaagataggaaaacgtttagcatgcgcaaagtcaaagtcagggatccataaatatcattgggtgtgtaatgaattgttagtagttggatgggggatgctaaaatataaagtgagagatccttcatatattttcgtttcctacccttagttccagatattgatagagatattttagaaaatcccaacttaaggccaggcgcggtggctcatgcctgtaatcccagcagtttgggaggccgaggtgggaggatcacaaggtcaggagatcgagaccatcctggccaatatggtgaaaccccatctctactaaaatacagaaaattagccagatgtggtggtgcgcacctgcagtcccagctactcgggaggctgaggcaggggaatcgcttgaacctgggaggcggagcttgcagtgagccgagatcctgccattgcactccagcctgggtgacagagtgaaacttagtctcaaaaaaaaaaaaaagaaaaaaagaaagaaaagaaaagaaaatcccaactgaagtatatgtgaacaaatgaacagctttttttttttatcaaaaaagcaaaggtctttgaaataattttattcagattttgctcacaaatattatatttccatttttatttaaaattatgaggatgatggctaaaagtaaaatgaaccaagttttgtgcatgctgcattttaacaagttgggtgtctcattggaatgcactgccttcttgttccacatttatttttggaatttaataaggcgcctgtcatatctgcctcaaggctaaaaaacatcatgggggagaaatccaaagtactgtcatgtttgagtgacatggagccaattttattttatttccttttcatggggggtggctcaaattagccaggctcacttctgaaaacgcattgctacatcatctgttctaaaggccttgtgctggttaacgggtaatgacattgcccagtgacatttgttaggtagatttgactcagaaaaccaggggaggattttcattaaaaaattaattctgtgcattttactgcaaagctcattctcatgatagattctggtacagtgccacatatctccagaattgggtctggttacgtgagaaactttggaaggtaataacttctttatttcttctttgtgctcccagagcacataattaacgtactgactcatttagctcaactctccaaaggatgaagctgtgtggatacaagggagattcagagaaactggcaaacaagtatggtttctgattctcattcgagtgagggaaaaactctgccattttcttcttctttcttttaagttgatgtttagtacaatgtgactgtgtttagcagaacataatatgttaggattacaatggaaccatcatatttttaggaagtttaagtgagacttgggatagatgtcacagaatgatgttgccatggctgagttagtcataaaattagaaatcacagtaagctgaaggatgtctgaggcataaaaataaaccatgtaccatgtaatgggtgtgttattgtaataactaagataagcatttcaaatgttttactgattaaatcagaattaagtcctgtgttttttagtagtgactatcaggaagtagattgtttaaataacatgaacttaaaacatgtaaacatagtaatttttatgttaaaaatatatagtgtagacaaaatcaataatttgtagctagaaagctctttctaccttcatttaggacttcctgcctcatgggtaaatggaaaaggaatagtaaatctaagcaactttttcatgagtttataccttcttaggcacaaagagaaatctgtgatctcttccctgtatcctagaagacctctgcgacaggagtgagaattgaatttggttacaaactactgagagtgtatgtgtatgtgtgtgtgtgtgtgtgtgtgtgtgtgtgtgttttgcatgttggctaagtatggaggaagggaatcattgtaggaaaatttaatcctgagattttgtggctacactcactttaaacccaaatatgtgggttggatcaatccttggttatatatgggagatcacttagtggtcaggccaggtctaaaccattaggtattgagccactatggagcaaacaaagagaaacatgagacttcaaaatgagcccacccccatgttaaacgtgctctacacttcagcatgctccagggactgtgaatcagaaaaagtcaactgcattttgaagtgtcggcacgtaacattttcttttcctttgttatggaattccaaaactatactgtacagattacctaatatattctgaaagctatcaagcaagcaatgtaacactttttttgtggacaatgattttaattaaataaatgccatttcttggagacaatttacctcttgagtatagctggtcttcatcttattttacacaagctatctcttgggggcataaatttccaggcaaggaaacaggaaaatttattggctatttgatttacatgtttattgggctctccaaaggctttactatttaactggtcattgaaagtagaacaggggtggggtggattatattcaatttaatggaagatttaggtaaagtcttttgaaggaaaaaatatgggtcaacttttaaaatatttcactttcagtaaacaattgtatctattattttagtggctatctaccaagagctgaatcattctgtacagactgaattctttagtccatgtctcgagttttaagttttccatgctaagaagtgctttaacttaaatgtgtcaataatgatgctgctgtggaattgtgtcatactattcccacgagcagcccagaatagctcccaggcttggagtctaatctttattcctggaggtggcaagagtaggttgtcatggagctagtggagaaatcagcagactctatttatgtggcgagggagaggatacagtctttcttctgtaaaattttagaatgaggctgttccgcaaggacattagtctgagtgctttaaaaaaagagcgtgtactctacacgtggaggctcaataaagtttgtttacagtgctgagagtgattccatattcacatcccaaatataaggccagttgccatccttcaattattctctcacaaatacagtggctcctcctctcttcagtaagagtaattgtatcagttagagaatatttcctttactaccaggaattctgagaattagaatcctcttccttgacggaaaggcactagattgacaattttgcaaatgcacgtgctctctttttgctttaggttatcattcttgcggaccatttcccttagtatctcgaagcgtctgactgacagggtttgaatcccagatctgccacttacttactaatcctttgaaactaagcaagtaaaagaatgttattaaattcataatactgataggaacaggatgcagggagatcctgggcagaagacagtgggtctctggcgagggccccaccctcaagctgaaaagcctggaaccatggccaaaagtaagagcttgcatccctgttttcctgctcgaatgttgcctttccacccacagccccaccccacccccgtcctgtgcctgtaaaaaccccagagctcagccagcagagaggagaagcagctgaatgtcagagactgggatggatgttggagagaagtggtttgacttcagagggacagcttaacggtgtagcttcggagaggagtccggtggggatggcccgactctagaggaagatcaccttcttgctccatcccctcttcacctcccctttctgctgagagccactttcactggcaatgaaatcccctgcatttaccatctccagttagttcatgcaacctcattccttctggatgccagataagaactcgggtgccacgagtgtgggtgcaaaaactgtcacactgaccctccgctgagctgttaacactgaaaaactgtcacactgaccctccactgagctgttaacactgaaaaactgtcacactgaccctccgctgagctgctaacactgaagccatctgcagatggcaaagctcaaagggttttgtcatactccgtctggggcttcaggggtcgcgagcacccccctggaggctgtcgcggggcccacatggagttttgctcctgccagcacccaaaggtgctcaccccagctcctgcgctcgctcacctgcgccccctcccttgaggagtggaagtgagaccaaccgagtgagtccagcgcgaaagcagccagcgaggtccagggcctgtgaggtccagggcctgtgcgctccagttcccgcccacgaagggggcaggaaatagctgcttcaacatcacttgctcttttttttttttttttttgaaggaagaattcgtaaaataagtttggagatcacttgaacataaatattttggaatatgagcccactcataaatgtgaaagtcattacttttattttttaagacagggtgtcagtctgttacccaggctggagtgcagtggctcagtctcagctcactgcaacctccaccgcccgggttcaagcgatcctcctgcctcagcctcccgagtagctgggactaacttctgtgtttttagtagagaaggggtttctccatgttggccaggctggtctcaaactcccgacctcaggtgatccaccagcctctgctcccaaagttctgggattacaggcgtgagccaccgcccctgcccacatttttgttttaatttgggtttttgtcacagtgagaactggaaaaaaacaaaaacaacaaaacaaaacagaaaaacctctgctgaattacctgtaaacgaccttatgataaaatattctgttttgtcttctctgtatatatattttttacaattgctttagtttcagataatattctgtacaatttgtaatttagagataaataatcaaatattcatacatatatgaagcattaaagaaaaatttcaaaaactctgaaacgtcatggcatccagtaagaacaaagtttctgtaggaatttgcatagaaaaaggcagctggacttaacatagcatctcacggcacctttaagaggtccttagctatagcagccagccctatcttcatattgcaagagataattagtttcagctgaatactcccatccatcactttaaaatgagatattgactcaaattttagaagttacaactttttttttatttaaaaatgttatagttgcccaagtacttaaacatacaaaacttaaacctagttatatatttgctaacttaatttacatttaagtaatgtaaaacaaatatcagtcagaaatcagagtgtttcttttaaaacaattgtcttacaccaatcaaatttgaatatagctactatattttattattattattattatataggacccatatgcataaatactgaaaactaagacctggctataaagttactaagtgttagatttaatgggttttttttttcctgattttccatatgtataaaagttttacttgaagaactctgcatttaaggaagcatccaaagtaatttttttctataaaaacacagaaaaactgtgttatagcataccagtaatgcacaaggagaaagtcatattacagaattaaaatattgctattacataaaaaatgctataagattactttaaaacctcctacctagattgcttcaactgcaattcagaataacatattaatttaaatctagaaaggcctagaactgaattctgtctcagcttttgattgattcagttttcattcttggtcaagttatttaatattgctgaattttagctctcctcatctgtaaaatggagaccctaaggctacctggtaagatcattttgaggattccgtctggtattgtgaaagatgcctggtctgtgctattccatactgggcctccaacagatgtttagcctttttcccattgtctccatagtttcataaatggaaatgccttttcccttcccctttaatatccagcctccttcacaccttctcctgctggcgagacgttgttaggttccatatatccagccagtcaaagtctgtgtgtgccatgactgagttgtacacataaaatagcagctgaggcagacacggtctttttttccccggaatcacacatccatgtgttaactgactgtcttagtctcttgtgttttgctaaagcagaatacctgagactaagtaatttacaatgaagagaaattgatttggctcgcagttctggagtttggaaagaggagatgcatctggtgttggccttcttgctgcagcattccctggcaaaaaggtgggagggcaaacaagctcacatgagagatggagggtaagggggctgaactcatctttttatcaggaactgactcccactataactaagtcactccatcataatagcattaatccattcatgagggcggagtcttcatgacttaatctcttctgaaagatcctacttcccaacagtgttgtagtggagattaagtttctataacataaactttgggggtcattcaaacatttcacccctggctctccagggttgcagtctcatgtctgcagctttctcaggctgcagttgcaatctagtggccctgcagttccaggagctcaggggctgctccactctcaaggcttcactaggcattgccttagtagggaatctctgtgatgaacccacccctgtggcaagtctctgcctgggcccccaggctgtctgatacgtccttggaaatcttagtggagattgtggccattaaaccgtggccccacagctcttccattttagggacctgcagatttaatatgatgtggacatcgccaaggttttcagcttgtatcttctagagccatgggtcaagccacacacacctggactcgcttgaattacaagtgtggtggccaaagggtgctgttttggaattcagggagcagagttctagggcagtgcagggcagtgaatgctgtggtcttgcaggcacctctctcaaaacgttgctctcaacgccctagcttgcttagaagatctcagaattgcctgataagatacggtcattatctctttatcctgatgaagagaatctggctttcttctgtccatgttaattactttaggaaagggttgcttagccacacccttagtgatatggatttgttgcgtcccgacccgaatctcaccttgaattgtagctcccataattgttgttaggagggacctagggggagatgattgaatcacgggggcggtctcccccatactgttcttgtgttagtgaataagtctcacgagatctgatggttttacaaggggtttccactttcacttgactctctgtctgtctgccaccatgtaagatgtgctttcgccgtccaccctgattgtgcgggctccccagctgagtggaactgcgagtccgttaaacctttttctttatgaattacccagtctcaggtatgtcttcatcagtagcacgaaaatggactgacagacttttttattatttacatggccagcctggaaaatttcaaaatctatccattttgcttccaattataaattttatctttaaattattttttcttccctaattttattgtaagcagtcaaaagaagccatgtagcactttgaacactgtgctacttagatatttcctcagccagatatcctagtacattgctcatcagttttgcctttcagtcttacgacgtgaacattattctgtcaaatttttgcaactgtataataaggatttcctttactccattctccaacactttcttcctcatttttgtctgagatctcatcagaatggccttgaatattcatatttccagcaacattctgatcataaccacttaagtaatcccttacaaaatttaggctttccctatatctcttatcttcttatgagaagagaccactcttttttaaataaacaaacaaaaacaattactgactcagcaacaagatgtgtgcatagcttattcatgaatcaattcattccttttaaatgacacttgatgcatttgaaagagcattttatatatcattattaaattagaaatagaaccaggcgcagtggctcacacctgtaatcccagcactttgggaggccgaggcgggcagatcatgaggtcaggagatggagaccatcctggctaacacggtgaaaccccatctctactaaaaatacaaaaaaattagctgggcgtggtggcgggcgcctgtagtcccagctactccggaggctgaggcaggagaatggcgtgaatccgggaggcagagcttgcagtgagccgagatcgcgcccctgcactccagcctgggcagcagagcaagactccatctcaaaaaaaaaaaaaaaaaaaaaaaaatatatatatatatatatatgaaaaataaacagacggttttaataaatgaattccaacctgtttagaaagagtactctatttgataaaataatattaaattaatttgtatggctagctgtactaatttcaaattatgctcttttggaaaaaaatatggatgtcccaaagttaacattacaggtatttgtggggcattttaagatctaagttaaagagaactaggaagtgttctaagtaaatttctgagacaccacagggtaagggttctcagctagcatgtctcgtgttacttcagatggctgtcagatgctcatatctgattctgtaaaaagtggattatctctgaagtcatggtttcaacgtgcaaattttgattttactgagaatatttaaaagataattgtggttcctaagagacttttaaaaaatggatttagaaattaactgtaaaagttcaaggaagccaagcaagcatttctatgagttgaattatgtatttaaatatacttgtgtggaaggggtatgtaaagtcagatcagctagagaaaaatgacttctcaagaagttattcacataaagacctatgtgacataacctgcaaagtttaatattcactaaaagctctattccaaaaataatattaaattttatcatcttttaaaaaaattaaatctggtattcttaatctattatgaggtgtctgtcccaatgtgaaacaaagttttccctaggtgggaggactctacatctgcttgggcaatggaaatcatatgatttgagtgatgggcctggatgagtttaaaatcatgaaaagcacaattattttcttctttgtcaatgagaaataccaataaatgtcatcagagaggcaatggcatattcttgtgttctaaatatttgggtcatttccataaaaaggctgcagttttcagagacaaatgtgaatcctgaactctagaaccagatcatattcataccactagaaatagaggtaaagaaatgacctagaattatgaatataaactgatattatttacgaacctctaatctgtaatatttgaaatattttgttcaaaataataaagaaaaagggtatatcttggacataatttttcttatgctattctgtttttatactttgcttgagcactgtaaggagactttggcaaagtagtcagcatttaattcatttgaaaaggtaatgaaaatatttttgtttttcctttaaagatatatagcctgggcaacttagcgagaccctatctctacaaaaataaataaatatgtaaattagccaggtatggtggtgcacctgtggtcttagctactcgctgaggtctgacaatggcttgagcccaggagcagttagaggctgcagtgaactgtgattgccactccactagagcctgagtgacagagaccctatctcaaaaagaaagaaaaaatagttttctgctcttctagtgaatagtgatttccacattaagtcaatgtattcattttttaattgaatcaatacaaagcctaatttgtctaatgcagtagatattttccagagagtaaacagaggaagcagctttacaatatattaagcaattaaaatacttctttttttttttttactttttgagagaatgatgattttggacccctctcctatggtggaaacttaacatctgaaaactgaagtacaaaatattctttttttagggtcttacatgatgttgaagttgaatacctttcggaactattagagaggtggagaaaattgttccactttttaaaatttggttttattataagttgtgtttattcttaataatctttagtttgttgtcaaacaagattgagaagttaaagcgattctgatatcacatttgttaaaggcccactctgttctaggcacttatttcacttacttttatttaaccattatttccatattgaaccagcattttctcttgacataaggggaaactgagagtcaaaggggttaagtgtcttgctccgagtcacccatcaaaaagtggcagaataaaaacaaggtcagatcttctgacacaaggtctaatgacttttccattcaacttcaattgccagttttgtgtgtaataggggcaggttcctctatctgtcttttctgagagggaaacgtattccgaaatgtaaagtttaaactgtgctgttaaaaggaagaactagagaaggtgagactttccactaagattccaaagatataggaaagtaaattttagattaacactggggagactggattttcttttggtaaagggacagagaaatgtaaggttacccagtgaaatatgaactcagaggaacaaaaatctatttggaggttttgaaatcaaattaagttacatgagtccaaaatgttgagcaagcctttcttaaaggcacctgtaaatgtaaagaaaaaagttggtaaagtgaaaatgataagaattcataaaatcagcattctgtaaagtgcgtgaagttttaaaaccaattcaactatgagtagatgtcatgtaggcagggaatatagtaaagccccattctttggagttgctaaccatgtgaccacaaatctccactgccaccttgtggtggtatgtatatttcagagacaggctctgaagaaaattgacctctgaagtgctgagaggtaaaataaaaggtgtctggtggtaaccaacctcccactttctgaactcaggaaccagacagatttggggaacacaggatccctcttttggagttactatccaaattcctaccatagcaatttaggagataccatagatttggagagcagggctattatacagacatcacaagggtgaaaaccttgagcaagagtaggaactgaattttctttcagattcttttgtgttcatggtggaggaagatattctattttcaagaggatcctaaatatccaatgcagttttcatctagaaaaaattttaatctattctgtataaagcaatgaggtaacattctcgtcaaaggaaatcctatgggtatgtgagaatggaaggcttccagtcacttctttacatttagttgcattcataaacgtgaccaatggtgtttctgtctagagcttaatgggttacttccgcttatacaccagttgtgctttcaactctgagcatgacatcaggaaatgtgtttgattccaaaatgatcaattacagaagcatgtgatagctaatgtgcctgtaaactcattaaccgaatgaagccacctaattgtcaacagttcaacagaattttgtctgcaggttatttgtttttaggtgtcagtggtattcctgttttaatttcgccagcagaagtgggattaatagatcaaaatagtattacagcacatgacaatagatgacaagcaaagacaaatctaaaattattctgattgatcattctataaatgtaataaaacatcagtacttaagtgtagtcatcatttattttattttttatagtgctcaaaaatatttataatgtatctgtgctaaaaacaagtctctaccaactgcataacatgtaatttgagcaaattatttaacctcttcccttttatgcacaatgaagataacattaacatcattaagaataaatgggtaataaaagtaaatcatgggacattctcaataactgtgtgtgtgtatgtgtgcatgtgaaaactataaacaaaaaaaaatctcttttattcagcagaaacatcttgacatcttatatcttaataaacctgcaagttaaataagaggagggcttaagcattagtacaaaaaactattatacagtgctttatttgtggagaatattgatggagaaaggaggaaagaggaaaagcctattcccaagagaggcttctgcgaagagcagagcatgaaaccaaggctctcgaggaacaccaaaacaaacaaactctggcagtgtctgagtaagccagccgtctttctctcaataatttttattgtgcacccagtgatttctcaggcaatttttagagccttttggaaagtggtctccaaattatgcactaatacaacactgctaatgaaagccctcattgcaactcattagctctcacttttttttgctaatccacaaattctgtcctatgtggtggacacctggcagtacacccctcagccccatatctcagcagagatgtaattgccaaggcctggagcgaggtttcatattacctagacgtgtggcttatgcaagctcttccatgagactgtctgttgtcaataattaagagctatcaaaacacttggctaatttacacttgataatctgaaatgagggcccctgtgatcaccagcttctgtcttattatttaaatacacatagtataaaaaaagcagaatggggccaaagcaagccgtatcagggaaaagaccggctttccagcaaacaagatatagcccagtggttgtaagcaagtacagcacaaggctgaacaaacatggcccagtgagtgctttttatggctgagaagcttcacagagcaggtgggattgtagaggatcttttgaacactgagatgtggggacctggcaaagtttaattggcaagctgttgtagtcaaatgcagagaccatgaaaatgggcatgcgttatggacatgagtagggagctcgcatggtatttcaaaaagagtgattgctagaaataataggaaataactatgtatgaacagaaaagaaataaaaccattaatttttaggaagtgcaaatagtcaaaataaagaagggcagtgcagtctgtatgtaaacagtgaaaaaccctttgcacagttgtacttgggttttcagcaacattagcttagcataggaatgactgcgtaactaatctcattatttgttcagaattcagggcatttctgattttctaattccaacttacaagataagagataagtggcgtaattgaagatgttgttaccagtatttttggttcgtattatgggttaaattcagcaatacatactgagaaaaaataatgtgtaataacaaggaacaaaaccttttgataataatatgtcaggatatgtcattttaacctatctgataaggaaagtgctttgttataatgccatttaaaccttttttagctaaaatgtcttgactagaatttggggaaaaataacttacattaaactctgctatactggaagtgtatgaaaaagagtattgattttataacctgttggtgagacacatttccttgtgaatgaaaatacagtgggctgtaaagtttgaagtaaagtgtcaacgtgtcagagtaagggccacatgccgtgaaaaatgtgtataagagatttgaaaggcgcatgtagttcagattcacttgtataaagttcgagtgaaagtgtagctggaaattttaggtcaacactcaagttaaaagcaagattactgctggcttaagttataaccaaaataatgagaaaatatactaaataacctgtgagagagggaaatatgagtgctataaaagtttaagtctgttactttttacctaattgtatattcctccccaatatttttaagtttagaaattgagaaattatactcatttttgtcagaggaagagatagttttaaaagtccaggtaagattagctggccatggtggtacacacctgtaatcccagctgctcaggaggctgaggaacaagaatcgtttgaacccgggaggttaagacttcagtgagccgagatcgcaccactgcactccagcctgggtgacagacggagactttgtcttaaaaaaaaaaaaaaggaagaaaaaaaaagtccaattaagaatttcatgcctttcaacacttccttttgctgatcctcttcttttaaattccacctcatcttcaaagtctagcatcaaggcctccttaatgaccttctagctatgaataagctaaatatctcttctcaacttccaaataccattctttgggaatttatctatgtacaagaaggttgtcttggggacaaaatttcttttaattcatggatgctttgcaaggagtttccttacatacaaatccttcttgattggatggtgctggattctgtctttgcttctttctatattctcccacttcacattccagctctgctgaacagttgactgatctctgcacagtcagttctcttttcctggattgtcttttcctgcacgtctccttggctaatttcttctaagccttcagctttcatttaagatctcacttcctgatactctcctcgtattcacatccaatttaacgactctgcgctctgttctcagaaaattaccttctgctattaagattagtatttcacacacctgttattgcctgctttcttgtctgtctccttgaacagaatttcttctctctctgagatgagaatcataagattcatggtcagtgctaaaaaaaattaagaatgcatgtaagaattagcgttcatagaatgtaagcaccatagaagttgcgaatttgttttgcgtgtctctatatctctggtgcttggaaccatgcctggcccacagtatatcttcaataaaatagtggttgaatgaatcagtgaataaagaaataaaaatattatgtattttaaaaagaaaacaataggttactaagaggttgtgttataaataatgattacagctgaacgaaagtactaaaaatgtaaatgatgacaaaatgatagatgagagtaaatagaacttagtatttggaagtaaaataaagagcaggaacaaaaaaggatgattgcttactagctgctgttcttagacaaataaacccttattctctgaaagtttaccttagcatttcagcagctgacaataataaaaaggagtaagaggtatgaaaaattacatgtcgttttacaatcacttccgtgctttgtctgtttgctccattgtgatggttcagatggttccatttgaccccaacctctagctgttccaacctcagaaccaatatttattgccacatatgggctgcgcatggcagctgcaaaatccagatgccaagctttggaatgtatttttacggcagcaccatctggggctctggccagccttctttattgtctcttgaatgtttacactaatagctttgctgggctgtggcactacctgtgggacacgctgagggtcaggccgtttatgagctcatcttgtcattctagttagaatttccctttaaatgtctctcacctgctatcaacttattccttttaatgtatctacaatgtctgatgaaagtaataaaacaggtggtcatcgagactaggaaagaaaaggactgttttcacagcggtgggtccatgttattcatgggttctcagcagcccatttgtgagttttggggggaaataaaatactttttcaatttactgaatatattattttgcttatatttcattgaaatagaagatatacattattatagcccttaacccaacttactggagtagcatattgatctctaagggaggtgataatactccacagcacaaatgaacagtattttaattcctagggaaacttaaaaaaatagtttatttttagcaatcaatgagttgagttatttgaagattcacctgcaacttaggatggataaatgactatttgtgatccttagaaccatgatttagggaattcctcaaaggtgattcaagcagattcatggttttgaattgtgaggaacccgtcattctaaaggaactaatgcaacacgaagattcagctcaagtaataatttagcgtgttatatccagcaaagggaatcagctctgagagtttaaatgacttatccaaggtcccacaagcggtagatccagagtcaaagtgaagatgaagtttgtccaattattcgatgacagtaggacttgtcaggagagtcaatcctgatcatcgagcccccgaaatgatgaaatgacctgaatgattgtgcgacgtccctatttgctttcacggccccgacactcgttctgccccagtgggtaacctcaccttttgggggtggctttgtgggtggaggctgtggagcaggactgcagtcagacaaggaacatgaaggaaactgcgtttgtgtgacctcttggaagcctcctcctggtagctgggcttcctgggattgtcacagagagactgccatctcagaagtagtgacaaaattaggcattcccaggctcacggtttctaatcaatcagcctgtcacgtatctgaggagatatttcagagtgaagatagcgtatgggaaagcaatttccttggacttctgcctctgagttctatgtctggagtagaaatgaggtgcttagtgttaaacaaagccaagtagggagacagtgatgtgactcttatgcatgcctggaccaaaatggcaaatgtgtgcctggggaagccacaggaggctcccagaagcagccttccaggttctgcagacacttaagaaaacagccacaattaggtccaagggaagggtgatattctctccaaagacactttaaataagaaagagctgttaaagctttcctgtaggctgaggatagaccttttaaaatgatatttagtctcaggaaaaaagaagacatattgttataatgtgttgtcagttctctaaggaaatggcataaaaaggagattttattgtggcttaatcctttgttctggagaatctgcgcttttatatacagtatatattttaatgaaaaccatgacaagattactattcataaatcagcagtgaaatactaaggacatagatgctcacagctgcatgcatgtgtgcaggaggtgaggggggtggtgcatgtattttttcaaatgggttcattaccacaattggaagaaaatcaatgcaactatggcaaaacctcattgctttgttgccaaaggatttctgatttcatttttttttttttttttgtaagacagggtcttgctgtcactcaggctggagttcagtggcataatcatacctcactgcagcctcaaacccctgggctcaagcaatcttcccaccttggcctcccaaaacattgggattacaggcatgagccaccatacctggcttgatttcattctttgtgtgaaggagataggagaagggctttcagcactctgaagtatccttaaattgattgatgtattctcaaactctctgaaaaatagtggcttcaagttgcccgcctcataatttttgccacttcaaatttgtacattctatttctggttggaaaataaatacttcacaaaactattatagttggacacaaatatatcaacaactccatcatttcatacaatagctggaggatatctttgagatgaaggtcaagcaaacattctcaagtaaagccataggttatatgtggtgggtaatgtccagtgattggaaacacatcagaggagctactattttgtctttgtttggaaatctgttttgcagattgaaaaatgacagcatcgtgatacataaattactagagacttacaaggaattaagaaagtaagtagtaagataaatgatcaattggaacccaatttttcttgcatgaagtactcacaaatgagtacttgtgctgataggtgtactgggagttgtgtattcacaatgagaaagcataagtgtctttggatgggccttagctatacatccttgtaagtaatatattacaactgaagaaatccctgaggtacatctggcagggccccagcttcaagttgaacctgaagtagagagtgagcttacaactcttgcgcatgagtgcacacacacactcgcactccaaaaatatatgccaaaaaaagcttcccagaaaaaaataatttaaaaaaatccctgaaagctactggaaagtcatacatatgttaaatttggtcatttagcatcataaattgaagttggaatatcatgaaataggcagatctgatcctcccacattccccagcatttacaggaagtctgagacagcagaggttggatggcgatgatggtgatgatggtgatgagtatgatgaatgtgatgatgaaggtgacagctaacctttattgagttttgctataaactaaatgccactctaaatactttaattcataaaattctcacaacagtttattttacatctgagaacactgagacacaatgcttagattgtctgagtaacacagtaactaaatgcaagattctgttttctacgttgtagtgaaataccatcgatctcagtggaacaagttgcaaagtaatttgtagaaccattaagtcaattagggaatttaaaattctgaactatggtggtagaaaaaaagccacatttcaaatagacatgacttcagagaggcaaagctaaaatttaagccatttacttgccagtttttatttttattttaatatttttaagttttattttaagttcagggaaaatgtgcaggtttgttacataggtaaacttgtgtcatgagagtttgttgtacagattatttcatcacccaaatattaggcctagtacccattagtaatttttcctgatcctcttcttcctcccaccgtccattatctgataggcctcagtgtgtgttcttcccctccatgtgtccatgggtccatatcatttagctcccacttaggagtgagaacatgtggtatttggttttctgttcctgtgttagtttgctaatgataagagcctccagctccatccatgtccctacaaaggatataatcgcgttcttttatggctgcatagtattccatggtgtatatgcaccccattttctttatctagtctatcactgatgggcatttatgtggattccatgtctttgctgttgtgaattgagttgcagtgaacatgagtgaatgtgtctttataatagaataatttatattcctttgggtgtatacccagtaatgggattgctggtcaaatgttatttctgtctttaaagttagaatttcttaactttactatgaaccactcaaaatacttgaatttgcacatgtgcatgcacacacacacacatagttagtgttacttaatctaagcattgtgtcttggtgttctcagatgtaaaataaactgttgtgagaatttaatgaattaattatttagagtggcacttggttcatagcgaaactcaataaaggttagctatcaccttcatcatcacattcatcatattcaccaccatcatcatcaccatcatcgttatcaagttaccaacctcatctgccaatttttaaccccactgccatagatgccactctaaatactttgtaatttttaaattcagtgcttttaacaaatggaaaaaacagccgtgattttcttctaaaagatttttaaacaaaaattatataagtagttataaaaacaggagattgttcataaatcttgatctaggtaaaaacttaaaaagacccagagaaatttcacttttcacctttgttggtcttatttttttaacaactcctgactttgttcattgttcgccgaatccatctcggcttctttgatttcacaccacactggttttgtgcgattgccatttcacatgaacatctggattttttttctcctgtgcttgtgcacatttggagaaagatagtaattttcatccaaatttattctactttactcagccatcagaggaatgttaactgtacatgttcataatgtttttttttaattctaaaaaagatctatgtctgccaggaagagaaatatcctttagtttgtcaactggatccttctagaggagtcaatagtatttttgtttttgatatgatcttccatcaccattcacagacttctagaatcacagcttcatatgctggttaattctaccatatagatacatatatagtaagatggaggcatttctctcgagttcctttaacactctctgtttctttgatattcttcttagtcattgctgcacttctgacaagtctgaatagagagttgtctttttgttaattgttgaatagatgaagagtatagttaagatattatatttcaacatttttaaaagctataatgcggcctgttcctttaggtgtatcactatagaaaaatctctttattcttgttcctttagaaataccttgaacaattagaaaatttcctggattgatgattgcccattttgctacttaaacactaaatttggtcacatgatctgatggaattggaatatggtatcattaaatatctgttgcaactcagaaaccaatttcttctaatgtgctcctccaagggcttcatttacattgcctgattcatccttacatccctatgacataaaagaagggcaggtatcacattatccccattttccaattgaggcatctgcgaccagaaaatggaggcacttgcctatagttacacactatgtcagaggcaggagtaggcaaagatactacttttgttcactgccaatccacccttcttttcattagtcactagcctccttatttcgtaaggtgtaggccattagaagattgatcttgtggggaaaataacatctgttttaaaactcaatgccttttacaagtttatatgccttgatataattttaataggtgcatcattgcctgcttttctttatgagagatgatataaatatgaaaaaatacacttgcagaaatgaaatgaaaataataaataaagccctcttccatttccattattctaagtcatgctccttgagacttcaatctcaatatgatgttaatagaaccattagatatgattcatatcatacataagacattcctattgacaatttcatcttgaccaagggtcaatggatccattacaatgcaaatcttactgtatactttccatctaaatcaaaagaatttggtcttgtgtccattctaatatgtttcatgaagtagaatccaatctcagacatgaagtacacatctgtttctcatactaaatcatgcctgttcctatttgctctcaatttaaaagataattaattacgttttacatcaatagactactttggagtatttaaagaaatgcatagggtttatgggaatccaagtttgcctgtttaatacataccaacctgcaagaaaaattccttcatggatgtgcatctcttaattttggggggtgcatgtaaagctattctacgtatttggtaagatatgcagaatcaggacatgttccaaaagattacctaacccagtcttgtaaagtacaagaacacactgaggtttcaatcagtttttcagataagctgaagaatgtctcactaggcacaggattttttttaaaaaactttcgcttttccccatgctatttatttctactttttttttttttaatcttcatctcttattcctgcactcttgggcatctttcagaatccttctctattcagtgctctaagtagcttataaattgcaatctaaccttgatatggacaatcattgagcccatttctggccacctttaagtttcagggctctcctgatcacctgttatctcttccctttccttgtccgtattattttccttctagaactgtactactgcttctctctatttgtgcaccacaacagaaagacctgctgctgatgagggcttcctgttacagatgaggttaaagtagctgaggaatagctgaacaagaccttacgtaaaggccttttctcccctagggttccatgacattgcatccatactctggtctcaccatgctcctccatcttcctttcttctttcttggaacgttgggtagtgatgaactttggaccaggaagacttctgtataaatccctgatctactaattcttgcggtgtgatcttgggcaaatcctttaatcttgtctaatccttagttttgtcatccataaaataatgataataattatccacattggaagattgttgtgagaaggaaattaagtgatttatgtaagggtcacaatgcctgactcaaagtaggtatttaagcatgttgttgccttgctccctctttactctctctttttttcccatttctctccaaaatattcgattttgtgaaacaaaaaatgttgattttttcaagctttccattatccaattacatagctaccaactgatgagctgttccaatatttatttcttttcaaagcgctttacttcttgtgggttatcgacagctagacatattttttcctctttcagttatgaaagatattctcagactcacaaagctttaaattttattcaagacattgaaacataaaagttcagggattattcaatgatgttaactattgaatgtacacaaaaatgatcttacttgcaatctagtttgtatgctgtttcaaacatgcccaggactcccaagttcaaaggttctctctacacgtaagcggtagtcaaaaatattagttgttttattgcggacagccttaatttatataaatggaaaacatctaaaactgcaaagtacaatagtccagaaagttttcattagcaatccagttcttggacatcacagggaaactcggcagaaagaaatgataagttaattgttgaaatgtttcatattcccaggttcagtttcttacaggtattcgcacctgcctcacctgcacctctgttactctctgtgacatgttccaccaccctggacaagacaaatgtatatttgaaagaataagggtgcttgttagtgggtaggtgtgattatgggaggcaattctagtgaggaaaagatgggttggcgtatggggcagcagtgaagaaaaataaataaaacagtttatttgtagtgggactgatccctcttgctcatgcattagtgcttggctacaggagagtagtaatttattgatgcagatggctatgtaaagtgcatgcaatttgtgagggggcttgacccttgactgatgggccatatgttgtaaagccctaggggcgtcatttgcctccgctctcttcctctctctgtctctgcacctatggtccttattcaatcaccacatattgaactatagacttaccaactcccccaataaatctccaactaatggctcacaaaggccataacttaaccctttctacacaacagagcacattattttgcatcatgatcacactcagtgaaataaaagataaatattatatgacctgcctagaatagaaagcaaattgttgtaaaatgctgttccctgctgggtattcactgcatttggatgtagtagggttgctttgagcttgctgaattctatcgttatattctgccatgttataattacagcttactgttataacataattcttaaacactgttaatacaccacactagagaaacatttaatgttttttaattagcttcttttgtctgagtcttcttttttccctagtaaaatatggaacatatgctcaatgaaaaaatgcatatatttttattctcatgtagaagcaagtttttataaaatatattagggcatttgtatggaataacagaaaaaaagtacagtgtacgttttaaatactcactgtgctctgaattttctataggacccattccagcagaaagacttaatgaaattattcattctccactgaagcactgggatttccttataatgtgggctgtctgagtcctaaatgccacctgaaaaagagtttaggacaccaagactagaaaaaagtcattgctgcttatctattaacttcattttttcccatccaatagtaaaactgaataaatgatactaatcagtaatgtgcacatcagtacaatttctctaatattaggaataccagtcagttgccttatgcttattcccatcacttggataagggagcagaaggtgtcttccttggaatcttgagacaacatcactgcaagcaagaagcagacatctattgctaaactaaagttgaatttttgtatctactccttttccccttttctgggcatggctcttggtagatttagcagcaatttagagagcctgggggagtgtaggaagaccacaggtttcaccagtgcatagcccatctgtagaaatagttgtcagagctgagtatctctagttatattctatgtttgtaataattagcttcccagaaaacaatttgtcttttagatagcttgctagtacagtgttcacagcttgtgtgtgatatgttttatataatatctctgagcatcttaattcagtaggaatataatgtttgatttctaccagatcaggtttcatatcctgtgttggtataaaaaataggtttcataatttttttttcctaatgcataatttccttacactatagtgaaaatccagctttctgaaccaattaaaagaaagatgaaatttcatgtacacatatgctgtgtcaaaatgttcatttatgagtcactagtcttatcaacatggataactgatgtagaaaaaatattcaaatatacagaaaagaagaagtcattgtcttctgtcctaaacccagtagacctaacacatacaatgcaggcagaaaggaaatcagcataaataaaccatgcattcccaattgaatctcaataatttaaacataaatcctttaggctttggtaccttttttccacatgggcttttcttttggatttggcgttcctagcatcatttagaattcatctgcgagccacaagtaaatagagtttccataaaccttgaataaacaatcccctttgaggttatattccataatttaaggaattccaatgaaaacatggttggtaaggagttttccaagatgtgtgtgtatcaatatatttgcctataaaaaggaaccaacatgttaaagcataaattaccaactttcccgcatataccatatgcacaagggagggacatctataatatatgtatttctgagattgacaacaagaaaggatgaattgctaatattctgcttaccatgtattcaaaaagtctccatagttttcagaaaatgtggtgagaaaaacttttctctcttctgatgtattttctctctaattataatttggcatctagaatgtgttgtttcttttaaaaataaactaaactgcatagcaaactatattgattttaaaagccctctaattaaaatagcaacttaacagcaaatgaccatgaagtatttaaaataaaaaatgatgatgtaaattgaatgtgtcaactaaagttggtacaaatgaagattaagagaatagttaccttcatttactctatgtttcatattatgccttatcccagttcttcagttagttaatatagctataatgagttcatactccttagaagcagccaacagagaagcttttctttaagaacattctaaatggttcaaatcaataccatttcctaaataaaaactttcttggctcagatttaaaacacctatggctgttggcttattctttatgctagcccaacaaaatgccacgtaatcttgtaagtaagactctgccacattctgatatcaacattgtcaatgagaaaactctgtgtatatacattcagaaacattcaattataattcgcctcttaaagtcatataactatctggtattacattgagttatcactgaacatattaattaaaatgcctcagtattgaactcagtggttcaaactgtttgtgtaacccaaaaacccttaatcattgacatttgaagattgctgttggtttttttaactaataggacaaaatttatttttagtacaaaaataagatataagaatagttacttaggattgaaatggcatgttaaatactaaaggaaaattggaatttgttttgttttttagaatggtttctggccaggtgcagtagctcacacctgtaatcccagcactttgggaggccaaggtgggcagatcatgagctcaggagttcgagaccagcctggccaacatggtgaaaccccgtctctactaaaaacacaaaaagtagctgtgcatggtggcttgcgcctgtagtcccagctactcgggaggctgaggcagcagaatcacttgaacctggaaggcggagcttgcagtgagccaagtctgtgccattgtgcttcagcctgggcgacagagcaatactctgtctttttaaaaaaaaaaaaaaacggtttctatgtcattgttgaaagtgataataatttttatgtatatgattttatgagaaataatattttaccaatgcacatatagggtacatttttatattttttattcatgaggatttccacattttttgtgcaaacactatatgttatcattattttgtatcttctatgtaatatatacaataaatcaacaaatatttattgaacacctactccgtgctaggtgttagaatgataacattgaataatattatctcctctgccttgaagaactttcagtgtaagctaccataatatttacctgaggatttttcatgtttttctaacagtttataaaattcctatatttggaggctctccagaaacagacggaaagggactagtgaaattatagttgaaaggtacagtgtattttgggggacaaatatttatgttattgtatttgttttctatgatatttttaaaacatggcactattcccctgacagaagtgaatttgccaagcattagcctagggtgtttagaagtaacagctgaaggattaaggaaacatcagcattgagtgggaggaattcagcataaagtgtgattagagcctccacagtctgctattcttagctattcattccctgcaaaatcacatcagtaattttcagtgacatttttaattgtccctgtacaaaagataataaagtagaagaaaataaaatcaaaagtgagaaaattcaagtactactaagatgtaccctggtgtttgttggttgtgggtgccctaaattacgtattaacagagaactgccttgtagtaaaatttgatgcccccatgggccctgactttacctttatcatgtagtttcatcatttcaaggatctttccttatggttaaccccttttcatcttctgaacaggttcttacagccagagggttcgcgtgctatttttagcgtgcttctttgagtggtggatagtggttgggaatttctttgcctgctgcatgaatacacttccctgcagagtgtacaaagaagcacttaatttcgagcttttcattttggttagtgacactgcaaacatagcacaggtggctataattttacaccatgtgagtaaaaatactatttttctttccccgtcaaccttcttgtctgatcgtcttaaacccataagatggggaattacagaaactgatattttaaattgatgaactagtttaagatactctttgaaaaggaatccaaacttgctatgtaatctgtattagtctgttctcacactgctataaagaaatacctgagattgggtaattcataaagaaaagaggtttaactgtctcacagttccacaagctgtagaggcagcatggctgaggaggcctcaggaaacttacagtcgtggcagaaggtgaaggggaagcagacatgtcttacatggcaggagcaggaggaagagaagggcgggggggaggtgtcacacccttttaaccaaccagatttcatgaggactcactatcacaagaacagcaagggggaaatacgcccccatgttgcaatcacctcccaccaggccccacctcaaacacaaacactggggattacaatttatcatgagatttgagtgggaacacaaatccaaaccatatcataagcaaaatgtaaaattgttaaggatggggaaagatttataaatgtagggttcaagttagtgtaaaagcgatagcattgtccaccagtgactgttactgggcctgtatctttatcatagtggatcatagttccattattgtaattatgccatagttttgtaaaaacctttatctgttatttgagatataaaatgttgctatctggcaatttttaggttgtagtctcatcttttaggttagaaagtatccttattttataaaaaatctctctctatatatatttagattaatcttctattaaggactagatattcatgttcaaacattaggttttcctgataatccactttttagataatctcagtttttattttagatttaggggcacacattacaggtttgttacaggggtttactgcatgacaatgaagtttgggtatgaatgatcccattactcaggtagtgagcatagtacccaatacgtagtttttcagaccgtttcccttcctttttcccccgtctagtagcccccactgtccattgttcttatttttgtttccatgtgtgcacaatatttactttccacgtataagaaaatgtggcacatatacactatgggatatgtgcagctgtagaaaaagaacaaaatgcatatatgcagcaacatagatgtgctgcaggccattaccctaagcaaattgaggcaggaacagaaaactaaatgccacatgttctcacttagaaggtatctttgaatggcgttgtcagacaaactcaagcatggatccttgctgaagtaccagaatcttgactggttatggttcaaaaacaactgaatagtattcacggatctgagtcttagatacaaaaaatgaaagtaatctagccgttttatttagctggtactgaagtgtagatgatgtattgcataaaattatagcaagtcatacaatttcccttggctagttggtcattccctttctctttatggtttctattcttgtacagatttctaactagtgatacagaacaataacttggatgacttaaaaacattatgctaaataaaagaagacagactcaaatgactatatgcttaatggtttgcttcatataaactttttgaagaggtaaaactggattgttggaaagttgatcagtgctttgcaggggccagggttggggagggaattaactgcaaagaccagagggaactttttggtgtggtgacgatggtctgcatcaccatcgtgtcatgaatgtcaagactcatccaatcttttctaaactttattaattttttgcctgaaaattatatccaacaaaagatgttagaattccactttggtgtgaatctaacctagacaagttgatactttttcctgtttttttttcccataagttaaagctatactgagtttattaatgaagttattaataaaattatttataaccctaatatattcctggttctagctgactttacctgtagttactaggtatttgaatagagtcaattgaagtataaattttaaaccaaaactaaacacttttttcccaagaaacattcgtcacacaggtgcatataaaatacatgcttacatctgaatttgcatataaagtgttgtaggaaaattagaaagcatatggtcttttcttctttttcattgtctaagaagcactaaagccaaataacttggcatgattcttccagttttactctttttaaatagctttattgtcaggcagatggggagtgctagccacttattaaaattacacttgtacatatcgtaagaatgttttatatttattcatgaatataaaatttttagaattggcatttaaaaccaaaaaaaacctgtcatagagttgagtaacaactttatttgtcactttgaaaccactttgaaatatcttgcagcatggacggttgcctaattaatattccaagattcaggttctctttaatgatgtttttaaaagctctccatcttaggaagccaaagataatcatagagtagagattgaattacatggaaagaatgaactttaagatgtggcatctcttccaagttgtattaggaaaatatatatgggaaaacattatcgtatactttgtaataggtactttcccgccctctgtgaagagtttaaaaatcagtacttacactggatagttttcaagcatcattttgtgagtgaataatctgagccaaagagatgtaacatagtccatgaacaccagacagttaaaagattcttctactttagaggttttttaaagactgatttaaaattaaaaaacagatatctatttattcatcacaattttgtgctacaaatttgaagaagtagaggataacattcttttgggtacttaatgaatatttttcaaataaatatctgaattactaatacatctcttagattcatattgcagctagagaaataactgcatcatttgctgaagaacatttgaaaatgtagaatttcttatttgacacatgaaaatatattacataatttaatatatcaatgaagacaggtaaatacatagataactacatatatagatacaaaccagaatatgcaggtaattgactttgaaaatttgtcctgaagacaaaacttttagacagttttgaggagatactatgtgataaggcaaattttataaaactgaagtcaaaactaaaccttctgtcattcaaaactatcatatgtcaaaacgtttttaggtagaactttaatagaactttagcatcttataatgtcatatccctgataaacttgagtgtatgcagagaatctgccaaaatttaatgagcacatgtctgaacaaccattactttgtggctaaagatatttctttccaatttctctccccagtatggttactctgcctctttaatttatccttttaatatgtgcagcaagtgaagaaatagaaagcttgggggaaaatgaactgctataaaaatgcaagtatctccagggtttttctacattctcttttctttatccctctttatttctgttttatcaaataaaatctttttctcctcatagttgcagtatccaaattgtgttttttaacacgtgtatcaaatggataaagtttaatagtataaattgccaaacaaaattggcataagagtttctccaggaccacagtttggtgtacaatatgataccaaatatatcctaaaaattattttctcttaatttagttatagatgaaatgccaggtgttgtattgcaagggtgattaaaatcaacttagctccttggaatctttacctttgtctacataaagctgttaaaggaaactggaacccgctttttctcagtgatgacatccaattgttttcccttatatatagggctatgaaagtatgctatgagtttagcaaacctatctttgcaatgtgtatgtgttatgtagcttggatttgtttcaaaatctgtagagaggctgcaaaatttgtaaccaccttatagaaaagtcaggtgtactcccttccactgcccttcacattttcattgtatccatgctttcctttgcatgttcctctaagataagagttaataagttgtaaaaacaaacaaacaaaaaaaaaaaacaaaagaaaaaatgtctctgataccttagcatagtgtttctgaaccactttccattactgccccttaaaggagtcttttcaacaatttttcctaattgctattcccttgaaatgttactactacagataaactgtacatctgtttatatactgtatttgtgttttaatacataaaatacttgatttttggctcactcccctgaatctatttttgcccccttaaggttagcattgcctcccttgagaatgcaggctgtggcagtattagattgtccactctagtcaggtaggacacattgtcatgtgctgttctgtatgttccctcttttgacttccccttagaaatgctttaataattacattattcaaaggcatagccagccatggtggcactcacctttggttccagctactcgggaggcttaggcagggggatcacttgggctcaggagttcaagaccagcctgggcaactggagtctgttctcacgtggctaataaaaacatacccaagattgggtaatgtataaaggaaagaggtttaatggacccacagttccacatggctggggagacctcacaatcatggcagaagtcgaatgaggagcaaagtcacatattacatggtggcaggcaagagatcttgtgcaggggaacttgtatttataaaaccatcagatctcataagacgcatttactaccaccagaatagtatggggaaaactgccctcgtgattgaattatcttcacctggccctgcccttgactcatggggattattgcaattcaaggtgagatatgggtgcggacacagtcaaaccatatcagcaacatagtgaaaaccttgtattttaaaaagaaaaagagagagagagagaaataaaaatgcacccttccttccttcctttcttccttctttccttctttccttctttctttctttctttctttctttctttctttctttctttctttctttctttcttctttctttctttcttgtctttctttctttctttctttcttgtctttctgtctttcttttagagttcattgcattttttgtcttcaactattattttaagttcaggtgtacatgtgcaggatgtgcaggtttgttccataggtaaatgtgtgccatggtggtttgctgcacagatccacccatcacctaggtattaagcccagcagtcattagctattcttccagatgatgtcactcccaccaccctcccaactacaggccccagtgtgtgttgtttccccactatgtgtccatgtgttctcatcgttcatctctcacttataagtgagaacgtgtagtgtttggttttctgttcctgtgttagtttgctgaggataacaacttccagctccatttatgtccctgcaaaggacatgatcttgttcctttttatggctgcatagtattccatggtgtatatgtaccacattttctttatccggtctgtcactgtggacatttgggttgattccatgtctctgctgttgtgaatagtgctgcaatgagcatacatgtacatatatctttttgctagaatgatttatattcctttgggtatatacccagtaatgggattgccgggtcaaacaggattgtctttctggttctagatccctgaggaattgccacaccatcttccacaatgctggaaataatttacgttaccaccaacagtgtaaaaacatttctttttctctgcaaactcaccagcatctgttgtttcttaactttttaataatcaccattctgactggcatgagatagtatctcattgtggttttgatttgcaaggaaatgcagttttctttgtctatttcagaaagagcacaggggatgggaaaagatgagaataagctagccccctcctctctaaagagagaatttatattttggttcttatagatgacattcttagaattaatatatattccatgaatgagaagccatgtaaatctacttaaacagccatgctaaaggattaaggttgtttgccattatcatctccagtagctcccatagacttccactatgttaatgacaaataatatgtgtatcctccattcaatctctactctggccttcctgataacactgtaactcatatctttccaaaccctataaatagatgcatatttaggggttatgtcctggactgaggtacagtgttgctagaaaataaatataacacaaaacacataaaccaattttatgaattaggctaatttatgcaagatgatgatatgtgaatgatgagaaattatgaattattattacatatattaaatgcttattagaatccaggtacagtgttaaaaactttccatagattttctaatttttatcctcacaataaacctatagatacttttgttatttttactttatagataagaaaaataatatccaaagtgcattttaaatactggtttaaatagctaattttattgatggttataatgcgagaagagattataaaaatcagagttgactaatttttgcttcacttttttatggtggctttctgtcttgccagttgtggagatagtagcaataagtacaaaaataaaatagccaccaggaggaaaaaagacaaacaaaaatatgacttaaattcaaactcagactctaaaattggctgttttgaaactaacaattgttctaatcgtaatcatggtaacagctggcattagttaaccgcttactaaatcatcatcaccttcacagcagcattttcattttactgaagaggagacaaagggttagagatgctaatcatattccttagattctagacctcgatattttattagtgatggtctggattatttgttgttgtgagatgtgttaagggtaattaaatagccttctaagaaaactgaaaacgtctctttttttcacgtaaacaattatcacaatataaaatgagtagaatgtgccatttttttaaacgcctaaatttttagaatcgtatatattttctgaatataattgcccatgaccataaatttttttaactcttttgagtttaatacagtgtaccttttcttttgaaaattttcagtaacttaatgacggcattgcttatacgggaaacattatgcaaatgactcacaatgaagtctgtgagtttagttaagcttgagaaaaagtttgtaattaacaaattagcatttgaaaaagacatttgaatatgcatagtagaaaattccacttaacttgtggggtgtgttcataatgattatttcagaattcatgcatatgcatcttttaacatgcaaatattttaaaccttagtggactagtccagatctggctcatttctgttgtggttgttgttttagttaaatgttgaaaattgtaaataaggcatcatgaatacacatactaacatgtggagtcctctttacttctctttgatatagtctttttaattattaaagacacaatattaaatactttctatttattattacttcactgtggataaaaataacattaagaaaaaaaaatcttggtatctgacttttcctaccaaagtgtataatgtgtactagaatgctatagtcaggacttcatttacctttatgttcaattgtgctgttagaaattagagtttgatgtctcacatacacacacagacattacattattcataaaaagtggcaagaataccttgtgattacttttaaacctctcttatataatatattggcttcattgtaaagtatattttcttaacaattttttaggtaggtcataaccctcctctgtttaaaaaactctaccagttcttgattaattatcagatatgatctcagacctttagttcagcattgaggactgttctccaatacaaagcacctctctcacctacatctcttcacatgttccattctaatctggcctcgattctaattcttatgctttctataaatgcatgatcgctaacccatctaaatgtttagacaaaccgcttttctgccgttataccttactcaccttacttaggctacatgatattttcccttgatgaattcctacagtatttatagttcaactattatgttccctgcaaaatggttatgtggaaagttatagctaatttaaatctagggttgataaatatgtgaattctttgcctttctagatagagaaattatgtcttgttttggtttggccaacctcctaaaatccaataggcaactgaggacagaagattgggcttgacttggcttacacagaggatgggcatctgtttctaatgaactcgtaatttatgccccatcttgtagccaaaaggaattaatagacctacagacataaaaaatgaataaactattttttccacactagtttgtccataacacgacactagaaaataaggtcattacatggtctcatgaaacccctgccaatcctatgacttgatgtattttaggttctttcactttgctttatgtatttgttgtgactctttgacaatatctgatgtttaactttgccttcagaaatttgccatggttcaacttcctttcagtgctcctgccttccttttcagtttattgatagtttcccttgccctagacactcatgtggacactgattacacaaaaccaatcaaaatcgacattggaaaagcaaaataattaagaattaaaatcagccagttcctgacactagctccaaggactagacaggtgacacctgaacagagtggaaaatagttgttgggaagtattccaggcacaaggaacagaatatgcaagggcattcaataatcaatgtctctgaggacatcaagtggaatataaaactagctgtattatcagatatcagaaaggccttatgagccacgcttacactttgcaacatactagaaaaaaagtcattcaaaggttgtataatcaatcctagctgaagatgcttgcaattgttcattttcctataaacatgtatggacagtggataaatcccaaatttttactctgaagcttgtgttgtccagattagatttgctgtttaccttagttttatttcctgaccaattttcaatccttctttcgttacctcccagacacttgctttttaaaaaactatatttttacaaaaacaaaaggacaaaaggtttttctagacagtgttagtgcattcaatacagaaagtttccagttagacaagaattttactgtctctatatgaagacttcactttgcactaaatataagaaaaaatataaggaagaagaaatgtaagaaaaaaaaaaaccaccagaaatagtcttagaaatgcgtatgtttgtacattcatccctcagtatctgtgaggaatttgttccaggacctcccatggatgctcaagtctctgatataaaataacatattatttgcctatcacctatgtgcatccttctatatactttaaatcagatgtccccaacattttaggcaccagggactggttgtgtggaagatgatatttccatggatggtgcaggggaaggaaggatggtttcaggatgaaactgtttcacctcggtcatcaggtgttcaagcagtagattctcataaggagcaggcaacctagattcctcacatacgcagttcacaatagggtaagcacttctatgagaatctaatgccgctgctgatctgacaggaggcggagctcaggcggtaatgctcgctccctcctgctgtgcagcccgtttcctaccaggccacagaccagtatgagtccctggccccggggctgtggacccctgcttgaaatcatctctggattacttttaatatttactacaatgtaaatgctatgtaaatagttaatactgtattgcttagggaatcatgacaaggaaaaaatgtctctacatgttcagtgcagacataatcaaccatttttttctaaatacttttgatgcagtttgcagatatggagggttaatttaattttgcaagctcttataatcaactattgggattcatcattattttcagggtttttctcctccttttatgactgaatttatttttttaaataactgaattactgcataaaatataattattttcataacttataaggatgtatagactgtaattaggctgttgtatggtagctgacaggtactgctgatgaaattttactaagtgaccagaataataaaatttattacacaggttacttcctttagaggttctactttttggtcttcaatatctaacatgctttctttattattaatataaatataaaatagatcttaatggtagggacagatttctctctgtaaatagaagtacaaattttgtatgaaaagttgaagagaaataaatataatattcccaaatctatccacaaccattcatacttgataaaatgtaagtttactgtaaaatgaatgaattattgatgtacttagcaaaacattatatctgcacaaagtcataaattaaacaaactctaatacattttatgataagcataatttgacctgagtccttgttagcctcaaagcataatataatgatcagaaaaattgggggtctaatcaattaatttgaaaatctgcaatgagattattatttatctagagtgaacgctttactagcatacaaataaagtttttataaatgaaatagaataaatatctaattattggaacttttccattaaataactgatggcataaagaggcttctgcttttaaaaaaaaaaaaaatatttgctgatataaacctgagaatttaaatgtcaattatggcaaaaatattttctgtacaactttgttgttttttaaaacattattaatgtaacagctactacatcttattattttcatccattctgcaaatctggtgaatctatttagtctacatctagaacaactagaaaaatatgtataatatatgtatctaaaagggaaatgaagatgcatgaaaatatctaattgtgtaaatactgttaagctagagaattaaagatgataaccccttttcaccattcagccaagcgtgaaggagcaaaagagattcaaaacttcattaattgctctcacacaacgttacaggccacctgcacttcaaagaatttacattggagcagatggattgctgaatgcgatatcaaagaatttcagaatgtttgttttaaaaataacctggattctaaggcaagcaccagcaaagcatacaatttacaaagatgacaaagcttttcttattaaaacttctaaaacgtataagtgaaggcacatttttatctctaaaataagagtatacataccaactactctttaaaatgatcaaagttacatatttaaatatataaatgaaatatattcatgcattatttgaggcttttgaacatacctaactggtttcctttagtaactcctagatcagtgaaatctagctttttcccagtataagttttcacatctctctgattattcaatcttttgaataaagatggtccatatggaaaatgagatttttaaaaaagtttaagagtaactttttttgcagaaactcctttcacttgtcatttgattctgacttgagctcggtactttgattgataggtcctactcgcaatgcactgacagaatccacattggaatagctagttaagatgaatcagagctaatctaaatgcatcttggatcagattatgctttacttttggaacatattgtaatttttgtattttacagaagtttctatagctttacccacaaattaagttttacttggaatttgcatcacaatattttcattctttaaatattgatgtatcaggggtcagaaaacaacaacagctagagggctgaatctgaccttgtacctgtttttgggaaataagattttattttagcacagtcatacccattcaattacttattgtctgtggctgcttttgtgctacaacaatagagctgagtagtcacaatagacagtatggcttaccaagccctaagtgagatatttactatttgcctcttcacaggagaaatttactaaccctgatgtgctagcacatgttataaccttgggtaagttttcttaagctctctgagcattaggttcctcatctgtaatataaagacaccgatggtgtctacccagatgtccctgcgtgtggtaataataatggtacctagccgtgatgattaaatgggataatataagctgttaggaaaaggcctcgttcacaataggtctgatacaaatgtcacccaacatcaacatcactgtcattttctcaggaataatgctaggtcatggagactgagaagagggtttcaaactacattactgtagtctgttcatcttcactagtcaaacaataaagtgggtagcatggttttgtattatgatcatagaatttgaaggtggaagccctgggtatgatgacaatttgccttcttctttgctgtttaataagacctgcagtgagtaatgtaaacactctaatcctctctttcttacctgtaaaattataataatattattaataataatatcatcccccaataggctgtatattgtaaagggccaattaaattagaaatatgaagtagggtaacttgtaaggttgcaatacaaatcaaaggtttcactgcctcattaaccgtacctcacttccatgctttgaactttggggtaatgaatatgtgtaattatttagctaagagggctcaagattaacgcttttgtgtcgagtgttgccacacacatcaacatggatgatcttacaggctaatgagggaaagaagccagaagccgaaggccacagacagtattatcccctttatataaagttctacacctagaaaattaatctttggtgatagaaaagagaatcagttacctttcagggtgtgtggaaggggcatagggtattaatggtagagattgtaggaggcaggtgatgttaccggtcttcttgtgggtataggttacagggctatgttcactttctacgacttcattggccagaacacttatgatttgtacatttcactgtaggtgtaaaatgcttacaagaagaacgaaatattaaaacaaaaaaagagaaaatgaaagaaaacaacaaaagtgttaagtccatccactgatcctgctttcagagccataaaaaaaccgtctgctatacaatctatttacctcgtcctctcacttacaccaatctttctttccacagcaccataaaatctacctacatacatgtaagaaaatgggactctcctttagccagccttgtctcctataccaccttgaatacgtgatgtttgacagaaatgacgttttatttttctctttatataaatcctatgatctccacttttacccaaagccttttttaaactaaagcattatgaccttaatgagactcatagatcacgttcactctctatcttacatgtatcattgcgctattctccaaagttctgtttgaattttattttatatcactccttttcctaaactatgcacatgctcatgaagacaaggcaaaacaaaaagaaaaaataaacaaatgaacaaacaaaaaatccacaggtcttaatagagagataggtttgagtagcaagaaaatatagtttagaaaataaatgttatttatttttgaaaagataatgccctatataataccaaatgccctatataaataccaatgccctatataaaaccaaaaagtataaaagctatgaagagaaaatcaagtctctattttaccctaacctttaggaaacccattcccttctcagaggtaacacatgttgctgttattttgtgcaaactttcattatatctgtgaataatctgcgcatatgcatatagcagtgtgttttacaaaaatggaagcttgttgtagacattaccttatactctatttccataagtgaatcatgtatcttgaacatcttccatgttaataaatattgagtttaaaatacccccaaaagtaatggaagcctagaaacacaaaattatggagctttttttttttttttttttgagcttgagtctcgctctatcaccaggctggagtatattggcgtgatctctgctcactgcaacctccacctcccaagttcgaacgattcttttgcctcagccttccgagtagctgggactacaggcacatgccaccatgcccagctaatttttgtatttttagtaggatggggtttcaccatgttggccaggctggtctcgaattcctgacctcaagtgatccgaccgccttggcctcccaaactgctgggattacaggcgtgagtcactgcaccaggcctatggagcagttttttaaaagaactttgcaaatattataaaattgccttctttacatcatccatgtagaatattccttataaccacttttgtcagtctgagagcgctttttgttttatctatgtctgttaaaccatatgctgaaactgttttctgctttcttcatgaggctttcccttatccttcacagaactatattgaataaatatttagtctattactcttgaagtctacactgaaaaatacttgaaacattactacttttccttatttgtttgtggcattctggccacgagtttgtataaattatgtttcagaactttgggctttgccagatgttgagtaatacgctgctaagatgtaagtacaaatggtttcactcctgactcctttgtacaagtgaaagacaacttggaattctaaacagattagaaatggaggttgccattcgtttgagctctcttagaaaagaaggctctctttgacaaatccctctgcttattagacaaagtgcaaaaagcattacatctggagttcataagccattgttttatggaattgatccatcatacaatcccttacgctcttgaaataaacccatgagaatttaagatgctatatgcacacttactaacacattcactcatacatacacacccctctatgcacacatgctaccattagagacttgtgcccttgcaaaaaaatcttatagcgtagaattgcaacatgctttttaaattgatagttatttttttttaacatcgtttatctttcaaaagacttctgaattcagctacaggaattattcttattcctcgaaacttataaccccctattctttgtactcaaaatgttttgtaatacaacattttttttccattaaaaagagcaaaagtaaagctacaattatttttgaaacacaccatccccagatacttctgaatttattttccttcctcaaatcttgaagcacgtattatttctttcacatctttagaccgttaaaactcaattgttcattctgtgagaagaaaacttaaggaaacattcagcaagtagctttatatgtgggagatggatttttagaggattttaggtgtttgagaagagtttctcatagattctgttgctttcagaattcctcaggatgccattctaaaggatgactgcaattcagatcagcgaagtgctttgatgtcttattttttcttttgcagattgtactccacatgttcagaaagcctttccctagagtataatttaatgtaattgacagtcattgttcctcgaaagtttgaattaaattaacctgagcctgaatgaaactggtaaaataaccacgtacagatttcattttattttcctttaggatcagtgacaatattatgtataaaattggcagttggctattagatcttcattgaatcaccctagatttgattaaaagtagatatttcagtgtacagtaatttaggttcatgaaaaactcttaggtttctcatttagttattgggtttattgaggaacagggtattttatgtgtgtaatgatgaattttgttctttctctttttccactgagatcaaatacagactgcaaaattgaccgagcatgaaattgtttttagaaattgtgggagctagtttcgatggcaagaatcagaggaaccgttgttagtgaaaatgtgtttggaaaggatgatggtagtgggtaggagagaatagaggtagagaggtgttaacataaggcaaaaacattaaactgacaaacacttctctgtagagtagttgatgtgttaagccagcacacttaaaagcatacaagtttttggatagaaaagtcttcattgttctgactgtttttctggacatgtagctggaaaggagactcaaatcttcatatggattttgtgtcttatggtcactgacactgcaaagcaattagccttcatgatggctgtgcttatgcaatactaattaacatgcctgttgtgctgttttccctgtttgaccatgtgacagcccacaggtctgacactctctgtgaaccaacagctgaggaaatttccaacatggcagattttttttacaaaacacacccaaacaaaaatggaatcacacttttcctgaacaactgcattaacagaatgtgttacaacggatctacaattagaggattgcattcatatgtactggggaaaaaaaaggagacgagaccctactcaagcatacggatacaaattgattatacctgggtccagaatttcaaagtgtgataacactgtattatagtatcatggagaatataatttaccagtacaatcacatctagtaaaattatcattgaaagttagaagtaaagttgtcaatatatttacggcaccatgtgagacctctatattgaagggctaatttagtaaatttgtatgtgttatgactttaagagtttgggcattggtgagttttgtttctgtgtgtttgttcctgttgtgagtgggactggaatactatgattaacaaaatcatatacaggcacttgatatgtggattgtacagtctagtgggtgaagttggttgaagtttatttataggctctacaaataaatataaaattagcactgatgtgaggggaggtgcttgatactctgagattgttaatagcagtttttagccagattgtaaattgaggtaagttcctttggaagtgacaattgagaaagacataaagtaaaattgacggttaaatgggtaagctgaggctagagcaccaaagacataaagtaaaattgacggttaaacgggtaagctgagactagatcaccccagacataaagtaaaattgacgtttaaacggggacactgaggctagatcaccccagaaattaagtaaaattgatggttaaatgggaagttgaggctagagcactaaagatataaagtaaaattgacggttcaatgggtaagctgaggctagatcaccccagacataaagtaaaattgacagttaaacgggtaagctgaggctagatcaccaaagacataaagtaaaattgacggttaaacgggtaagctgaggctagatcaccaaagacataaagtaaaattaatggttaaatgggaagttgaggctagaacactaaagacataaagtaaaattgacggttaaacgggtaagctgaggctagatcactgaagacataaagtaaaattgatggttaaatgggtaagctgaggctagatcaccaaagacataaagtaaaattgacagttaaacaggtaagctgaggctaggtcaccaaagacataaagtaaaattaatggtaaaacgggaagttgagcctagatccctaaagacataaagtaaaattgatggttaaacgggtaagctgaggctagatcaccccagacattaagtaaaattgatggttaaacgggtaaactgaggctagatccctaaagacataaagtaaaattgacgattaaatgggtaagctgaggctagatcaccaaagacataaagtaaaattgacggttaaacggataagctgaggctagatcaccaaagacataaagtaaaattgatggttaaacgggtaagctgaggctagatcacccaagacacaaagtaaaattgatggttaaacgggtaatctgaggctagatcaccccagacataaagtaaaattgatggttaaacgggaagttgaggctagaacagtaaagacataaagtaaaattgatggttaaatgggtaagctgaggctagatcaccccagacataaagtaaaattgatggttaaacgggtaagctgaggctagatcactaaagacataaagtaaaattgacggttaaacgggtaagctgaggctagatcaccccagacataaagtagaattgatgtttaaatgggtaagctgaggctagagcactaaagacataaagtaaaattgacggttaaacgggtaatctgaggctagatcaccccagacatgaagtaaaattgatggttaaacgagtaagctgaggctagatcaccccagacgtaaagtaaaattgacgggtaaacgggtaagctgaggctagatcacccaagacacaaagtaaaattgatggttaaacgggtaatctgaggctagatcaccccagacataaagtaaaattgatggttaaacgggaagttgaggctagaacagtaaagacataaagtaaaattgatggttaaatgggtaagctgaggctagatcaccccagacataaagtaaaattgatggttaaacgggtaagctgaggctagatcactaaagacataaagtaaaattgacggttaaacgggtaagctgaggctagatcaccccagacataaagtagaattgatgtttaaatgggtaagctgaggctagagcactaaagacataaagtaaaattgacggttaaacgggtaagctgaggctagatcaccccagacatgaagtaaaattgatggttaaacgagtaagctgaggctagatcaccccagacgtaaagtaaaattgacgggtaaacgggtaagctgaggctagatcaccccagacataaagtaaaactgatggttaaacgggaagttgaggctagaacagtaaagacataaagtaaaattgatggttaaatgggtaagctgaggctagagcactaaagacataaagtaaaattgacggttaaacgggtaagctgaggctagatcaccccagacataaagcaaaattgacggttaaccgggaaggctgaggctagatcaccccagacgtaaagtaaaattgacggttaaatgggtaagctgaggctacatcaccccagacataaagtaaaattgatagttaaacgggtaagctgaggctagatcaccccagacatgaagtaaaattgatggttaaacgggtaggctgaggctagatcaccccagacataaagtaaaattgatggttaaaagggtaggctgaggctagatcaccccagacataaagtaaaattgatggttaaacgggaaggtgaggctagagcagtaaagacataaagtaaaattgacggttaaatgggtaagctgaggctagatcaccccagacataaagtaaaattgatggttaaatgggtaagctgaggctagatcactaaagacataaagtaaaattgacagttaaacgggtaagctgaggctagatcacccagacataaagtaaaattgaagattaaacgggaagttgaggctagaacagtaaaggcataaagtaaaattgatggttaaacgggtaagctgaggctagatcaccccagacataaagtaaaattgatggataaacgggtaagctgaggctagatcaccccagacgtgaagtaaaattgacggctaaaagtgtaagctgagactagatcaccccagacataaagtaaaattgatggttaaacgggtaagctgaggctagatcaccccagaaataaagtaaaattgacggcttaacgggtaagctgagactagttcaccccagacataaagtaaaattgacggttaaacgggtaagctgaggctagatcaccccagacataaagtaaaattgatggttaaacgggtaagctgaggctagatcacgccagacataaagtaaaattgatggttaaacgggtaagctgaggctagatcaccccagatgtaaagcaaaattgacggccaaacgggtaagctgaggctagatcacccagacataaagtaaaattgatggttaaataggaagttgaggctggaacagtaaagacataaagtaaaattgacggttaaatgggtaagctgaggctagatcaccaaagacataaagtaaaattgacggttaaacggataagctgaggctagatcaccaaagacataaagaaaaattgatgcttaaacgggtaaactgaggctagagcactaaagacataaagtaaaattgatggttaaatgggtaagctgaggctagatcacccaagacataaagtaaaattgatggttaaatgggtaagctgaggccagatcaccccagacataaagtaaaattgatggttaaacaggaagttgaggctagaacagtaaagacataaagtaaaattgacggttaaacgggtaagctgaggctagatcaccccagacataaagtaaaattgatggttaaacgggaagttgaggctagagcactaaagacataaagtaaatttgacggttaaacaggtaagctgaggctagatcaccccagatataaagtaaaactgacggttaaacgggtaagctgaggctagatcactaaagacataaagtaaaattgacgattaaacggtaagctgaggctagatcaccaaagacataaagtaaaattgacgattaaacggtaagctgaggctagatcaccaaagacattaagtaaaattgacggttaaacgggtaagctgaggctagatcaccaaagacataaagtaaaattgatggttaaatgggtaagctgaggctagagcactaaagacataaagtaaaattggcggttaaacgggtaagctgaggctagatcaccccagacataaagtaaaattgatggttaaatgggaagttgaggctagaacagtaaagacataaagtaaaattgacggttaaacgggtaagctgaggctagatcaccccagacataaagtaaaattgacggttatacaggtaagctgaggctagatcaccaaagacataaagtaaaattgatggttaaacgggaagttgaggctagaacagtaaagacataaagtaaaattgacgattaaacgggtaagctgaggctagatcaccccagacataaagtaaaattgatggttaaacgggtaagctgaggctagatcactaaagacataaagtaaaattgacggttaaatgggtaagctgaggctagatcaccccagacataaagtagaattgatgtttaaatgggtaagctgaggctagagcactaaagacataaagtaaaattgacgggtaaacgggtaagctgaggctagatcaccccagacacaaagtaaaattgacggttaaacgggtaagctgaggctagatcacccagacataaagtaaaattgatggttaaatgggaagttgaggctagaacagtaaagacataaagtaaaattgatggttaaacgggtaagctgaggctagatcaccccagacataaagtaaaattgatggttaaacgggaagttgaggctagaacagtaaagacataaagtagaattgatggttaaacgggtaggctgaggctagatcaccccagatgtaaagtaaaattgacggctaaacgagtaagctgcagctagatcaccccagacataaagtaaaattgatggttaaacgggtaagctgaggctagatcaccccagacataaagtaaaattgacggttaaacgggtacactgaggctagatcacccagacataaagtaaaattgaagattaaatgggaagttgaggctagaacagtaaagacataaagtaaaattgatggttaaacgggtaagctgaggctagatcaccccagacataaagtaaaattgatggttaaacgggtaagctgaggctagatcaccccagatgtgaagtaaaattgacggctaaaagggtaagctgagactagatcaccccggacataaagtaaaattgatggttaaacgggaagttgaggctagagcactaaagacataaagtaaaattgacggttaaacgggtaagctgaggctagatcaccaaagacataaagtaaaattgatggttaaacgggtaagctgaggctaggtcaccaaagacataaagtaaaattaatggtaaaacgggaagttgagcctagatccctaaagacataaagtaaaattgacgggtaaacgggtaagctgaggctagatcaccccagacattaagtaaaattgatggttaaacgggtaaactgaggctagatccctaaagacataaagtaaaattgacggttaaacaggtaagctgaggctagatcatcaaagacataaagtaaaattgacggttaaacgggtaagctgaggctagatcaccccagacataaagtaaaattgatggttaaacgggtaagctgaggctagatcaccaaagacatgaagtaaaattgatggttaaacgggtaagctgaggctagatcaccccagacacaaagtaaaattgacggttaaacgggtaagctgaggctagatcaccccagacataaagtaaaattaatggttaaacgggaagttgaggctagaacagtaaagacataaagtaaaattgacagttaaacaggtaagctgaggctagatcaccccagacataaagtaaaattgatggttaaacgagtaagctgaggctagatcaccaaagacataaagtaaaattgacggttaaacggataagctgaggctagatcaccaaagacttaaagaaaaattgatgcttaaacgggtaaactgaggctagagcactaaagacataaagtaaatttgacggttaaaaaggtaagctgaggctaggtcaccccagatataaagtaaaattgacggttaaacgggtaagctgaggctagatcactaaagacataaagtaaaattgacgattaaacggtaagctgaggctagatcaccaaagacataaagtaaaattgacgattaaacggtaagctgaggctagatcaccaaagacattaagtaaaattgacggctaaacgggtaagctgaggctagatcaccaaagacataaagtaaaattgatggttaaatgggtaagctgaggctagagcactaaagacataaagtaaaattgatggttaaatgggaagttgaggctagaacagtaaagacataaagtaaaattgacggttaaatgggtaagctgaggctagatcaccccagacataaagtaaattgacggttaaatgggtaagctgaggctagatcaccaaagtcataaagtaaaattgactgttaaacgggtaagctgaggctagatcaccccacacataaagtaaaattgacggttaaacgggtaagctgaggctagatcaccccagacataaagtaaaattgatggttaaacgggaagttgaggctagatcactaaagacataaagtgaaattgacggttaaacgggtaagctgaggctagatcaccccagacataaagtaaaattgatgtttaaatgggtaagctgaggctagagcactaaagacataaagtaaaattgacgggtaaacgggtaagctgaggctagatcaccccagacacaaagtaaaattgacggttaaacgggtaagctgaggctagatcacccaggcataaagtaaaattgatggttaaacgggtaagctgaggctagatcactccaggcataaagtaaaattgatggttaaacgggaagttgaggctagaacagtaaagacataaagtagaattgatggttaaacgggtaagctgaggctagatcaccccagatatgaagtaaaattgatggttaaacgggtaggctgagtctagatcaccccagatgtaaagtaaaattgacggctaaacgagtaagctgaggctagatcaccccagacataaagtaaaattgatggttaaacgggaagttgaggctagaacagtaaagacataaagtagaattgatggttaaacgggtaagctgaggctagatcaccccagacataaagtaaaattgatggttaaacgggcaagctgaggctagatcaccccagacataaagtaaaattgacggttaaacgggtacactgaggctagatcaccaaagacataaagtaaaattgacggctaaaccgtcaaactgaggctagggcacgaagtcacacactgctgcacattggacttgcctcagatgttggttttttgtttgtcttgttttcttttgttttgcttctgttctctttttttcctaaattactgatacccgagtcccatgtctagagtctaatttaattgttcagtgtattccctggacattgagacctttagagtatccccaggtgattgtgatgcatagcaatgtttgagaacaattgctcagaatattctaggccgatggaaaaggccttgtggtaagatgaatcatggcaaaatcttaagaaggctgaaaggttacttgctgctcctgcaggacaaaagaggagggacctgggagagaggcgtgtgcaacatgagactgaatagctggccaagaagaagcttctaggccattataccggtttggtgctttgctgattagcagcaagaagccattcaagtctttcagtggacatgtctttccaccacctcgtgtgaaaaatatggaagtgttgactgcttttctcgcatactttgacttattcgtctgtatgtacctttaaatggacaggattttttgaaattaagttgttcatggagaaactaaaaattttttttttttagtctggagttatcacaaagttggaaaatgtattttaaaaatctacgatggtccatagtcattagatcagtcttcaattctgggtcttccagccaccacaggtggatctgagatgagttgtactgcagtgggctttcaacttgggctacatgtgacagtgacctagggacatttttacaactactgatgttcaggctcaagttagtcaatttacgagtgatagttaagcataatttttgaggttccttaggtggttctaacatttagccagagttaataacaactcacctgctggataaatctttttggatttaattaaatttgggcatattgatcttagacatgaactagagtctcttgatttttgaaaacgaggggaagttaaaatgaacaccttgaggtatttgcttaagtgcactcccttcacagaatagagatgagtcctttacaggcagatctggttaaaggaaactccctccggaatgctgggtgatggacgaaatgagggaaaccttgcctcctctggaagcttgccattggctacatcagattttacatgttgcgttttcaaaagtcagtctctcggatctaactttaaagatatgtacttctaacagttggttctgattatttccccacagttgtgtcaagtccacacagttgtatcaatgcttctgcttttctagacgctagttaacactcagaggttttacatttaacggaagaagaaattgacaaacaaaggaagtaaaggaagtttatgtggaatagaaagggaaggaaacagaccttgaacatgtgtagaaaggaggaaacagactttgtccgggatagaaggcccattgacatgaggaggcatgctaacagaggtcagaaagagtagaaagagtcgttggacatgggccaagaaggttcaacaccaggtagcagctgaatgagtccatcagtggatgggctacctaagcgggtagggcattgtgcttgtgggttattctgcaaatcctcctcagccaacaatgagtgtcattggatccatcaaaggattcagtgaaaatgaagcttttttgggtgaagaattccaaggaaattctgaaggttgtgacttagatgaagaaaaattctcagcatgaattgaataatattcacacgaagtctgaaagttaaaacttagaataagtactgaaaccacaccaactaacaccaggaaacgcagagggccatttactaataactcttaggagttcaagcatggaaaatgattttctaaaggtcaaacttagaagattatgcctttcacctccatgaagtttcatagctggaaaggaactccaatcccaacccctcatttaacaaatgagaaaattgaagtgaaatgatttgccaaactaaggaattcttgagagcaatgcctagagtccagactctctcactcatgagtcttttgtattcttagtctgtcatgctgccttcagaccagggcaaaatatgagactgaactgaagtgggagaaggtttacttcagtcatgggaaaccaccattaagggttatttgttgctgggaaagtacactgttgtaatagctgcactgtaacaatcacagctgactaacagcaagttatcctcagcagagccgtgaacagaaaactttggttgggcttcaggagatgagtttaaattattctctgttacagacaaatttgttattcattccttcattcatctgtgcctcctgtgtgcatgggagtgtgcttggcactgtagaatagataaagcaatagaccctgccctgaaagttcttatagtcagtatggaagataagatatacgtgtacagaattataataaaacactgactgacaaaagtgtcgtgagatctggaacaaatcagtagccaggacatttcagaagatagaggggctatttttatcttctagggcaaacagaattgccagagtcaagattatttcatgaaaaaggtagaatttaaattagacattgaatgataagtaagatgtgcatgatgaggaacaggaagaaagcattttagaaagagggaaaaagagaagcatgaatgaaaaaaattagtgctttttaacaggatgtgaaacattttttaaaatataagttgagatggcaagttggaattagattctaaaatattagtctacatatgtttaaactgacatttaaattgaggacagaagaatggaatagataggtgtggtatcaggatgtgttttggtaaaagcaacttaagagagagcgaagactagtctggagataagaaggactgaaagcctagagatatattagtttgttctcacgctgctatgaagaaatacctgagactgggtaacttataaaggaaagaggtttaattgactcacagttgaacggggctggagaggcttcaggaaacttacaatcgtgatggaaggagaagcaaacacgtccttcttcacgtggcagcaggaaggaaaagtgctgagcaaaggggaaaaagccccttataaaaccatcagattccctgagaactcactcactatcatgagaacagcataggagtaactgcccccatgattccattacctcccactggttctcttccatgatacgtggggattatgggaactataattcaacatgagatttgggtgggggacacatcaggagacttcttagattatgattgcaaaatctcaggtcagactaattgaaaataggaatcagaggaacaacgataataatacagattacaacagagagggacgatagagtggtgagtggcaggcaatgtctgccaactggataaaagtaagagaatggaaatggagaccccaagttggtttcaaagattctaagcctgggtaacaggagggaagacagagtcatgaaaatcaatatgggattcaaatgtttccgtgtcactcatcatattctcatagtttggaaaaaaatacctcactctttctcccaaaaatatttaaatctgccatacatattatatattgtatatgtacaacaggtccataaatgcaaattttgtaactttaatcacttttgcaggttagcatagatttacagcaaaagggaaattgacatagaattaaataaattgtgcagtagggaaatgaatttttttttttttttttttactgctctttctcaaactctagactctgcctagagttttaccatttgctatgctgcctcacatattccaaaaattattctaagaaagagttatttggagagttgatttagtttatagagcagctactcagaattgaaaataatcaatagtaccttaagattcaggctctaactggatatttaggcaagaacccaaacagacagttactcctataacgacattgagtaaaatgtagagagcatgaatgtagcagcccaacccatctgttctttttttctaattttgaagaggttatttttatatcagtctttggaatttttagttctgtctctgctatgctacataaatactgatgctaacagactaaatttaaaaaaaaaataaattgttgataagaggaagaggaaattgcgagatataaacctagccattttcccatttaggtggtatttccttactttttaaataaactctatgacttttactttctcactatctcctctctgcatcagttttcttattaaagtctcaacatttctgataatgaatgtctctagaatttctttacaggagacatttaggggcagctacctaaaacaggagagttggggggcttattttaaacctaaactgaaataatagactatttatttatttatttatttatttatttatttatttatttatttggcagagtctcactctgtcacccaggctggagtgcagtggcatgatcttggccactaacatccacctcttgggttcaagcaattctcctgcctcagcctcccgagtagctgggattacaggcatacaccactatgtccagctaacttttgtatttttagtagagacagggtttcaccatgttggccaggctggtctcgaactcccgacctcagttgatccacccaccttggtctctcgaagtgctgggattacaggcatgaaccactgtgtccggcctaatagacatatttttaaattgaaaatatatattactgattttaaaaaataaagatttctaagatgattttattcaggctttacataagatttttaaagagtccaatttcctaatattattactaatattattatcagaataattattctgggggagactggtgttaaaacagttcccaccatagctgataatataataaattgcattggctaagtgtaatttatgaaacaatgtacagtggaggctcctaactacttatatgaagactccaatcacttctgaaattgcatatgcatgtattacaccaaaattatagaataatataaatatacagcagtctatatatttattcaattatcaattcattcacttatcaaatatttaaaatgttcctatcatacatataggtgtggatatctaaattcgcacatgagcaaagcaaaattaaatggcctatgccattcatctgaaaagttaggcataaacactccactgaaaaatccctttttctaagccctctttgttctcatcatagttaaaatgataccttctttttactttagaaactaacgttcaaatattgtaactcttttactaaattcacggtgtagtggttaaatgtatcactctggggttaagctccccaattttgttacatacttgctgtgtgtcctcagagaaattacttgaccttgctgagcttcaatttcctttttttttttcttttttaagttatttctttcttttttaagaaacagggtcttactctgtcacccagagtggagtgcagtggcacagtcatggctcactgcagccttgacctcctgggctcaagcaatcctcctgcctcagcctcccaagtagctgggactactggtgtgcatcaccacacctgactaactaaagaactttttttttccatagaaactaagtaaagacatttttttttttccatagaaatagcatctagccatgttgcccaggctggtctcaaactactggccttaaatgatcctcctgccttggcctcccaaagtgctgggattacaggtttgagccaccaaacctgacctgagtctgttttctcaataataaaaaaaaagatattaatcgtacctatctcatagggtggttgtaaagattgaactaatgaatacatataaactacttagaacagtgtcttgtttgtggtgcgcccttaatgcaagtttagtattcttctgactgaagccttatttgtcttcattaggtcttccacaggcttactttccttgtctcccataatcacccctaaacaattatgggccatactagctcagcaaataagatcattaaaccaataattgtacctgtgtgtatttctgtataattaatatgcgttcttggctagaaattcttaaaggttatactgatgtggacaccaaatctaagtgataatgccaaatttccagatttcttatttaacatgttccagctcactcgattattataagaggttttaaagtcaactgtaatttcaggtatctattggaaaatacaataaatatcctctaaatgataaaaagatagaataatgcattaatatagctgaaatatagacttggaaggcaacaacagcagctggctatgacctttttattgagaaagtgacccagaaaatggccgaggaaatttcatcatttatttcccacttctgaaccaaagtctcagatgcctttaaatccccataggataaagttggctttaggttgtatataaaatacaaattgagtaagggaatattttttctttactgctcagatgttttatcagctttgaatagaaaaacacactaatatttatttccttaatatgtgcacatcagctttaattataatcaatccttccatagacggatttcatgggatttaatgtgctaccaaatgcaaagatagaacttgctaattctctacaattacacatttatttctgggcatgtgggtataaccgcacctccatgccatgttctttctatattgctacaaagcactatggattaaattgtaggtatggagtaccatattaatttggaagtttgaatgtctagaatattttatatttaagtacagatcacacagagtggacactccctagttaagttgttgaatggttgaaacaggtcaagataaatgaagccgtacgataaactatggaagacaaaaataacctgtctgtaaatttgattttggggctaaggtaggtttcttttgatatcacatttattcctgtgtgaaatataagtattctgtgttcataacagagtgaaaatgtatacatttattcaaatgactaatattaagagcatctactgtgtggacttatgaaataatatatatttattgcattcacaatgcttatatttgagtagagaataaagacaaggcaattaaaatataggggtatcttataactgagtttgtacactttgaccatattttgtacataatgggtggtggtggttgtgttaattaatccaattgtattcatcattacacaatgtgtgtgtatatatatacataaaaataaaatcatcatgttgtacatcttgaatatattcaatctttatttgacaatgaaatattttatatacatatatatacatatatatatgcaagtgctagggataagcagaaatgtatctggggacatggaaggtggctctgtaggattactaaacattttgagaaaaatcacatttcaacttcacctttgtaagaggttgtgctgggcttcctttccaaatgaaatgcggtgtgacagaaaatagactcatgtagctctctttagtgggatagctttctttctcaacatcaactaacacatctcctaggtgtccttaaagtttcaacctataaatattctacctcattaagcataaggaccagccatggacatatgccgctagtgtccactttccttcagagatttagggtgatgagaagataaagggtctgcttaccagatggagcttgtcagattagcaattggagcagagtaaatatcgctgtcatattgttgttttgaagcacaaagaaccccttttgtataacgcatgtgcatatttaatagtttaaaacaaaaaaagctcagcagaaggttggctggtcgttgtacctctagcagagtggccattgcctgaaggcacggtgctgttttcctcataatagggaacattagcaaccagtggcttgagaaaggcagagtcaaatatgtctcttggggcccagtcggccacatgaagtgagagccgttagacgcagcaatgagattactgctccagaaagggtttgccacatatattactgcagaggcttttcagggctgccagcgcactcaacttacaaatgtcaaacatgatttaaaaggttattatactatcaagagggaaggagaatgattttccatcactgaaatttctatttcattctgtggcacataccgcatctcacgaaggccaatattgctaaataacctgcttttatctttaataagtgttttatggaccttaaattggaagaaccatttccactttatttgtattagaaaatttgatcttttctggttgaataacagcatgagagatacagtgtgtgtatctgtgtattgtgcttagcagattgttctttgaggggagtaaatttgtctgtgacgtgtcagttagggagagcgtacatacgtaagctgtagttttgataaatgcatttgtaagtctgcagtattttaagctaaaaatgaccaggtgcagttctctgtactgcattacttatttctctttgggctttattgtgactggtatttaaaacaacctgctttcaacctctctgacccctttgggaatatttatttgctcaataaggactctatttgttggcctcaatgagttaatttaagtacaattgtatttgaaaagttgctcaataaaagcagaagacgatttttcttttattttagggagattttcactcttgttttgtaacatttgaaaaataaataatcttcaagtgtggctgttaaaatgtgcaataaacaccttattgtcaatgtggaatttttaaacattgcctttgcagtcataaaagaggccaaaacaagggatttcaactgcccttttggtagcattcttcactctatttcctagcaaatcactgatggctttttctgagggtgagactgtaaaactgaaggttgcctacatttccaggtcccagaatgtgccatgcacagcaatacatcagcaatctaagctgacacatttgaggatggtgttctcaggtgggatgtaaaaaggacagaaggatacagtctatggtgttgagatattgtctgttccccctttatctgagactctgaagcattaaattaaaatctgtgaattcgcccatgttcacatgggcattgtcaaaattaaattaaagcttatggaaggaaaccttctcagcctgaagagtagcacctttcctccaagttctgcaccgattttgtcatttgccaaagtgcaagtcacaacaaaaggaaaagaaaacaaaccaaaaaaatctttgaattttgaaaaataatcagacttctttcatgggacaatagcactaaaaatttaaatttattcgacgttctccagatggagtatgaaattagctttctaacatttgaacaagagtgaacctgaatatctacataaggattaatatgtatgtctgtctgtgcccttttattcttttgaagactttctgtaatatatactgatttcaggtagcttctttattgttatataaacaaaaataacaaatctagagacacaaaaatatttccagtttaggaaataattagaacattctatttttcccccttcttttaaaaagtaacaatagaaagaaaaatcacttaaatattgaatgataataaatatgttttatcttagttttgaaatttgatgaaatagtaaattcattataataatgtattcatatattcagtaaccaatgacatatttatgtaagtcttgaatgttttaataatcctatttaaaaattttgaaacattattttttctaattggattaaaaactcccttttacaaatctctcacatggtttcttgtaattgaaaactcttatagtacatatgaaatacaattctattaataaaatatgcattcatatacacctttttaaagcattcaattatttgggcaaagcaacgcaaatgtataaactcaaagatataaactatgatggttaatttgatgaaatatatctcacattaaactgtaaaatgaaacaaaagtgtttcttctatagtaaaatcttagcttctcttaaaataaacacacatttttaaaaatcctgtgtgaccctgtcttaaagaggtaagttcactaatagaccagtgaactattttctagaaaccaaattcaattttgaattaaaatcatggtctaaaaagatggagacatataccacatagcataagtttctaaaacttatgtcagtccatatatgggagaaagttatctttctactatgattctacaataaaaatattcatttatatctcacaacttagtaaataaatcagaggaatgtttaatcttagaatggctgcagtgaactggacaatcattcaccccaacatttttttctagaattcttaaattgaaaattaaatgtcatgctaatagtgtttcgcttcctttagaaacaaaatcattgtttacaaaaggcactctctttgcatctgacaatacgcaatttcatttttcattctagttatccttaaaaaatttaataatgcattcttgccacctctttcccaatgccaaaatagataccttgtcaccttaaaatatttcacagaacaattacagcctttaacatgcagaacatagctgtctgagaaatagggcactttctggtgcttgtgatatataaacttcattggataagaaatcaagtgcctcctacatgcatcctggcctcgttaatttatgttgatggctggtatgaaaaagatagggaggtggcaaactggtgagttgtctctgaccaaaaagaattatttattttgttggaacaatgtaacctaacactaatattactttttatttaatattggaaaattatacattagataatgttttctagaaattaagctagctattttaaagtagagtttaccatcttggctaagggattgcaaacataaaagcatacaggggtgaagtgaatcaagtcaaagtgaatggctgcagtgaactggacaatctaagctatcaccaaggacatgtttctttcaacagtctactgacagccttccccagggctcccattgctggcttcttcacgaaggcctgccattctttatactacttatcaggctttttgaaaaagcaggggtgggggcaaggtgcggtagctcacacctgtaatcccagcactttgggaggctgaggctggtggatcaattgaggtcaggagttcaataccagcctggccaacatagcaaaacaccatctctactgaaaatagaaaaattagctgagcatggtggcgggcgcctgtaatcccagctactcgggaggctaaggcgggagaatcacttgaacccctgaggtggtggttgcagtgagctaagatcacaccagctactcaggaggccaaggcaggagaatcgctggaacccataaagcggtggttgcagtgggctgagatcgcaccactgcactccagcctgagcaacagaatgaaacttgtctcaaaaaaagaaaaaaaaagtaggagtagggatgtttttgtcaaatctaggaaatgtgaaatttcttctagaaaccacctgaattatattaaaaatattgacaatatatgagtttttaccttgatgaaaggagatatttctttttttttttttttactaaattgcttttatacaaagtctacaaattaaatctgcatataaggagagttaaatttaaatattaattttaagatttttggaaaatgcggcaatcgttcttttcatgtgagagataacaagtctaagccagatatttagtcatgttctatgtaggcaggaagatctcatctggattccctggccttcttggcattctgactcacaatgtcttcatcagttttctagtgatagatgaataaaagcataataaaagataaaccaagggcatcgtcaggtgttcaggggagcctaggcattagtctaggtgggagaaagaacctagacttcctaagtggcctgggactcccaacgttgtgtcagtgacgctggatatatccaaatagactgataggagagccctggcaggagaaacagaggagcatggatgctggatactagacatcaatactaaaatatatgttgaaaaatttaaatagtaccagttctgaacattcttgtggtttcataactttatagagctatgatatatactaaagataatcgccacttatcatcttcagtgaaacgagtggggccagggattttcatagctttccaaaatctaaaatgcctctattgtgcacagaatttgtaggttacttggacatactgtatttctctcagattctaactaattcttagagaattgtatttctctcagattctaacttgtacttagagaagttaaataactgactatatagatacatgtatagaaaatggttgatctgggatttaatccaaggtcaagattaagacttaaccaagattcagtcttgatccaaaacttttagtccaatattttctcgaccataaatcaagaggttaaatgaacattggattctaattctgactctactaatgatgggcataggtacccatattatagggctgagattcggctatttattgtttttttttttttttgctttattttgttttgttttaatcccaagtaatttcaatttatagctaggattgagaaccactggcttaaaatctaagaaaacttaatttattttccttttcctttactttcatatatattctaataaatgccagttgttactaagctttacatatatatactcacaatacataaatacgtaaatacataattcacagaaataagtttatgtgcttaattatccatctcaaaagcagatttagaggatttaggagaaatgcagcatgtgataccaattacaagaagaaatgggaaatattcttttgtagttggttgttcctaaattctggtgttttcatctggagggactgaagagaacttctatccattgattatctatgatgtgccttcatgcttatggagagatttattcattcagattctcctggaagaagccactgtgtgataatgaaagtctcataattagggttgccaagtttagtacataaaaatacttgtattaaatgtgtttatctggtaacactactactaagagcttggctctcaaattcatctctggtccaggtttttagctctcttcccagatgagtcatggcaactgccctgtctgcaaaggcaaaacatcatccttctcttctttagagacactgacctagctgaaatgtttctctggacaatccaagaggaatcaaacatttacatcagcaagaaccacatttgtgtctgtgatactgttgaagggtccatagagagataactgatttttaaagcagtggtacttgtaaaacagcaacagtaaggcttaaaataaattaatgccaaaagtgatttccttcattccttaatgtaaaatcttcctgcatgtaattcatagtaactgaaaatggaaagtaagtggtagttagacagtagctcttttttccattaaaaaagtttaaaagcttcaagtttgttttctatgtacggtctaacatggccatgcagatattcttcattcaaagttagatcccctcctagggtttcagtgactgaaagaggaaaatttcctcttattttacgtttcctttaatggatcacgtatcaaattttatgtacacataaactcaaattaagagcccgtttattgcgaaattgtccttaaaaagctaaatctaacattggtaaaatttagtccctatttgtagcctgatggtatctaaaaaaaagttttgggtaaaagtaaatctctacaccttcaaattgaatgttgcagccaattgagaacctatgagaaattaaattgagaaagatgtttttgaagacccatttcgggagaaatgaattcctgtgtcttgagaactctaaagcagataagaaagcaaggcaatggatctaattctgtttggagcataaaattcctgaaattgaggatatataagaaaagattgatcttgtgtctatttgtcttgaagttcagttcaaatctggttctggagaaaaagaaagatattaatttccagacagagcaattgtgtctttcagaaaaattgtgcatttcttcccaattgagatgtctcaaaattaaatggtatggtgcaaagcttcattatcttgtttctcttaagattcaagccttttttttcagaacagttatccaatatcctaatagatgaaacataatttagaacaaccctgtattataagacccagatttaccaatacaatatctatttaaatatagaattactatttaatatagaattcagtgtggatagtagttttgagctttaagtgaaaaaaaaaaaataaaagaacagaaactccataatggattaggtctaatacagccttttggtcatgagtgaagaggctaatgtaatatgagcactcatgagtaatcagatgtcttctgatgagtgaattgaaatgtcatagcagaagtaatccactatacattttattatgaatttttgtgggtaggtttaaatttattttctggctcatttaatttatttaatcaaaacaaaatctaagatgcatggaaaaatcaattttggtaataagagatttaccccaatatatttattcatttctaatgttttctttttctcattagttgactgggttataatttttgcttgtcattctttatagctttgtttctggtttttgctaaaggccacaaaactacatacatcaggtatttccaataatattgtactattgtatgtgcaccggaaatatcccggtgctttcggtagctccaatcaaatatgtcttatacatgatttgtcagattccacagataaactgtatatttgcaaaactggattttagaagatttagtcaattagaaatatatgtggctatgtaattggcttctattgttttgctcttaactcatctaagatctaatgctaagttcatcatatcatcatgatctttggtgagaatgtaattgctgaaaatgttttgaaaccactgggtcagtgattaagaacgaaagggattcagcgttaaatcaaagttcccatacgacagtcatcttgattcacaggaaatggggattgaactgggttcacttgaaaagtactgaacctcttaacttctcagggttcttgttgtatgttagtaggatatgctttaatgtggatcactaatctctttttcataatcatttgtttctaataaacaactgtctcattctttcgtcttttcatacatcactcaaaacaaatgactcagggccgggcgcagtgggtcacgcctgtaatcccaacactttgagaggccgaggtgggcagatcacttgaggtcaggagttggagactagacagaccaacaagatgaaaccccgtctctactaaaaatataaagatagctggatgtgacggtgcatacctgtaatcccagctactggggaggctgaggcaggagaactgcttgaacctgggaggcggaggttgcagtgagctgagatcaccccattgcactccagcctcggcgacacagcgagattacatctcaaaaaagaaaaaaaaatgattcagaaaattttaaaattttttaagtttttatccttcttgagcatatatatgtgacagccaggggaattccagatgtttttcagcttatttttatgtctgacaccagatactacataaataaaaacagttagaagttttgtttattgagtatttttgtgattacatatctagacaactttcaaaacaaccagtcagtggtttcaagtatgctttcatctccatcttgtatcatatcattcatatattgttggcaaatgatgagttttacctgtattatttggaagcattttatgaagccagttttagaagttcatttaaagaaacagaaaagctcatatgcctgtctctaaccaaggacacaagagcaagtgaatgagggtgttttaatttttattttttgtcttacttttcaattcacacataaaccaatatggaagtagtactatctaatgtggaagatagaaacctatatatttttaaatatttttgagtgagtgtgactagacaagtcagatagtttatcattttcattcttaggccataaagatccctctggcaaactgaagagtttaatgactacatattttcttaaactttaactgtcttgagtgaagggtacacatagtttgcactattggtgagtgaaaatgtctaccttaagcaaagagaaaacagtcctcctctgccatgagagtgaatagagacatacatgtcagaattcaatatggcagctactcatggaaattattcagcacacacattttaaaaactcagaaatcttaattatcaccaaatctaaaaaatctgtgtcctttatttaccttttctgttggcttttagactcatgcttaatttcatagctgacagtgcaaagcttatcttcatttcttaaaatttctaattggaacccagcagttgcatccataaaagaaaatatttcttatgtggaaatggtgtagcctactccactttccatcagataaagattaggttaaacattaaaggaacaagataaagcataggtgtgcatttgctatttcaagtaccaatttctattttatcactcaggatgggttagagattctgtgttaataaacagtcccaaaagttcagtggtttttccatttaattttttaattgatacataacaattgtacatatttgtgaggtatataatgatgttttgatacatataatatgcagtaatcatatcagggtaattagcatatctatcatttcaaacattaatcatttctttgtgttgggaatattccgtatggtccttctaactatctgaaattatatattatattattgttaactatagtcatcttgtagtggtatagaatactagaacttattcctcatgtctagctgtaattctgtattctttcacaaatctcttcctatccctgctttccccaaccattcccagtctctagatcagtattttttttgttttgctttgttttgtgttttttggtttgtttgtttttaagatggagtttcgctcttgttgcccaggctggagtgcatggcgtgatctcggctcactgcaacctccgcctcttcgtttcaagcaattctcctacctcaacctcccgagtagttaggattacaggcatgcgccaccacgcccagctaattttgtatttttagtagagatggggtttctccacattgatcacgctggtctcgaactcccgacctcaggtgatctgcctacctcggcctcccaaagtgctgggattacaggtgtgagccaccgcccctggccaggatcagtgtttttaaaagcaatttatttttaaaaaaggtctaaggtctaccagtccttgggctacatgcctatttcatgttggctggggccttgctctggcataagtattgactttccttcagtatccagggtgaaggaatgttgacactctggtgatagtggctgagggaaaggagagttctggaagcttttgtatcaacataaatccctcagcccgtagtaatgcatgccatattctgttacaactcataggccacaacaagtcacatgccacacataaccacaaagaagtcagaaggcaatctagctatgtttctggaaggaggggaccaccacaaacattcggcaagcaccaataatgattatccatatactacctgcaaatctaaaaccccaatttaggttccattgctaccaatcttacttagtctacatgctgacttaactccatattttaagtattgactttttaaagaattgcatccagcatttggccttattctttaagcagagttatcttttatgtgttattgatgtgtttttcttttaaggtgttttgtcttaagtcaaaacaaactctagtgaatatgtcattagttactaagcctaataattataacattgattcaacaggattaaaatttatgcatgagattctgctatcaggtttttcagggagatgttctgtgactccaagacttacagtttctgtgttttgcatgtcattttacaaatataccagagaatagactgtgagtcatagaattctaacatcatagggttgacagggaagtgttaaaaaatatatcatctatttcttatattttgacaagattgtacacaaggcattatatatcaagccattgaggatgggagggcagacagagaaaattatttcccaaaattgtttcattcaattcatcatagagcaaggttgtcccatataactgctgtagggaatgtgggtagggtttgtcttgtgaaaaataaacttatttttggccttctttttgcttaaatttcagtagcatgttttctctttacaacaattttcaaatgaatctacttggaagtttcgtatttatctcattagcaaaattagtattgtgtaagttcataaatattctgaataataataaaaatgaaaataaaacaatgtggtatagggagaagaaagctggatcacattactgtgatccctgaagtgccttaatgtcttcaaagcctcagtttccttctccgtacaatggaggaaacaaaataaaccttttgcaaattaataatatgaacttggaactacacaaaggtcttatttgcagaacagtcttagaataactacataaatagaagcatggtaagtgtaactgtacataaacaagcacacaattttaaatggaaattaaattttattattcagaccacattgattttatctgatcaatctactctcacatatttgagttacaaggtctgagggtgaatggtattgtgtgatgaattccaacaagtctgggctttacttaatcaaattttacagcattggaccaaacagtaaatgctggtgaagttgattcctttgtctctccttaactttgagacacttaatcaaataaaatcataaaatttaaaagctagaagtgactttgaattcatatcctctaatcctttcactcacattttttaaaactgggctgttatcagttaggaattttattcaactgctagtgaaagatttttgaaagttaatgctgtatacaaattataaatatatacctccaatgtttttgcaagtttcttggccttccctacgtaattggctacatggatggcaaggtttgcacagcgtcttatttttagaataataagagtgacattcaacaaagaaagctgatttaaaaaagaaagaaaagaatgataaaaggcaaaagggtaagtggctgataagtttgtctcgtcttaaaaagagccagggttttttgcttgtaacttattgcccagcattttttttttgaggtttcaatattttattcaagtttctgtaagtgatgttaattacagcatttgaaggggaggatataattccacacaaaatggaagactttaaaatgtacccattaaactgctaaaaaacaaattgagtgatgagaatacaaaagaagtccaatttagattctgagtgttgtcaccatgtgattacaatcacgcagactcttccaagcttatagctggagctcctggaagctatttcttactctggtgcaaggacaaaaaaacacaatacaggaaggaataagtcctgaattattggcttcatcacatccaccttctccaccccaaaatggcacggaagaaacagtgaccacaccctgcagaccatttggtgtaaaagaggtgacgacgatgaactgcggtgggaacaggtcatgaagatctgtataaaaaagtctcattcagatgagtttgtaacactgtcaagcagtgagcctctcatcagttagggttaggaaaccaaggttcgattctcaggaaatcacagtttcattaatttactcaatatgaatttacaaagtgcctacatattaccagctaccacttgaaggcatttctagataaaaaagaaacttggcatctcacaggggctaccgagttccccccaagtctactactgaaaggatcttttttggaaatgggtttcttctgtacctctgaaagggtaacatcttaaagcagaatcatctttaaccttgaggtctaacatatttagcaatacttgcatcccagtcatacaatattaaaaggtacactaaattctgaaggtagctatgctgcaaaatagtttaaattaaacaattgtatggtattcattcatgcttgaaatttcagtcctagaccaagcttgtggccaccagccttgacgttcttgccatccaggagagctgacagtgtcagtttgatacctggctgcagggtctgagtgtatcctaaacctatcaggctggagttgttcactttagtggagaagcaggcatgagggtcagtctgatacttggctgctgttccgaagcgcgtgttactgtttcctgctgtccagacgagattgacagcggtctccaacttcttgttcaccttctggtaaatggagccgccaaactctgtcccgtcattcacagtagtgtgaagctggaattcatcagtcctgtagccaactgcaaagttgctctgggtcactcaggaaggactttgcagtctcaaaacgcatctggtacccagccagccagccctgtaacccggcactagagcaccccggatggaaggcccagcagtgtggaaatccacgtcacagcccaggttaatgtgctcccacttgcaccctgtcttgattttagcattttttttttcccagtgttaggtgacgaggatgaatgcaaggtcagcctcaggccacgtgcaagctgaccgtccacgctcatctcggtgcctagtgtattgtcggggttccatttctccgtagacctcgagccatagtcagtccatcggtacctggtttccagactgcccgtcactttggtggtctcagtgttggctgagcctgagcttgtaaactccgatccatcctcagatttcgttttcaaatcaagctttattaagccaatccatagcccttggtgaagacatccctagcagatttgccaagatcggcatacgtgggtggcacagccgtcttctgctcaaaggtggcggcgggctctgcgggggctgctggttgctgctggggggctgctgggggggctgctggggggctactagggggctgctaggggtgctgctggggggctgctaggggggctgctgggggggctgctggggggctgctggggggctgctaggggcgctgctggggggctgctaggggggctgctgggggggctgctggggggctgctggggggctgctagggggctgctggggggctgctgggggggctgctggggggctgctggggggctgctaggggcgctgctggggggctgctaggggggctgcggcgccaaggcagggagttgcccaacattttaatataaggctccacattgcgaagaaggtggggtgatttattttattttatgttatttatttattttattttatttcattttattttaattttattatttttttgagacagggtcttgctctgtcgcccaggctggagtatagtggcatagtctcggctcactgcaacctccgcctcccgagttcaagcgattatcgtgtctcagtctcctgagtagctagaatcacaggcacctgctatttttgtatttttagtagagatggggtttcgccatgttggcccggctggtcttgaactgctgacctcgggcgatccgcccacctcagtctcccaaagtactgggattacaggcgtgagccaccacgcccagctagtaatgtagttttatgactgatcaccttatgtactcttccaattctcaacttctattaataaaaaataaaagaatatagataatgcattagaaacatctgctgcagggaactgttttaccattacagataacgttatgaatacaagtatttctgttatttatatttgccattatgtctgttctggaatattatcaaaccagaattataactagcaagagactatataaattaaaatcacacattttaaagtaaaactgaagttggttcaaactaggactccaccacttgagcaaactacttagcacaaattacttaaacctcgatgttctcatctataaaataaggggtttacaaggtcaactactaaattagataatacatgtaaagtgaaatgcctaaatacaatgcctaggatacagtaattgccctgtaagttgtaagtgctaccatgaaccagccaatgatctctactacatactatgattgagaaattaaagatggttgaaattttatataaatcgatgtcaaggtaatattatttatgaagttattgtacttcaggtcatcatgattgctttagtgcatttgagactcttttcttagatgacaatggttctaatccatcttctatcaaagtctctatttctccatttaaatctggcagatccgtcttctagagacatgaccaagtcaatgattttgattagtctgtgctccttacccaatattacaatacctggaaagtaattatgtttctatttttcattttaatctgctcttaccatattgacaatatgggcaatggctaagtccattatgagtttaattgctttatgtgccaggtgttcggaagttcattctttgaatctaatgaaagtaaaagataaagtcacagaactctggttcattttatgcatacattattctaactttggataaagaattaatcattcttttacatcctgtattgtttaatgtctcccttgcccagaaataaggatttttatcacagtgacttcagtcactgatgaggcatacatacagaaatctcctgttaagtaagattagaatttgtctttgggcctttttaaagtttctgcaaactgataacccaattgctcatgctgattgacagaacaacattgaatatctaagtagtctaggcctttgtctggtcattagaatttgtccttttgaggaccattggctggaaactttatactacaattgagtgtgctatgagtaagacagcttcaattgaagcctctgaagaggaaaggaaaataacaaagaagacgcttttgtatctttttccattatcaataacgtcaatatagaacatgccttttttcatatgaaacttcaatatgaacttattcaaatgacactctggctatgtcataatgtctgcattctccaggtatatatgaaacagattttaatggatgttgggtggcttccattcaccctttcatatttgaaaatgcacttagaaactctgttgagaaagttgcttatgctattggtcctccttttctgttgttgttcagtctgcccccaagtggtagagagcctaaaaacccaaaaagataacaacgtggtcaatccatgacttatcagctgcaattgtatgcctgattgatttttgttgctatacaacagctgaacaattcgaaatttatcacatggaatatgaattcacctgttcaaatcatggtagtataataattcttgaaattgcagctgcatattttaattcattacaccaagtaaataaacttcaagacattcagccaccattcatgaaatagatttctaaaggcttatgtggggatcattttctttctcttaccctctaccctcttgttttaaaactcctctccccaccatggccttatactggaagacatttttactcttgatttctagcaattgctggctggtattgttgagttttaatatttcagtgtgattcagagctctgaccattttcaagttcttaggagccctctcttgtctcatttttaaacatggcctttggggaatgacagtgattgtgacagatggtaaaggaataagattgcactttggcgctgcttctgtctttgcctcttgatcttttcccactttctcaaggcaaattatagatttccttttgcctctagagggacgcaaattgcagttgccagttatatggttctttgtttctctttctagctcttaaaaaaaaaaagaagggctcttatttaattaaacattgtcattacatttattgttgatgaaaggtactgatttgtatgttggccaaatatctgaccagacaagggagaggacttgttgaactacaggcaaaaaaagaaaaagaaaaaagaaaaaaaacttttgttgcgtttgaaggtagcttccctctagtggcaaaaactggtacttcacttgtagactacaagcgatttaaaaaaatatattttttgttatctctttttaaaacattatctgatatgtgtaatgtacatatcacacattttaatgaatgtggcttgcaactaaaatcgagtttcctaaaaagtttagaaatcttttcagttaccaaattcataatcttaggtatgcaaagtaggcaaggtactttactgtccattttgttcttcagtaatcccacacatacaacacacaattccagatgaaaggattctagttgactaagaagatagttaataaaggggttttagatttttttcataatttattgggtcggagttaactcaagcggttacctcctcatgccggactttctatctgtccataatttatcaaaggagtgtgaaggaattataaagtatcgcataaatttgggtggtgggcatattgctgtacttctctgtgtattagaaatattttaggctgggcacagtggctcatgcctttaaacccagcactttaagaggtcaaggtgggaggattacttgagcctgggagttcaagatccgcctgggcaacacagggagaccccatctccacaaaatattaagaaattagccgagcatgatggcacacacctgtggttccagctgcttgggcggttgagataggaagatcacttgagcccaggagttcgaagctgcagtgagctgtgattatgccacttcactctccagcctgagtgacagagagagagaccctgtctcaaaagaagaaaaaaagaaaaaagaaaagtttgatactggaaaaattttagagagaggcgatagaatcactagatagttaaaatttaagtattagaatttaaagggcactagagattagttgagtgttacagttttaacttgaacttattcgttcacattcatgtaaccactacaaaaggatttaagcaatgccaagaatgagctataatttagacaatgtgcaggaaatacaaggacaactaagacgggcaagcggcaagtgaaccgagaactgtgcaaagagatgagtactaatggaaatatgtacaacaaactaagagagtacaccaaggacaaagtggccctttgtttgagacggatgaaaggacagttaagtacagaagataagtgtaaatgatcaagagtttgggcacagtgcacgggtattttccatgcacatagcaccatgggaagtggttctgagcaatcaggagataacagggcttcaagtatggaaggcttaaatggagagagctgagggagacttgttgttaataactttgctagagcaagtcctaagcaggcactgttttataccataataaataatcaaatgagagaatatgaggtttggttccccaggctccacacgtgactatgaataatcttataaataatagacttattcacaaaacacaagatagtctagaataaccgaatgaaatgatgtttttgtgcttctttgacttcctaccaaacatagtgttccttggaaggaattatgtttgacactgtattgtatgactggaaaaaaatctataatgaagaggtgctcacatatgaagtagcactgagaaagttcgcttcaacagaggtctggtgatgggagaattaagcataatcaaaagttctagttgcattctgaagtcaatttcaagttgtcagtcctaattgggagtggggtttgtctaacataatgcttaagacattttttggtggcaaaatttctcaatttaaaggaacatgatacaagctcagaaaaaatgcagcaaattgatgactaagacctaggtaatctgtaagtaaggaaatgggatgtcaggagagaaattgacatttgtttagataatatccacacttggttggatggactatattttatagatattttcattcttgaatattttagtttctaagatctttattatgaaacaagaacataggtctaatatatatgttatatgtttatttatatataatatattatattatacatatgtattataatatattatgtaatatattatattatacatatgtattataatatattatgtaatatattatattatacatatgtattataatatattatgtaatatattatattatacatatattatgtattataatatattatatattatggataatataatatattatattatattatggataatataatatattatattatattatggataatataatatattatattatattatggataatataatatattatattatattatggataatataatatattatattatattatggataatataatatattatgtatgttaatactatgtaacatatatattacaattataaaaaaagtgtatgtaattacttgtatcaaatagtgttttatctgactccctccatgtccataaacatatttcccacactgactatcacccatgttccctcctacctttacatactcaaggatttccaactgcccaggactatgaccttcatgtcccaagcacattaaccctcctttggcaatactcacctgctgttgacttttcatacttgctctcctgagttgagacttaattgtatctctcaagaccctgatatcaggtataagatgagatcaagtttataatctaagaagctcctccatgctaatagaataacacatttgcattttgacctgttctttcttccaaaattaatcaagaaaaagagcttttctgtagaacatgggctatttgagaaaatgtgtatcaaatgagtttgtcatcatttaatcacaccaagtgcatgcctttggactctatttgtgtatagagctaaaccaatatttgataaatgtttgcaatactgataacaaatttcttagataaatgggcaatgttattcttgtcttttaaagatgaaactcctgaaaatgattacaaagcccattgcttcatcacacacagacacatccacacaaacacaccatacacacacacacaattttcaagctttgaaaggctcatgtgtaagacaaagggtattttcagtaggcttggaaatcacttggcatttttgagatttgccaaacagcttgagatatttaaaaatatttttgttcaaccaaattccaaacatgtttttctgagtactttttttaggtcaatttttataaccatgtgtaatttcaagaaaatttaacccatatgtttgtttctgttagtgtatattcagattgatttataacacagatgtaagtatttctcttaacactggtatatgaagagggtgagagggtctcccaatttgctgcttgggacagtccacagtgagactttagattaatggtcacagactataacccagttctaatctcaacacagtctccatgataaaagtcacaggggactggctataagtgtcagcaaaagatcagatccagttactgcagtatgttgatgaatatgtgtgttcctagcatggactcaaaagatggaactctgactgatgactgtacagcactgtgagaatgaagcccttaagtgctactaaaaggtctttaccaactgtgatgaaaaactgcatctgtgagtaatgctacttactggcaaaataggactgtgacctgccaacatattccattattttttgtggcatcgagtataaaagtagacccgttgtccagttgtagggaaagtagaaacacaagtcaaaatactaccatacttcataggccgggcgccgtggctcacgcctgtaatcccagcactttgggaggccgaggcgggcggatcacgaggtcaggagatcgagactatcctggctaacacggtgaaaccccatctctactaaaaatacaaaaaaattagccgggtgcagtggtgagcgcctgtagtcccccagctactcgggaggctgaggcaggagaatggcgtgaacctgggaggcggagcttgcagtgagccgagatcgcgccactgcactccagcctaggcgacagagagagactccgtctcaaaaagaaaaaaaaaaaaaaaaagctaccatactttacagggatagcaaaaatgaatttttaaactagcgcgtgtttcctgtaattcttaaaattaaacagaaatagaaaaactctaacaagaacctcagattcagccaatgtgccaccttagaagtgatattctctccatagccaagatgctgtaggtaggaatgaataataacaggatgtcagagtaagtgccaagtggaaggaaattaaagtatagttatgatgtaagggggcagacataggtaattttaaaaacaacaatattttagaaataagaaatgattcataagtattgcttgtgaatgcaaaccaaaagtcagataccacatgcataatgaagtgtgactctatccaaatacttacaacattttcagggaaaaaaatatattctctgatcctgaatgttgtgcctacagaggaaagaaaatgaacctgtttactagagggagaaatctcagtgactgaagaagtcaaacaactttttgaactctgagagccaccttagctgttctgcttcagggttttgggcaacataacatctttatgaatgttaccttatagaacgttagttataccagagcagacgcaactggggatttgacaactctgccacactttgactggactgacatttccttagcagtaacaagctgctgctgtctggtgccatgggggccctgggcttgatttagtagcactgacattgactgcttgttatttcatatcttagagctgtcaggaggcaactgatgtcagcataaaattatttgatagctctgcatcttgggcaaaatgtgaatctattgatgttataaaatggccatcaaattcttggaattagggggtggagataatggagaaagaaaactcacctggtttattgttaagtaatcttttgtttaaaatttggttcacataaatatgaactgtaactatctattaggcacatactggttgtactcattaaactacatgctcatccaattctaacagtttcagaggataaatagtattattttgatcctcatttgacagtacagattatactcctggaagatggaaaagctgggacgcaaatgcaaacaatctggttccaagatccgtgctttcaccttgagttacatggtttttcccatggaattgaagatcctagattcatagaattctttccttgagctgccattgatttttttctttagttttaattttagaaaacatttgctcattttattgagggaaaatagcaattagcaccttgtgtgatctgataaatactcactgaatgaaaaatggaactttttatcatcctcatagcttttctggagtaaccgtgtatccaatggaatgattccagtcgtaaatggagttggtcaaagactaattctctcattacaatacttactttaacacagtatttgagaacactttgaaaatgtgaggagtagtgagtaaatgtggggaattttgtgattaataatctcagtagtaaagactattagaagctcagaagctctcacaaaatatgcaagaaatacttatcaaatttatgaattgtatctcagtttaccactctgttgatcaaatcacttatttttaaacatagtgatcttcaaatatagccatttctaaggaatgcatttgcttctttctgaaaatcacctgacaaccccaaatcatttccatttatattttgtatatccattgatcttgttttgtgttgtttaaaagtataatcttttatgttttttgattaacttgaacaatgacagatcacaatttaatttctagaatgtgtctttgtatgtgaatgcgtttctttttttcaaacaaatcacaaaggtctgggggaattgtgattctctaattcgagctcagtatataccagttgaaagcatttagttgtgattaaaacagattgaaggagataatccctctgagaaagcagcttcaaatagcttagcagcgcttcttcagggataagaactaacacaacacaagctaattcctccaaagtctccctggtggagctgtggacgtacctttcatttgttgtttttcttccttactgcgttctatttgaattcctcttaaatatgaattctgctttaataacactttactcattttgttttccaagaaccaacatttaaccttttgtgttaactgatacagggagatacacttcatataatattaataaatgaagagtgtgcaggcagttctcaatttacaattgaatgatattataaaagttcataggtaagtcatagacaatttagaactcgggatagaatttatcatagaaatgttgttctatataaaatttggtttcttggttaacccttcaaagcctattgaactctcaatgtagccgaatataccttatgtaactagtacaagttctgcatagcggcagttctatgagaatacttctaaccaatgttctggattcaatatcgggaagaaaaaacgccttttccttgggagtgccttcaaatttatttcgttcacagtgtatgtcatttcgagggtcggagaaactgacaggtctgtatcttctgggagtagtgtgctggagatgggagaaagagaaagaactagataaataacaaattgtagggtgagattttcttcattttcctattcgcttggatatgctgtaactccattttacaatttaagaccatgcccttgaaaaccggacccattattggagaagggatgagtaaagtgcatatatggaccccaactattaaaggctaagaaaagaaaaatggaagcaaatgcccaatgacaataggcaaagaagttatgactccttcagccaagcccaactgaagatagaagtggtacagatctcatgttcctggatattagacacatatggagcaatgaaatttcaaaaactatgttgacccttaactatctgtattaaaaaacattgaagatttaatggccaggtgtcgtggctcatgcctgtaatcccagcactttgggaggccgaggtgggtcgatcacctgaggtcaggagtttgagactagcctggacaacaatggcgaaaccccgtctctactaaaaatacaaaaaatagccaggcatggtgatatgcacctgtaattccagctacttgggaggctgaggcatgagaatcgcttgaacctgggagacggagacagaggcagaggttgcagtgagtggagatcgcaccactgccttccagcctgggtgacagtgtgagaccgtatctcaaaaaaaaaaaaaaaaaagaaaagaaaaaaaaaggaacattagaaatgttcctgtttactcacccgcttttccttccccacttcccccacacccctctgcccccatcacttcctcttccctcccaaaattgctttaaggattttcctttctgctgcgcccatgatgcagtgatggtgagccacacagtacattactgtaagtccctgttgagttgaggaattaaccaaatgctaccacagagtttattaataaagtttaggccaaattgtgaacggaattatattttaagacacagaacacagtttgctatgtaaagttttgtaagctggagcaacaatgcagaaactaatattctgtgaagagttcctagcaagccagaattaattgactaccagcgtctaaccaaacctaaagttctaatctagcttttatatacagatcacctgccagcacttcatcattttgtatatgctgtttgctatgctattatttggtgattgatctgctgtttaacttatagtaatgatgatggcctggcgttaacaataatggcatatgttaaaaatgtaagagagcatctcagcaataaaagagatagatatagttcagaaccttttcacattgcattgcccctgttaatgtttcacaacactttatactctgaaaaaataaaaataaaaaaaggaagtggcataaaaatagcatgtaaagtgttattcccacatgctgttcttggtctttggcatgcctgttatccccacattctccaaaaatgacaagaatgcatcccatctgatacatcctgtgaaaaatttaagagcatatttgaaaacacaaaatactgttttcataaactgctgaaatctgtgatagtttggcagtaatcacaggaacaatgctggaacacaacttttaattttttcttttccttgcgttctcttgtcaaactcagtgaacttccctgttctgtattgctttctgatgtgttgatccaagtctccctaaaacccacatgctaattcctgaacagagtttaacacttgacttttccccattaattaatagtccagtgttgatatcgatgtagtctttcttttgtggataaaaagaagcaatctgaagctaatttagcattgggaaaagtagtaacacagcttttaagaaaaagaggaatgaagcaatgggcaaaaccagctgtaagatcttctagacggatacgtgtggctacagttctatcaaggcaagaattggcagaactttggaaacttctgtttctatttttattcttttatactccttcagaatttaagagtcactccttgtctccatgacaaaacataacaaatgctgtttgttctagtgtttaggctaatgacataacgtgttaacccttggttacacagaataaccttcacattaagagtaatcctgcaccatttatgaaacataagcatcacacctggcagctttttgtcaataagcatatttaaaagaaattccaaaacaaagagttcagtgtagtgacagtgatactatagtgacttcttcagccatgttttgctggataattaattctccttaattctgattctctcctgccctgtgcctcacattgggtctatacttcccacagtgcttaggagatgtgcattcatccaatttgtacagtcagtctaaggattcaggcagactacataattcgttagaatacactgactgtgttgaccagattataacctgtctctgcttttggtgttatgtgagggcggcacaatgacagaaacaatggtagctaatacctatgtatgcttactgtatttggcacagattatctcatttagttctcacagtcccaagcttggagttataaaggaagaattcttggagatgatggaagctcaataaagccaaaaaacatgaacttcaccattagacagactcaaactaagttagtaatatttctacttttcctttttttcttttttaatataaattaaaccatttactcctctcctctaccctaaagtccaaatgtaatatatattaagggatatgatttgtcctgatttggtgtccatacaaattctctgtgtcagagaataacctagaacttggtatgctttatgattaataatctttcaatatgttgttaaagattttatttatacttgtggctgggcacagtagctcatgcctgtaatcccagcactttgggaggctgaagcaggtggatcacttgaggccaggaatttgagaccagtctggccaacatggcaaaaccttgtttctactaaaaatacaaaaattagtctggtgtggtggcacatgccggtaatcttagctactcaggaggctgacgcaggaggattgcttgaatctgggaggtggaggttgctttcagctaagatcacaccactgcactccagcctgggcaacagagtgatttatttaatctttattttctccaaaaagaaaataaagattatacttatacttgagtagcagtcagttataaatgagctgagagggtgaagtaaagaagcctgtatagacaaatgaacagagacagacttttgtgatgcgtctttaagggattattagaagatcattttggagtggacaactcaagaaagaaaactttggtgggaggttttacaaggtcttcaaggcaggcaaagaaatgtgggttttgatctgaccacattatatgcactttgcttatttatcgttgaggtatattactgaacactgtcttatcctatttcagtaataatctttgtttatttggtaaagtattatttttttaagggttagcaattctaagttccaccatgaagcagtcaagtgaaattgtttctcagtatttgattgacttgattcatccattttcaaagaaaaggtaaatcatatagtattctgtatgatgtagactgtgtcactcagagtgaaaaagttacctttgtcttctaccatttgagaatgtgctgttgaatttgcgaagaaaagagccctgaggcattaatcatacacattctccaatctagatttcaaaatgttcagtagatgtttagggtatgacagaagaatattaagcccgttaatacggtaattacagtgtttcttgcttccttgtaccctgaactgattaatacataaacaggactcaaaatataaactttatgtttagtgaaagtgccaatatctatgtctgaattcatcaatgccatcttaggaaccaggcaatatctgttcactgcctagtgccttagggagactgtttaatgaggagatgtgaagccttttacagtttattgttgatgacattttgaggacacttgcagtggggtagactgaaaaacaataaagctgggtattttcttggatatggtttatgtgccccagagtgttgtatcagattttatcagtaatcaaatttctacttgatagcaaaaacaaaaacaaaacctttttagaaacttaatttcatatattgaaggcaaagaaaaaaatacttgcaaatctgatatctgaattttcttaagattcaaagaatttcaatttttctacttattcagttgaattaaaggttactaccactgtttttacaagcttgaaaggcctatttatttacttatttatttatttatttatatattttgagatggagtctccctctgtcacctaggctggagtgcagtggcgcgatatgtcggctcactgcaacctccatcatccaggttcaagcgattctcctgcctcagcctcccgagtagctgggattacaggcacgtgccaccacgcccagctaatttttgtatttttagtagagacggggtttcaccatgttggtcaggctggtctcaaactcctgacctcaggtgacccacctgcctcggcctcccaaagtgctgggattacaggcgtgagccaacgcccccggcctgaaatgcctattttttaggttagatatggtagtgttataactgttgatatcctttgtagtctgtacttaaaaactctgaaatggcttgaggcagttccacagcaaaaattccatatgaatgtctattcagataacgattcttatattgtgtactatattaatatacgtaatgtatttttatgtctattgcctaatactttcaaaatgaaaagaaatggaacaatatatttttctcttgcctttgttttcattggaaccttttgtgaccaccttgtacttattaacatctgagactatggcacaacgctgtggtgaaatgtgagccatcagtccaggtgggctggtgttcgtgtgtcttcatgatcgggtctggtcctcagctctgtaggtacattttacagaggtagtattatggggtgtgtggttaaaagctctggaaatgcactttgtagacttgaatccgaccccatcaatttcttagtgtgtatagttatgtaactcatagttatgtatgtaatctcagtatgttgcataacttagtgtgacgcagttatataagttatgcacataacatagcataaataactacataacatacatacttgatataacatacataactgttatgtacataatgtatatttagtacataaaagttacataatagacatatttgtgtaattaggcattaattccaaaagatgtagtacatgtttgtacctgcttgggttatcattataataaaaacagataatgtttgtaaatactttagctctaatgtataacacaaaattaatagccagtattagttgctgctgttaatattaatgttagtactgtgtaatcatctgaaaagtgcttgctcaataccaggttaaaaacagagagcgctagagcgacttattacaaatttacccaggtaatagaaaacccggatgcgcttcctcactctaagcagaaaatgtgtctgtgatgatttgcccttctggaaccatttccagttggtattaagtgaaatctactaaattttgtatcctgggtttctcttctctatactttgtgcagatacctctgtctccctaaaaagaattatttgaccagatacaatgcatatgattatggttattctagcttaagccagtttattataatagatttagttgaagcttggttatattctggcgtcagtagttttattaaccatgaagaggttatagctttagatttgttgattcaaccatgcattcttaagatgatgtcgcagacaccttaattaaacctgggtgttcctaaatttcctcagacattactttcaccatatttctaacattacacttagaagggaagctttctgcttctatgtagtcgaaatggtaaagaatcctagattttcgttttattagattgattagaacagaatgcaagtatagaagcttttaagtgaaaagatctatgtgaataaaaatatatgcctatatttttgttacaaaccagtgatttaaattttaatgcatatgtttatgtagagaagtatgtttgctattataataaacaataaaaagccattgctcatgtgactcatgaaagcaaacctggcaatgactttttctcatatgtctgcagcctaccatcacatatgcctaaatttttacgaatgtgtgtccagtatattgttataaccatctgcaatcaaatgtgttatgcaaaacaaatacttaattggtataactaattctttgattcaataatgaagatcatcacattatgttatttagagtaattacttatagcttaggttgggatggacacttttcaggaagaaaatgtatactttgtttctcttttttctgaaatagggatggaaagggtattaactagcattaaaaagggcgaagcaacaagcttccctgattggagtgtaggtcccaagcattttactgataaattcattcagattgagtaagctctttaagctctttctttctttcttttttaagttaaagtcatactctaacacctattctcctgcccacaactatacctttgagtaaatgttcttaaaactaacaggtacttctctcctaatgcctaaatgaactcaaccaccatggagaagtgatagttttgattggtagatacaaagtgatcatttcagcattgtattaagctgtacgtggattaggtagtagccaaagaaacagggtggccagagattttgagggaacaaaggcagaacagaaagtgagaagaggccaaaacaatacatcagtcgtgtaaatctgccttgggcactgctgacctatataaagctgaatatcatcttcagtgacatcttcggtgtacctgtcctggattgcctgtgcttggcttcgggcactaattttctttcctcatacaatccaatccattaaacgtctgctatagtttttctggcctgaagagaaattttgtttgtttgcttgtttgtttcggcctagttccaggcccaggataagatgaagcaaacactgctttcattcattcatacatcacatatatgcttctcttcaaccttctcttccttgctctctgacatacacaggtacttctaaagctctgggatatcccttaccatatagcaaacttcctggcaggagcagaggcaatagctctctagtagtgcttggggtagtgacagatactttcaagactgacagaaaaaagaaaacacaagctctttttcaggaactgtatatatatatatagtgggtcttagtgagatacaaatctgccactaaggtaccacttattaggccttataattgagatttacttgtggacctgaaaactctgcacagtccataagagaatttcctgtattccctgcatagtaggagcaagacgattatctattgtaaggttatctatattattccatttgacatttttaagtctattgaagtaagtgagaaatgtggacctttgcaaagatactgattgcccaaactaaaagaagttaaaacttgaagtggtaatttagtgttctcttcaaaggttgtttaagtacacacattattaatatacacttagtttatgcttttgacatagcagatcagactttacacctggaaaaattgtaaagacaaaggttaagtttgggcatggtggctcacccctgtaatcccggcacttagggagattctttgaggacaggagtccgagaccagcctgatcaacatggtgaaaccttgtctctactaaaaatacagaaattagccgggcacgctgatgcatacttgtaatcccagctactccggaggctgaggcacgagaatcgcttgaacccgggaggtggaggttgcagtgaaccaatatcacatcaccgcactccagcctgggtgacagagggaaactccgtctcaaaacacgaacaaacaaaaaaagcagagatcaaaaaatatctgtatgttcatctatagccatagctgtacctatgttctttaacttaattatacaacaaacatgatagtatttagtttgccaaaatgtaaatattttccacttctattcactcacctaggctggcttctttacaatagaccccaagcccattcataattgacctatcccctacttgggtctgcatatgatcataaataacagctctcgctacgagtcattattaaacaggaagcattccaagtgttaggttattctctgattcggagtagccatcaagaaaaaggaagaaacatagaaaataatttatagtgatttatggaatggcaactgagcctaactgtatgttagataaggcaactttgattttaaagagctgacactacgatagaagagagagatatccaccaaagataagcaatgcaaccttgttaactgctaactgagtcagttaatgatgtcctaatggtttgatggggagaaaaacctcagaaattaaatgttgaaattgtcataatggaggtatatgcaaggtactgtaagaacaaaagagaagccttatgaacagccttttaaaagtagaatggactataaagttccagtaactctgtctgagaaagtcaagaatggcctcatagtgctggctttggagataggataatcaatgggcagaaatatgcctggtgaagaaaaaaggagataaaccaagggttctacttgcacaaatgcagtttttggagggcccctttggactttgtaggtgaataaagagccaggcttttgggtgcatggtgtacagagtatcacatcatggaaggtgagactgaatagtcagacagaaggcagagtgaaaaggacctctcaggttcagcaaaagattgtaacatttatccaacaagcaacacgaagtcaagaggggcctgtttgtctactagccttctttgtacctccctctccttccctttggaacttccttatttcatttttctgttcatcttccttttttctcctcctccttctgctcctcctcttcttccttttaacccatctctttctcctcttcctctttctttttttttttcttttgcttataaatgaaggatgatcctttcaatagtagtgtggtggatggactaggattgggaaagatgattagtgtattgaataattagaaattttagtaatacattatgagggaactaatgagggccttccataagaaagtagctgataaaagcagatacaaccttgtatggcaaagacaggcaaaatctctggttccctgcctaagcctggtgtaccacaccaacgcctgacaccaaacaggcagactgtgaagttttattatttgcaaacaaacacttgtgaataatgcgtagcttctattttgtgatgctgaatgaattggtgatgcctttcccaaggccaaaaacaaagcttgtgtaaaatagtagtgaggaaaaaaggaagacaagttccacttttgttttgctaaattcggtatatgtctccaggataaaataatgtctgtattcaacaaatatctggaaataaatacgagttctagaataagggaaagaaggaaaaaccatctacaagagatgaagtttcattgcaatttttataggacagatgatgtaaagggttggttttctgttaggaagaaattaattgttcactttctgaatgaacatcggcaatttctagctgttagaaagtgaagtcatatttctaaagaggcactgtcacagagatacatttggaagccttcaaatatctttttgttcttttaaaattagcattttggcttttccattcataaggcagccagtgatcagaaagtaatttctttcttctttggaaagaaaacctttgccctaagaaaaatggcatctcttcctcaagattagcccccaaaatattaaacttggggtaaagcagccaattctgttcatggttatgaccaaaaaagaaaatggagagtttattttcttaaaggctgctcaagttcaaaaatttgtgtttgatccctcaaaattcatttcatgttgaatatgttacctgaacttaagttgagtttacaatatttttcaaaaaatactataacaacaaaacatttattttgatataaaattatgtttcttatattgttactttattttatttgaacctaatagttaactcgcaaattgcatatcttgctcaaaaataagctatttctttaggcctacataaaacattaaatgagaacacgacaaaactaactgattctgggattacataaacatcccctaatcttaatattaaattcatttcttttaggaatacattgcaaaaattagggaagaaaggttttgaattactttccagtatgaaatagtaaggtcttttaaatgtatggataatcagtaaaatcattttattagtcatgtttctgcttccttggcagaaaacattccagcttgactccacaaaccagcataaccaagtttgttatagtaaataattaatctgtacgtattggttgatgtttcatttcagcatccttgaaacattccatggaactttcatatttccaataaacaacttcaatcagtaataatatgcttgggtaaaacaaagaaaatgtggttatttctttccaattataaagctaagttttagaaaacagacatcagagaaggggtaccacagatctatttttaatattcaatacaagttagagctcatattttattttggtccaggattaagaaaaaaatttgtttggagatagtattttacttcagcatttccacattgagtcttttctatttctcattgtttgtgatgcttttaaatcaagggcactttgttttttagctcacatctgctccccccttgttctggtcagactttcaacacgtagttgctctgagattgttcaggagatctcagacaggatcaccacgaccttacctgagagtggtcaaaaaaggagcagatgcgtgttgtgaagattaagcttatgtttatctgacaaatgaccttaaagataaaacgcagaaagcaaaactcacaaatgtggttgatgcagagcaacgagacaatgttgtggcaattatttttaaataacttattaaactttataaaatgaaaagatttttttaatggcaaacataggtctttaaggaaccacagagtgcagttattgaattaaaatattgacgtgaacatatttttcaaatatgcttcaaatggtaagtatctgccatcacaaatattcaatgtttttaaaaatgctaatatatttaggtataggtcaagaaaattactaggattaggtatttgctactagcaaagcaatgccatttttcctagctattgctttttctattgagtaaattattgaaataattgtttgagtttatattttactcatagttgaggctagaatagtaacgccagtgtattgatagagttgatttgtttttgaattatagatctgataatagaaacagccctagaggtgagtccctgatgacatctcaaaatggttgtttaattttccatattagaggagtattatgatagaacaacaaacagagctgctttcagacaagaaacatttcatttaaattattttctttttagttaatttctaatatatttctaatatacttaccttattttacaggagatgcggacattaagaaagcttttctttattttttgccaaatgataaaaaaattaacactctttttttaatcatagatatatatattccgtatggttgaagtagacacattgaggattagagttagaagttatttgcacttagccaggcaaatattgactgtaattaaatgagcaaagataatttgaatgtacagataatttcaaccaaagaagatgccaaactggtcaggtgataaagaaaagtgtggtgagcttgaaagttccaaatatttttcaccatcttcttcatataagaacacattttcagacttgaagttcagctttctcaaaaatatttgaaatactgttgatgtgctgaacaggaaatttcgatgcaacttgcatctgtggacaacatcagtgtccctaaaaatgcaagaaatgatcttggtcagtatagccttaaataatccatttaatgaaagaaaagttgttttgtttggttttctcaatctttgggtagccttttaaaatcatatcattttcagatctccaaaaagccattattatcatgtccctttcatagaactaaaacatacatctacagggaatgatgaccttctcatgaattagtggctttaggcattataatatatattttaaaaaaaaagagttggagtggctagcaaaaaacatgcagacatttcataggatttttttcccctttccacttcaatgcatttatttgaaaactgcttatttgcctgaatttgccctgctggcaaaatttttctaccagatagctactttttattgttgatgcacatcatgaatagcagctttatttgatggcaaatgagatgccccaagttgcaagctttccataaacatatctgaattgttcaatttccttctcattgtataatttccaccctggccctttgcctgctgatattccgataaagatttcattcaagtaattttcaaaactgtcctatgttctttgctatcataagtggtaagattgctcaattcgtattagctataacacaagtgctgcacaggttttttatcagatatttctaaaatcatttctttgtcatgaatggtaacgagaataataaaataatgcctccagttgggtttgcaaacactggtggtttactagcaatagaattagtagtaatatgaacgtgaaaagtcacttttctaaagaacatatcttaatgaattattttgtttctttttctttcatgtctcctaacatggatttgaaaattatgattgctgaatgattccaaatgacttgggcctttgtttctcaaataggtaagtgattcttgttctttggtgttcttaggagtccgtggttgtattttaaaataaatattcattgccagtttgcactgttgaattttctggcaaaatagggtaaaaattgaacataagacaaatcatcattttcagaaatataattcagatctttttcattagttggcacaggaaacagactaacaagaagacccagtttgagttgtacgtattcataggagccatatgttcaaaatcatttaagtcctttttgctggctagcttttgtattttaaagcagcttggtcatattttgcccatgaagttctaggtcacactagactagttactaatcataatactgtatgaattacccaggtataagaaagcatttcatatggcagccagtaatggcttgatacagaataattagctaacaattttcctgatctcaaagatactaggctgaaaaaaagtttagctttaggttctgtagtatcgtcacttgtagagctgggatcaacaagctagtctatgggccaaatctgaccaactatgagttaagaatattctttacatttttaatggctgacaaaaaatcaaaagaaaaataatatttcataatgtgtgaaaataatgtgaaattcaaattttggtgttcaaaagtattgttggaacgtagccatgcttatcactttacatattctctattgctgttttcataccacaattctatggcccatgaatcctaaaacatttacattctggcccttaacagaacaagtttgccgattccattgtttgagtactagcatataagaggttaattccccgaacctcttactttggagattctattagagcagaggtgaaatcattatatatctgaccttttcttagtcacaagggaatccaccatatctaaaatgaccaggtcagaacaaatggaagagcaaatcttgactgtagatttaagttttcctgaaatagtcttttacatagttatatttctcatacattttaagccctacaacattcaacccattaagtctaatgtattttactgccagcaagtctttgagcttgcccacagatattcagagtcccatagttgatgggaactggggaagtggcattttgtggctagtgaagcagcaacatgttgtataatgaaaagaaatatcctcaaacttttcaatagttctcaaggctctgtttcaccaaagagaatactaacattctatagagactgcctgttctgaattacatttgacagtgttggaaaagtgtaatactcatcactgtaatccagcttagcatctaaaacaacacaagtaagtacagttgtgctttgtggaatagattttgcagaatttttcagaggccatgtggaacatgagtggttatatgcatattctaattaaaaaaaaaactttaaaaataattataaatatattgtagttcttttcatgttggcatttatcagaaatagatgcatttgtagtttgagaaagaaagaaataaaagagaacaaagaaagcatattcttggaatattgcaagagagagcaatgtagaaattgctggatattaagaatatgcattaacttctaggtttaggccactgggaaataaagcttccgtgcgtgtatttgatgtataatgacaggcacaaagaaaaaggcaaacatactatagatattctagtatggtacaattatacagtatgtgttctaacccttttcatgaaaatttgacattactgcacctcagatagaagcagcaggaatcaccagggaaagaacagctggatgctttattaggttttatgttgtacataaggagaccatgttttccattgtcagtgtgtaaaagaaaatgaaagctctgggcatcattaaagtctcgaaagcgtaagatgtgtcagctccattctctcaacacctggattgaaagtgcagtgtggggtcaccgtaaaacaaaaacagaccgtcttctctggttggaattgcaagagttgatttttagaaataaaataattcataattgttgtagagagaattcttcctttataactagagagttgcatgtatgaacataaacttatatgtctacctgaagacattttctataaactgcgtctgaatatctttttcctgcaccttaaggggtgctaggaggcttcttggagtcagagagctagaagactccccatttgctgccactgtggtattgtccttttgatgaacatttctccctggcttttcatttgcctccttttgtggaaccatttttgttggcatcccccacccaacacacacattatattctcattgtgtcccttgttgcaagtacctttatgttggagaccgttttaccttatacctttatgtaatccacaaagcttagcactgtgttcctcttattgtggtttaaagtgctgtattagttggctcaggctagtgtaacagaataccacaggctggatggcgtaagccatggaaatctatttcctcaccgtcctggaggccgcaagcctgagattgaggtacaggcacggtcaggttctggtagggtctgtcttcctggcttgcagatagctccttttctctctgtcttcacatgacaaaggggataggtagatggagagagagagagagagagagagagagagaactttcttataagaccacaatcttattggataaggatgctgctcttatgacctcatttagccttaattattgcctaaagatcctatacagtcacattgggggttagggctttaacatataaattttgagagaatatagttcagtccagagcaagtacctttgacacaaattgagttacataagcagaagagaggactgaatttttctcttcatgaaaatttaagagctctttgcctataggctttggccacttctgttttctccaagagttgctcatattaaatctagtaaataataaaaatgcgtttcaaatattaaaagatgttctatgttctggcgctaatctctactcttaattatcttaaaaaacgtacaagaaatttactattgattttattaatcgctcatgaacccacttatttacgtatttaacattgataggttgcccaaccatatgcagggggatacagactaaggggcttaggatctaaagaatgtcctgacaacattgtaccctttaggaactcctagctggcaagaaagacagtctcagagcaatgtgtcaagtgcttaatataatttgctcttgacatacaaatgaagcagtgcccacaatctttagtaaattagagacttctcaataatgatagcatctgatcatgagattgagtttgacagttgaagaaataaagggagtaaacaaacaccaggcaaaaagaatggcaagtacaaaccaaacacatgggtgaatgagagagctttactgcagtctgcaaaccatttatgctgaacaaaatgaagaaaatacaatgctcttaaattttgtttgtttgtttgttgagctcctactatgtgtcaggttccaggttatatgagtcagcatagaatggaaaacaacaataagctccctgttcttgagccaattttcaaaggtgaggagataattaataaatgattagtaaataagtgatcaagaactgtaaatgcaaagaagaatataaacatgaccttgatatagcaggatgggctaccgtgagcctccttttatggtcagagaggtcctcctgagaagatggtgagaaggagatgtttgatgtaaaattggaatgacaaaaaagagtcagccatgtgaagatccaggtatacagaacagcttctttcatatatcaaaaatatttttttcttaaaatatatgacatattaaccttactttaaaatatgcaagaggaaaagtgggaggatgcaatggactgaacatttgtgtcccacaaaattcatgtgttgaaatcctaatccccaaggtgatggtgttaggaggtagagcctttggcaagtgattaggccatgagggcagagccctcatgaatgggattagtgtccttataaaagaggcccaagaaagctctctagtcccttctaccaggtgaggacacagcagaaacatgccatctgtgggccagacagtgggctcttgccatactccaaatttgccagtgacttgatttggatttcccagccaccagaaggtataagagatgaatttctgttgtttataatctacccagtatagggtgtttttttgttatagcagcccaaatggactgaaacagaagataaaaaatagtaagatcagcagtggtagagcagtaagacattgaatggttgttaaagataggtgatgagtacttaggaatctgtgagaattttctctcattttatgtacctttgaaaataataatattaaaagtttttttggtctcaaatgttttctccatgaacatactgtttcttcttgatatattccttatttattacactaatataaagaacattatgataaataattcttgaagggaattgcattccttatctacttcagcatgacaaattaccccaaagcttagaggctcaaaacaacaataagcatgtattagcccttacagtttatgtgggtcaataatttgtggttttagcttgggaaacacccttaaaaaaaaccgtaaaaactcttatgagatttgagttaagatgtcagccaaaactacagttatcgaaactggcttgactaggtgaaggatttgcatcaaaggtggttgactcagaattgactagttgatgatgttggttggtggcaggaggccttagctcctccctgctgggtgtccccacagggttgcttgtatgtccttaaaatatggtgtctggctttttctgaagcaatccaagagaaggtagaaacatggcagacttggaaatcacacacccttaccacacatgattgtattggtcatagatgtcagccccattcaaggtgagaggggtctacatgaggacatgaataccaggagatggagataattggtggacatattgaaggctagctgccacagggagaaacagtatatttggtattaaacaaataatcttgacatcatgctcactgaattgatgccccctccccaaaataaatccctcattaatttgttgttttcaactcataactcacacaactatctttaaacctctgtatctatatttagtttgtagggtacacacttatataatgatgtctttcttctgattaggcacttaaattagctgtatttaatggaataatgatattaaataactttgtaaatcaaaaggtgaaaatatatgcctagaataaattatcaagactttgtccagtataatgagtggtgattattttccagtatactcttcaatttattactgtaataatcttttaaacccattaacagtcaatttgctctgtgatattaaaatgttagccacattatttgcctgttaatgtaggttaaatgttaattatgctgttgtatggcggctaagatggtacatccagaaattacacataatattggttggttctttggccgtcatacactaatgtgcttcattattattgtgctaattttagtaattttagtacaaactacataatactctgtgttactaaaacagaactacccatgatatattgcttgcaaccaaacattaggcaattttggccccatcatttaggagtagtttacatgactaaacaagtaatgattctgtaactctcaaacttgcatttagtgtatttagaatgaattgcttagtatattttaaatatttgtagatcaaaatgtaatcccttttaaaacaaatgtaagtcatgctttttaagctaaatgtacatttaaacttcattagtgtagtgattataaatacagctatgattattcctccagttgtactaataatagaatggcatatcaaccttctccctgggtccagttttattactcctcattctactcttacaactattttaaaataatacttagcagtattttgagaaatagggtttgttttagtaaactatcactgtgtaacttgctgtcacaaacttagtggcttaaaaccacactcatttattattttacatttctgtaggtaagaagtttaggctcagctacctttctgcagtaggttcacattcccggaatcaaggtgttggcctttctagaaattctacggatgaatctgctttttagctcatccaggttgttgcaggaattcagtgttctacagttgcaggactgagattcccatcttcttggtagctgtgggctggggttagttctcaccttctagtggctgcctgcattcctcatcggatacccacttcctccattttcaaagccggcaaaacgatcaagtccttttcaatcttcgaatctctcttaatccctttctcctttgtcctttctcccttctggcagagaagtttctctcttcttaagggcccatgttattagattgggcctacctgtataattcaaggaaatcttcttattttaaggtcagctggtaagtaaccttaattccaactgcagagtcccttcacagtagtacctgagggagtaaatgtgggaaagaaatctcccagcgatatctttggaattctgctttccacagtgttgttgtttgattagaaatttagagtaatgtaacctgagagagcccactcaggagaagttccatttaagtttagttctcagtgacacaaggaatcatggaaagatctggagaaaaccagaaaaagaccatgctaattgcaagtacaccataaagctgtaaggttcatatttgatttattcaaaggttcataaagcaaaatagataccactactaaccaaaacaatacgaattaaatacctcgcgttccagacctgaaatattataatatatataaataaataagcagacatcataatttgcgcttccatgttcttaaaacatttttgtagcaattttccctctttccttccctcttaccgtataattcccatcagcataggactataatgtttatttctgccagaaaaaaatagaagaatctatagtgtgtcatatctccccttatctctccctatctatattttctgctcataatttgtatttttttcttaagccacgtctaaaattcagctccttttcccccaaatattctatgcaaactgcccttacgacccacggtgactttcacattactaattatgatggccttgttagagtattgatctaaatagaccccaaattaggatttgacacagatggtcacactgtcatcattgatatactttcttcactaggcttccagaacaatcagccttgcattgtttttctcctgtctgcctggaagctccttctctcatgtatgtgttaatttcaccttcttgcccaaatccttttctttagagtgctccagctcagggtttttagacctcattttctatcttaaagtactttctaggtgatctcatcatttctcatggatttcactaccgtctctagctttactcctaagagttctacttttcttcctaaaaactgctccacccacacttttctgctcaactaagcccaggatttttgattttatacacctttttttcctctaatccctttcctgtggtgagaaaagcttttaccagacaggggtcctgatccagatcccaagagagggttcttggatcttgagcaagaacgaattcagggagagtccatacagtgaagtgaaaacaagtttattaagaaagtaaaggcttttaaagaacggctactccacagacagggcagccccaaggtcagctggttgcccatttttatggttatttcttgattatatgctaaacaaggggtggattattcatcctcccctttttagaccatgtagggtaacttcctgatgttgccacagcatctgtaaactttcatggcgctggtgcgagtataacagtgagaaccaccagaggtcactctcatcaccatcttggttttgatgggttgggactgccttctttaccacaagctgttttatcagcaaggtccttctgaccttgggtcgacctcctatctcatcctgtgacttagaatgactaactgtatgggaatacagcccggtaagtttcagccttattttgcccagctcctattcaagatggagttgctcttgttcacacgcctctgacaaagctatttgttctattttcagaatatgtccagattgcgttcatttcctttgccactgcctaaagtcaagcaagcactatctgtcacctgaattatggcaaacccctcctaacaagtctccctaatcctgcccttgccttcaggtatcagtgcccaccacagctctgacctctctcctgttagtctctccccagggctaagtcctcattatcttccttgctttttcttacagatgcatcacctgttggctctgcttcattatcttttccaacagatattcatttgtctggctctctcactttcttcacttcttctcccgaaaagcttcttctcggagaggcctttctttacattgcaatccccgcctgcacctgaggttttgtattcctgtttcctgccttgcttcttcttctcacttacctaacatcagcctagcctctaaattctgtgtgagaaggtatttttgtctgcttttttctcactgccagtgctagatgagagccttgaatataataggtggtcaataaataatactgagaaaaaaagaataaaacatgaaagtacattgatagatggtatgttttggtgctggctataacattttgaggtagatagtacaggtattattttctttattttccaaatgaaggcaattatacatcttgcccagggtcacaaaactagttaagtatcaaagattaaaccaaaactcaattctcttgactcctaacccggtttccattccactacaataggtgctaaaaatacaatgttgtctgttcttgggagctacagtacagcatccctcaagaacctggaaataaagaaataagattgccttctgagagtcacactatgaaatcgacgtgtaatgagtcacttaccttaaagagctagaaatgcttttaagccaaagggaccattactgattaaatggtttaacatttccaaagaaagaacattttaataagaaaaggcagacatagaggcacttcaagaggatactccaaagcgaaagttgggcacgtgaatcctaggggctggagtctaagccagtgaattatgagaattccagaacttcctgggttcacagatacatcagactctgttagttaatgacaataaacattggattcatctgaccaactcactttttttcagagaggcctttctttgtcaccccactttatattgcaatcgtgatcacaaaacagccttatgattaataattaattttccatgcagctctgcctgtctatagaagaaaaatcccttctaatatgtacttccagcagtctggtcccgatgttagttatttcttattgaaagttagttgaccttctgattgcagtatggcttttgtaaagcttacttttggaagaaaagacatcctgatttcactgacacctgtacgtccctgcgattggtacattaaaaaaaaatatatatatgtacacacacacattcatatatatataatatatatatatacatatgccgtgtgcagtggctcatgcctgtaatctcagcactttgggagactgaggcaggaggatcgcttgagcccaggagttcaagaccagcctgggcaacatagctattaacccaggtaattttgggaggctgaggtgggaggattgcttgagcccaggaggttgaggctgcagtgagccgtgatagtgtctctgcactccagcttgggtgacaatgtgggaccctgtcttgaagtaaatatacactgaattgtgattttatgtatcaatctcccttacttggttaattgaatgtgagtctcttctgcacctccctcacttccactgaatatggagatgctcttaacatttcagtgtgaaacaaaatcaaccactccagaacttcctagtatcattctgtactcgaagtgctgcacaaaagcaggctctgaaggaggctcctaaattagagacgaaggacagacttttttttcttgtatagagtcttaacagaaggtgtcaggtgaaattcagcattttagggaatagtgggtcaaggataattctgggttttcatagaaggaaggaatcctcttgcagagtagctgccattgttttggcaacttagatttttatcaagaggcaatgggaggggcacttgtcgttaaggtcacttgcaagaggaagcccagaggaacagctacacggaactggacacaagagaggcccagaagaggagtctcagtctttggttgtctctcaacagaagcaaattaggtttctaaatcagccagccagagaactaaacacacacttggtggctttctgatttatcaagcacagctggtcacaaattatttttaatgcttgcatgtatgcatttctatatgtgtcaataagttatgctttggtggtttctcccttttaaagtcttgaataatagttaacaaagcactcagggaaaatattttatttctagcaagaaagcttccttccttcctatttgtttgttttactcctgacttgtctttttaaattatttcaccttggaagataaatcttagggaagtttattgtgacaacctcaaaattctgttgtactatagtcagatctcgaataaataattaattttagggaaaaaaaagagcgacataaacatatcaaaacatactggcattgtgatggcataagaacacctgaatttaagtctgagagttaacaattcctctttaacatcaagatatcactcagttaccacagaaatgaaaaatgagccattgaaggtgaatagacaatgagtggcatgacttttatgttgggcaggaaacaaattatgatggcaggtgaagatattgatcatgagaatgagaaagggtagctccaagcccaggaactgggatcggcaaaaatgaaggaaaaaactgagataaagggttccttggttgagaatcgtaaggtgcctcactacagtcaccaggtatattttcccttaacaaagtggcagagtcatctacgttgaaatacaaggaggtacctccttagacatcaagaaggtctcatttatcagcaagtagaatggaggatcattgtcataattaaccaggttctctaatcagcctaaagctgttgagagtgaattaggaagcacttgttatattaacattctaagtggaaagagcacaacaatataatctggggtctccaacaataagagtcgcaggtttttttgtccttgcgataggacaaaaaaccaaacacctcatgttctcactcataggtgagaagtgaacaatgagaacacatggacacaggaaggggaacatcatactctggggactgttgtggagtgggggcaggggggagggtgagcattaggagatatacctaatgctaaatgacgagttaatgggtgcagcacatcaacatggaacatgcatacatatgtaacaaacctgcacattgtgcacatgtaccctagaacttaaagtataataataataaaattaaaaaaaaaaagagtcgcaggtatcagcattttactctagcattctagaggaccttattttaaactcggtgcaaaccactacagaaacacataatgaatgatttatgctctctctttttttttctgaaaaaaaaataaaaataaaaaaaggcctaggatttgaacatgtaggcaggagtgactatagaagtgttgtcaaaactcttgactccaggagtaatgacaagggcttctttacaattcgtgcatcattctatttcgtggaagatattctcatgcaggtggtctgacatcctgtgtctatacacagcagcatcagcccagagagagacatcagtttttacacaaaacagcgatatttttttttcccagagtctaaagtcaatgacatcctgatgggagaattgcaaggctacgacatgcttttcttgttcatttggtaagccatgaagaaattagaacatgattttttttttccaatagaagaaaactatgacacagaatgaatagtctcaaaaaagttcaaaacttttgttttgtaaaaaatggtcatattattgtcttcatcttagttttttgccttcaccttatttttcggagtgttcaaccttagcaacatcaaagtcatcaactgaaaagtcaccagtgggaatgaagtctttctattgagttgatcttctgttagttcactgtagaccccagatgtgggaagttacttctctctgtgacaagacggctagagagagcattcaggaaaatgcagatggcgagtatttcttgatttaaacagctcatttcacatggtccatcacataatccttttaaataaagtagtttgtctcaatagacttattaatcttattggtcatgtgctacctgtgtttgattgaatctcagtgtttacaacttatccacagaattatttttagaattgttcttttaaattctatgatgaaggaataaattcttaatggcttaaactttttcatagtttaaaaatttatttttaaaaatgttactcttacaaccaaccccctttatgaacctggtgctcaaatgaatattgtaactttgtagtctctctaagaagttttcaaagctgtacattgaaccagatgatatatttctgcgatgtgggccacccaaacatttggggtgctgtcaatagtgtaaaagatttgagcaattactgctacttctaaaaaggtgaattatatcaccgttccttgttttagataaagcatagttggaatttcttgacatgattgaggaccaaggagagctttggtcaaatctattttatttgaatcaagatagggagttctgaaacaaaaatgttcaaaggataaacgtacttggtatctaattagtcagtatgcctcaaaatagttcttgcatacctagggaacctttttttttgagatggagtctctctctgttgcccaggttggagcacagtggcatgaccttggctcactgcaacctccgcctcctgggttcaggcaattctcctgcctcagcctcccgagtagctgggactataggcatgcaccaccatgcccggctaatttttgtacttttagtagagatggggtttcaccatgttggccaggctggtctcaaactcctggcctcaagtgatctgcctgccttggcctcccaaagtgctgggattataggtgtgagccacagcacctggccgggaacctttagaaaaaaaattagtaattattaatactgctcagaacatgcaatggaaaatattgatgtagatcttctgaaatctcttcttggattaaactctaagaatagaaaatgtgtaaatgaattacattaattaccgcttcttcccaccactgctccttcaactccataccctgaattgtttttactgaattgcactttgaaattatgcccttgggccacattgaggatctttagaaaaaaacagccctgagaaactcattactttatttactgtaagatgttgtttgaggatgttgttctctgccttgccatttggacaccttttgagaacccccagaagagatagatctcaaagggcaataccaggaatagtcttctatttcctgaacaagtagttgttggtctcatggacactgacaattacaatttttttttcttttccagtttacactggagtccagataatacagatcaacctagagcacatctctacccttagtacagaatattgcagaattttttctcctggtctcactgcagtttcatttcattgttcctttgttaattttcctttgccttgatgcacttgttgacttaattttatttcgcggcatgaatttgcatcatgaatttgcatctaaagtctggaaaaagagtgtaaacaaccaaattgcctttataatgtgagtgagaccaaggcacctctgggaaaccaaaggcctagtcttagatgaagaatttggggaaagattgtcaactgaaatgtccatattttcatgaagtctctcagtgtggaagttcagtagaattaaggtgttatctgaatcagaatccctggaaacaacacctgagcataggtatttttttgaattataacatgtaaaattaaaagatggcatttctggcatggaaaagagcaagttcaaatgacctgaaaagggaaaaagcttggcatggtttggaaagagtgaaaagtcacacatggctgggacagaacgagtgaaagggaaaggtttgggagataaagttgagaagtagacaggccagatgtcaggcagagccttacaaaccataataagacgttgcatcccatttcaaacacgctagaaataccgaaggtttctttgttaagtcaagtttgttgaagtagaattgatatacagtaaaatttacttttttagcataaagttctgtgggttttgataagcacatggagtcaggtaagcatctctacaaccaaaacacaaaacatttctctcactccaaagagttctatcacatacctttatgatcaacccttcctcccatccccataccctaggagctctatcacatacctttatgatcaacccttcctcccatccccttaccccaggagctctatcacatacctttatgatcaacccttcttcccatctgcataccctaggagtttggctctgctttctcttgtatagttttgccttttccagaatatcttataaattagatcatacaatctgtagccctctgagtctggcttcttgcacttagcaaaatgcatttgctattcattcatgctagtgtgtgtacaccaagagttttgagtgggggaatgatacaaactgctttgagttttatagaaataactcctttgctgtggtaattgtgggagtggggttgtgaagaggtgattgtagcaggtgaaattaagggagaggataggtcacagcaggaaggtgctgagatgcggattcaggaaatatggtgaaggcttatctatcatgagtgctagtgatgcagatatgagtaggacagataattttctacttaggaaaaataatttcaaaacatttaatactaaaaaacaatgaaagtactaaaaggattcataggaaagtttaatataattttagattgaagaaaaacttattcatcaaaacaaaacataacaaaacgtggagaaaaattacaatatgaaaaagttaaatttgcataaggtgaaggacaccataatcaaaactgtaaaagtagtgtcagccagggagaaacattaatagcatatataaccaagtattgatgtacacactgtataatgagcagctatcaatctctgagacagataatccaaaaaaaaaaaaatgggtaaagtggagaagacaattaactgaagaaatatagatgtccaatatacatataaaaatatgcttattctcgttactttttgattcagcaattccacatctggcaatccattctatggtaatacttatgtatgtgggcatagattgttttgcatcaatagggaaataaatatgtaaatgttggtttattggcataataaaatattatgcaaccattaagaagaatgagctagatctgtattaaaagaatgagctagatctcagttaaaagagtgagctagatcatggaaagttctatgttaaatgaaaaagttacaaaacaatttgttcagcatgattctactgatagctaaataaaaagaaaagcacattagtgactatgtgtgcatgagagagagagagggagaatgaaagagagagacagaaagaaagaagggaaggagagacagagagagagtaagagagactaaattcagagaaaaacaactgtatgcacatcaaatggccaacaggttaatagcagttcatattcacagaggatcttagaattgggttgggtatgtagacgaaaagaaatacatttttcttacccatccctgggttcatgactgaggcctctataacaaaaggcagattaatagaaaaacttgcaaattgatttagcataagttttacatgatatgagaacttttgaaatgaaaacgcaatttatatattgttttggggaaatacccattagtaaacggttaaaatatgcaaggaatgataccatacagtctcaggaaagtggttaattcagggggagatggcaaagttgggcttcgtttctataatttttgactattaaaaaatataaagtatatatgacacgatatttaatgtttggtgatctagatgattgaaatatgtggacatattattttctgtttcctgatggtttgaagtttttgttattaaaaatacagagaatattttgcttagatgatgactaaagaagacattatggagtaacatgaggaaatatattaaatattgcctaaaataggggaaggaagaagtgtttagtttggaacagggtgctaccgttgtgacctttcttggattattataatacaaacagtaacttgcatctgttgagaagttattgtgtaccagatactttgcaagggcctttcgtgtattttatcatttaatcctcacaacagctgttaggtgatgctatggcttgagtgtgtcacccaaagttcatgtgatggaaacttaatccccaatgcaacagtgttgagaggtaggacctttatgagatgcttctcatttctctagcaaaagactctgccctctgaatggattaatacagttattgcaggagtgggttccttatctcatgggagttaagttcctgatgaaaggatgagttcggctggcccctttccctctctccctctgtcctgagtattctctctccctgtcatgccttccaccgtgttatgatgcagcaagaaggtccacaacagacgcagcccttctatcctggactttccagctaccagaagtgtaagaaataaatttctgatttttatacattacccagtctcaggtattctatcatagcaacacaaagcagactaagacagcctgtatcatagatgtagaaaatggacatagattggttttgaatcttattcatggtcacccagcagttaagtgacagaatcaagattttaaccaaagccttctgactcccttaaaagcttgtaactccaaacttccatgttctgtaataaatagcatttttctgttgagaaaggaaatgtggaagagactggtcctagccttaaatcagttgggttattaggaaataaagtagggaaatggaaagtaaagtttaagggatagaagaaaaaaggtttgggctaaaaactacctttccctatggaaataaaatgactagagaattaaaccttgaaagatccataaggattggtgtaaaattcttgtcttttcacttttgaactggtagttcaagcataagaaagaaacagtgtcttctcaggaagatcctgtttaaaatgtgttcctcgttggaaatgctaaagggtacacaggtttattggtttgcaagggctgttgtaaccaaatgctacaacctgggtatttggttacaaccaacacagagtttttgttgcaaactgtcataaattgtcagaataattctggagtctagaagtttgaaatcaaaatgtcagcagggccatgttctcttggagactctaggtagactctttccatgccttttcctagcttctggtggtggctgtcaatccttgtccctcaacttgccggggttagaactccagttccttcctctgttctctcattctttctttgtttctttccattgactttttataacaacactgcttagattagattgagtgcaccttactccgatgtgacatcatcataactaattttatctgcgacaaacttatttccaaataaagtcacattctgagctactgagaattaggacttcaacatgtctttctgtgggacacaattcaacccataacaacaggaaaaacacaataaggcaatcattataagttttatgtttcattcttgaacttggtagatattgagcatttaaaataaattaaaatatgttaaatgtataaataactatgagtatatatccacgtgcatctacgcaggccatgttttatttctaaatagtacatcatttaagtgtttagcaatttgtattatgtactgagattttatatctagataacaatgtatttagaaagagatttttaaatatcaccccaataaagaaaccagtggaagaaaactgtattaagtttcctccaattccttatttagaagagcatatagtattcaagtcaaataagttgttgaataaatgaccttttggtaaggtaaattattatagtaggtctgcaagatgagcacagtcattgtaggaaaatctgttgctgagtatgctttgtgttctttttcatttagttgttctgtttggttttgctttattttcttctctgactgaaagccttaacagaaacaaaagtgtttctctcatgtgaaatgattagctctctttctcaccctgacttcctgtcccgacttgaatagaaagcaatgcatgagtatctaaataggaatcaaatgttctttgacaaagatgcaaaagaaacaagaaaacaactggattttattcgtttctcagggacacgttcactgaactgcaaaagccaaaacacctgggaaaatctgcctaggcaggcagggctgtgaccagtaatggaaaatgcatctctgtgtgggcttagagggctgggaactatcatagactgtggctggagtgtgatcaagtaagattcaaaagagagagattatttcagaaccatatagcataaaactgaaacgcagagaacagataaatgtatgtgtctgtccttttaggcagaaagcatccgttttgaaaaaacatttacctgtgctgatttgaagatttcaatatgtgcctttccagagtacttgcaatcatcattgtgtagtgagccttcaaaaatgaaggcttgctgaagaacaccattacctgtgagtctgagtgtgttgtgggttgggtcatccaccagagcagatagggtagagagggcatctgtagaccactaagtaaaagaaaacatctgaaataccaccttctttattcagccctttggtttgtttgtttgaaatgaggtctcgccctttcactcaggttggagtgcagtggcttgataacagctcagtgcagcctcaaactcctgggctcaagtgatcctctcacctcagcctcccaagtagctgggactgcagacacatgccaccacactcaccaaatatttttatcgtttattttctgtagagactgggtttgactctcttgcccagagtgatgttgaactcctgggctcaagtgatctaccaaagtgatccagcctttcagtgccaggatttcaggcatgagccactgtgcccaacctcagccctctaatcaaagaaatagtaagctgcatagatgccaagtgtagaagttgaagtactaaatctctgctgtgttccagcattgctagggatgaaatcccctaagtttatttagcacttaaaataatactctctagtatccaagggcctgaccacttctttatcagtcaccacatgcaggaagcagtgtcagggccggcggggagtgcttaaatattctatttgcaaatgctctaagttgcaacagttagaatgtaatgcaaccccccccccaaatttagaagcccaggagggatttattctacccataagtagcaatgaatttgacacttgaagaaagttattgtgtataaatcaaaaattcagtgattataaattttgaatttttgtttgagatgaagggtggagaggaaaggtgggagtaggtaaaaataaatccatcgaggtaattgaagtcaatgaactttgtcagtcagtatctattatcataaaatgctataactgtcaccttgggcttatacagataatgaggactatctgtgttttaccaataaatttctttgtgttggtttagcacaagccttatacaagcactgaaaatgctaggagtaattttttttcttttccagttgacttttttttttttaacaaaactgtaacatgtggtttgcaattagctttaatttcaaactaaacatattttaagaagccaagtagtttttatgcatacaaagtttcaggattcctctcctctctgactttttaagcaaattgctgtgtctgggccccatctccacattttcacaacttaattcttagcactttcatctgaccacattctatattttgggaagcatccaaaggttttcttagggacttgaggtgggtgctaaaatatttttgtttgcattttttttttctggctacattagtttcttgttggtagtgagtgatttttcttaatttggtgattttcttatattaagattatgactttttaaattgcataggcaaaaattattagtttaaaattccagatctcttcatttctatcaggcatatctattggtaattttatcaatgtttatgctcatgcctagttagtacttcaattagcaaattaattgtacttttcataaaatacctttttaaagtaaggttgccagattaaatgcagtttgcccagttaaatttgaagttcagataaacaacaaatagttttgttccagttaaatttgaatttcagataagagcaaatcgttttgttttgttttcagacatactttttcacatagtaagtacctatacaaaaaagtatttgttattcatctgaaatccaaatttcactatttttttctttgttatttatttgtatatttattttatttttgtctggaaatcctactataaagaaagaagtataggaaaatttattggttaaaaacatgttatatatcaagctatctgtcttagttggttcaggttgctataagaaagaccttaggctgagtaatttagacagaatctatttctcacagttctgggtgctgggacctccaagatcaaggtgccagcagattcagtgtctggtgagggtctctccttcaaagttggcaccttctatatttcctcacatagtggaaaggagggtcaagctgccctgggcctcttttataaggacacccattccatttatgaggatggagctcttatgacgtaaacacccttggccccgacctcttagtactatagcagtggggattaagtttccaactggaattttggagggacatgaacattcagactgtagtattatctctaaaaatgtgtgtaattgactcagttacatttcaatgattagagagggaagggtaaatccaaatttaagatcttgttaactttgattcattaattcattttacaaatgttcaccgaatgcctaaaatgtcaggtcctaagggatgagcaaaacaaacttaattcttgccttaatgatatttataacttaacggagaagaacattaaccaaataatctcacaaatacatggtaaactgtaataaatacaataatggggaaggatgacattcatacatataggggaatgtgttggaaagggaaagtcaggcaagatttccctgaagaagtgaaatttgaattgttaaagaaaacaatcagtcaatgatacttgttaaagcacagtgaggctgactttagtcaggtctattgcaatagacatagggaccatgaaaatgggattttgcaatgggggagagaaattgaacgaaactccaaatatagcatgcacaagtgggaatttatagccaagaagtagagtgggggtcagtggatggaaaattgctaagaggaagcatctggagtaagaaagattcaaactaaaccaaccaaacatgaatcttgctgaagacagaacagagtgattaggtatcatctgggggatggtggaggatgaagaacctgctcatatattgagagtgatcaggtatctgtggtggaggattcttgctaaactgacttagcagggttcttgctaaaactggattttacaaggaagcacacaggagagcttaggagaaggaggctgactgaattttggttaagcaaaggataattgtcagaactaaaactaaagccccagtgggactaaattaggcaaagaagagtgtatcagtctgttctcacactgctaattaagacatacccaagactgggtaatttataaaggaaagaggattaattgactcccagttcacatggctagggaggcctcacaatcatggtggaaggcaaataaggagcaaagtcacatcttacatggtggcaggcaaggcggtgcgttgagaggaactcctttttataaaaccatcagatcttgtgagacttattcattatcaggagaacagcacaggaaaaagatgcccccaagattcaattacctcccaccgggtccctcccacaacatgtgggaattgcaggagctacaattcaagatgagatttgggtggggacacagtcaaaccatatcaaacaggtagaggaaaggaagtgaatttatacatagatgaggcatcaagaacaaaagaattgaaagtatgtgtcaggttgaacccagtgagcatagaaagtgttactaaaaattctgcaaaggaagtctaaccagatcaagcatgactcagcaagctatttcaattttgatactaaaactcaatggaaagatctaccaaggttttaaaagactagtaagatttgcatttgaaaagatgaatctagctgctcaaaagcaagaagattattgttgaaggcaccatttataaaccatttcctggtggcctgtatattcttgtagcaaaaagaaaatgatagctcaatgtatatcagatattggcaaactttttccataaggggtcagatagtaaatgtttcaggatttgcaggccatacgatctctgttgcaagttaataacagaaaggtataacaaattaatcaaagatttatgtgacccaagagccttcaaaaatgaagacccaaagatgtagggaaagctatctgtttttctgctaagtttagcgtagaatggacagccgtctagaaatgcgactggacaaaaggatatgatttgctgacaatagactgagagtgtggcaaaccgagccaggctgtccagacacttcttggtctctctgtgtaacatttcttcctccctggtatagggcacagccccactggaatgagggtcttcaaggaagaagggagaagggagagagtaacctttcagaagttttatgacttgctgtgggaagagagggattcaagtgtctatgacctgccttggagaagacgaattttatttcctatgaactcactatgggggagaaaggggagcagaagacagggggctgggagaagggcagacagaggctttgctttgagggcttctaatttcctttagttcaaagtccttgggatgccaaagcattatattttggagtattctcttctaagccacaacaaactaaaaaaatgaaaatcattttatcttaatacaaggtatatgaggcaattgaagccagcaggggctgacatcttctataatgcttaattgctaaagtctttccagtgcttctccattctgggtagatcttaaattatcttcacttttcttccctgctatatgtcttattttctgatatatttgtttatctactggtgattatcagctctgctccctatcaccacttgttgaactatattctccatgatttttaatattatctagtgtggtgcctcccaggcaatgttcatgacctcacaaatgggtcacttgttagccttggggcaccagggcagagtttgatgaggctttggatgggctggccacagtgatcatatatagctaaaagtggcctctttcattattcttgacagtatgagtgtattactattttctctctatgccttgacttggaaaaatttggaaaaccctgatcaactgtaacggaaagagtcagtaacaggcatatcagaggttctctggttaaggaagtagatattgaaaagagaaccattttggggtcagaacactggttctcatataccagctgatataaccttgggcaaatagtttctctaagctcaactgactaatttgtaaaaagagaataatagtagttgaacataagaagtaactgttatgctttttttgagagtatttaattagataatacttttaacttctagcatggtgttgagaggaaaactttctctgtcccaacttaggtgtgtgtgatgggagaggagaatgtgaatcaattgacaacagatagattaataggagaaaagttttaattcatatgcatgcaggaggcaggagcagtgagtaaccttgctgaatagccaaggataagcagtatacctagttaatgtcaggagttcgagaccagcctggccaacatggtgaaaacctgtctccactaaaaatacaaaaattagcaaggcatggtggtgcatgcctgtaatcctagctactcaggaggctgaggcaggagaattgcttgaacccaggaggaggaggttgcagtgagctgagattgcaccactgcactccagcctgctgggtgacagagtgagactccatctcaggaaaaaaaaaaaaaaaaagaaagaaaaagaagaggttctaagacttcagtgggaaagtatggaaggttctactgttttttgtttgtttgttttcatcctgatgctaatggagttttcttcttgactgaaagctccactgaaggagggtttatggcagctgaatttgtacatccttgtgttaaggatctgtcttctctcaagcaggaaacaccctcagaggggagttactgacagctatttttttgggaggctctgcttgaatttagataagaattttttttcttgttgctgcagttagttcagatgttttcagtttaaagtaacatttacaccagtctggtagattattggtcccttcagaagcgatagtatacccttgtctaagtcactgttctattcctacaactagactcaaaagaattgtcttaccttagaaagattcatcactttgtgtaacactcactttgtgtaccaccagttaagttcagcagaagacttaggtgtagaaaggtatttcagatttcttggcaaaccgttcacatagctggtaacaaagtgcatcatgaattgtgaatcactttcacatttttgtgctgataagaggacctctcatggtatagcccagagtaaactaacatgcatgacgtgatttattctaaccaacccgatgaaatgcagatgtgaatggaagctctaggcaaaatattacatggtgtatttcactgaagaggagaaaaatgtattgactagcaaaattttaaatatctgaaacccaaggtggtggtaaggactagaaaaattattttgattgcagaaaaatgtttttttctccatttctttttaaagaaaaattcagcatcaaaagcagatatcgcaggaatcagtcctaatgattatattctcctattgttataacaactgaaatgagaacacaacctaaatgaatttttctgttgagtttgtaaaaagaagtacatgttacattaaattcactcatccatgcatggatctttagaaagaaatagtttgaaaaaatttcaagtcttttagagaatgtgactaatctggtctgggtatttctggtcagggtgcatcttctctgctacagacaattcttgtgtctactcaaaatccatgtgttgaaacctattcctcaatttgatagtattaggaggtgggactttcgggaaatgattataagagtgaggctctcatgaagggaattagtgcccttagaaaggagggcccagagagattctctgtgccatcagccatatgaggactctgagaagacggcctgtaggaaccagaaagcaggccctctccagacaccaaatctgcctgcacattgatcttggatttgctagcctctcaaattgtgaaaaataaatttctagggttcataagtgtctcagtctgtttatgttgctataaaggtatgcctgaggctgagtaatttataaataaaaaaatttgatttggctcatagttctgaaggctgtacaagaagcatgatgccaacatttgcctctgataagggcatcagtctgcttccacttatggcagaaggcaatggggaaccagtgtagaggtcacatggccagagaggaagtgagagtgagagagagaaagagacagagagagagatacagagagatacagagagagaaagagaggagggaggtgccaggctctttttaactactagttctttcaggaattaatagtgagaactctcacagcacccccccgacactcacagtcccctggaattaatctgtgcatgaagggaccacctccattaggccccacttcaaacactggggatcagatttcaacaggaaatttgaagaggataaacattcaaattgtagcaatacattgcactgtaagttgtattgtgttatgacagctcaaacagatttagacactcactttgaaaccctttgcctgaaccttttgtgtcataatcctgctgctactgttgatgttgtacacataccactcattggaactgcaagaccaccaggttaccgtatgatcatatttttatgtgaatatatatattaaaaacctttaagccagagatatgcacataactcttattgaaattatgattaagcaaagtgaaaaggtgatagtcctaagtatcctttttctaaggaaatgattagagtattgctttacagctgttgactttgcaagtgtccttggagtacggcattccttccactctccccttcccaacccccgacccagtagttaatggtgggcttctagtacacacgctgagaatcatctcccactttggaaatgatgataactcagaatggatcataaccggactcgcgatagttttcatagacaggtaataaaaagaagacattcaacatgaaaaattaaaggtgttacgaagatgccaagagatatattcttcattttattgtagaattatcagaaggagatgaagagttccaacctttaagagcaggcaacagtaattttccgtggttctgtgggacaccttatgcttagcaatgaaagtgtgtaataaactctctggatgaaatattaccgctagcttccagaactttattctgtttatcctctccatgggattctgctataatgttaactcttagaatgctaagatttgccaatgtctgacacttccagttcatcagttgtggttctttatgtgaatatttgactagagagcttcagaatgttataacattctttaatggaaagggaaaattagttttcggatgtgagtttcgttttatggaaaactaaattttcttccatctaagaattttaacttatgaaattataggagacaagaagtatgttttttataaatagtggagtgtttctagtgtcatctgccttgtctgaattttcacatcaagtaaacattttcttagagcatttatgaatcatgaaacagtgtttgtctattaaacagattctggtcataagtttttcaagggcttaatttataattctctccagcaccttgattctttatgctttgtctgtattaaatttccatcatctttttccttttttcttattgaaattatttgggggtcaaatacattcatttttttgttattttaataaagaaaaccgaagctatgcatccaagagcacataagaaatttattattcatgaatatacatttatatgtgcaaatgtatgtataatagacttaatacgtgcttgtatcattgaaaaactttgttactaacaggctttgggaatcatgtctgtgacatgaagttgaaacaagacaaaaaaacttgagcaccaaatttgctcattggtggtttagcaactgtgtagaatttcaaggattatgtcctcattagctgatactgctctagatgtactatatttaatgttatacttttctgaatatactaatgttcaaaaaagaatacaattaaaatattagttaatatgcccacttcaggtgcaaacacattttacatgtgtctccgcacaattccttgtttatgtgtgcattttaatggtttatttagatcttatgttctgtatcttttgtgatattctcagtacatttagctacttaaatttgaaatgtgaaaattattctttccttcctaaattgatctctaatatgatagaaaatttttagtgcttactataaacgtcaaagttgggtatttatcttttatttgacaaaattcatatatatgaatacatgcatagtataacctttagtcagtgaacacccataaagtcaccttacttgagttaattaattcgaaaattatgcattcactacttacgggggtgttaaaattttatcttgcggtggggttgcaaactctcactgcaaatcccttaaacattggcaaattacagtttcacatataagagatagaactagtatcctgttcattcaagaaaagccagttagagcaatgttgtctaaggtggcctcttgatcgtggccaaagctgtcctgggactagagtgaagcaggtgaagtgcccggggtgtgcttcacactcttcagtctcccaagtgcccatcctgttcttgaacaaccctgaaagttgttcaagtgaggtgccttgggggcaaaatttaatgaagtcctcactctcaggatcatgcatctgtcccctgaattttgtacttgctacacaattgtctaggtcctggactgtagcaggtttcacaaaaatgtgtacagggtgcccctcctgtgtcactgagctgcagccagaggcagtgtatgcatgcagaaatgaatgacagtctcttggaaaccaagcgataatcttgtataatgttgagtgatgctagcaggtatgtggatgtaggccataactgagcacttctgaggcaagttgcatacttacctgaaagtgcggacccttttttggtagctgcatttttgtaattattggatcccatagaaccatgctcacttgtgagaaataaggggataatttgtgctcccaattaaagttttttggactcttgatgttgattccctgcaagaggatactggaacttgcattggagaggctgagttagggttttatggatagacttaagccaaaggcaatatgaaattgtccaaatggtgtagggttctctttgtcccaagagttatattcttgcaaggagttattcactggcctatgtgtgaatgaaaatatggccatctatagttaatgtattgggctttagtgttaggagacagtgatatttgaaaagtcatccacacatagtgaaaccattaataatcaagatctaatgaataaactcagccatctgcagagcctcctaaaacactgtgtttaaatacattgtagatgcaacaagagtgatgcaagtcagatttagaagaccaggctgttttccagaaagctgtaatgctctgaaatgtattgtaatgtttctgaaataatggttggattgttataacaaaagtgtgatggtttgaaaaaggcacaaaaaggggaacgaaaatttaaaattgctagtgcatatccaggaactggtatgggttgtggttcttgatctagataagtgctttgctctccttagatagttctagcctttgtatatcaaaggtaatagtcatactacattgcttgaaacggaattcacattttgatacatctcaccttacattggagtctccttagtagcgtaaatgaacctgatcatctctcagtatattgatgaatacaattcctgtacatgctaaaatgagggctccgattttgacttggtgttgaagtcccttcttagttgccactctctctcattctttttctggtgctgcagctttttgctgcctccttcttccctgggcttgtggcagcaggtcgagtgtattgggttatccagtgggctgattccaatttagatcctgtggaagactgtgctttagaggagggatcagcaaaccacggccacatgccaggtctggcccactgccattttttggtatgactcgtgagctaagaatggtttttccggttttaaataactgaataaaactttaaagaagaataatattgtaggacacatgaaaacttgatgaaaggcaagtgtcagtgtccacaaagttttatcagaacacagccacactcacttattttttgtactaccacagtggaggtgagcagagacagagttgataacaagagaccgcattacccacaaatcgtaaaatatttactctctagacttttacagatctctgccctagatagtccagggaaatgagctgaaagtttccataaaagctctgacgtctttgcagttgtcgtatagttcggtcttcaaggggtggaaagttgtgttgtggaagtgcatcctggaaaaagagcggatatgagaaggaaagcaaagggaatgaaggtggtgatattatttttttctggtttatattgacaatcttgaaactgaatcaagaatcaaacttctaaattcagattcatttaacaattcttaaaaatgctttatgttccagggatcaaggttggtgatttatgagaaaacaagaacactagcccattcacaaaagtcatctcaaaacataattatgcacttttctgaatgattgcttaactgtttcaattagtatgtctcctctacaagtagtgctctttatagggtaaatttaaaatctctacattcaaagtctttatcctctttctatgtttcttctctcttctccgttctcctgcctcccttctccctttacatctctatctacactaggtgtgaaacactggacaagttacttaagttctcatttactctcattataaatgagaacttacatactagggccttacttacatacaagggctattttagaaacgttaaataagaggatctgtagtactcagcatacacataagtaacacaggcaaattttgattcttataatgtgagttttcttatgaaactaagaagaaagtgattcagaagtgctacattaataagaaaaaatagaagttcaaaatacatttactgttctatagctacataacactttattcttgtgaaagtttaagaatgacctgctaagtatttcagttatcaaacctaatatatgctgggccatttgggtcatgatttttatccgggaccaggcatgtgttaccgttaaacactttcattcatcatttactagctaacagctaaacaaaactagttgtgtaatgcgaaatcactaaattgctgcagtagtcacttgtaatgaataacagaatattacactgccaataattacaggtgattaatattttctggtcagtttccattccaggatttgagttatgtggataactggaacattccaccttttatgagtgacaaaatcttaatccacatcaagagttctgtattgtcctgtgaatatctaaagctaaagaaagaatttagagactgtaaactacattgaaggagattttaaaaagggggagaaagggaaagagaaggaaggagggagagagtgaagatgtgagagagtaaaggcaggggaaaggagggagggagcaagaaaagaaaaaggaaaagcattattaaaaagtgtccggtttaggcatagtcaattcttatatcaggaagaggatattaaacggaaaagagatgcataaatcaatatcgtctctattttgagggctattaaaataatccttaagtttctttccatttctgactttgatgctaagattgctctccaaatattatatttttcattatattctatgccatttatagtttgtaggagagaaggaaataaatgatgaggtcccatactaaagctgaaaatttttaatctctcagacaacagataatcatgtcaccgtgcataaaacataaccatcagtagtaaatgtataaaactgagttgcttaaagtcatagaataattgcttctaccaactttgtaagaaagagtatactatttttgcataaaatgtaaattaaagttgaaatattatctgtgttgaatggaagtatacaattctttctcggtacagggaatcagtagagccttacaggaggatcttccatgttgcttttagtttgggtgaaaactgttatcactggatttgcattaaatgaagttccttcctcttaagataggatgattggcagggattaaggctttattactacaagatttctaagccaagcttctctttttcatgaataatacctacccccttatttattcatggtatttttgacagctgacagttcaggaagtatatgtgcttctgtattaactattaaagctctctgtttacatatgggtggagatggctggtacatttccacttactccaccaggtatgttaaaatcataagtgaggaaaaaattatataataaaataaattttataataaaataattaaaattattataaaataattaaaatataatattttaaaattattataaaagttataaaattattataaaaattattataaaattattattaaaattatataaaatattatattttaaaattattatataataaaataattaaaatattacaataaaataaagcaagacatgtggaagtattagagggaaatatccagagattatcaagccatatttagttgcaccttttctcgtggtattccatttcagtgattttaaaaaatatatcaatgatgagtcaactagatacaaatgttattacttctggaattcactttggccttgttgaactgaaatagttctatgtaaatgtatatctgtctgtctatctaatttgcttagttttacttctataatacaagatttgacctttatttttccatttattaatatcatatttccatggtaggtcttcctagagtataaagaaatcaagtttctcaaaaataatagtgttaatatcaaaattgcgagtgagtacaaagagcatcatgccaagtgaatggcttatctccagaaaagctgcgtcctggtgaaaaggggaactgagcaaaatgcacattttgattgtgtgtatcagataaattatagctgccagcaatcctctctatagggagaaaattcacaggatgggtttatccaaaggaaggaaaaagggtcatctcccctaccttgctcttgtctgagcctgcagttgctgttttcattcactcccacaggggtgattatagagcagcctcaacaccaaagcaggcaaaaaaaaaaaaaaaaaatgttggcggggcgcgatggctcgtgcctgtaatcctagcactttgggagggagaggcggggaggatcacctgaggtcaggagttcaagaccagcctggacatggtgaaaccccatcactactaaaaataaaaaaattggccaggtgtggtggcgggtgcctgtaatcccagctactggggatgctgaggcaggagaattgctggaacctgggaggcggagcttgcagtgagctgagatcgcaccactgcactccagcccaggccgacaacagcgagactccatcaaaaaaaaaaaaaaaaaaaaaaaaaaaaaaaaaagctggactaaagaaaaaaacaaactacaacctgaatacagtctttaaaattattaggccagtcttagtttttttggtgttttcaacaaaaatatcctgaaccattaaatctgggtttgagtcaagaatgaaataataagttgaagtgactagactaagttcagtgaaggaaaggaattgagagatttttcttaggaaatagataactgttgacaagtaaatagttattaaaaatatatgtcactgcagtgtcagccacttatttatttttaattaaggatctgttgacctttttggccttaaataattgtgttaaatagaaaatattgccatttaaacttctgtgtagattactgttaactataatttaggaatatgcttccttaaagtttttgtaagtttattttctggatcatttctcaatgacttgattcttaatttggtctaagtgctattttctgatgcttttatagagtttaccatgttggtttaaaatatactttgctgccagtttactaagagagtagctgagatgtactgactgaattactcttagttgcttgtatcctaattatagaattctttactaatccaaaagtaattcagcaaaaatacttgactcagtaaattcttattttaatccttgtattttactataaaaagatattttaaaatatttctttgagacagacttttctttcagtacaataagatatatgaatggtgctgggcatgctggctcatacctgtaatcccggcgctttggaaggctgaagtgagaggattgcttgaggccaggagtttgaggtcagcctgggcaacatagcaagaccctgtctctacaaaaagtttttgaaaaatgagccaggtatggttgcaactgcctgtagccctagcaattcaggaagccaaggtgggaggatcatttgaggccaggagttcaaggttccagtgagctatgattgtgctactgtaccccagcctgggaaacagagcaagaccttgtctctaacaaagatatatgaatggaattaaaatgttttcttggagcctcttgtcattgatttagaaagtctatttaacctctgttcggttcccaatgacaatagaatgtctttcttttctcatttattttttctgtcgtatcatgcagctctcacagaaataaagacagaacattaaacaggtgtaccttttaaattctaagattgtaattttattattgaatagaacttcacttttagtgctttccaaatgatggtgcctatttgatttcctttaaattcttctctttacacatgacgatttcacttgtgttgactagtaatctttggtttaacccttccgcactttttgttaagtctaaagtttaaccctttagactttctttactatgaaactatctaaactagaaacatactagggttcaagttaagataatgaagagtcatctggtattaatgggaaacaggagtatgtaaaacccgaggttctcaactgttttcttcctttcattctaggacaaacattgatgtgtgagatatccccatgcatttgagaacctttgcatagactgtactgcagccctacccctttcccacaactgttcactgctcacactttctcacccttcagcacacacatagaaaaaatagtactgaagtgctcagtagtagttaagagtgaaattaccgatgatttcagtactgcattttagccagaaaagtctaaggtaggcctaggaagccaattcagaccaagagatccctttctcaagtaggtcatgtttgtgccttgagtttctatggctctttggcatccattgtgagcgagatggacacagtccaggaaatatccctaaggaatagctactggtagcagatcccattatcaatacagttgtactataaaaggcaaaggcaaatgaacattacaataggcatttaactttcttttttttttttttttttttgacagagtctcattctgtcacccaggctggagtgcaccagtacaatctctgctcactgcaacctccgcctcccaggttcaagcgattctcctgcctcagcctcctgagtagcaggtattacaggcctgcaccagtacacctggctaattttttttgtatttttagtagagacagggtttcaccatgttagacaatctggtctcgaactcctgacctcaagtgatccacccacctcagcctcccaaagtgctgtgattacagacgtgagccaccgcacccagcttaactttcattttttaaaaatttatgtcaacaagctaaaattcctcttgattttgcattacagttaaaatatcacaaggtatcattgaagaagtttaggtgctcagttcctaaaggcccttataaagtcactttcctagaagccgttcccttttctccctaggttggttgcatatccttcttgtatatgcttagaaagtccagcatttaacatgcctagatcttgctgaatgttaattacctgcatattttaagcatcttttacccctgcatcctccattagaccgcaagtccattgacagtatgtactcaacactagcagagggctgggctcaagttctgaaacatgtgtgactttggatatcataatatccaatgaccacccacttgccatttctaccctttctattattcaattggtataattctgactagcagaagtattttaattcaaataccatcattttctgaaaataatcatgctacatctatgacaaagtgtcacctaaaattatttcctcattctcattaagtagaaattcctaggccaggtttatttatttgtaaatctcataagtttggatttaacagttcttgtttattaaaatcaattatgtggtgatttgtgagtttgaccaaaagctgatttccctactttattttagaaatttatatcttcagtctatactgtttttatatttggatataaaataaatttacattattcaaaaacataaaattcaaaagtataaaggaataaaattcaaaattcaaatataaatgaataagcaataaaaattatcttgttcccctagcccatccattgctctttccaatggcaactgatgttgtagtttcttggttattcctcctaaaatattttgtgaaatacaccaacaaattcatatactgtgtaaaaggtacattagtttattccctttgaaaaacaaatattgatatactatacaattttttgtccttgaaatttttatataacatattacagtgatcttaatccatacaagagaacatcctcattcactttataactagataagcattctattacatcttgtatacaagttgagttttgttcgttgtgtttcatttatgggatacaaatccagcaggaatttacacacaagtcaataatgtccccaagaccatatgaaagatatgagacctcgatccttggcaggactgactgtccattgtaccatgttgttaaagtgactgaaggttattgacttactgcaataggagttagatatctgatttagttgagtatatccatttcaaaaggaaaacccaggacttttggtgtttaatcattttgtgaaccttaccttaaccctttcccattagattggacataaacaatgcttaatatcagtgactaatggtattagttcttcagcctggcggccaaacagagcagttcagaactaatcagcaagatacaatcagatagatgccagaggtgagggataatttttattttctctgttctgactctctggagtttcctctttgcagtaatttaggtcatgtctatatttactggatgaaagatttatctgttgaattctttaaatggtggcaccaactaaatctagttctttgcaacagactttagaaagattaatatgttctatgctttctaaaaaaggtagtatagataagacttgtccctttttatttgaagttagaatgaaagtaacatttttgaaaattaccattgtcttattgaaactcaataggtaagtatcgttctccctaacttgaaggttcagctaatattttgttgagaacttgcactttgccaggtactattttaagagccctacctgtattaactctttgagttcctataaggtaggtgatgatgttatccccattttatagaatgggggaactgagaagcagagaacttaaggacttgctcaagaaaacagcagaactaagatattgtaaagccagaattagaagcaaataaataacaacaaacaggacatttggctccagtgtcattactttctatggctaaatttatgcgacttctcagaggaaactctagttccagaagctcaaagtcatgtacctgcaaagtggtaaagccaggatttgaacccaaatctgacatcaaactctgtagttttattcactgtataaatagagagatatgattaaatatatgtattgatatataaatataggtaaatatatttgaaataggctatgtgattttgaagtgggtgaattttctcttgtgccgtctctgaaccggtgttagatttcttgaactgttttatgattccatgctatggttaactatgcaattacttctgcatagatgcccgaaaaaatctttacttaagatccattcaattcgtgtttcttcggtaaagtcttccctggccatgctttccccaacccggcatgcgtaacaagtcaagattatcagtcactccttgatgtcacttctgtgtcttcttttttttttttttggagatggagtttcgctcttgttgcccaggctggagtgcaatggcgtgatctcggctcgctgcaacctctgcctcccaggttcaagcgattctcctgtctcagcctctcgagtagctgggattacaggcacatgccaccacgcccagctaagttttgtatttttagtagagacgggttttcaccatgttggtcaggtttgtctcgaactcctgacctagtgatccacctgcctcggcctccccaagtgctgggattacaggcgtgagccacaacgcccagcaacttctgtatctttttacataacttagttaaggtacttaccaatacatgcatgccttttgttaatctgcaatacctttatataaaatatggtgacttaattttgtatccaaagtatgttacatgctatctgactcctggtatgcactcaattaaaaaatgtaggaagtctctgtgaatgtattctggttcgagggttgcctgattaaaaaaaaaaattaaaagtcaatgactctgacaccatcctacatttgtctaacttaatacgtcagtagctgtaatgaattagagctctataacttgaagaaatgtgatattgtttgataaagtaaatatagaataaaatctttgtacgtcgtttgttcagatgaacattttaaaaataataaatgacgtttatcctttgtccccatgtgtgaatcaagtctgtgatatctctaaactctggtactctgaaatatctcttcctgacctgctacttcacttcaatacactccttcactcccgcagagcttgctcttagcttcagcaggatctcttcctgttccatccagatgccctttcctagccttggtgctcccactcatcttctaaatgacagccagctcagactccattcacctttctagttcccccgagagagtctcaatcccatgtcaactcagttgttagctttcaccctgcacctctcagctcactgcatacaggcggagcatctgtctttttatccccagggagaagcaaaggtatttggattgccctaaaacactcagggaggacttaacggatagtcacttctaaagcactctttctgttccaaccctttcactgtgtgcctctgtgcagtagagaagtgagtctactaatattaatgtgtgaaacaaggaacacttatcaaagtagctgccatcagtgagccacctgaagtggaattttatttgtcttgtactcagcaccaaagcagaatatcttgctttttttggaagaaatcaaaataacacagattttactttggaagatgaaacacactagcatgtctcatctgttccttcttgatgatctgtcctcctggaagtatgacagtgttgacgtagatgtactgagttcatggaacacaagcctattatcgttcctctctgtcatatggaaagaggagaactgagagattgagaaaaaagttaaaacacagaggacccaagtgtaacgtcatgttaaaacatttttgaaattatgcaaagagaaataactatcaaaggagaagaatgaaaatcaatgagtaacaattaaaagacgggattttttttagaattcaaaaattaatagaattggtagtgctttattttcttatacaacatttatttagtgatatctaaacgttctttggctaaagtgcaccttctttttttctccctcttccctccctccctctctccctccttccctccctccctccttccctcccttccttccttccttccctccttccttccatcatcacaggtgtgagtgttacagagattatctcaatggttaatctgtataaagatgaatatttcctttatttctctccgctgattagcgctgtctcaaatggcaaatgttttaaaccctgatcttttgatgcacttcctgcagcctcaccccacccccaaactcaaagagagtaaaatcacagtgttcctttctctttctccccgtgaaactggcaaatccccaccactacccttgctaccccacccatcaccattcatttctaaagcagacatttagaataatcaggacagcattttggcagggcgcagtggctcacgcctgtaatcccagcactttgggaggcctaggcggggggatcacgaggtcaggagatcaagaccatcctggctaacacggtgaaaccccgtctctactaaaaatacaaaaaattagctggacgtggtggcacctgcctgttgtcccagctactccggaggctgaggcaggagaattgcttgaacccgggaggcggaggttgcaatgagccgagatcacgccactgcaccccagcctgggtgacagagggagactccatctaaaacaaacaaacaaacaaacaaagacaggattcttacacttcctgtttccatagaatctatagaaggtctaaagtacctaggatgccgtattagtccacaaagccatgatcagatttccagtctcttgagcctagcttagatcttcagaggcacaatgcaagacggtttttaacagagaaaatgtgcatgaaggaccttttaaattatagcttctaaactttcagcatcccttcaatgatttcatactctgactatttttgcatcttcctgacatttgcagttcccttgaggcatatattacagtacacacactacccatggttagataatcacaagtttagatatttgtgaatgtttcagctgtgaagaagaaaaatgacttcaggcaagggtacttgtgaacatcatcattgaaaatctcagaaaattccatttgcatatatccacatatgtgagcacttggttgattctcctcctttacttttgctactattttgttttgctttaggtcttcctttcttttcatttatttttaaaccagagtacatttatcctggacattttctgatgtttatggggggtgaggggctatgtgaaacttgatgccaattgacatgaaatctatttttctgaagagaaatttgaggtatctaggagaatgcattttcaatcccttctcaccattaacgtgtattaaatgcccaagctaagtttgtccttgatgtttgcagagaacctaaaatctctggagaaatcagatattttagggtcataccaacaaaggaacacatgaaaatgaaggttactcagaaacaagctttttaaagctgaggcataaatggcagagctgcccattgagtaaaatgttctgcaccgtaagagtgaaccggaaatggatagaaaaataaattaacatttaaaattatactttgtgtttaagaattgagaaaatttgataggccctgtaaaaaacaccattagaatgagaacattctaaattacatcgttgaaatagtagaaaacacatgtccttttttttttttttttaaaaagtctttttttaggtgttttaagtaattctctttttctttttcttcttcttttttgtaatttcaatagcttttggggtacaagttgtttttggttaaatggttgaattgtgtagcggcgaatcctgagattttagagcacctgtcatctgagtagtgtacgttgaacccagtatgtagtttttctccttcacccccttcccaacctctttcttctgagtctccaaaatccattttaccactccactctgtctgcctttgcatccccatagcttacctcccacttacaagtgagaacatacagtgtttggtttttcatttctgagttacttcacttcaaagaatggcttccgcctccatccatttgctgcaaaagacgctactttgttctttcttatggctgagtagtattccatggtgcatatataccacattttctttatccactcattagtcaataggcatttaggttgcttccatatctttggatttgtaaattgtgctgcaataaacatatgtgtgcaggtgtcaaaaaagatctatttgtaatgtttcattcctagttgccaacatgccaacaaaatacttttttttaatgacagagaacttaaaattgatgttgaatttctgtttttcttttgttactttttacaagtatctgcaagtttcttgctgctaggaagcataaaatagaaactatttgcatatgcatttaaaataacttctgacttatatcttattttcattaataaacttcagctacttcactggaaataattttattaccaccttgtatatagttgataagaaatgagactctagaacctcattagcatgtttccttagacacataatttaacctcaattttctcatctgtaaaatgaaaataataattgtgctttaactcaaaagccaaagtttagacacatactgcactgtaataggcatgatgttcaataatgaaatagctattattattattttgctatagagaaagatatataagtaacattaaaatttggaaacaagttttccatattttcctattaattaaaatatttatttttctcttttattgttttatatattttatgcttttatggtcattgcaggaatggaagtttaaggctcaaacttgcaataagtagagccagttttaattatttatgctgctgatactcaaagtttagttgaaattttaactagtttttggtttgtttaaactaattcaaagtttagttgaaatttaactattttttggtttgtttaagtccctaaaggtagatatattgattttaacctaaaagctgttaacttaggattctacactttgccatggaggaaaagaggttgactaagtgcctcctttgagaaacttaagatttaattaacatttttcctttccctctgcttcatccatacttcctttcaacaaaagagatttttcatcctttatgtactttctaatattccatagaggtttatcactttagttttcataaacttgcaaagatgatctcaaataaacggcttcaaaaataggacattaactgtatgtgtttaaggagggaagagattgtagttagaatacttaactaaatgagttctatcaaacattggagaagtactttagaaagagtttactaattgacaaatgtaaaatatgccgccctgaaaattttcagatgtagtatggtgtaaaatatgttcacaaataaacctaaaaagcatggtgagttttttcatatatactctttaaacatttggtcatgacaaatctatgtgatgtttgggtggagactagtgctcaattatttcccagaatgctaaaatctaaatgtatgccaaccgaaagtctttaaatcagatgtttattacttaaaactgaaataggttaacctttcctagatgctctgattaagcttagtcctcaatgactgatgtacactggcttacactaaagttattaacctaagaatcttcccagcaagtccatctctttcttgatattatgatctgtgaagtttgaacaaatgttgtttttcttcaatgttatttatctttaaaaaaagtccaggagtagaaagtattcctgatactcgataaaccagtcctctctgaacaaggaaataaatacctctctccaacttttagaaacaattgaatgacagccttctagtctcctattactgagaagattatgtgtggctttaagacacaaattgtaccttattagtctatatggccctctacccagtactttgcctgaaatataagtgatactcaatgaacgtcattttaacaaataagataataaattaatgagcagatatagacctttttaaaactcatatgacattttgcctgctccttatagagtcacaaagtatatataaataagatgtaattagaatttgtgttaatgagaatttaaaatattgtgatatagaaaatggctgtagactttatttacagacaagatactataaatttcccttcccccattgttacctctaaaaatttccatgatttcaaagctgttgagttcattgaactgttaattcttcctcggaggcagtgcaatctctgcaaaacaaaaacactctggctctgtggtttacaataaacttcaaatatgaagggttttttgtttgtttgttttgtttttgtttctgtttttgttttagacggagtctctctgttgcccaggctggagtgcagtggcatgatcttggctcactgcaacctccgcctccggagttcaaataattgtcctgcctcagcctcctgagtagctgggattactggtgcgcacaaccacacctggctaattgtttatatttttggtagagaggaggtttcattatgttggccaggctggtctcaaactcctgacttcttgatccgcccacctcggcttcccaaagtgctgggattacaggcgtgagccaccgcacctggcccaaatatggagtttatttgcttgttttaaaatatttattagagaataatgtgagtaattttagtcagtaatgtgcagttattttaaaattcaaaattattatcatttaaaatcttttcaatatcccattgtaatggtacccaagcgacatttttgtgtggtagtgtatagatctagaacatttatctgaagataaataactttgaaacagagtttaacaatgattcaaagcttgggaaaagcctaaacattcatcctgatatatccgaggaagtccttcctctagaaatcttttacacctattcctatggaaaacttagcttgaattatacaagtttttcattctgtgaggtctttgggatgaattcctcaagtgaaatgagacacctccattgataaccctctcagttacatgaagttcctgccgcacagtaagacattgtatgttttcctgccttaagtaaagacactttgttgcagaatttaggtaacttactcaaaaccctcagacacgtgagtgacagagcctagaacacagttatcctaacactcgatccaggaatgtttctatcacatcacttctaatcctaaatctaaaagtgaaatctaacaatagcaaccaccacaagaaagagaaataaaaacatgaaatattgtcatgtaagtcaatttgtaatgatatttatgttttactattctaataataactaatgcatattgagtatttcctaatgaaggtaaaatgcaggtaatatgcttaacagtacatccactgcgtactgtgctaagtattttacctgcattttattactttatctttatgggaaccatcagaagtgcatattaatattatctcattttacaagtgataaaaataggactttaaaaagttcaataactttcctagctattagatgtcctgactagatctgacttcagagcttgttcttataacccatctatgattccaatttacagtatcttcaggactaaagtaaattgttaatgtttaacactttaaaaaaagataccagtggaacacttgattttctaaagcacacagagaattttcttttagcacgttaggtatagaatgtaatacatttaactgtaattcagactgtgaaaattaaattatagaaaccttgtagcagcatttctttgagtgttacatcaggtacatttcagttaatatttgaggattacaagatattttattaaaatatgtttttctaactgttaaaactcagagttaattattttttcagccaggtaatttttttttttttttttgaaatagagcctcgctccgtcacccaggctgaagtgcaatggtgtgatcttgtctcactgcaacctctgcctcccaggttaaagtgattctcgtgcctcggcctccggagtagctgggattacaggcgcccaccaccacactaggctaatttttgtatttttggtagagacaaggtttcaccaggttggccaggctggtctctaacttctgacctcagatgacccacctgccttggcctcccaaagtgctgggattataggcatgaaccactgcgcccagccgataatttttttataaattagttctgcttgatcaaacaggaaaagcttgaaggtcagagtttgaagtatttctgacttatttatgaaaatgagagaaaaagaatgctcttgtcttgatgaaagccttattaagccgctcacattcccaaatttgggatgttagagtgaaatcttcagcctcggccccattcatgaaaaatcttggaagcaagtagtgatttctcaaactgtgatgccacccatttttacaccaaatatcagtgtttctgggactatcatgcccctggtgggtgtgtgatttagaatgctaatgagcgttggcagaccaccgtagctcctgctgtaatcctcacactttgggaagctgaggcaggaggattgcctcaggccaggagttcaagaacaacctggccaacatagggaaaccccgtctctcaaaaaaaaaaaaaaaatgaaaaaaagaaagaaagagaagaaaaaaagaacatctaatgaaatcctaggagaaacctaggtcgaatcaagcaccatgttgggtccagttggtcttaggtcgcttgacctacaccctggattttcagggtcttatcagtccctagcttctgcagctatttgaagtttccttttgatagtcatgtgaaactgctgcctgaaattttctgatctcctgcgatcaccctgtattatttctgtctcaaaaggaaaataaagcttgagaccccaattcactctaccaaaagaaaaaaaaaaaagctgaaagctgagtcgtacaagaatccgcctttccttttgttcctaagcagatagctacaggcagaaggttaaatatccccacaggtagctactctatgttcatcttatcttatgtaaagtgtcagtttactgagctccagaaaaatacataattgactattgccctagctgctccttttgttctgcaccttgtagattcagtaatgtggccataccattcttcattcacctccatcctgcttttccccttcaaatatcgaagccgtctaaatcatccttagagaaaggctcagacttctcttttaggcattgtccttaaccttggcaaaataaacttccaaattgatcaagaaaaaagaaaaaaaaatgagtttcgcttgtcccaccatttacccctgccgagtggtcagatatttgtagcaaatttagttatactctcttaatatctataagcaatccaaactccattctcatagattcacacatacacacacacacacacacacacacacacacaagcagtttttttgtaaaggtactattttgttaaaatgtgaaaggatgcagggttatcttttcaatgtatattcaacaaatgaaaagatttttggcaccaggcatggtggctcacacctatagtcccaattactcaggaggctggggctggacaatcacttaagcccaaggagatggaagctacagtaagccctagtcatatcattgcattctagcctaggcaacagagtgaaaccttgtctctaaaaacaaacaaacaaacaaatgaaaaactatgttgggatcttcccttttgttcttctcgctccttctcttctttccccacctctttatttctctactttcttcttttttaaagtttgtttttggcatttctcaaattattttaaaaattaaaggcatccttattgtaattttctaatgtttttaatttttattctgtgttgtatatatttaaggtgatacaacatgatatttttatgacttctctcacaattaatatcaagttccagtttgtggtgtgaaggaatgatgtgtttcaagtattttatcatggatcttcaatttgtggccttttactaccatagtaaattgactgtaaattagaaaggaaccttaatacaccaataaaatctataaaaaatttgtctgaaagagccatgtctctaaagacaatttttaaatagagacaagatgtagcattttaatacatagaatgtaaagtaaattcagagtttacgtcagaggggtttttctgatttatttatttatctattttgttgttgttgttgagacagagtttcactcttgttgcccaggctggagtgcaatagcacaatcttggctcacctcaaccttcacttactgggttcaagcgattctcctgcctcagcctcccgagtagctgggattacagccgcccgccaccatgcctggttaattttgtgtttttagtagagacagggttttaccatgttggtcatgctggtcttgaactccggacctcaggtgatccaaccaccttggcctcccaaagtgctgggattacacgtgtgagccaccacgccaggccttatttatttttttaacccactttcttcctccatagatgtatggtgatgatagagtgcccacttgctgactgtgcctatgtgtatttaaataatttaaaatttaaaaaaaaatccagttcctcatttgtactagccacattttaactgttcagtagccccatgcgggcttgtggctactttattaggcaccacagacataaaagatttccatgatcatgcagtgttctattggacagtgccacacaacatactttggtatttaaccaggaaagtcagcagtattgcagaactgtgtgggttcaagccaatgttgtttaagggtcaacagtatttatattttatatttatatatttcttacatttatatttactttatcttctttcctttttttcttcttcttccctttttccttcctcccttctttccttcatgtcttttcttcatgtctttctcccttttttatttttaatttctttgtaatttctctttttgaccgagttcattaacttttttttaaaaaaaagaactatttcagcaagaccatgacattggctcacccactttgtattcatttaggagtgtgtctgttttctcacccccacctggtatggttgctaaatccagatgaggataaagagcacagatgttctcctccactgtgtggaagcctaggctacactcttgccttatacttgatcatgtcaaacgcattcactagaaagggatacaaagaagattctaagattgtgattttacctataagtgtatttaaacagcagcaacctatgtccagaagagaggaaacagattttccaaatatcagtcttgggcctgggtcattatggggaagtgggatcaatgagatgaaggtggtaagatccatgtccttaaggccagtccttccgccccttcttccaccttaaccacgcagcttagattgcaacccagattcctattttactcgacctgtaggtaacctgtaaattggttactctcctcctggaaaatctaaagttgttatatgagaaaaagttccagtcaagtactctggtgtttttcttgatgtatggcatcttacacagtttggctgtgtccccaaccaaatctcatcttgaactgtagcttccacaattcccacgtgtcatgggaggcacctagcagaaggtaattgaatcacggggatgggtctttcccatgttgctcttgtgatagtgaataagtctgatgagatctgatgggtttatagagggaagtttccctacataatctctctcgcctgccaccatataaggtatcccttgctcttctgccataactgtgaggactccccagccatatggagctatgagtccattaaacctctttcctttctaaattacccagtctctggtaagtctttattagcagcgtgataacagataataaagcaactatgatcaaaatgtaatatgaaaaaaatgaacattatatttttaaatagcatgtgtgccacttacattttaaaaacattcagtgatcgagattatccattattcctgtaaaccctgcactcattatacacagtgtctgaagtgttaatagttcttattggaatcattgccctgctgagttcccaacatcccaacaattcagcacatctcaccagtctctttctctctttcagcttgcaggtaagcgaatgaaagttttccctcccttccctatgccttctggatgtgtttcagtccctttgaatttcagacctgccttcattttagacactcttctgagtgctgaatgccacagtttgaagttcactgcatccccctcaaaaggcattaattccactcccaggttctttctctctgttggacaccaagggtctatgattttggaggagaatattttattatattaatgtatttacaatgccaagtattgtacaagtttagaaaggaagaagaagacaaaacactttcctaaaaaattgcttataacctgcagtattcaaagtcaagttttcattagaaacctttgaaatttgcattatagtataatttataaacatcaaaacaaaaagcttttttaagaaatttttttgagacagggtctcactctgtagcccaggctggagtacagtgacacaatcacggctcactgcagcctcaacctccccacctcaagctgtcgtcccaactcaacccccaagtagcttggactacaggtgcacacctgtagtccacctgtagtccagcaagggacgtcttacatggcaacaggcaagagagagcttgtgtaggggaactctcctttataaaaccatcagacatggttttatagcatggcaaagacctgcccccatgattcaattaactcccactgagtctctctcttatgacacatggaaattatgggagctacaattcaaaataagatttgggtggggacacagccaaaccgtgtaagatgccatacctcatgaaaaacaccagataatttttttgttggaattttagtagagacgaggcctcattatgttgcccaggctggtcttgaactcctgatctcacatgatcctcccagctcggcctttccaaagtgctggcattataagcatgagccaccattcctggccgaaagcattctttttttgtaaagtgatgtactttagatggtttggatcctctcttttactgtcatctattttccacatgctttctaatcccttgagacttaatatttaaaaatcctaattttagccaggccatgcataacagatctgtggaagaaactgcattgtgaaataagacctgtcaaagcaacaatatttaagggcagctttgatgtcaaattgaaggctggcattttagtttggaagtatattcatctattctttgacttcataaattatatttagactactagtggctacaataatgaaattactgtggattgtaaacatgaggtattgctactgtggtctaccatgtatccttaatcgactcagtttttaaattgctaaaattcaacctatttgactctgtcagaagagctttaatgttcttcatttgtgcaaactttgtttctgtcacccttgacaaatcctaatagggattaatttagttacgggtgacaggataagctgcaacggcaaccctgcattctgccatggatccaaactagttgtgagctctgtttttcttgctgcaggcagaaagtttgctgaatctacaatggacaccacaatgcctgactctcgtttccatctcttacttgttcttgtttaacataacctcgttcttgtgtggcccaatttaaaattatatattgtggaggtatttgcaattgcagtaataaatatgtgttctacacttttttaatcacttgccagtctgcattagccttttaattattaataaagtgaaatccattgatttcctccagttgttcgaacatgagtctgacctaatcctgcctcaggcttgaggggttctgagatgaacagcaaatccttgagctaaacattaattttgtgggatttaaacatagtactatttttttattcctaacagaagctatttctttgtcttttttcttctgaatttgcagaagtattatgaactttggtctgttccgtgttatacatacgaaacaaatcttgaacaaaacaagtttgtgatgccactaaaatttgacctttcttattattttgtgctgatattagaagttttatcattgatgctcataaaattgtaggttcagaagactgtaatcacattttaaatttaagttgagcaccagtcattactacatcatttttgtctttctgtgttaggaagagctctgttttcctggttatattttaaaccatatttaagaataaatttgcatttattgaaaattttcttaatgaaatctcattttctattttctttgtttattgatataatatcaattaacatatttttattctgtctgcctatagaaattgaataatgtatcaatttctcttctcaatgtccttttacctgcaaaggtgtggtaagcaggatgaaaggttgcttttgaacagaaatttatatttggtctgatttacctattttcttttggaaaaacacagtttagagctttagcagctggtgaacagcattaactaaaacttccggaagacaaagcatcataagtataaatggtctatctcattgtatatgctaaaatgttgtttttcaaggacagaagaaaagttacctatgataacagtaccacaaaatgactagcacagagtaagttacttatatatgtgaatgaattaactattatattttatatatagttaatagtatagtataattataatatatagtaatatataatatatttatactgaacatcaaacaatgtttaattataacaactactttgcaaagacaacttcacatagttcaggatattcatatttatataaagtttattaaagttattacattctgcacaggctgatccccaagtcatatattattagtcaacagtcattatttgctattcatatactagctgttgaatatttaactcaatcaatgtggttgtttcttacaatgaaatctggagttcttttcttacttaaaaaagattgcagaatattatatatatggtaatttattaaaatataaactagactttatcaaacttagagttaattgtaatatttacaattggaagctgagaaatggaagattacaagtgcttatttgaccaaacagtggcaacagattttgtttttatgtgtgcggcctctccttatagagtgaaccctcataactgcttctaatcccaaatctcagggaatttgtttccaacaccataacagtctttcaaaagcaacggtgattatagtaacttcaaagcggcaagcatctgtactttaagaagggccagtggaagctagcatccatcttccataaaaaagcaatcgtgcttttccctgctgccacttagaagagcttccttggggaccttgttagatgctttcatgtgaagaccatttgacccatttctgattagtgtgcaggttttcatggcagtggcttctgggagggagatgccgttggctggtcgcctccctattcttgaagtgaaaagaaaactctcagtggaatatattaaggataataaagggaagaaaaaattccagttaaaagactggtgaagtattgaactactattaaaaaaaactaatgaaaacgtatttctatactgactgttaagaagaaagcagagccagtatcacagttccttgttttgtgctcagatgagttttgcgtcttcatttctctttcttgcaatatttcagaaatatgtagtttgagaatgcaaagaataaatgactttagctcatttcacctttattttgtcagttttcttttacctgaatcatcatgtctacatttaaaataacagtaaacaagtctttataagtaacaggaaagataaccaagaatgcctgcattgttaatgctgtaataattgtcatcatagcttttttagcctcatttaccttacctatcttcactccaccaaattcactgtttcatatgatattcatatcagcaatactgttggtatcaagatatcgacaagcttctaaccgtactacattattttttaactttaatgccaattcttcactaataactattattcaatatagaattattttaagatcctgcttgcctaaataggcccagtatttctccatttctcatattaacagagtgtttacattcacagactcaaactatgaaggaaatgattccttagtagtttctcttgctatttgaattttatttgtatagatgcataacggaagagttcagagcgtaatgcagtatttgctattttctaccctccctcctccatataggattgccacagtctaatttcctattatgatagattgattttaatgtagtagattgcaaacactgtgttcaagcattcttatttttaatttctcctgcttcatccctttaaaaaccacagctgttactaggataacaaaaataatgttgaataactgcttacttttccgctttcccggaggggtgggggaacagcaggtagcatagcctcatccccaaacagatgttactttattaaaaattgagtgttttggagggagtagaaggagatttatgctttaggagagcagtgaaattagaaggagtcagaatatgatatggaccaattcagcttttaaattcaagctttgcttgtattttattgatagcattttaattgaattgtattttagatgtgtttggattaatcgaatgcccaaggtccagcctgatattaagtaattgctatcataattagtcaactcaacaagtttttctagactcttcatataaaattgcactggataagttctgtagtagatctaaatgtaatcgtgtatgatacaattcttcttttatgagagtttaactgataataacactttactaaattatttattaccagaatttttaagggaatttaatatgcgatgcatgatacattgctctttatttaaatgtatttcactatacatttgttggattacattttgcatagcgtcttgtatacttctttaaggcatgaatgagccatagctttgaaagtccttttgttttgttagagaattcagacctgcccccctttttttttaacttaattgtggaagcattctgaaatttcaactgctaggaaatcgttctgcaataacttaatctttttgatatccaaataaccaataaaattatatattttcaaatgagtttttaaaattatatccaagaaacttaaaaaaaaaaagaaaagcactagccattctcacttgcatccatccatccctgagttaaaattctgaggattattatctcacctcctatttggacctgctttctaggttactatttgtttctatatacaagattaagataaattatggtaatatgcatatttccaatgccattgaaacaaaggatttataatttgtagaaaaactagaaaaatcagtcaaaatttcaaaactaggcagtctgtaatacacttcaaataaatttatttctttctgtatttttcagttgtttctctttgaaataatcaaattattaaaagcattctaatcaccttgcaatcacaatgtagagacaaaagagtgaatacgtgaaacactgatcttcacaattattgtgaacttaagctgtcgtactcttgtagttactgtgaccatcagcaactgaggacaattatgcagaatcattaaattttagttatagtacttaattaaacacttgcaattttttgaaggtgttggtatctattaagttttttgtttctacaatgctaaatatcttctagacataatcatcatattagaccctgtcatggttagattgctgttattaaatgtctcagtcatgaaagtctgtcaactgccaatgaggatggagagttcaaatcttgcaattagtcagtcagcaaaagtacattcagttgtttttcttaatcttgtcagtgtcattttatatcattaggtaaaccaagaaaaggaaggcacttatgtgggcaatttattccgtgatactatgaacctataagtagaacaattattgtttttcatttgtgaggttaatagaaacttcatcctttgaggtccatagtaaaagcgaatgcattcagaaaactatgacacgtttagattaaatataaatatatgttaaaattttcagattacaaatacttaaaggatatttaaaggtgtcacatctgaatttcaggaaactgtgtgagtattacacatatcattagattatccagtttttccaagcaaatattcagtgttattgtagaaataagtcaagtttctggggaaaaaattgctctctcacccaaaagaaagtccgtctgttcatattcgggaactgtaggtaactaaaagtcttagtcagtgagactgatcatggcttgttcatttgttgcaccctaccaaaaaagagattctgtgaaatcaaactacatcaaaactttcacagtggaaactcctttatggtttctagaattctcattgtaaaccccttaaaccagccatacctgacagcaataatcagagatatttgtttctatagtgaagtagaaatgcatcctctagaacaatcccgtcttcatgagtcccatcataacatgtgctcttacctagaaggctctgtctctcttctggttggcagcccaggttggagatgaagccttgtaagtgtgaatgcgattagttactttcattaaaagatcctcagtaagaaacctcttgatgccctcctgtgtatttactagcatcatcacttggcaaaaatgtatatctttcttttggcaaatgtgtgtgtgtatgctatcttcctgtaaataagtgcctataaatgttcaatagtattcataaaatgttcattgcaacaaattggtgtataaattgcatttatctttttaatagttttctgaagaatttccatttacttagtgcaaactatataatttttgttttgtaaaatttctgaaatgttcttcctagctttgtactgagttctcaatttgtctgcaaaaccgtttatttactaaatattagtaattgatgctacttaaagaaaaattaggagcaacaaagaaaaagaagagacataaaaataaagataatttttaaaccactattaatcctagtacttaaatgaaatgtctttaacatttagatgtattgttttctgaacatgaggaataatataacacagagaacattataggtcttttagaatgtatgtattatattttatatatgaatgaaatacactaatattcactacaataatgagataactaggatcattttaaagccaattatatgagcttctgggtttaattgagctttagacatctaagtcttttgtaaactcttttgatgcaggaaaaccaaaagagaggatttcagggaacatgcgggagggagtgagttagtttggaatgttagcttggtggagagaagggagtgttagaactgatgaagcaggttgtgggaagccaagatgccaagctgaggagtttcttctttattttattaactttgccagtgatattgttttgttcttgaaacaatcagagagatacaatcagagagaaacagggagactgaatgtagtagaattctcattgtatattttgtgccatgtaaaattacttacatggaaaaaaatcatttcctttggtaaagggctttctcttgctcaggtttactgataacctggatttttactaggcctcttttttctttgtattttaatttattttttttagagacagtctcactctcccgccctggctggagtgtaatggcatgatcatggctcactgcaacctggatttcctgggctcaagtgatccttccatctcatcctccctagttgctgggactgcaggcatacatcacctcccccagctaatttttgtattttttttggtagagagcggggtttcaccatgttgtccaggctggtgttgaactcttgagccaaaatatccacctgcctcagcctcccaaagtgctgggactacaggcatgagctaccatgcctgaccattactagctatctttttaacttatttaaagtcaagtcttgtaaaatagcctggagttaatagaagttatttttttttccttctaaaagtgatacagtcaaggtcctgtttcagaaattagcaaaattggttattgtcttttagcagttggttccttatacaagcctttgagaattcctttgaaaagataaatcaaattgccaagtttgattttttaaaaatatattttccttctttcagttctcattagatatagatttcaagaaaatacttggggcagtaaatgattctagaaaggcacttaaaacagttaactactaaaatagcctatttacatgctttgagtgaatgataaagagaattaagtttatttttgtcacattaattcccttcatatctagagctctccagaaaagctctgcagataggatgcccaatgcacatattccttggtgacaagtagtcaggataagttttatggaagtttcctaggaatctttttttctttttacaatacttggcttagtaaatcaatatttttgtttgggtttctgtttaaatcacaattcagtacagcttcagccactgaatcaagatgtgaaatccatgtactgtggcacacatttcaaattgtgtgttttaaagcctcaatctaagcaaattctaaattcctatgttttttgaggatggaatggtaccttaatgaccataacatgtggttagaccatatatctagaagtaaattgatttaattggtcatgataaggacttatatagtacttaatggtaatagatatagagttcgtgcagtctccttagggttagaattcacatggtgcctgtgtatggatccagatctatgcataactagctagccaggaagcaagctatctctatcttttaaaaacatttacacctatctaaagtagaaacttgtattatctttggaaaactgaggccccagaaaccctaagtaacctgcctaactcacacagctctaggagtcatggtgattccactgaaacccatcagcttgacactatgatgcaggttgaaatctgcagtgcgttgccttgggctaggttaatctgcccagagaggtattttgctgtgagtggattgtataggaaaagggtttgtgtggccagacagcagagaggaaatggatgaggaggcagagaaaatgatgaagctagtaatgaaagcattgacattgattaaattccacttcttagaattgtcactgattaaccatgtagcttagcattttatttaaaaattttccttatttctggcccaggatgccatgagtccaaggatttaggctttaaaaatgatagggttagctcaaaaggaaatggataggttgtgaattatctgacttggtgaattctaatcagacaaacagagctattaaaatgtttcaataacttttagggcattttcaaaaattagtagttaatatttctgaatggtactgctttcttttctgtaggctttatcaactattgatcatgtgaaatcaaccgtggattcttctggagtcttttggggggccttttaaagtaaatcagacattggaacacatagttctaagaaggagccagtacgttcactttagacattagaaattatccaacacattcggttcgtttaagtgtataaccgtacaagtaattgttttaacatatttaatttccatatttgttttaattaagaaattgtgttcaactttttcttctgagtcacacttctttgattgtttttatgattgccttgtaatcgttcaagaatcccttttatattggttagtatggggctaattatgcattcgcgagtgagctaaatgcagatgtagttaattctcacatctactccatgaggtaggtattaagatcttcacttcagagacgaggaaaactgagatagagcctggttaagtgagttgttaaaattctatacctagtgagtggcaaagtttaattacaattcaatgtttttctactacaaaattgatcttgttaatcctattccttattctgttcgaagtcagttttaacattatgcatacaatttttgtgttcttttctacctttcctgggagggttcttgcaagaataaaaacatagggttgtgtggcatttccggattgtttccacgattcttggttatttcctccatagaagccatgaacatagaggatacaaaagcattgtagaaagaagtaaatctgtcaagaaatgtcatgcctttgtttagattacttcctcatcagtccttgcagtttattgaaaaatcctgctctgggtggattgactatgagcttacattttattttatttctgctggtcatgtactactgcagagttgtttgtatttaaaaaaaaaaaaactcaaagaggggatttcaatccttaaaaggcaagaggattttgtttatctttctagaattcatgcagtgttgaatccaagtctcttctttacagctatattttaaactttttcaaggcagggacagtgtatttttatgtgaattttcatatacgctagatgcaactcagaattttatgaaatgcttcttgaattagattttgcactgtacattttgaagactatcctacctctttaaacagggagatacagaagtaaacctattgggctggtaaaaagggtatgcacttgaaaacttggtggcctttagaaagcattgagatattggactgagcacatcaagggacatattctgtgaaatcgttacagtagccagctagtcagatatgagcagagcaggagagtaccctccccacaacacacacaccaggaatgtcaggcagccatcaggcgatggtcaggcatttgttaccggcttctttaaaataataattggttatatacccaataatgggattgctgggtcaaatggtatttatggttctagatccttgaggaatcaccacactgtcatccacaatggttgaactaatttacactcctaccaaaagtgtaaaagcattcctgtttctccacaatcctctccagcatctgtatatacccaaaggattagaaaccattctactataaagaaacatgcacacatatgtttattgcagcactattcacaatagtaaagacttgcaaccaacccaaatgcccatcaatgatagactggataaagaaaatgttgcatatatacaccatgaaatactatgcaaccatataaaaggatgagttcatgtcctttgcagggatatggatgaacctggaaaccattattctcagcaaactaacacaggaaaagaaaaccagaaatcaaacaccacatgttctcactcttaagtggggattgaataatgataacacatggacacagggaggggaacatcacacaccggggcctgtctggagtggggtctaggggagggatagcattaggagaaatacctaatgtaggtgataggttgatgggtgcaacaaaccacaatggcacgtgtatacctatgtaacaaaactgcatattctgcacgtgtgtcccagaacttaaagtataataaaaaaaattaaaaataaaataaaataataattggttgcagcccatgtcagggaaaggcaatctcccagtaaacagaaacacctgaaaccggtgatcagaaacttctgaatatctcaggagttgggtgaatgggctcaactatgtgcactaaaaggcaaaatggcagagtttaactggtatatgaccttctatggacatttgactgttaacggaagaatgcctcaagtgagcgtgtgtacaactccagtaaacacagtgcacacgctcccctcccaagtgctagcaggccactgtgcatgagggcagcccaccatagggaagaatcaggagagaagggatgcaaggcctcagaagtacgccggcacacgaaatcctgagttaaaaggtcaaaccacgcacttgatctcccaagtcgcccacttggccctcttacaagtgtactttactttctttcattcctgctctaaaggtttctaataaacttttactcctactctaaagcttccctgagactctccttctgccttatgcccctcagttgaattcctatttctgaggaggcaagaattgaggttgctacagacccgtacagatacattccaccaccaggaacagaattagtaagcaatgatagaccaaacatttttcaattaattaattagttaattataactgacaaaattatgtatttgtggtgtaccacatgttttaaaatatatatacatgtggaatggctaaaccaagctagttaacatgtgcattgtctcacatatttatcatttctttatggtgagaacacttaaaatctactttcagcgatgttcaagtgtacaatacattaactatggtcactatactgtacaacccatctattgaacttattcttctatctagctaaaattttgaaacctctgaccaacatttccccaatttctctcacaccccagcttctgttaaccaccattctactctctgcatctatgacttccactgtttagagtccatgtgtaagtgagatcacacagcatttgtctttctgagtctggcttctttcacttaacctaatggtctccagattcatccatgctgccatgaatgacaggatgcccttgttttttaaagtctgaatagttatttcagtgtgtgtgtgtgtgtgtgtgtgtgtgtgtgtgtgtgtgtgtgtatttttttttttatccattcatttattaacatttaggttgattctttatcttggttattgtgaataatgctgcaatgaacattagagtgcagatatctctttggtatagtgattttgtgattttgtttccttttaaatatatacccagtcatgggattgttggatcatatggaacatttctatgtaccaaacatttcaatggagtaataaatcaagatgaaaaaagtggagtttgaatcagaccaatggagagagttttttttttaagttggcactctgttctcaagcctgaattgcttggaataggtcacttttccaaattggcactaggctcgaaaatggttggttttcaagttggcatttgctgaaataaaacactagcaccagcatccagttaaaggtacacaaataccatagttattttttattatgaggaaagaattggggaataataattcctcataacactgaggctgcaaaaatgttatatgacagtctctatatataataactcatggattcttggtttttaaataagcatagggcatggggaaattattaaaatagagcaaagccttatggaatataatatctcatgtgtaagtttatgtacacagcccctctatataaacattaagtgtgtgtgtatttgtaggatgtaaggaggcaaaatcatctcttagttgtgtttatatgaaacagataatttcatgattacattttttcttctgtgtcacttgcagtatgtcttctaacagttgttggacaactagctcagacattttaagagcctacagatgtcattattaaacttagtaatcagtctagaaataaacacacaaataacaaaggatcataaaggtcagcagtatggcaaggcataaacatggaattctagaacttgtttttattatgaaaagatgtattttgcagttcaaagcatgtcattctttgcatatgttcaactgaaatatgaaagaaggaaaattccctccaaatgactaaggtaacgttttacaggggacatatggatattcttagaatttaatgggggataggggaacttacctggaatcaattataggaaatttggcaaaatggaagtaaaatattcatttgctttgcttgttataattacgtttgttataagctttttaaaaatccaaaagaataaaatgaaagtaatttcaatcaatgggaattaattgtgttcaaataatagcatgacaaaagagacattggaactgattttgaataatagatttcaatatgtgctgagtaaagctctagggctgatgtcttctcttgtctgaaattttctaatactctccccaactgatgttgtttctcccatgtcttgtgttccttgaacatgcacttccctgaaagcaaaaatcacagaattgtttgtttacctacctatcccacgagactatgagtttcttggaagcagtgatctctcttacaaaacacttttggatcttcagttatttttaacacatcatgaacttcctatttcatgtatagtattgctagctcagggctgagagagcacaataaaggatgaataagaacttacaactaaatggacaaataaataaatgagtgaatatgatagtgtatgaatgttgcactgatatttacttattttgatttgatacatttcattgtaaacagtaaaaatgtagagaatattcttctctgtaaaaataaaatagtattttagagctttctttgtaaaatatatgtaatttatttaaacattacagatgtatttgattcaccaaaaaattaaaaatatcatagtaccattcatatctatcttcatattctaattatgattaagttttaaatagcagttatgtctttaaagtgaatgtgtgttatgttctgccctaaatataacttaacattgcaggtagaactctagtgtttgaaaatgtttagaagtcagaattgcaattactgagtgtgggataaatattagctataaatataattatgtataaatataatgaatataaatattagttataaaaagtataagcctcttccaactcttaatgtttataagtctactaaaaaattaaagatttctaatagtttaggagttgggagggaaaaaggaaaaaccacaaacaatgatgttggaatgcaagaaatataatttgatagtgcagaggtgagcaaaaaggtctgttgggccaaattcagcaaaattcaatgcagaaaatatttactatctgacccattgaagaaaatgtttgctgatccctgtatgtcatgaaaagataaacgtgaatttgatttgaatggcaaaaagtagaggtatgaagtaaaatgcatatagtccaaaatgtatatagtctccacagagccataaagatactccctgagactgcacaatttataaagaaaggaggtttaattgactcacagttctgcatggctgtggaggcctcaggaaacttacagtcatggcagaaggtgaagggaaagcaaggcacagccttacatggctgcaggcaagagaggaagcgaaggggaagagcttcttcaaaagcactttaaaagcatcagctctcctgagaactcactcactcactgtcatgagacgagcatgggggaaaccacccccataatccggtcacctcccagcatgtcccttccttgatatatgggattataattcgagatgagatttgggtggggacacagagtcaaaccatatcatagggatttctccagaatatttgtgttgtgatgctatcttacgtacttatttttaccttttaaataaaaattggagtgaaaatggcagagtcagaaattaatggatcaattatttttttgtttgtatcaaagtttgagataataaagataaatattttatcaacatggccttattaatactgtatattcaatgcaaaaggagtgctgactggaaaacaatttcaattagtaatacttattaattggatgctaagcctaattctgtccttgttttattttttttcccaagatattaaaatatatttacctataagttgaaaagtaaaaatatgactgcaggtggctcattttgttttcacatattttgaaagttctaggctatggtgcccctttttgtccccacttcatgctttcccatttctcggagacaagtcacaatttctaactatttttgctctttgaattattttatgcttctttgtagcaatgtgaggcttggaagaaaatgtacagtacatgactttctcaaagtttacattttaaatttaacacattggaccttgcatttcgagttcaggttgcactaatgagatttctttatgagcaaagacaggagaaatgtttaacgtttttaatagctgtaactctttttatatatagatatagggtcttgctatgtttcccaggctggtcttaaactcctgggctcaagcaaacctgctgccttggcctcccaaagtgctggaattacaagagtgaaccacccaggcaataattcttttttatgtttgtggatatatatctatcctaagtgacaaaggaatggacagtattcacattgcctcatgctttcaaagaatatatggtgcagggacatctagaaaatgggcttttggtggattaaaagaaagtcatgagtgggttggccaaatgatttctaaaaaaaaatcaactctagagtagttttctctaagccttttagaatcgtttctttagatatttatatgatcttataaacaaatatcataaaattatggttccaatttactgacacattgccttgctggaaatgtggtttcatgccaagaacaaatatgaaaaatgtagcaaagctaattacagtacaacatgtgtccatcatttgatcttttggaggagttaagggaaattcaaaagaaaaattatcatgtgcaaataaagagagcttagctatcttgcctactggcctaaggtttctccatcactcctgcagcgtttactttatgtatcaggagttaattaaggtgaaacatgaggtaattagggctaatcctcccagcctcctgctggcttgttgcctcccaggctattgcctaaaccaaactatgttcgcagttttaaaaaataatgctcgtgtttattttagacattactcttaacttttaaagttgccttattcattttaaataggactttccatggaaaaagtataaagaatgatcaaactttagttttgatttaaaaagtaaaacaagactcattaatatataggtggtcattgacagaattgtaagtttacacttgttcactttacgtgttactaacagatttaataaaatttgcattagtataaatctttagctttgattatgctggaaaggtgcatgcacttcccaagaaaataatatttcttatacagatttctcaatatattatgcatttggatgtgtatcagggtaattggagggaggatcagagaacaaaaacaaaaaaaaaaataaacaaacaaaaaaaccttccatgaactgcatttaggtattttatctttgaggaacattctaacttttagatttcactaaatagatctggtaagtagtgactgatttattctccttaaaataaatacatcgcttgtgtcaaatatttttaattccacactaaattgtttgtgcgtgtgtatgtgtcgtttatattttcactttttcaatgaaagtaaagaataaaaaggttttctatccttgttgtttctctaagttgaaataaaagcatgtgcttttttattaccctagtcttataatttaccaatcataatagaatctgtactcttgccaaagacatttcattaggatgtgaagactttagaattgacaccccctcacatattaattaaaaagcaaattgcaggtaagcagtcatgacatttataaaagggggaacttacatgggtaaaatctcttttgttgttttttataatatactatcaggactgggactaataattctattataaatttgatttggggagatgtttgttttcccaattgctatcaaaatttgacttttatttagcctacattgacttcttctgttccatctttttatttatttgtctgttttattatttttttagagacagggtttcactctgtggcacagtctggattgcagtggcttgatgatagctggctgcagcctcccttaatctcctgggatcaagggatcttcctgcctcagcctcttgcatagctggggctacaggcattcaccactgtggctggctaattttttaagttttaaaattttttatagaggtaggtccttgctttgttgcccaggctagtctcaaactcatggcttcaagtgatcctcttgcctcgtcctcccaaagtgctgaaattacaggtgtgagccatcatacctggaatccatcttttatatgtactcttaaaagaattgtttatgctagcatcttgaaatacatacatatatatatgtatatatatatatatatatagtcttttactgaggttaaaatcatttttttgcagagtaaaccagtaaagattgcagaacaattatattgcaacaagttgctaattcatagtttctgcttgagactctaaagcagttaatatttacattgttagatgtgtggccaaatcatgaacttttatttagtaggcgatttcataacctccaaatgtctgaatcttactctttttgtattgtattgaggaaaaaaatgatcattttgattctataggctttaaaattaaatcaaactctaggtagcattgtttgggttatttagtgaatttaatgttgattctttaaaaatagaagtggggcttttctcctgcaaaattgccaagagagcatttgcaccatggcatttaagaatatatcagttgagattttctattgatcccagctggggggatgagtgccccgagagaatacatgcgccggctttatgagggtccctgtcatcaaggatttagctgtttcatttacagattcctgtaaatgttcaccagatccatgaccagtaattttcactggagaaggactggaccgtgggtaagcaaatgactctttgtcattaatggtttcaagtagcattaaaaatgttctggcagctcagttgattttgatgaagctatgaagcccaactgcaatgtgtatctagctcatatttccaattataagaccaaggaaagaatcaaagtgaataatatgtaacgtacacacatacacacacaccctaattttgattacatagcttttcctgtatagagatttaacttgaagtctacagatgttcacatttagcacagcacaataaaaatacaagtaaaacagaaactactttttatgtaattaaatttatatctgctaatgttcacttccttaattgggttatctcctaagtgatcagtaaattgcatgcaataactaatttacatgcctccttagacactgtagctgcctgatgatttgaaaagtataagtacccacaagtgtaccaaaattcattttgaattaacagtgaataaagaaatcttcaaaaattcttgagacatgacagataaatgagttaacacatctctctgtggaatctgtttctatgtatcaaaactttttagttcatgttactgtttaaatgacctcccattaatgtaagcctgtcatttataaaaatattattattattgtttctaaatttcacttagagatgccttagaaaaatctatagctaattttcttcgcctgtattgcttctagtatgggctgactcacagagatgctgcattacacacaacaaagtgttccataatttgcaatatcctctcctcctccttccccttctccctcttctttcctcctcctcctcttcctcctcttcctcctcctcctcttcctcctcctcttcttcctcctcttcttcctcctcttcttcctcctcctcttcctcctcctcctcttcctcctcctcctcttcctccttcttctcctcctcttcctcctgctcctctttctcctcctcttcttcctcctcctcttcctcctcctcctcttcctcctcctcttcctcctcctcctcctcttcctcctcctcctcttcctcctccttttcctcctcctcttcctcctcctcctcttcctcttcctcctcctcctccccctccctctcctcctccttcttctccttcttcttcttgtcactctgtcatcccaggctggagtgcagtggtgtgatcatagctagctgcagtcttaaactcctgggctcaagggatcctcctgcctcaacctcccgagtagctgggaccataggtatgcatcaccactcccagctgtttttaaaaatgttttgcagagatgaggtcttgctattttgcccagctgttctcaaattcctgggctcagaccatcctcctcccacctcagcttccccaaaatgctgatattacaggcatgagctaccacaaacagcttgtaatctgtaatctcttataagcacagagcagaaataaaaatggcatcatttttaggttctcctaactcttcttgcccattcttcactgtctgcccaggaacaaagtcctgctcttgagtccacaattatccaagtaattctaaaggtcttctcatacatgcctggtgagggcataaattaatgaaacctttattgaggacaacttagcaatatttattaaaattaaaaatgcttgaagccttcaacccagcaattccactgctgtaaatctatatttcagataaatttgtgtatgtgaaaaatggcattatatgtgtcaacttttgcattatggcattgttttaaatcgtgaaagatttcaacctaagaaggatgaagtcagcaggggacttgctaagtaagttatggtgcagcttgttttgagccataataaaagaatgaggaagtccttcacaccttgctacggtaaagttaccaacacactttattaagcaagaagaataaaggtggtaaattgaacttctccattttaaataatttgtgtaaaaatggagaaatgaatatatacacatgtatatgtatatttatgcatattagcttatatgtgtgtaaactctatctggaaggacggacataaaagaaattaatcatactggctgtttatggggaggagaactggacaaagctaaaggagacaggtatgagcatggcatttttctttaaccactttaaataatgtttttatatcgttaagacattaaaaatattctcatcctttattgtttccttcccaacctgacatcccatgttcaaatgttcaaattacatttttcctcttcccctcttttaaatttccattttagtgctgtcaattttagttggctattagaaaaacaacccaaattcatattaatgtgtaggtgactcatagcctcagaccttccaggcgtgttttctatttagaagaggagagttattaacttgcatggaattctaactcgttaaataccaggcggttctaaaagtaccccaggcagtgcttgcacgatcatttgattaaagtgaggacagcaagccaaagacatctgtaggttctttaatccacatccctgacaaaaggacaaagcagtcactgccactcacaccaagattctacccagaggtggatgcccagagggcttccaaggaagttgcatgctggaaaactccaagtacagatgggacagagctgctgagctctaagccagtatatctaagtgtggttatcacacatgtggcaaaagacatataacacatggcatatgcttcatgatggaatgtttgttaaaaagaaagactctagagcccctctgtcctcaagatctactgaaggcactgtataaaagagccctagtttgagcactgctgtctgtcatgaattcgcttcatctgctacttttctgatttcagtaactggggacagtgggatctcaatcagaaaggatttgctcctggaacacccaaggcttgggcaatctctgagcagccaagcccagtgttctctgagttcaaagatctgaaagtctttgcaaagaccttagagacccatcctgccaagactgatcccaaaaatgctttcctaatccatttcctgaggctctctgctcactagggcccaaccccacacttcctgttttatagggatagttagcctctgccctggggcactgggctggtccatgtgttcctttcctaccctagctaatgtcttttgacatttggggatgcgtcagtgctgcagattctttaaactctattcatttattttaaaaaaatacttaataagggctgggcacagtggctcatgcctgtaatcccagcgctttgggagcctgaggcaggagggtagcttgggtccagccagcctgggcaatatagcacaacccccatctctacaacacaaataaaaataataaaaatatctagtgagtacaggctttgggaccagtactcttttgggccctggggattctgaaaggaacaaaagagaccaaaatcagtccttttgggaagtagatatataatagacaataaacaaggcaaataaagaaaacataattgttttaggatgaaactctaaggtttgggggtaaaaaagaaaaaaaaagtatgtaggaatggggagtggggacagaaaatgttctagaaagaggaaagaggaagtgcaaaggcttaaatttacgaaaagcgaggagttccatgtgagtggaacagcctgggtgggataaatcctgcaaatttgaatgaggtgaactgagagccatgagcaggggccaggtcatggagtctctttgggaactttggctttgatgctaagcgagacaggaatccattgaaaggtttgcgttttgttttgttttgaagaagaatcaacatgatctgacttactgaaatgatcttgatgttcagttgagaatttcccacatggtgacaaggcctgaaatacagagctccgttacagtaacgtaggtgagagttaaccaggtggaatcagcggagaggttaagaagtaattagaatatggtgtattttcaaatcaaaaccgtgaggattccatcactctatgtgaggatataaaggaagaacgagagtcaaggacgactccactttgttggcctaactggaagaacagaattgccacttactaagatggaaagactggagagagatgcaaatgttaatggacaagtaaaatgtggcaggtcaatctgacaactaaaaatggagctgtaatgtaggcagttggatgcatgagtccaaggaagagatatggcttcaacatataaatttagaatctttgtgtacatgtagtaatttaagtcatgatatttgataagtctacagatggagtctgtggaggcataagagatcccaagactgagctttggatcagttcatttttaaagattaagaagatggagaggacccagcagaggagactgagaaaaaaagaaaaaaagaaaaaccgtagctagtaggcagaaaaccaaatgagtgtcttattctgttggccaaatgaactaaatatttaaagatagaatgctcaactgtgtcagatgctacttaaggtcacagaagacaagtaacaagaactgaccgttggaaacagcaatgtggagattatgggccacctttataaaagcaattttcctggagtggtacaaggaaagtctctattgcaggaggttcaacagagaatgagagaagagactgtggagatagcaggtaatgataccacactagtgtcctgcagtacggggaagaaggaaaatgaggaatatatggagagaaatgtggatataacaggttttgtttttaaaacaggataaggaaaagcgtgtccatatgcttgtgggaatcatctagttaagttagaaaaattaatgatacagcagagagggggaaaattgctgaagcaaagtacttgagcagacaaaacaagacgggagctaggcacaagtgtagaagtgactgtaatgtaggcacatagacagattatcattattatgagagaagggagataatgggtgaaggaggtagataagcccagatatttggtctttgtagtgtgcagtccatgatgcattcattatttcacattaatgtttggaaaataagtgggaaccctggcatacattgtttggtaaagaaacaatgaattatgctgaaagagaacagatttccagacagtgttgttggagtctttatccattgcatatggctcctgttagagtcaatttatataaatagagaattccttttccagtcttgtttaatttaagcaatgaagtattgagtgctcctgaagattattaagactccacccctgccttcaggaagctgcccatctggtggaatgagccctaagatattttgaggactgctcactccacccatgatcccacaacaggaaagaatatttaacattagggacatccaggaatattcaggacatatgtttgccattactgtaattagtgtcagttgtttgtaagtgcagaaatagggaaataaacagtgttacaggagaacagaagagcaaatgctcaactttgtctgggaggtgtagagaagcaatgttaaggcattgaaacttactgaaatagaagaagagacaggagttaagcctggacaggtagattagggtcatattgaatgaataattgttctaaggggtatgaatatttttctataaacatcaatggtgacgttaagtatgtctgtgttttggagagaaatgtagtagctgtatggagcagaggctggccataattgaaggttgaaaaccattgtgtgtcctctgcaatagtccaggctaaatataataaggaagtgacaatgacacagggcgctttcagctccacttcaccagccagaaatctctgtggccagctgtgcccctgcccaggcttcactcggctctgggctcgccactgggctcattccacccacttggcccagtgggctgcactcagcttgcactaccaacccagggtagggcacaggtctttgcactcagtggctgagctgggtgtgggcagtttttgctttgggcaccagcatctagataaggggaacccagtggcatcggaaaactcagagatgccggtaaccacagagacctaggggttttatggctctttcccagggagtccccaggtttgagcccccaagaaatgttacatcatttctgctgcccgcagtgcagcaaacaggagggcatattacagcttattcatgttacagcttgttcgttcctgcagcccatagctcagcaaatgggggcatgttgtgcccagaggctttttctccacattgcttggtgaatgagagggagggttacagtgttacagctctttttgtacctactgtttggtgggttccgtgttcttgtcccacaaccaagaaggatgagattgcacagacattggagagtggacaaggcagggaagaattttattgagtgagagtaaagttcttgacaataagaggggagcccaagttggtggccctttgtgtgagggggagggcccgaaagtgggtatcccaatgtgtgcctgagtctggggtttttatgggctcagaatgagagagtgcatgctgattggtccatggtgggcctggagaatgcaccatttaattggctaaaggccttaaggaagttcttactctggtagtggactcccctcagaactggaagttcagttttcaggctttaagctgtctttggcttgaggttggatttcaccagagacctgtccctttctgcccagaaatttatctgccgtggcctggagcagtggctcatgcctgtaatcccagcactttaggagactgaagcgggtggatcacagggtcatgagtttgagaacagcatggccaagatggtgaaacaccatcactactaaaaatacaaaaatcagccaggtgcagtggcaggtgcctgtaatcccagctactcaggaggctgaggcaggagaatcacttgaaaccaggaggcagaggttgcagtgagccaagatcatgccactgcactctagcatgggtgacagagcaagattccatctcaaaaaaaaaaaaaaaaaaaaagaaaggaaatttatctgcctcctgctgctatcaacaagggcaataaatgttgaaaggagggagtacatctcattaagtttttaagcagggctttgacacgtatttagaaaataagagaaaaaataactgactatgaggttgctgtttggggtaaaagttacattttgatttcatttgtcaagatgtagattgccgaggatgagacagatttggtcagaaggtgagcaagcataatgagttcattatgtacatgttgaatattaggtaattttaagctactctaaagtctaggatttgtttctttgacatgtttcctgtcttttaatgaacgttgaatctataatcagaactcaacaaaagaaaactcaggaaaactagcaatatttaggtgcaatttcatgtgagggacattgactgctaaaggacaaattcattacatccctagcaaaatcaagggtttccattattttaatgcagggtagcagggtaaccactttttttttttttttttggcttaaaataatttttgtaagttacaagatgggccagacatactttactttcttttcttgttatatattcacaggcaatcaatcctttgataaagaaaaaataaaagtttagaaggatggttaggaggatgtgattaagtaatacagcataaagaaaaggattaatttacttgaagatacccttttctttcatatatgcccagtggaaaatgataatagttttaagatttccaagaacttcaataaaatatatgtaataaatgcatcaagcttcttattgcattgtctcagtcattaattatacaccaaaaccatttaatgtcagaatagaatgcttacttgaccaatccacaaaaactccattgatttgtaccactttagtctatggattcaatatactgtaaaaactttaaaaatcagtaaacttattttttaacaaactaaagaacactatgaaatgctatgatgttttctcattacactgtcatagtgttcttgtactcagcaatgttatcaatgacatagattatcatatgaatgtattatcatctttattgtgagattatgtatatttaatgcaatgcttttttctggaaagttaaacctaaatttaatatataattatggccaatatattaattcctttaaggtatttaaaattttctcatgttacatattttttaaagtttccttttttaagttcttatatttttattaggtgaatgactttattattgactaaagtctctgacagcagataaaaggaggaataaatgaatgaatatacaaactgaacaattaaataagccttgttgctacctcaagtgatttcttaaaaaaatcttgctttcagcaatgttagtagcccactgaaagtaacatccttatattttttttacctacagaaaagtatgtgaaaaagtcacagcagcctttttggtgcttcttgtttttcttcaaattgatatcaactgtgtttagcatggataggtactttgcttgagcaaaagttttcttagtatttctaaattagcttctcctcattttttggaggatattcttatcatcatattgactctgcaacatattagatgcatccattttccaaatcgtgtacatttttattgcggttataaatggtaatcttttaaattgtaaggtttttaaattaatcatggctcaatttaccaaagacattataaaatggactaaatttgctggatcttataatttatgatttgttcttttactttcatttatattttctcattttctttctttttcccttggagattcactatctcaaatattgtgtaacaccaaatctctttaagagccacaaagaaaagtattgtgattcatacattcatatgacagatcgcttacccaaatctccattttactaggagttatgagatgtagaaagtaaaggcctaacctgccttttccaagaactagtaatatgatggagagagacatttaaagtacagtacaagagagaatacagtatttgttgctgtagaatttttaaaaactataaactatgggagcacctagaaaaaattgttaaggagtgttaaaagcctcgttgaagttggcacttctctcacactgcagattatgaaggaagacctattcatatgggcaaaagggatggttgcaatcaggagaaaggaataatggtttgtttcctagagctaccattaaaaattagcataaattgggtggcttaaaacaaatgtattccttcttcattcaagaggccagaagtcagaaatcaaggtttggttctttctggagactctgagggagtaactgtcccaggcctactcttgaaaaataatagtttctcactattgtttcaatttattttagaagcagagagacagattctataaaggcccaaggcaacataaactcctatgtctggtttaagtaatgtcctatcatagaaaacgttaaatcatactttgtcagctcacagagatacattgacctatctaatagaataataataaatgttattagcaataaccgtcatgtattgaacatagttaagcgtttcacatgtatatctcatttaatcatcaccttaatggtagtactagcatgctctaggtagagataagaaaactgaggcctaaagagagttatctataaacatttgcttgtgataagcagaataataataaaacaaattgaacatgaggacatatattactatgaaaactgaaaaaagaaggagaggtggcacatgagcataaatatgaaatgatagtgcaatgacagaggaaatggaactctgtgtggtgtgatcaacttaattttcagcactttctgcttctgccttctgcagcaaaactcattacacaatataaaaatattatgtgctacttactatgagagtaaatattaaggctatagtacacattgctttgaaaccttgcatttgaggattgaaagctttatctcacaaagtagaagttaatataaactgccattataagtaaatggatatttgttaaaaagcaaacaaactgaagaacttctcaaaaatgaatttatttctaagctagaaaagcctaatatttttgaggtgcttcacaaggctgatatttttcaagtatgaccaccatagtgtattcctgaaaataggtgtcataggaataggtaaaagtgaagattactctgctcaacaccatgccttctgaatcgaagtttcaggaaacaaactgaggcaatttgcattataaatgaacatccagggtaattgtttaataccaaatacctgagaaccattggtgtaggtttaatgtgagtattcataacattccccccaacattaaaaaaaaattctttaatttttaactttaagaaatgacttcagtaagatggaagagatggtcataaaatgaaagggtgttctcagtctacagtggttccatgaattttcatttcaaaggagttgtattaagtaaatatttaaggtaactattttacagatgacttttttttttttaaatcaaataaatatgtttggaaaagccatgacctatttgtaaattcttttctaaaaagcctgaatgtgtgtatgcatatggtatatatggtcgtgtatcataaaataaaatgaaataaaataaggtagatattgggctttctcttgctggtcagaaaaaagccttcccatttcaagggactggctctaccaatcaggccaaatttcctgggcacacatccttctgggagtggttgctctctttactttccatttagcagctgtacagttgggaaatgttcaacagaatgaaagccacctgctcctctaatgatttcagccaaacagacaggattgaaggtttaccaaatgtgttgtctgtcactctgactctgctcaaaaaagtaaatcaaactggtcagatattcatatagaaaatgtgtcattagttaactcctggagtgcctgaagctcctttcaggctaccagactctgctgatttggagatgcctttttaaaatgaagaatggaagtgatttgaagagacaaatttggaaaatgaggcattctagaatgtttcccttatcaaatgctatatcattgcactctataaaatgagtagatttatgcacatttttccccacattgacagtttgattttagtatgtgattatatgttcccaatccgactaattaaatgtcaaattcccataagtttccaactcaccccttcttccagctcagtctctctgtattccctgaaaattgtctacaagaaagtatagtatggaagggaaaaccatcatagtctttcctatcacactggaaaaatcacattagaagtggaaattggcctccaccttctctggcagtttgggcacgctctttaatccttctgtgccttaggtttttaatctgtaaagtagaattattttatacattagatgtgtctggaaatgtcacaggacatttgttttcctgaataaatgttcagtattatgtggttttttaaatgttattttgagatacttttgttttatatggttatcccattaatatttacatcacgacaaatatccagagaagtttcattttatgtattttgttttactacaatctgatcgtgtataacattttttttctatggccatcttcaaccttatgttgtcaatattggttaacagagggtgatgcagcttcagtataaatttgtttgtgtaagtatttctgtaatctcaagggattaatgcttcataagaattagctcatataacgccatagaaataagtagagaaaaagcccacaaacttttgttgaataatttcaggaaaattctttatgggtgcacttttttgttggatcacagagctttagtcatcgaaagcattgaactagtgagcatcctcagcatcctcagtgagcataatagtgttaaaaactccataaacatgttaattgaagtagattttgaaaaagggaaaatgataagcagatagatatagaaaaataaaaatgggtaaataacatttatcagtaatccattggttatctttttttcaaaaggcatggtagaaattttattataatgaacaaataaattatatcagcctgaaataattttaagtttaaaaaacaagatctgctgtctaaaaatgttatttccttttacacattaaaatgttattaatttagactcctctaatttagagttcctcaaaatttattcaaatgaattagaaataatatcatgaaaaattagattcatgtgctgatttgtattcttgcatttaatgggcactttgctttatactcttctggcaattttgaatgctgaggcagcacactagaaaacgccaacatcggcagattagtgcaaaagtcaagaagccatttacctaattgctgtgtcagtctaactgcacaagcatcccactcggttttatggaactgtacctgaaggcgaaatcaagttggtgtagaataagacaggggattagcggttccttttgacattttatgcctttcatttccctcctgtgctcactgtatcttctggtgtccagggaatcttgcttagaaatggacatgaaggctaagcaggcatttatagctaatatgtacttttctactcctccatatcattatttcatggttatctttgcatcccagacggctcctggtacaaattgttgcacaaggtgggccttcaagacaccatttttaaaaacgtctttgccacgtcctcctgagatatgactctggaatcaatctgttcctaaactagtgtttcataaattagagtcagctcaatgatatcgaaccacagattcattcaaatagaactgcatttcaggcatggatttacaaatgattatcttaatattttcttgcaaaacatagctaatgtgttctttacatttatttgacctcccctggttggattgttctgtctttattgcttcagcatgcaacattgcctggacactcacagtgatttgcacctattttttatggatgtgtcagcctatgattatataattatatgactttttataaaagcgtagaaggcatagaaaataatgtgccctcattttatgaatactcaagtaccctttaaataaaacactttactcacttttagagatgatatgccactggaaagcaatcatttggtcttttatgtaaattactatttttcattgtttaccaattcccttatggcccatatgtagtgtaactatattttctatggcagtcagagttatacaatctagaagttaagtgattaataaagcagatttcctgggatcagatgcagtataatgctgtgctaatataaataactattttttccccacattactcattggaccaaaagcatcaaaatatattttatgtaaatgaggaccctacacttttcaccagcttatgaagcaacatttctttaatcttaccgtttagtttctaatatgcttttcagataaatttctttaaaagactagatgaattactatgtcatattaattgcatatttgttgtgtagttggtatgttcaattcagtgacattattttataagaagtagacctttcctgccatgagctttcaaagtagttgcagaatttcccatgaatgtgaaatacagaatgacaaatactgtaagtaaacatttaaaataaacaattattaaggttatactaggttgaaatgtatgaaattgccagttttcaactgttttgaccaaatataacctcatacaattgtattataattttacataatattttattcttcctcaattctgtgcctttgttcttcctggtttttctacttagaatgtccctccccacttttttctgacaggaacacttacttttcatctgtatggtctcacctggaacactatatgtgcccagcatttttgctgatattcacaagaagacttaagcactaccactactgattatacagattttacatttaaaataattcaatgtgtggacattttatcatatgtgatttcataaacccctaactccaccctggtgcttcctaaaacataattctcccagggtaacgttatgacttactgtgtccttcaggctagatgtcataatgtatttgtatctatagagcttattaacatgattggcatataacagtaggtaaattcagtgctgactgaatgaatatgttattctattaataattcagtaactttttttctttgaactgggaaaaatcttggagagtttctacttctttccccttattttataaatgagaatactgatgctcagaaaaataccttgatattgctctttaagagtggagttaaagctgatacagcacgagcaaaatactaaaaatcatctaaaattatatatgtgacaatttgcacagatattaaaccagagaaatagtaactctgggataactctagacaatgacaatcagagaaggtgttgtagaagaactgggatttaaaatgaattttaaaggacgggtagaatttggacaggcagaggaaatgggagaatgtgagtaggatggtatgagtaaagcattgacagaggaagacctaaaatgtgcttagaagagtgagcaaacagaatgttaatcaatgattgttctgatgtctttacaaagtatatgcttttacccaggggatatatacttgttggctttcttattttgatataagatacaatatatgtgaaattctggagactattcctttgagattgaaaagcgagtgatactttgtcaaagtgttctgtattacaagttagaataggattgaaaattaaatataatccaaaccttgaaacttggcttaaacataaatatatttctaatttactgaagcaactaggcttccacaatttgtaatgtaaaggttcttttcttttttttgttggttttatccccatgaaattgtttccatcaatttgagaaaatactgaggtttcttagtttggttcttttttgtatatgaacactgcgtgcccgtgtatgcgtgtgaagtcacaaagagaagggttggaggggagagttggaggaaacaaacatccccttgtcaatgtagtttagggttttcagctccttccatgaacctttgcacagtatgacatctacaggttatagatggttttctttctgtatttggtgttggctctaaaatcctccttagaaaaggcaacacaagtatcccttcccgattaatgtgaattggaacaaaaggtataaataccatagataaagagagatacatatatatgacgtagtatttgagtgagataaactcttacccatggctaatatttgagtgaaaggcaaattggtaaatattttctctattgaattatttttaaatcacttgagaatcatctgttgagttctcactacgtgcccagcagtgtgctagttgtcagggatgcaatggcaagaaaaaaaaaaaaaaaagacttgaatggtctttgctcttatggagctttgaactagtaaggagatatataataattacagaacaaatatacacattgcaaattgctggaagtatgttaagaaaagcaaacagatgatgtggtaaaaagcagtttggtctgttagaatttgagtaaaattaaaagaaaaaacatagcttgagatggtgtcctcttttggaggtggccaaagatgttctttctaagggggtgatacataaacttagagccaaggtgaaagatgaagtcacccatactccataaaagacagggacaaagtgctaagcagggaggtggaactgtatatgcagtggtactgcagtgagaggaactgggaaggagtgagggtgaagactgggtatgaggaggatggggtgatcaggaatagtcaggtcatgcaaagatgtgcagaccatgctaacgacttcaatatgactctttttttttttttttgatggagtctctctgtgtcgcccaggctggaatgcagtggcatgatctcggctcactgcatcctccactcctgggttcacgccattctcctgcctcagcttctcgagtagctggaattacaggcattcgacactacacccagctaatttttgtattttagtagagacagggtttcaccatgttggcaaggctgatctcgaactcctgatctcaaataatctgcctgcctcagcctcccaaagtgctgggattacaggaatgagccacagcgcccagccccttaatatgattcgtggtgtgactagaaaccatgaaagaatttaaagccaaggagtgcatgacccagttcatattttctaaagattcctgggattactgtattgaggttggattgggagggagcaagaacgaagcaggaatgtcacgttaaaggtcgttcagctgtccagacaagaaataatggtggatttggctagggtgatggcagtggaaatggagcaaagtgagcatattctagaaatacttgggacattgagctgtaaggactccaagtgccggcttcatgatgtgtgggaaagactgatcaaggagaatcgatgggtttctaacttgaacaacaggatggataaaggaaccatgaacagagatggggcccactgtggcgggcaggttttgggggtgaagaagatgagttccactttgtattctgaattggagatacctgattgtcgtgaaggttaagatgcttcagagtgttcagaaatcaggcgtgagattaaggtaacagataaggatttgaataatgggaatatatagataattgaaggtatagaaattctttttcttgatcataaagggggaaaccctatttgaatgtggtgtgtataatgtaaatacctacacacacatacatatgtgtgtgtctgtgtgtgtgtgtgtgtgtgtgtgtgcataaaacctaaggagtaaaaagaatagctgatatcatttggtcaggaaggaaggaaggaaggaaggaaggaaggaaggaaggaaggaaggaaggaaggaaagtttttcttgattgaagaaacccatgttcaattcaaccttacacattgaaatcatttactaatttgctttcatttactaatttgctttaattttcccccacaaagctgtatatgaatgtaaaaagaaaatgattaaaaatacaaataagattaactcagcttccaaagttcatatagggtaagaatttgcattgaaaatctgatgaaagtgtttgaactctatgttctctcccaagagtcatactccttttaaaatttgctaacagcgaacttcatattttaatttaacattgagctgaagcctctaaaagtgacatttctacatggaaggtgtgccagattcctggagagggcatatggaatgtgcggaatatgagcaacctgtttgtaggcatctggaggcactggaaaagggatgaggttaacctgaaaaccactggattcaggattagagtagcctctcttgccgctgatcctgaagttgtatcttatggaagcattgtcagaccacagaacgcttgctactgaaaacacagggctgaattaataattgctaatctatattttatttatgatgtgctagtcagtgttgtaagcacttgatgtattatttcatttaattattacaattcccttaaaatgggtgcaattgctatctctattttataactgaagaaattgaagtgagcttaaataatttgtagaagttcacgtatctcataagtggtacacctaggatttgaactcctgttcgcacaaagcatgtatcgtaattgttatttgttgtttgggatgagtgggttgaggggacaagaaatttcaatcccaaaggaaagaaatgctgtctttcctggatgttagttgatttcctggagtgaatggccttctggctcccactggccagggaaaaagaaagaaaataacagcaagtcgttaattcataaaacaattttcccaagtgcaaggcttgcagtttctgcacctgctacgttgctgactcatctcacctgaatcatttagtcagcttcattgtgtttgctaagactgctaattatcctactggaataatttaaactatcaataaagaatgcaataaatcattaaagatatggttaatagggagagataattttgactattcagcttgcattgatccttgatataaaaagattaattttatattccgtttttaaccttacaggcaaccattagccatttcttttcacagagttgagctgagctggtttttcattaaaaatgtggcatttatcttattgaattctagctgtgatatctcattccaggaacaaaaatatattctgacttaccaagaaagcacaacaagacaaatgttacatttttaataaaagtcattgtaaacaaatttttgaaatttttatgctttttaatctacccaagtatacatcctccttattcctattaatttagaaaattgatatcttttccccttaaaactataggaattatgtgattttattcgttactgaaattaatgaggatacagtgtcaaaattatttggcctgtaatacataaaatgtaatattttgtgtttgaggcattcacagcaaaacttaggtaatatttttttttttttttttttttttttttgagacggagtctcgctctgtcacccaggccggactgcggactgcagtggcgcaatctcggctcacttgcaagctccacttcccgggttcacgccattctcctgcctcagcctcccgagtagctgggactacaggcacccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccggtaatattttattgttaatgttccttggatgcttgtagaatggtgctcatttttaatagcttttaattaatttttatgtttttgctattgcttggcaaagttgtataataagaaatacttgtattagtagtcatgttgatctattgcatgccaagattatattggataatgtatgtatccatgaaatcaaaaagtttcagtgttaactttttcaaaataacagtataagaaaaatgcattttctgtcaaaactcatagagtttgagtttttaaaaagtttattgaagagaaagtcagaaccatactatagaattttgatttattttttattagaaccaaaggaatagttagtgctactctaaagttagatcagctaaacaattactgtatatacactagttttatttccataatctgataactttagaaacatgacaaaaaagagcaaacttcagagtcgtatcctattgtgacacaaatcagctatttatatccaaagtgtgcattcaaaagtattcctggttactcttgaatgtggacttgtggaagctcacaaattcaatctctgcattacattttatttctccatttactgatcctggtaataggccaggagctacattttattaccatcccataagtgcacccgacttgctttaccagactatgacacatatttttaagccattattatagcccccactggtacccaactggtcagaaaacacagattcaaactcaagacaagtaaaatgatatttctccccttcctcagacttgattggaaattcttcctttatgcaatcaactaatcatcaaaatcctattttgctggtctctgaggggaatctcaggcagtatagagagcaaaggactttgcagttttgttatgtccatggatctttgggttgtaagtaatagaaaacagttcaaaattgctcatgtaaaaagcagggttttttttttttttttaaatgcactcagtatttcatgatgttcaaatactgaaaaggaaattcatgagaatcagacctagaaagttgaaaaacacggttgtgatcttccctgtgatcacaatctgtgatcacaacaacacaatctgtgatctgctgtgatcacagattgtgatcagtctgcacccctttctctctgcatgttgatacttgtggtttgaaatggccccacacaaatcacaccttacggtctcttagctgcggtgctcactaatgactgtatctcaagagagagaatctggatcaacatggtagagcctaagagtgggagcccctggcccactctgctgtgaccatgaggttagatcaggtgaggcttctgtgcaatggacagtgatcgatatgtttcatataatcctatccctagaaacatggcacaggcactgaatgatagctagaaacccaagcctggagtgattaccagcttgcaatccattctgtggagaagggaggacttctactgatttttggaggatgagggcaattctgacagggagtggtatgagtaaaggctaaagattggatcctttctaaatggtgactagaagggtgaggggagctaaaggtctacatgaagaagttgtggaagcttggaaaggaaggctttgtagaaagccttagataataaaatttttactttggcatcctttgaagttttgttgttgatatggcttttgtgtgtgtttgtgtgttttagcaaggagtggccattggtcagaggtgtgctggtgaatgtttaacaaccagctctccaaaataaaaatgtgtatgtacatattaatgtattaaaaattttattgataggatatggacacacaatttacaaataataaaatatgtggctaagtctgaatgtttgttttccctcaaaattcttatattggaatcctaaaccacaaaaggatgatactagattatgaagtggggctttttagatggttagtgaccttataaaggaggccccagagagctgccttgctccttccactacaggagggcaccatctcaggggaaccatgccctcaccagacactgctgccaactcaaccttggacttcctaacctccagaactctaagaaataaatttctgttattaataaattgcccagtgtaaggtattttagttatagcaaccagagcaaactaagatatgtgtaacaccctttgttgtacatttcatatggctagttgatgatctcaagattctgtcagtgatttttgctaaacttttgtgcctgtatctcatctgcatctgcagtctagccatggtttcccaaatcaagttgcatcccaatctgcttattcttttcccagtaagtttattgtcattaaattttatatgtgatctgctgtaactatttctcatcctgatattaattacattctttaaactggaaacttttcagcgttagaatcaattagaaatgtatatagtgcaacaacagactcacaaagtaactgagcatttagcaattggctcctgagtttcagccggagctggtttcagtgagtaactcttaatgtctgagaggtgatgataccctcaattacaatgttacaatcctcaaaacaatcaatgggatttgattagatatgggagtatggtgaagacaaagaagatttcaggaatgtgtcctttgataaaggggttatgatcatccacaatggagaaataatataggaatccattcattcaacaaatatttatgaagaagcaaatactaatgaggaaaagctaaacattttatatgctctacaggatagttttctaattaattgttcaagtcaaccacagttcaaaaatagatataaataattattgatttctattaaattaagcctctcttttcagcttttagtgatgaccctacttgcacattatgcctgaaatgacatagtcgctggaccctgagccctcccaaagcagaatctgtcttactttcgtcctgtgttcccagcatccagctcaatgtttggcttatactattcaataaatgtgggttgagttaaggaacaaagaatctatacttggctccctaaaagagctagtcagtgatgaaaaggggcagactggttgacttcaaccactttctagagaaagtgttgacagtgttaaatctagggaggctattttttattcttttcaaatcccaggaaagtctatcagtctataaggaagtctacaagaaagattcaataacgtaagtatgttgcttgacactgatgtttctctgtcttcagggtgaaaattctaggaatcattgtttacagggacatccttgaattccaaatcctggaattaagctaaagatttgtgacttaggttggatattgatgtaactctaaatatttagcaaaaccaggctgagcaattttctctgcagcatataatgaatgtgcatactctatgcctctagcttttttagcaatttggaataaaatctttgggatttgttctgacacttttgccttgttaataaacatagtaagaataaggacaaagagaggattataaaagtcatttgtatggtcaagctaaaacagtggcatttacagaagtttataggaaatgtaaggaatgacattttatatacgggcttatttttcctttaatcctatattaataaagtgaattctgtatgggtaatacaggataccctctgtgagttgactgtgtttacaaaattcatttctaaactattgttcgcaatggggcatatagcggtgcatggaagcaatattaaatatagtttttagttacctccacaccagtctacaaaatctgatttagcaaagcatctgaagtctctgaagggactaacgatattatagaccagggtgtggggaagctattgtccctgggccaactctggttcaccccctgatttaataagtaatgtttttattggtgcacagctgtgcttatttattagcatattgtctatggctgctttggggccacaatgacaagactgagtagttgccacaaagaccttttggtccacaaacccaacttttcagtgggagtgtttgcctatcactgaatggtctttaatgaccacaaggaagggtgacctgtgaagtttattcagttttgactgtagagatcaatcaggaattcatgctaccctagtcgacccgtatgctggtttattgtgtctcacagcaccctcttgtattttcccgtccctccagacagtggtacaacttcatgtggcaggaattaattctcaaggtctgaagagaggactctcacaggacatagtctaagagacataaaagaatgggattggattgtttcttttggtgtctcaagttcaccgcagaggtgaggacatggctttatttggcgacaatgccttattgtcggatgacaattgtcggactagtgatgaagtcaattgcttgcttcctttcttcttgctacactgtccccataactagtctctctgcatctcagcccctgatcaggatgggtcttgcgatgagacaccttgcagacatgagttgatttttcaaaggtttagtcttggtcaggagccaatagagcaagataaacagaaataaagacagtgaggcaaggtgagcaggggttcccagactcctcctgcatttcagataatttattagctaggagagttaaccataaagtagctgtttcccatccgtcctaaactgttctgtattgtgttctattattctatgttatgctgtcagtatcactcctagatgacatctatataatgtttattagggaccatgcagggtgctagatgccctgcacgctaaggattttccttcttctctggcaacttgtatatatatatatatatatatatatatatatatttctccttcatctaatctttaaacaactgagtttctctagacttacttgtgagttctcttaatctcttattctatattttctccctagacaatcacatgaacatcacagcttcaagtgccttccctaaacagataactctcaaatgtataactctgtcctggacctaatttctgagcttcagatcaggatacccaactacctacttggaaacatttcctcttggctcactcatggtctttctatctgactcttcagtcagagactgtctcagtaaatacatccaccatccatgaaacttctaaacccagtaattcttgtgtcagttttgtcccttccctttcccttatcccctggatcaaatcacccagtctagtatgtattttcctctaaatataattgggaatccatctacttctttttattcatactgccatcactctcgtcaaagcagccgcatttctccctcggagtaggaaacagcttgttagctagtgcacctaaagctactcttcgcaccaatcatgttgctcttctatttgaaacttttccctgacctccttttactttttggaaaaagtccaatagcattaatgctacctacaagaccctgcattatctcttcacagctctcttcttggcctttttctacttcctcctgtgtgttctccttcttgcctttgaatacattgcttccttatccttagcctagataacccctgaatatctttctcagcagaacttacctcatatccttaatatgatttttttaagaatgatcagactaggtgaggacccccaaatttcccatttgcaactgtattcacaactgtaattaagtaaacaagtatgtaattgtgtaaaatgtgtcagcctcaccagaatggaatctctagaaagacaagagctgtatagttctgtttaggactgtgtttccatctcctaacacaactttatcattactgaaagaattaatgtgccgactgaatgaatgaatgagctcatttaacacttgcatacttgttagatatttattgttgtcaccatttatgagaactaggtagaactaagtttccaatctaggctatcagaccctcagaccatgtactgcgatacactgcaaagaaggtttagtgcttatttgctctcctggttccccattaccatgcataatgaaaagttgatgagttccagctactggatcctaggtaaggaagagcaaatcaatatgtaacagtgtttttggtgttaagggtcaaattgaataaattgtgtaccatattacccttacatttagaaaatggcttcactggatacccttttattttaagatcacttattgtatttttattttaatgcactcgcatataaaatgaagaaacagccagataatgagtacttgatccccaaatcatgaaatcaattttaatatgcttagaagatttaatattttcttagggcaatgagattgatgaagtcctgttaatgaatatattgatgtaattgaaggaaaatgggctcaacagtcttttgccatcagtgagatgaaccctatcacacaaactaagaagtaggtaaaaaagaaggcattaaagacattgcataagcataaaagttcattctaaacattttttattaataaaataaatttgttgatatagataacataaggctaattttctcttgaaatttacataacactaatataattattttaagtatcttatactgactccatgaatctgtttattttctttccatatcagagattgtagacgaaaaaagaaaaaacacctcctttttgcagtacattgatggaaagtattttatttcatatcatattttattaagaaactgatctattatgaaaaacactttttaagccaaataagtactaagaaatgtgaaaagtagcattgttttaaaaaatttaaatttcttttaaaaacattcattttctggaagaagttttgaatacaggtttaacaatttcaaattttttttccatctaaattctacctttcaaactgtattcccatgttaactagcctgaagacagatactaattgtaccccaatttgtaatgcatcagtttagcactattgatccgctaaaaaatgaaagcaaactaagcaagagccagtctcaataccaaaggaatgatatattgattccatctgacaatgctttgtctacagatcaatgtgtatgtgcagcatagaccagttaaaaatgaaacagggtggacaaaggtcgtgaaagaaacagggtatccaagattattggagatcatgaaatgaacatatcttaaagtatatctgatagttgttcacttataaaggaattctgtaggtttactgtgcaaaaaaatcataatgtaaatgttttatgatgacaatgccatatcttggtcctgggagtctctgaagaaattgagactcacttcttaatcaagaatgactttgtcttgattaagaatgactttgtcattcttgattaagaagtgagtcttagagaaaaaaaaagacatgatatggattcagtcctgctatgcttggtcataaagagatgactgtgtatgatatataatacatctgattcttaggttctctaatgcatgttttatattcctgcagttttttttacatttcagattttgaaaatcagatatattgggctgatgagagattgagagatggaagaaatgttttctggcataatcacaaagtagtaattaatcagactgtgagatttcctccctgtcgaataaaatttaatatactgtagtgaaatatatgcatatacaatacattatctgtttgttctcttcatcactgtattaaagaatcacaaatatgttctagaaccagaggtgggtaatgttgatagtatagctatggaaaaatagcctaccacaaatttctttttttcttttttattcctctacacattttattttcttgggcttgttacattttaagagcaaaagtaggtgtcagcctgtatcaacattgctactttaagaataaaaatactctgttttatgaattgttcaagttagcatgtctgtggggatttttgaagattcgaatatggtcagatgtgaccttctgagttgatgtaaaaagaacatagaaactaatttatgtgtagagatactggatttcagaataataataataatatttggaaatcacatattagaaagtcagaactagttccaaaaatgtatatttgggatttccttatctagatgctatttatgtttttaaaaccaatttgaagtctattcaaataggaataaggaaagaaactattatagcctgtatgcagaggaaatatctgtcaacccaaaagtttagcagctatgcaataaaccataatgtgtattcaggctttgcttatgcaacttattttattattaagaagtgtgaatattctgtaatagcaatctttggacaattgtatacacatgattttctacttttgcatttcttctgattcaattctgcattaaaatatgacaaatggaattcatgcaagaaaatgtgtttctgaataccttgcatagtccacatcttctgttattcataatccctgacaaaggatgacagatttttgcttttaaccactaaagtggaaccaccctgtggcaatagcataaagccagttcaccattcacttggcctgccagcatgaaaattctttgaatatttgagaaatttttaattttcaaatttgtgatttctaaaagtttgtttatgatatgaggatatagttcttacactattttaaataagctcaaaatgttactgtattatattgtctttcatcttataaaccttgtgctcaagtactgaaatttaatgtgtctagggttacctatttaggattttaaattatgttctaagatttaaactgtggatttaaatagaaatagtgattattattacattatagataatacatagtattaattaacaatttatttttatgatagcaaactttactgcctattaaagcatctaattttagtttatttttcttatagttatattaaaaaacatttgcatagaactgtaacatgtttaacctttctaagtaaaatgggactagaaaagctcctttattacattattcatcgtaagcttacagataagtgagagaatttgacattgttttcacaatctagcctataaaatggcttaggtttttgaattgatgattacctacttactcaaaactctttttttaaaatcaaaagaagccttccatcaaaaatgtccccaataaaatatgacagccttctgtgaatacaccctgtcctctgaccagtcaattccttaatatccagatgcaagaacttatatcagtcggtatgccacacactacagtgtgcaaagctaggataataaataaagtgtagcagtatgtttattaaaaatctatgccttaaagcaatttaaaacatttttaataacgataataactataataccatatacatgattaataggaggtttttactgtcttataataatactttccccttctctttggcatatgcttagtttcagatacaaacttttcaacctacacagccttgattggattggaaaatgtgcttgcacgctctctctctgtctctctcggcctctagatagatagataggtagatagatgatagatagatacatagatagatagattgattgatagattgatagatagatagatgacagagttgacctctgagagggatgagcaaatggcaacagcaacaagacatccaaagaggactagcaattgtccaaatgactacccacttagactgatttctgagcatttcaagcctgaaactgagttttaccaggaaataaatctgtatatattttatatatatatggaaagagagtgagcatacccaacctacgagagagagcaggtttgccagaacacttcagactgtttagggtgaaaagtgagtatctgaaaaagagtgtgtattgaagagaaggggatacacacacacacacacacacacacacacgcatatatgtgtatatatattgtgtatattacatattagattatattaatatcaatagttatgtttattacatgtaaatcaagcatattatatatgtgcttactagtcatttaaattgtaaccatttaaaaatgtaaatagcattcttggctcaccagctctacaaaaacaggcaacaggcagatttgacccacagggtgttgcttccagatccctgtgctaaactgtacttttaaagtatatgcagaagaagaaagctttcttttgtggatgatgtgttactaaataactatcatataatactaaataactcatattggctttgtaagaaaaagtgaagtagtttttttgagttagttttacatacagagctattaaatctgtagtgttctatgtggtcaaagtcatttaaactaaaagaaatctcactagttcaagggaaagtcaaaataataaccatgatgggggagaacaaaaattgcaaaatacaaaaggacaatatatattgtccttttgcattcaaaccatttttaaattcttacaattatcatcagctttagcagctaattttctaaatgttaattaaatagactagaacattctatttactattatccattgtcccttaaattaatagcaaaaagtgagtaatatcttgtaagttattaagaagcaattagtatcttaatacagaacctggactaatcacttcattgaaacagtcatctgctttatcaactttgctcaggatttgaacatgatgatcaaggaaatatatttaaaaaggaggactatgtcatttctaaaatgaagatatctgatgatttttccattgcagtgtatctgtattttatgaagctacatggctttgtggcctcttatgatatgaattagaaattatgatatacaaattagttctgaaaaagatggactgcatttttctcttctcttattctctggcatttgctgaaataaatacttacgttgttcagggcagaacagaccaagatccaccaaaagaataccttattaagtatgaagggttccttgtattaatgcatttcaagagaagacgcatgctaaccattagtattaaggagtacaaggcaacctactaaggcaagaatgtcaatcaactttgacagtcccatgtccttcaacatttcctgttttttcctaccctccccaattttcctctcattttccttgcttcctttctcctgtgttcttcttttctagataaacattttatctgaacattttacattctaacgtgttttagctctcttccagacacctcatacatatcatacctcatctcttaagtggtttttaattaagttaaacacattttggcctgttacttgtccaggaggcagtccaaaaatatttattgaatgaatgatgtagcaacataatatgcaaacaaaaaatagtttttacgtaatatgtagttttaaatacagaagatagttattatatatatgctcagtgtgagaaacaggatataaatgtagctaaaacacagaagttgttttcatttatgtcagtctaccatgtgcttagagtaacaataaaagatggtttagtaagatgaccattactattcccatttttactttgtctttacatatgacacatttttacactgttttggtcaataaaaagcctagctttccatattgattgctatcacgtacttattgaatccaggctttgtccctctaattactttcttatgctattttacatccttgtttttagtattgagtggcaaaactcattattaacttgagagtcttttgatctaaataaaagttaaatcaccagtatcacataccggcttttttccaaataaatgtaaagattttgcatttatggtagttaaaaagttaaaatgtacttttataatgagctgtgcatatggctttagtagttaaaatatgcactgagtaaatatcttagcccatatatatgggtcatgacatgatagatggaattattctattagaaataatatgaagaataaaaatgtaagttcactgtgtttatagtaaacatttgataggttttcatgttctttttgaacaaaatgttttgaaattattctcaattgcaagacctatgtgaaagctcaattttattcctctttattcattcttactgggaaagaaggaaagtctcagccgagtgtaaaatctttgaaattgttcaatttttgctacattctttttccatttacaccattgagaattgacctggttgtggaagctcagtctccaggaatatttgagggttgcgggtggtgaggacgggaggagaggatatgtcactatgcacccagatttagaaaactccccattctctgcgttcttttctcccatgcctccccattttctcttttcttgccctaattctgtttacaattcccatattctattctttctgtcgaagatttcctgctgattgtggaaagacaatgtccaagggaagactgacatacaaatgagtagagtgtagttctacacgtcattttctccctctggacctttcctctttcactggggcttgtccccttgtgccattcgttgcccaactggctttacaacagggcagccccttttcatttttgcttagttttatcatggtgtgccttaatttaatccaagaaacatgtttgaagattgctgtgtaaagcattggatgtttccaaaacagagacgggaatgtatatgtgctgatactagatcagggtgggttgaaatattattgtttcatttaaaatgtaagtgtgcaactgtatatatgtatatctatacacacacatatacctatgctgtatattaaaatattcataaaataatacacaagaaaaatgataacagtgtcatgtaaaaaaacccaacgctttaactttgttataaaacgttacttaaaaatccttttgcaaggattgaaaatacgagatatgaaggacatatgtcttcatgtctaaatttaaacatacaaaattataaaatgagctgtactgcataagaaatcagtgttctgaaggacagctgggacagaggcctttgggatcagactgaagaaaaatgatcacacagagtaacagttagaagataaatgtctttagtcaaggttttcaaagtgacattttacctctcctagaaaaaaacctgctagtttctaaactttaaaattccattttggtgaattagcttaaaatattagaagaatgtgactgtcagcgattctcttcagaaaatcaaagaaaacacaaatttacaatggtcattttttgctgatgcttatcaacgttttgattatggaggaatgaaagttttaaaacattttacatttaagataattttttatcttaaatgtgttaggtttacccacaacacattttagacttgcttcctaagtattagttaaaatggaacaataatatcagatttacggccgggcgcggtggctcacgcctataatcccagcactttgggaggcctaggcaggcggatcacgaggtcaggaaatcgagaccatcctggctaacacggtgaagccccatctctactaaaaatacagaaaattagctgggcgtcatggcgggcgcctgtagtcccagctactcgggaggctgaggcaggagaatggcgtgaacccgggaggcagagtttgcagtgagctgagatcgcgccactgaactccagcctgggcgacagagcgagactccggctcaaaaaagaaaaaaaaaaaaattacattcatgagtcatgtgtttgttgcatgatgctattttcattcaaagagagagtatggtcattctgtaaaactatcctgttgtgtaggaaataggactgtaattttcaaacttttttcacccaatgaaaaccttttcttcatggcagagctgtatcatataaaacataattaaatagtatttaaagagatactatgaatgtaaatgtctaaggataagcatttaaaacttatacatatcaaaacagtctccaatacatggcacaatatcatggtgctgtgacgtgttgtatcagttagtagcagtgaaatgactatagcgtgatgatgtgcacttaccccacatatgaccctaagtattgagtaccagggttcacatgtgtagcattctcatttgtaccatgttccaaatgagccggggcaaatttgaaacgctaaatcagaatcttctcttccaagatctattgtgatgtagtgtgtgactttcccatataaagtttctgaaatggttttgcaagccttacagtgctatacagatattagtaataataaacacctgaattttacatcagtgctcagaaagagtggactccaacctctgcatgaagtcagttagattgcttgcacatatggtggttctcatatgatgggattggaatataatgtgtctgagtgcattgttagtttttgttataaaaatagttgaaaaccaaatttaaatgaaattcaaatcaaatattgttgccattcttagagactttagcgaaatactaggatttcattggatacaatggaaagaacaatgaatgtaaaatcaaagtcttattataattttgcttataaataattgcttttaataatacttgtatagccctgaactgtttatagaaccattttacacattatgctcaataatcttcaaataattctcatacaatgaggataggatggttattattatcttttttttttcagaagaggaaatagactgagaaaaaaataaattcagcttaacatggatttttttctcacttaaaatcttaaatttccagtgtggcaacatcatttacatatagtgctcaataaaatagtctaagtgccactcattgcccaatttaagtagtgcagttctagtatattttataactactcagctattgttagtagtaccatgaaacagtatgtcaaaataatattgaagaataaatgtatgtgcttttggagttcttgttttagaggtagacaattctactaaaattgcattttataaaataatagaagaaattgagaaaaatactataattttttttccctttaacatttttacctatatattaacataaataatttctaatttaacatcttaatcatttctcatatgagtaaaaagacattaaatcctctaacttcatttggagagttcttgtctcttccccatgcaagttgtagctatgtagccagcaggcagacatagcattaagacagccaacttggacgaaaggagacataaagggaatgtcagagttacccagcccagagcccctccctcctaccaaatctgaactttttttcttgattctcatgtcattctttccaacttctcaatcttctaaaacaatctgcataaagcatcttaggcttcacactttacaaattaagcagataatgtctctaattagccttacttcttctcttcctgattacctccccatttgtttcttattatctttgtccatgccttcatttttgatcttagatcttcttttctatttattcaacatttccctctaagattccatatgaagtaaattcaagaatactatggaatagcattttaatattaagattttctcttactaaacatgtatttgcataaataaatgtaggttcacgtctttatgtattttattagaaagaataacctcctatttaatacagaggatgaagctttaagggaatataaactttttatcgtgcctgatatatttgagtatataattatatgcttactctgattaggtagatatgtgtgtataaaaccttcaaattttaatggaaacattaacttttgtatacattaacttgtgtctctgaatacattaacttatgtctccatgtaaacagcctcaataactctgttcaatgacataccagtttctgtctgttggtgttttttagtttgccctttgacagataattttttctaagttcagttaattgaaactaatattttgccaccatgaaaagttttaaagaggaaaaagaggttaaaatacacattggaattattgatttagcagcattgacatctctacataaagcacattgctgcttgatactgaaggctctcagtggatgacgtataaaatcctatgtgggaaaaaaggcagaaaataccgaaaagaacacatctgtttatcccaggctttgggagtttggaaagacctttatttaagctatataatgtatagaaaagggcagggatttcatatttgaatagttagtgtctccagttaggagttgtcagcagacatgcagaattgtcacctatgtttggaatgtgcggaggcatccttaccaattgctatgacaaggtctggatgggatacgtgtctacaatgcattccagttccagtacccaagctgatttggtgttctcattcttgaaatggcgtatggctctttttcggcaaataaaatcagcaagtgattgatgtgccacatccgtttggtgacgtcaactgccatgttgctgatacattttttgtcttctgcagatagagcctttttagggacttagatagttcagtgtcttaagaagatgaagacaggagagcagaaagatgggcacctggcccacagcatcattagccactctacgctactagtggaaagatacatttaaaaattaatgcttttttaatttaaggaaaaatatgaaattaaaattaagactatctcaggacttcttaaaaccagtcaaatgagtgtaacattcaataattgtcacttacctcaaaatcaataggatatatattaaacagaaagcttatttggtgtaatatgggtatgtcactcctcataaaatacttccctacttccctctcccagtgattatatatacttatttatactctcatccttaaatatccatacaaaaataattatatatcgcaactaatagtgactttcgaccaaacttctaataggaaaaataaaaaagttgactcttgaaattataaataatattgtaaaacaaggttagagatttcaaggttttccacaaagtaaagaaaataagtgaacaatttaaatatagatatagccttaacttgataactatggaagctagaattttcatgatagtttcctgataaaaatatgcatgtatttttgtctaattaattgtagtagcatataaaggtaccagttgcttttaaacaattaaaaggtttttttttgtttttttttttttttttgctaattttagtatagcaaggatagctttctgtaatataaaccacaggaattccattttgaaactgtgtctagtatactgtacaggtgaaataattactaggatgacacgtagtaattgggtctgtaactccaattaccctgaggcattgactcatttagacttatgcctttattcttcgggtttgtgagataagcttttctgtagaaataaattcagagtatctttcctagaattccaggagtctacaactctcctctccagaggaccagcaagaaatcattgaattatttgctaattgtgagcaaaatttgtattgatttttctctgtctctctagtcgatgttaatagcatcatacttcaggttactaaatacttttcagcaccatctaattgtcaaagattcacttactaagacaaaattgtagacatcaaagctatacacacacacacacataaacacaaagaaaatgatgacacaggcagtttatatgctctttcttacttctctttctcatatgataatgttttgcaatatgtatttcataatttgaaaccaataacaatttgaaaggatattaagactactataccactcagctccatgcttgatttaactgctgggcaagtattaatttctcattgcacccaagtgcagctaacagaaaaaaagtacatcaaaataagtatatatccatattgttttcatcatgttgtcatatcccttaaggatataagcagcatatcttttgttttcctattaaaatcactttatatctgtaaaaatagacactgtatttttcttatagtgcttaaacactgtatatggtttctactacaatgaaactattcccacatattataatttctacaatatattagcagagtttttaaaattaaatatgaatgtccgttctccacaccaatacacaaaactattgctcaataaatttgactaaatttagtgaaatatagtggtggaaagaacagaaaaaaaatcctttgggtgctcacagtagaattttacatgggaaaagctatttctctcatggcccctaaatagttgttaaaatcaatgtacctcatctttgacatctgtttgagcagaatgaatccatcttaaattcccaaatcactttcactgtgaaagaatgcagtaaatgaagcaaaatagtttggggaaatgagaaaatgtaaacaggccaatcagatgctgtttaatttcctggatagccagaagttttctcaaggaaaaatgagatcagagtttgataaaaggaaaacctacttataacccattgctagctgagggaagttttctcaagtatattgagattttaattgatactacaccttgaaatgtttcatagcaacagccaatgctaataagttacttagcactattgcttgatagtccataaatatctgttctgtatacacaggaacagtcatcactaatattttggatacaacttactatagtaagaaacatagtattctgaatgtcaagtgttggaatattcaatactttggccttttttgctgtttattaatattgatgaggttcttcttcagtaatgctgttggattattaattcctgttaaattctgagaacactaaattaaaatagactgttaaaaatttaactttttatatactaaggcttaatgtaataggcttttggttagtactactctgccataagatgctaatgtgcttgagtaatatctctggaaataggttcacaagacggaccaccaaaattatagaataaatttgacatcacactttgcttgagacggaattcattttttatatttatataagttctgcaggagcatcagcgatagtatccttttgaactaattagtgtcttcttttaaattcagagtaggaaatctcatctgctggttcccaaatcaacgttgactaattaaaaagttctagtgcacaacacaatcaagatagaaagaatccatatatgttaaaccttcatgtttggttgtcttgttttaattatagtttgtttctatccttgaaagattgtaagagatggtgaaaagtggtgcaatattgagctactcaaggtcatatgtgtgagaaaaactgttgaatataaactcttgctcattgtacataaagattataaagtgtcgcagtaaatttttcaagctatggtaggcagagcatttataaagatgagtgacaataatttcttctgtccctatacctacagtttttgcgatgtgacattgctcattttcctactgagaggaggagcccttttctttattgcttgaatccgggctggtcttgtgacttgctttgagaaaaataatgcagtggcattgatgggctgagctaacacctcatggggccttgctgattccacatttgacttccaggatcactgatgtccccatgtgaagtagtctggcctatgacttttgaagttgaaattactatgaggggagagtagcccagctgcccagctatatagctgccccagtgaccacaaacagcaccaactacctacaaatgtaaacaaggccacctttggccattcagcttcagtaaagatcccttgatgactgtagatgaatcagtgtccccaggtaagatcaagagaagaaccattcggcaaagtcggccctaatctctgacacacacaagtgtgagccaatgaaataatttttgtaagcccttaagctggctttgttaagccactgagttttgaggttagcaaggcagctagagttaactaatggatacaccttttattatgcgtaaggacaggtattagtctgcgtacatttcactgcctggcacagagtatatattaaggaaaaattattgaatcgaaatgaagtaagtagaaaactttatttcaagagactggcagcttctcgggggaactgggcaaaggaaccacatcccttattgaacttttgcctgtaagagtcacctccagtctcttgctgagctctgggcttgagaccaacattaagcttttcctcaaaaaatcacatataagagccaagttaaaaacatttatgcacaactctatgtgaaaaaaaatcacatgagaaagtgtgaataaatttattatctatttcatttggtgtgattgtgttggtttatttgaagtagaaaattacagatatttataggtatgtaaaaattgtttataaaagttttagctctttaagttttgtagaactactttgaaaagaaaggtaaacatttctaagcatactgagtattcaattagatatgctaattgcttacatgaaaaggtgtaaaaatcataaaacatggaattagtttgttctttaaaattaacattattaaatattctattctataatgcaatattaattaaaattttccaaagaaaacttgagcttgaagttcatagaatgaaataagcactttagtgactaaagcaaatggtcattcgggtcatgaaaacaagatagtaatgagaagaatgaaaaggtctgtatttttaatttccatttttaaatttttaaatatgcgtatggggtaagtgaattttaggttgttaaatatgcagtcagattggcaaatatatatttagggatgagaagggataataaatgtgctgtaagtccatacatcttgaacaaaatatgcgttcattttaatcacagagaggacacttttggttgagtttcattcaaaaaagggaagaaagaaatctgcatctttcattaaaatctccatctagctgtgtttccattagagttcactgaaaaatgactcataaaaccaacaattttatgcatcaggtgacaggttttgacagaaacagcactgcagtttttgcgatatgctacattttgaatgcttaagctgtgtgattaggtgtgctttatatgacttccacgtgcttagctagcaaaatctgagtttatttatataaaattattcaagtgaaaaaaatagtgtctctcacagtgagcaaagtcagatctcaaaaggggccataagggattggctagcattttatcaccaagtgagtccagctctgttaaaaacaagccacagaccttcttgcgatgcacaatgggctttttatttttaactgaccacagagtaaaaataataaatctgccatctgcctgtcaatagaaaataaaataattttccatttcagctctagcaaaataaaaatctgtgtctcctgtaaacacagaaaaaaaaaaatttgtaaagtaataacatgtgtgccagaagcttttgtttgtccatatgagaaatagctcgttgctaatttttagatactctctagacagttttctctgggcatattttagaataattgcatatttgagtcagctggttttatttaaaattgagaatccagttgttagaatattcaaacttactttttttactttgatgttaaatgagacactacactacttgttcttaacatgacatgttgatcacgcagcttcaactaatgttttctagtaagggaagtgaaaagaatgcatattttagagaaaaagggccctggatttccatctctaagcttaatgacctttggaatatcactttctgaaactcagaaatgtacatctagagataataatcccttgaaaagtgaactagagataataatcccttgataagtgatgtgagttttacagattattggccaatgtggtgcctgctgtataatagatacccaagaatggtaattattactattagtactggtatatttaataaatttctatttgtcttacttggatcccatcaattaatatgaaaaagttttaaatattatttgtggatacttatacgtgagatttctactttgtcaatatcaaaatggcagaataagtacagcaagcctaaaggctttagtttttagaaagactaacgattttcttgtgttattcataagtcgaggcaagttaaaggtaaagatagtggaaggaaaatgtctttgttaggtattgtatatgcagaatcgtactttgagataattgacggtattcaagctggataattagagaacgaaattttggcctttattaattaaaattcggagtatagtgaaatttatgaaagaattgcacatttcattgaaggcatatttgaaattctacaaagtcaaaaagcatgttccaaacaccctagttttcttgtacattttgttatattcatccgtcagtttcagcagctatattcattaagctttcctgataccacttttcaaaagtctaaatgcatttgagaatggccttaattctcaaagggaatcagaacatacgctatgtaagtggattcctacaaatttttatttcccagttacatcaaaattttcttcaatagcttaaaatccagtgtaagcaagtttcactaagcagcatttataatttccaattctttctatttaatttgtttgaattttaaagtttgaaaaatgatccctatccatataaaaaccacatttttaatttatttatgctgaaaggatcctccaaacttaaaagaaataaaattcctcctcccattctaaaattattatgattttatagtatttttctttgaattcatatgcttttcactatttagatcactacctttggcttaatgtcctcatgagaagaaagtaatgctattttaacgaaggtccatagggtacaggtatgttttggctccacattgcatcccaatgctagctagctcagtgcttgcccaaagtgcagttttatttaatatatattaagtgaataaatgagaagataattgcaagatctcactctttgactattccaccattaccagccaaaatgtgcaaagtctagttcatttcctctttatctctcccctctcctgccctttgattctcccttctactctttcttttttttgtgtgtgattcttttcaatcattctgactctaaaaagcaaatcctttttttttaatttttttattatactttaagttctcgggtacatgtgcacaatgtgctggtctgttaggtgtgtatacatgtgccatgttggtgtgctgcacccattaactcgtcatttacattaggtatatctcctaatgctatccctcccccaaccatcccacaacaggccccagtgtgtgatgttccccttcctgtgtccaagtgttttcattgttcaattcctacctatgagtgagaacatgcggtgtttggttttttgtccttgggatagtttactgagagtgatggtttccagcttctttcttcccttcattcttcttcctagcttccatctttccccctagacaaaaatgaatatctcattgaattatattttaaacaaggaataattttgaaagttgattcataggcaaaataatgtaaaaatgatccttgaaagtccttcaaatcatttgcaaagtatcatactcattcatcgtgagcagaagagtgagatgttcacatttcatgtgggaaacaggactgcaaagatttccaaactttatttcataggaatattgtttggaattgactgaattgtggaaatattatctttttctcccgctctctccttctgagcatatatatagttaaaatcagataaactaaccatgtttgtgtcaacctttatagtgaatacgaaaagcatgcttataagtgcagcagacactcattccaatcccccaggtacccctttgctatcactggaagtggacaccaattatacattcgatattctcattcacaaaatggcaatataataatacgtaattttgcggttcttttaaggttaaaaaagaaaatgcctacaaagtctttaaacagtactcagtttacagcaagtgctcaataaatagtagctgttcttattactagatccagcttacaagtgacaagattagcattaaatggattcatttcttgaatgtgatattttgtgtcctaaaaccaaaacatgttttttttaaataaaaagcagaatttaattatagaaatcaatgggaaaattaatcccagttgcagaaacaggtttgaatatcaaaagcacacatacaagccaatgtgaattgaattgtaatgttttttgcagttttcacttttcctgttgatccttaaaatgggtatttctcagggttcttgtcaggaattcatccatctcctcaagtagtgtcttctaatctcatgtcttcagctactacatggctgacatttccccaaagtatgtctatggcctaggtatcacacttccgtatagccaagtctactcaacattgccatttaaaaatcttaccaacatcttattctattttcttatttatctaaaccattttactgccttctctattaaactactatgaaattttggaagaaatactcataaaacaaaataaaaataggatatcttctccatcaattgtcttctgtgtcatttttcattcaacatttattgagcaactttctcatcactgcagttggctttgaggcacagagttaaagagaacatggtatctctccaaatgcccatctacttggattgattcctattagtcacaattttaaagcctttttttttttcacttcaatctcaatggctagtcatatccactaactggaatttaatttcacattcacttactattcctgcttgtttccattattgttttatttatgttataggatataagggttaaaaggaattgtagataatctactctgatttcctcaatttacagatgctaatggagcttcatataacttgagactttttcctttgtcaagcagctataataaatcctctgttagaatctgtttgataggaaaaaagtatgtaaaatttagttaatattcctgattatctctgagaagtattaaatgttttctcttgtttagtcctagtttttgttagattcttagattcttgaagacagaaactctaccttattactgttattttccaggttatgtttgagtgcatggcttggagtagtaatttagcaattatgggattaatttttatcaattgactgccaaaatcaaaaccaaataacatattgacctttttataatatgagcttccaggaagaacagtgaagaaagatcattagaagattgaaacatttctgatgtgttttaagtgtcttgcaaatacatgtttttttgctcccccgttcaatcagcacatctattttcaatcctcatttcccgttaatgattggaccagacaccctcattagacattttaaaaaatagaacttgtatgtagccttcttcaagattagcatcttcctcaaagtcttcttactctgggcttttttttttttttaatacttgccggtttatggtacaaatatttgctagcttatttctcttctttttaaatcttgtctgggacactgatattttaatggttactgttgtttaccaatataaacaagattgtgtttgagaaaaagataagcgttcaatttggttattgggtttttgcattttctggtgtcctgccttggtaaatttgcagagtcttcagttggcctcgtcaatttctacacatttccactgtcgtagtcatataggtcatgcccttatgctaaatccctgactcatttgcaatcaaaactctcttgattgcaccctaggtgttatattaagacaccctttcatttagtcattcttatacatttgaggcagaaagttggaaatatttgtattaatctcctgcagaatgatgtttatgctgtgacatcactctaactctctactggcatcatttgtacagaaaattatttttaatccatagtgcatctgacttataatacttcacagtttggcattttgaaaggtgtttcctttgaatatttttttcacatctagttcataagaagccatcatgcactcttaaaaatttctaggatgatgattatttttcattctaaccaattttacttaattgtgtcttctctttttcaatttatttatgttatttgtttatatccattcatttgtggtagaggttgacataatgctaagatcatttgttaggataccatatgaattatcatagtttgaagatcatggttgagttagctttttcttatagtgaacacattcctacagccaggctgagactgtaatttagtctaccatctcctgggtgtataaaagtggcttaaactaggagatggcgagaaaaaatggattagtagtttgttgttgctgatataaagtagatgttaatagtcactagcttgtaatttcaaaaggtaaaattattatgggagaacaaatagaacaatgaaactctaatgctgaccccaaaacagtacatttaactggctttacaataaatagaattactagtataaatagcaaatcttgcatgttgtttgattaatgagagaacattttttcatacctttgagaaggaaatactgaatcattgacggaaacttgaaaaaagtgtttcagcagttacaatcatttacgaaaaacttttaagttacgctaatgaaaagaatgtatggaaacaaatatggaaaaattatgacactaaaaatataatcgctgacatgtgaatatacttaattagggcaaaacagaagtccgaaattaaggaaaagcaaaaatcgttatactctttttctttttgagtcttgctctgtcactaggctggaatgcagtggcacagtctcagctcaccgcaacatccaactccctggttcaagctattcacccaccacaccctcctgagtagctgggattacaggcacacaccaccacgcccagctaatttttgtatttttagtagagatggggtttcaccatgttggccaggatggtctcgatctcctgacctcgtgatccgcccgcctcgggctcccaaactgctgggattacaggcgtgagccaccgcgcccggccttatactcttttttttttttttagatgtttgaggcaatgactaatatgcatttttattcattcattaataaatatcaaatgccatcatcctatatatcatctcatttgcaaagcaattttcacatgtgtttctctttatagtaatgtcctttgaggattgatggcaactaaggagctttgccagttaaatattcctaaatgtggaaggaatctgcaaagtaaatgcaaatgtttatttccctttctcttattaaaaatgaattatcaaggcccagcatgtcttcttgtagtagagtgatagaggaattattcagaaagtattgtcagtgctcatatgtaaccttgaattcttagcatcctatttaatactgtagtatgaaaatatgccataatatcatagcacattctatagaaaaccacacataaatagaactagtaaaaagcaataatgttgaaagctatattattttgtacttacaaagtgaacttttttataagttgaaacaacaagccaataaaattagccatcgaagatcccaaactaagtgtgaacaggagttgctgtctgtaattatttatgttttgttggagatataagaaatctcaaagcttggccctgcttcaaaggaaagaatattggttaggtaggaaagaggtagggggtagtcttggaactgttaaggaaacatttatgtgaaaaaacacttaatgatgttttaataaaagctaaaggatatacagtgtgctggattttgtgtgcaaaactttcattttgttccagttaaatactgagttctaatgtacagaagtgagaaattcagtggcgaatccaaaaagaaaagaaaagaaaacaaacagacttctcttcattctgaagtgccaaggcagccatccaagtggtagaagatcttaggtgccatatgtgctgttcttcctatggggatgacattttaaacttaactgaaatgactgggcttatttgaattctgctggattcttttcacttcatctcaacatgggatggctcttctcagtagaatatattcttagaagaatccacacttactgaaaaaggaggcatatcatggccagtgtcctttcatgtcatgcagttcccatcatggaacacaactcagggtcacagtgtagatatggcaatgtgaggcatatttggagggtctgcatctgagcaccaatttccctctctccccatttacacatcttctttctgtctcaagggtaccaaaggattatttgttgcttttcagataaaccttgctatttgcttccacactgaatagagattacagtcccctccagccctttaaaagtccagcacaccaagctttgccatatgtgagcaatctacaggcactattagccccgcttgagtagctcttgataacattctctaggaagtcaattaaagatgtcaggaggtgggctggactgcttttcttttactaacaggcattcagagagtggaagatggaactgtcagaaacaggtgattttgggttgtcaagaaactaaggctcctgatttgttttgtcttttcccctcattatttcaactttttttctttctgtgagctcttttagtttttaaccagcaatagctatataatagggaggacaaagcacctagtgtaataaatgacaataacatttgcttagtgtaagtttaaaatataaagagagataaagtcttagaaatttgagcgtagcgaaaatttctattaaggagttactttttgtgttaaaatgcctatatataaatacaagttaaatggttattcactaagaattggtcataaaacttgatcggtattatattagagtgattctctgcccttgcttcccatacaacagggatcactttcttttgctacaaatctcgacccttttattttatgtgctttcactgagaaagactatccaaagaagtaaatgactagattttattctaaattaatatgaagcaaagtgtcacaactatttatctaagctaatgaatttaagtgtttaaaccagattattctgtcctcctaagtattattttgttcggtcaaaatagtatttgttaaatattatattaatttaatatttgttaaattaaagtaataatagagaaatagacattttattgtttgagctacaacctagttatatgtttatatactaatcaggacaattatcactgtgggcaaataaatactttataagagactatatataactttaaatatctctatttgattatgcaaaaccatgataatgaatgaaccttgctctttgccaggtatgtgctaaatgccaaaaaactatttcacttaatcctcatcgccgccttagataagaggcgccattatccccatttcacagatgaagaaacaaaaaattagagagggtaaataacttgctccaaatggcatagctgttaagcaacaataccaggactcaaacaaaaggctttcaatcaccaaaacatgtgggcataacctccagagggcaaagaatagctgaagacgcaagattctgtttgtacttgcaattgcagaaaatataacctataagaattatgtgactctgagaagttaactgtctccaagatggtaacatacagttttgaatgttttaataacggtgaatgaggagacagaaaagattgaggctggctagaaggtttgggtttgttggaagaagaagctggcttaaatttttcttaaaaagtgaagaccagtcctgagggtttccgcatacctattaggaaaaggtgccatagttggttatacagaagaagaatgtaacactgatcagcaattcactcaccatcagcttttgttctccagtttttgtttttcttttttttttttatgaaaaaaaggcaattgtacagaatcaagctcatattagggatttattcaaagaagcaagtgtcatcatgaattttgaattaaaaatagatttagcttaatgttcaaaatcaccatctcacagcatggcataataactgattataatgaagaccttagttacaaagctaaattatttttagtatactttgattattaggttaaggaattgtaaaatatgcctgttatatcttatttcatcacaatatttttaaagtataagatctagaataaaaaattgtctattttcaaatcctggccacttttattaactagatgaacttgacatcttggaacttctgtcttttcatttataaacctgcccacctcacagggtcattgtgagtattcaattgaccttatagacaagaaatcttgaccatttagtagacactgttttattccaccccactagacaactgcaatattttaaaataaacattcagaacatgatctttaaaaggttatggatgtgataagaagtgatacaagctactggcttttttctgatcatttgaatacatgaaatttagaagttagtttttacctttgaaaataagaaactactagcatttcaagatcattccacagtgataccttcaatgcatattacattccttactaaagcaagagataagcaactacccatatattgagtaaactcaacaattagaccaatataaggaactttctactaaagttgcatatgtaataattaactatatccggtttagtaatgacaagaattgaaattcgttattcatctgtttattcaatgaacatttattgcgcacctactgtgtgctaaggataccattctagactctggaaatacaacagcaagcaaaatgaacttggttcctgcctttgtggagctagcttacattttattaaaagcagatagataacgaacacaaacaagaatacttttacacagtaatatgtgatattcaggggagaaaacagaggaatatgatatgtgtgatcttgctgcttctttagtttgggtagtcctaacaggggaaactgaagaagtgataagtaaactgagatttgactaaaagaacaggagaggtgtaggaagtcatggggagaataacaattcacaggccaactaaataatgtagaaacaagacccaaggaagtaactggccttgctagaagaagaaaaaggccagcatggttgggaaggaagggagcagaaggggtagatactacgagatgagaggtcatatctcttgaaccttgtaggccaggataaggattttcacttttttctaaatgtgatgggggtggtggagtgggtgggggggtccttcggagaattttatgtaaaaagatgttaacatttatttttataattttgaagaggttcctctgtctgctgcaggaagaattgactgtagtgtggacaggagtaagagtaagattgttgagttggctgctgtgtactctgagagatgttggtgactcagacaaaatgacaggggcggaagtcaggaaaatcgggtggattctgaataagtttcacagtcattggagcttacgaatggtcaggatggtgtgagtgtgttcatgggtgacagaaatggaggagtaataataattccttgagcgattcatagaagatgataccatgtacaaagacagggaagattgcggaaataaagacttgtatggcgaaaaccatgaattccattttggtaatgttgagttactcttagacattcaagacactgtcaagcaggcaggtggacacaagactgaagttccagagtagctcaggctggaggcatgcattttgggatcatcagcatggaggcagaaccagcaggggttcactcagaagaatgtgtggctggaacactccgttttaagtactgacgattttttaagggcaggaagcttttggcaaagtagatggatgagtaatggctagttggaaggaaattaagaaaagtattccagaagacaaggtaaaaaacacacatttaaattagatgcattttaatgcaatgctttcgtggtaatgatttcattatgtaggaattcaggggagaataaaaaaaaactgtaggaattttccacatattaactcttagcaaatatatatctagcacttattatagataaggtgcaatgggagagaaacatggagttattatatctgcattggagataatagctgatagctaatttcccatatttttttccatggccatctgattcttcagtcttataaggtactgatgtattatgaaatgaaggaaattaatcactatattttattgagccatccgctgttgtatggaagtcttattcgaccaaatattttaaatattgaaaaggaaataatggctatattagtatacttttgtaccattttaaatgattttcaattactaataaacaccatctttcatatgactattttttataattgaaaaaaacaacaacaactgggactctgtggtaaaaaataatatgtttttagaacctgcaatttaattattgggctgcttaatatttgagatctattgaaaatatagagtgaactttttattatgcaaatttattcagttctaaaaataactaaatgataataaaacattcttttttctttacatcatattacagtaatgaagctgttacctctcagtatgcattttaatgaattttaactaacattttaatgagccaacattattatagatccaaggattagacaaaattgaatttactggtattgagaaaagttcaccaagagttatattgtttaaagatggaatataatacattttatgataaaccatcaagtatcctgtatgaaaaattgtgctaatggttgaataacattatatttatgctatacatagatatattcttcatcacactttaaaaacattaatgatatttttgtttttgtatattcaatccatatgaaatataaaagacatagcatatcaaagaaaataatattttataatattagatttttaaaaaaaattttctttaaggaaatctctatgaagtatcattataagtttttattttttaaaggaggaatcatttataattttcttgatgtactttttttttttttgagacagagtctctctctgttgccaggctggagtgcagtggcactatcttggctcactgcaatcctctcctcctgggttcaagccattctcctgccgcagcctcccatatctgggattacaggcccgtgccaccacacccagctaatttttgtatttttagtagagacggggtttcaccatgttggccaggatggtgtctatcttctgacctcaggtgatccacctgcctcggcctctcaaagtgctgggattacaggcgtgagccaccacgcctggcctgatttacttacatgaaatagatttatacactcacaacttataatttgagagagaaaaataactttttataaaattgataattttgggtaataattgatattttaggttctatagaagatgtattaataactgtaagccgctctcaactaaaacacagttagtaatacttgctccttcctttagaacctcctcactcaatattctgttgaggcactgaaaggacctaagtctcaaatcaaaaggttgtcatcgaattcgtctttatgtctcttgtgcctagctcgcaataggccttcagttaatgttaaatgaaaagaaatgtccttctcaatagcaaagtttgtgaatttttagtctatctttgaaaaaaactcattagttgaattgtacactttgatcaggctcaagttaaggccatgcttactagcatcctacagatattttattgacatttacatttcaaagcacctaattgtggaaaattgccatttgtgtcactgaatgactcttgtaagaaaccatgtttctatactctcttcgcaactctttgtgttgaatccagttgggaaagacagtataatttgaaaacactccgtcaatatactttttctttatacattgaatttatacattggtaaacatacgtattaataagtagttaatacatttacagggttttaaagaagtataaagtagatgcagggaagtcttcctcccttattctttactttccagtattttttttttcctgcaagtgcatttgttattattagtttcttgtgtgttctttcagagattgttttatgtgcatgcaagcacattccagcatgtttcttttccttttctaattaattaaagcatacaatgcatattccaaacccagctctgaaactcgctcctccaaaaagccttccttatgaaaacaaagtttcctccattttaccttacggcattttaagtatacttgtccccaataattcatactttcatctttcagtttgtggtttttgagttaggtatggtaactttcctaaatctctttagcaccatgaggggaccatctttcattgaaatatcttgtactcctaaagtgtgctatatagagactggaacaacatgtgcagtacatacttgaatttaaaaagtgggtgattgagaaataaaactcttctgttacctcacagaggtagtctcaacaactagagctggttgaaaagtgaaaaacaaatatctaagtttgttatcaattaaacagagcaaaattaaaggtcatattaaaatcaacttttaaaatgaactaggtaaaactcactgggcaaaatttatacttttagattgggaagaaccatggatattagtactgtataacataaaatagtacctctaaatgtgtttgtttttagaattatattatatataaatccctactcgcttattcatagcgatgatcgcttttagcaattgcatagtaattgattgaccccaagacattaaggcctgaaaaattttatatatgggacagggttattgaagattattattattattgttattattattattagttttcttgagacagagtatcactctgttgcccagactggagtgcagtggtgcaatcatgtttcactgcagccttgaccacctgggctcaagcaatcctcccacctcagcctccaaagtagctgtgactacaggcgcacaccattacgcctggctaatttttgtatttttggtggggatggggtttcaccatgttgcccaaaatggtctcgaactcctgagctcaagggatcccccgacctcgtggcctgtcaaagtgctgggattataggcgtcagccaccatgcctgtcctcttgaagatcattaactatttgatagtcaaaggaattaaaaattgacagccattaaactcattgaagatcagatgcagaagtaaaattcaaagtctttcttgtttactatactacttctaattcctaataacagtgattcttttatgaactacttcctttacttttcactgtactttacaaagatcatttgttcaggcttcataacaaaccaaagacaaaggctttttttaaaccttcattttacagatgaaaaagctgaagctaaaatggctgaaggacctgtaataatttaataataaaagtagataatcatctggataataaaagtagcagaacagagacaaccgaggccatctgactaagcccattatctttaccacagtgctgtgttgccttcctgccaaatagtagtagctccataaacacttgttaaatgggagttccaagtccctaagaggaactggcatatggtggaggggatttcgagtgcattccagaaatagagaacaaactgtgtttaggccctaaaaaaagaaaagagcgtgttacatttcaggacctgaagaaaggcctgaggaaatgtgggttgaatattatgattgaagtgacaaagaagaggctgtagagacaattttagaggctagactacttagagttacagggggaggaaggggactattcagcctgaatttcctggaactgtcctgcaataattattaatagtacttccttaggatttcaaaagtgttagtttggaaggtaaaatagaaagttatccaattcttaggtaatgttgaagatttttttttaatttcagaatgaatgaatgcatttcctcctttgctacttgggatattagaaggaaaatgaaaagtctgttagtccatacttcatatccagcacttttatcaactgagagcaacttcagtgattggttctccagtgatatattgaagacatttgtcataaggccctagccctctaaagcaaaggtctttcctttaactaaatatggggaaaatatgtcaagggcagtattaaacatgtgcattagaaattactgaatctgtatataacatttgagtatttagtatccactaatttatttcaaaaattatcccatttgccaacttcagattttttggttgttgttgctgacactttagacaacttgccctacattcacaacagccgtaatttgttcatcaagagtaccgagaaaacaaggttctaattttactatttgtagacagtttttagagggagtaaggttaatatggtgcatgaaaaaagccaaaaagagattaaggcagtttgtgaattttagtaatatggcataatgaagtgcctcgatcatgtcaaaataatggaggtttcgtagactttctggtaaatcttatttatcaagtttggtaccatcccagggagagaaactcaaaccatctcatgcagctaagtaagtagtaactacaatgtagagatttgcttcctctctgcacagaaaggaaatggctatgattattttttatctccaagcattctgagaatgaaagtgtagtaagtcctcaggctaggagaaacagggtagcccagggaatagatatatagctagagactcagaaggcagtactatttgttttcttactgctgagcacatactctatggatggtcaaggtgactccagtgtgtatcagaggaaaagaaggattttattaaaactctactgaagaaggcttctttccagtttcagctaagatgtgaaggtttgattaaagcatccatgagttttaaaatatttacatacttttgggtaaaacacacatataattaattctcttcatgagaactcagtattacttataccttaaaaagatactcagtatctgttgtttgatatcagtttgtctttaggaatgtaagaaactgtgcttttcataagtaaacaaacatcttcaagcacattgttctccaatcactgtcaatggtgtaatatgagttttctgagataatttaaatttggtatttaggatatttgcatgtataaaaagtacttggatatgctccttgcttcctcttctcctgctgaactgtcagaagatggtgatgcttttgaagatttatggtagatgggtaatgagattgctgaatgttaactactgcatttggaattcatttagtagcaaaagaaaagaaggttactgggattgggatagagtagaaaagtgatagagctatttttaatcagtgaatttaaaaatcaatatgatacgttctgaattaggatacatttcaagtctcttgtcatgtagtaatcaagtagaacatttcttgaagaatataggatgtcaaattggatctaattcagcaaaattcatgatagtgtagtgcccatattttgtgatgtggacatatcaaattttaatattggaagactaaggctaaaaaatccacaagcatgtggaatatgtttttaaaattcaaaattcgaatataatctattcagttaggctttggtttatgttctggtgcaaaagaggaacataaaccgtgtactctcaaactgctcatttttgagtttatggatgatgatgtgattcatgtgaaccccctatctaggacctccaatggttatggttacaaaatgtgttgttaaaatagctaaaatgatggaaatggtgaaattagcagaatcaagttgtgagcccatagatataattatatttctactctattcggagatttgttgagtttcgggtagaggggaaagaaaagataaagcaacaatagtgttaaagtaactggcaaagaaggttgaccttgaccttcttttcctttcaaccctcatttcatcagcaggggtgagattactttgagaccctgccaataggtaataaataacacataaattccaggacacccttgcactgtagggtgccctaatgtgtaataatccttagactattgagtttataactcatgacatctggcagttacttggcattgtaattcatgttgatcatgcacatcagaatacacaacagtagagaaatatcggagcaataacacgttgataccaggagaggctagaatgacaagagatgctgctgaaactgtgtacctctgtgaactgtgcagtggaatgctgtaaaagctaatatcttcagataaggactaataaggtgggaggagagaggcgatctgttgggatccagaataatgcagcacattaatatgtacttgataacactctttatttcctttattcaaatggacaactatagctataagtcagtaatgaatcctgaaatttggatttaaatatatacttagatatattttaatttaaaagtgcatgtaaacaaatgtattgaattcaaattttgtataaatatatgtaaaagagatttaataatttaatttttgttttctttggtctaatggtaagggctaaatgaggaaggaatgcagagagttagagaaaaatgagaagcagtagggaaaccaggcaggcattctacaaagcacctgtaacacacctacctggtacctagcagcctaactactttgtctgaagacccgaggcccatgggacatgaaccagactgaaaagctagaagcagacagatggttatttgtaatcatcctgtaaatgtaaattctttaaaactggtgggcttgctggctttatcatctatctgtctgtatctatctatctatctatctatctatctatctatctatctatcatctatctatctatttatatatctatacccaaacccagatctaagaaaagtaggaggcagtattataaccttaaaacaatctggtgtttccccttgttaccatcttaaaaagcactaatataaaaaaaaaaaagccagcctgtgtagttcttaattttaagttgactgtattatatcttctaatgcccaaagttataagcattgctttgagcaagccaagacagttttgtccgaactgggcaggtgctgaaagacagttgcctgtggaggagaacagaatgtgttgggagcatggtgagatgggtttttgttctgcagctgagcaagacattgccttgaacatgtttaggttaatactagcatttctagaaaccatcctcctcacatgctatgtttggacacaatctctaacttgatctggtttctttgagctttctgtgatttcggagacagcaatgccacgtgaacaattctgtgggcgatagctctttaagggagaaagaaaaggaactgattaaacattaatcagcttcaatccacagcttcctcataagctaatggataggctatgcagatccctgtcaaatatcacatgctaggctttgccaaaaataggacttccaagtgttgaaggcatgccaactgctggctctttaactgcaaaccaaagcaaatgattgccagagacaggcctagagtctgccgtggtcagatgtcaccagtttgcagtgccacatgtgatccaagagtttatgaatgatctcaacacttggtccccaaggagaacatatgcattacagaggttatggatacaaattacagagagcgcgatgtttccatgcaatttctaagaatccttcagcaagttttaaacataagtggaaaacattaaggaagacttggcactcttagcaggacttcaaattatattgtgggtgaggacagaacacggctaaaaaaaggattcaagaataaagacttggctaagaaactcgaagctggccattcctcctgtgtgaattatgtttgtgtttgtgtgttttattccctgcagaatactagacttcacaaaatgctatgacttgaaaatgaacaagtcacagggcattcttgtttattcaacatgctccaattcctaccgctggtttatctggatcatttgctcagtgaatgtgcctgtgcacagaatctcattggaggtgggggtgagagcttctcattttggagttgtcagcatgctacagggtgccagagtgtcagcttgcacagcggcccccggatgtctccccactgagttctttctttcccattccccttctgtgcagaagaaaccacttatgacttatgcccacatgttcagatgttattgtctatttaactggtggctagcctgcccatcctgaccatattttgttcaattgtaccaaatgtaataaagtagtttcttgtgaatgacaatctttatcagttgtttagtcattaaaacttcagaaaaatacagaattattatgcgatgtcagtggggagcttctggttgaaaaaggaaacttacactggcttaaatataaaaggaaacatacctagaaagtccagagttagcatagttttcagaattaatttgtccagccatgtccttaagagcccagatttttttacactttgtacatagctccagtttcatcctgaggatcggtctccccctggggtcaaagcgtggctgccacctatagccatgtagtccaggaagagatagggtgcttttttcatgtgcagagtagaagttctgagctgcatgctggttggggttacactcagtcattccctatggtaactggtggtggtggtggtggcagtggtgttggtagggctaggggaataatctgtggtagttttatgagtgaccatcattgttttttctcttagtccattggaataatttaatatgatatacctataatttgtgctaccagtttttttggctgacataaatctgttctattccttgagtcgttgatttctgaccttcttgaactgtctggcttttattttacagatatatgagtatgtagataggcaagccaagaggattctatttcttaaatccaaacaattcaaattgttcttcataaatgacattttaaaatcaaattcaaacactgtggtctattttatatcataaaaaaggggtgcagcacacatcttgaaggagagcacatcaattcaatcaaccaatcgacattatttggttaacttttctgatacccttcaactagagagctctttggagggttacccagtccagttaagtagataaggaaagacttcagatgagtgagtccaaagttgacactgaatgaacagtatgtacttcagaaaggcacaggcaaaagtaagagaacaaagggacagctaggagttacttgcaggcagaaagaccatcatatgccaacttacaatgataattaggtgttccttcatatccctagggcatggaggttacagaaatgtccctgatgagcctggagatatatgcagggacctggttccaaacaacatttgaaatcatattaaggagagaattttatcttaagagccattaaaaagtgttaaaaagggaattgacatgatcacatttgcattttagctaactcataatagctacaatggaaagtttaaaggagaaattagagaaaaaggtcaaataggatattcttacagtaattcaaggaagatataaggacattctgaactagggcagtggagagaggatgaatagacccagatgatattgcaaatcagtgcagcataatgactgtgtataaattctagtgtcagacacactgggttgaaaccctgtgcttacctaacacaatagatgaggctccaatgacctattctatatccatgacgctatctttggcacatagtatgtactcactaaattttagctattatcatagaacaagttattttaaaaatagattaaaagtgtcattatatgtgcctgttaattaatttttaaaagcaagtctaaaaaattcttactgaaaatcagcacataattacatatattatatatatggataagtaaaggctcctgagtatgcttctatttatcataatttactgaaactgtattcataaactaaaatgtatgtcatataaggaactgcttcgggctagaggtcggtcttctactgagaagtttggatgtcattgtgccacataactccagcagttctgatacatacacagagagaaaacctgccggcaggaaagacttgtgttcagtgttgtttgggtctcctgcggttttcaactgctgttggccgtacctttcattacaattatttcttagattatctttctcgtaatgtttagttggttgtggatggtattctttattcaatgatgtgtgccaattcttttatcagtaacattttaggctttacccttctaataactttagttgggatcatgtgcacattgtggtttagaaatgtatctttcagaagtccattagttatacagtctcacttcattgtcattgctaatttgttttaataaactaagatggaaatgactaagtagtgatttgcctagactgaggttaaaaaaaaattctaagaactattgatttaagacaaaacagagagggtttggggtgggaaaggatatgggattataaggaagcaggagccaaagatataagctctaaaatcacagctggacataaaactttttaaaggcactctgttagttacctattgcttcataacaaattactacaaaattcagtggtgacttgagtcctcaagggtttttggactgagggccttggtttcttgccagctgttggctggaagctgacttcagatccttgccaaatgggcttctccattctgcaacatggcaccgtgcatgatcagagaaagtatatgaaaagagagtaagagaggagttcagactttccctctaaagattcaataacttagtctgctgaaatacactgacaatagacatattaacaggagaaaaaggctacatatttactatgcacacatgtgcatagaagccacacaaaatatgagactgaaagaaaggtcaaatacttgaagcttaattattctcctcatagaggagaggaaagtgggagacacaggcaattttagaagaataagtgatttttttgaggagatgaatgggcctgaagaacaaagggtggcctgggacaacatttccctgggctctgggtgcggtgtcaactctggtctttcctcctgcaggatgcgccaatttcccctggttaatgagatatctgagaaaggaattaattgaataccttctggaggacagcatctttaggtagacaggggatctttagagaaagctctttcttccatttgctactcactgggtgctcttagtttaaagtctgaagtggcgtattttggggtatcattttctaagccacaatgagagagagagagagagggcaaaaacatgaaggtcacaatcttttataaactgatcttggaagtggcatcctaccactttgtaacattctgttcatcgaaggtaaatcgccaggtctagttcatgctcaaggggaggggatatacaaagggaataaataacagaagggagtgaccattggagaacagaacaagggtctatcacaggcactgtcatgtcattcttgttaatctatttcttaaccagttcataggagagtgtttgtcacattacagcattcaatacatacttgcagaattttaatttgtcaaaaatctctatgtcgtaaggtagtaatttagaatgttccaattttccaaaataatttcctaagtcatggtgcatcccaatgtaaaaaaacatgcaaatataattcaggttatattatgactagctaagtgaactatttatatgtgttttccagctcacatatggaagtgaatattcgggttctagccaattacatatcccccccacctcaccccatggagatttgaaaccctgtattctaacttagatctgaaagcaagttctatattagaatgtacctaccatatcccttttctttttaaatgaagttttaaaaattctatttttatttgacaagcaatcgtatatattatatatttactgggtacaatgtacacctgttagaaaagctgttatctgaaagatgaaagataaatattggtaagggtgttgagagaagggaacccttgtatattttgttggggctcagaaactgataccctgaaatatgtcactgaagcagtgtccttcgtctggggtaatacccaaggttcgttgcctcgtgccaaggaaatcaaggacatggacacacaaggactgagtttaagaacagaggtttaataggcaaaggagaaaccctcccttgtgcagagggaggggttccgagcgtatctcccagggtgcgacgagatgcggttggttttatagatgagcttgaggatgcggtgtctgattcccacagggtttagaggattggttggggcaggtgtgtcatttacacagagcgtgaagaagttggccaccccatcccaaccttttattatgcggatgagttctgtacctggtcggcacgatgttgcctgcttttttactgcacctgtggcggaagaaaaaaataataataagaagaagaagaagatggagcctccgtgttgaatagacttggcttccaggtatccctttctatcggcacagctgcggcattcacccgtgcaagcttccggcttgcttctctatgtctgcagttcgattttacaaactgctctttttttttttttttttttttttttttttttttttttgagacaaagtctcgctctgtcgcccaggctggagtgcatgaactcgactcactgcaagctccgcctcccgggttcctgccattctcctgcctcagcctcccgagtagctgggactacaggcacccgccactgcgccaggctaattttttttggtatttttagtacagacggggtttcaccgtgttagccagaatggtctcggtctcctgacctcgtgatccacccacctcggcctcccaaagtggtgggattacaggcgtgagccaccgcgcctggctgcaggctgctctttgttagaaattatttggggctgttttttgttaaaagggaagcctcgctgaggacttgtttaccctcactatctgcctaaataatttctagctcctatagcagcacttggacatgctgaactgaagaggaagcctcaagatctctctgaccttccttcctccaaacccccatctctcaatcctctgtgtctcttgaagcacaggatgaagttgttctccaaagtttcttacctgcctaaagtccggacctaccaaagaagaaaaccattacctctggccccttccctgaattttcatgagctcaaatgatatcgcagaaaggaagactgaagttggacaacaaacctgggcaaactttcgtcaaaaaccatcgtccccttgtgagccgaaaagacttagtcccaggctattgtatgttctttaaggttattgaatccgcctaaaaattatctatacttccccatctccctttcccctaagaaacggagtatataagcattggtataccatagcggtgttaggcaattactctgtgattctcctcagggtacgctaataaatttgtgtaccttttctccaattaatctgctttttgtgagtcgatttttcagtgaaacatcagaggcaaaggggacgctttcccttggcccctacaacttggtagaaatgtaaattaatacagccattatggaaacagtatatcctttttctttaaaacacaactgctgctaccctgtcatcgaatttatttctcttcatcatatttaaagactttttggagagttaggtaacacacactgtggtatgtgctcttcttttgacatacgtgtcaagtcacacttgaaaatatagttttcagttctttctagggtagaggatttagggggaatacacacacacacacacacacacacacacacacactcaatttagaatttaaaattgctttgctattttctacatttaccagaccattttagttctcttaatccgacacatgggaatacttcaccatggctaacactttcttgtttttatcggctacgataaagagcacagggcaaaatccaaggcagaaatgaataattagcacaaaaatgggaactgatagatattattttattttacttttcttacatttatgaatgtaaatacagaccccagaaacatataaacaaatatcagaatatacatatcttccttcaaaatttgagaagagtaaaaatgattttactcctttttctaaaaataagttctaggctgcctatggtggaacctgctgaaaagcatgtttttcaactgagagagagagagagaagaaacatattataatatcctgaagacttagggttaaataaatgatatcactaaacacaaatggatttactgagtactatacaaaccccaaagagcacattacaagttgaagagggtacagtatcaattatatcattatctcaccctactctctgggtgaatagtctgaaagcctaaaattacagttgatgttagatttcttggcttcatttgcaaattggagtcattttccccctttttgttgaatgccataagcacatgttttattgttgaagagtaccagtccttatagtttgttatgatgtttttcttctttttgtcctacatgtcaaaggacctttaaaaaaaaatggattgtggaaaattggtgtaacgttgtatttctgaatgatttgcaatggtattaggtactacttgtgcttaggctttttggcataccattttttaggagagcagatctggagaaggcccttcaactggccagctgtgccattttggaacagattgagggcctgcaaaaacaccatttgttgccagtaccggatattgtaggggtgctcatcaccctgttaccatatttttgcacttcttaacattgcataaataggcagctgttctgtatttagaatataaatgagtcaccagcttgctctccctggaggatttacctgcaagagggaaccacggtgttaaccccttctcatcagttgcatgaatgtcacatttaaatgcacactttcctcagcccactcagaagcaaatcctcatgcatataaatcacacctttcttgccagttagacaagggggccaaaaatatgcagttcacagagctaaaatggaacacatttctttagcagtgaaatcagtaaattaatcagcttataaactgagagtgagcaatttgtgctgaattatttcttactgctccttcaataagagacaaggtgctctaatctcataaagggccatgacttcattaagatggaaaaccatgttaaagggtgtgttgcaaaatacgagaaaagaaaaaccctgaagtcactgagttgactctctggagctcttttaaggacagggttttttatttatttggggaatgacaattaacctacagacttggcacaacaaagaagcagagtgctgaagtgggtctcattataggacacggaaggcagttggtttgacctaatccccagtcgcggcacatgatttacataacaggctaccacaagctgcctaatgttgatttcaaacagcttgatgtgtgcatgtgtctgtgggtatgtgtgtgtgtgtgtgtgtgtgtgtgtgtgtgtgtgtgtaggttcattttacctcaaggtactttggaaccaaacatgtcggtgttggaatgtccaagaacagaaatagtaaagccagtcaggaaaagcagaggcagttgcagtatatggtacatttgctgatctcaactacttttttgaatgtttaccctaaaattaatgtagctctgatttaccacctaaatgcagtccgatagggctgagccatctctccaggcttttcatcttgtcaggagcagagaagcacaagtagatagataggtgacatttggagaggcaggcatgccagattttcggtggttacagcgaaggtccaacctgctgttctccttaatgaaaggagggaaatttcagacaggcaaaactgctataagggatatctctgccctgaatgtcacactgcccagatgtcactcggcaggtggagttgcagaatgaaaatgtagccctgcgtatgtgggtgctagtgtgctgcaagggtgaactatgaatctgtcttctgaagtgtaatgaaaacagtgtggatcttgtctatgtttgtgtcatgagaaaggactttgtcaaagaattctcaccccactttccctcacagatcattaggcttgcaggctcacaaaccacatgcatatatatatgcgtgcacacacacacacacatatatgagtttctatatagaaaatagaattatactaatgaagggttctgcaccttgcttttttaattaatcgcagaactgtacatgaatatttctcatttttttgactgatttcatttttaaagttgaatttttgaccaaaggtgcatgataatttagtcagccattctcctgttgatgatcatttatgttggctccagaatattttaaggtggatgtagctatgttctcagtaaaaatccaggcaatttttactagaacaaggtaaacaagacttgaagttaccttgtacaacaaaaagcctaagttactgtcgttgagttttcttttcctgtaattatttttcctcagtgttacgagatgacttccgacaaaaccccacagatgttgtagtggcagctggagagcctgcaatcctggagtgccagcctccccggggacacccagaacccaccatctactggaaaaaagacaaagttcgaattgatgacaaggaagaaagaataagtgtgagttaaattaaaatcatggcccagagagattgaattttcagtctcaaaatacaaaatagatgtattttattctttaacattattaatacaattgtatttgaatgttaattacaatttatactgccttgaaaagatttaaaaacatttggatgagactacaagagacaaaaattatgtaaatcaagtgtacatgaaatattaataattgcaccaatctgagttatatctttacactgcaatattgatattttagctctttttttttttttttttttttttgagacagagtcttgctctgtcacccaggctggagtgcgatcctgctcaccgcaacctctgcctcccggtttcaagtgattcttctgccttagcttcccaagtagctgggactacaggtgtgcgccaccacgcccagctattttttgtattttttgtagagatggggtttcaccatgttggccaggatggtctccatctcttgacctcgtgatccacccacctcagccccccaaagtgcttggattacaggcgtgagccaccacacccagctgatgttttagctcttttataaaatctccagaagcttctgttgatcatgcagtacctgagtgttaaagtataaatgatagccataaaccacattaactacatctaattttgcaccattttcaaaaattataagagaaattaatttaaggtgatgaatatctcaaatgctttttccagtttttccaattgaataatatttataacagtaaaattttatacatgaattgatttaaaaggaaattgaatagatgtaaaataaaatggaaatcaaaacagctgactgattctgcatgtagaaaaataactgttttcaaaggaaatttataatcagattcatcagttgattaaaattcaaaatgaaacacacagaaacaggcaaatggcatgtaatcattttatttcttcagaggatccacgcaacatttgtatgtgaagtttttaagtgagaaccaacccacagaaatagtatgtaattgcttaactttctgatattattcagtagtataatttttatattcaatacaactgagagtgaatacatttaagataatttctcatttgactgaataaatgtgccattttaataaaaaaactataaagtattggtatctattatcttaaaaatatgtttattacaaatgaggatttttcctctgtgcacagtgagattacaacataaaacagaactagataggctgtggaagggatgacaatgtatattcatgcgtttctggtatagaggcaaagatattttttcccttcaccctctaaaggtttaagtcttttagtctgctgaaataaactggcaatagacagtttaatggaaggaagagcatacaaatgtatttatatgtaagtgcaagggaatcacacaaagtataaaactcaaagaaaggctagatggttgaagcttaattaccctcttcataggatagagggaagtgggaatagtaggtgattttagaggaagattaaatgattttcagagaagataagtgggcccaacaaatagacaaagttcctctggcctctgggagaggtggtgacaagttctgggaaggtgaggggcagaactgcactgcaagcaaaggttgtcttattatgtagataaagtctcagataacaaccccaagaagaatagttgaacagtctgtccagtaggcatggtaatgacctttagtttcttctttggtgattaatctttgcaggttactgagatttcagacaggggatttaaggcaattgtgtttcttttggaagaacttttctcagtcagataaggaaacttcagagagcttccctctctgttcttggggcaagtggaggggagaaacaaaggaatgtcagagagacattgatgttaaggaagtttctaatgacttacaatttcctttagttcaaagtgctcagaaagccaaagcaccacattttgggatatcgttttctgagccccaacaccagtctcactattaacactgtgagatctacattaccaaagagagttttgttctcagtggtcttgcttgggtaccaaatttatgaaaatgtactcctgatgatggagtaaaatcattgtttatggattggtagtttatgtttatagcatttagctcttgcctatttaaaggtgtgctggcagctgaataatccaggatgaccttacccacaagtctggcaattggttgactctcagctgggtatcttcgttcccctccttatgatctctaattttccagcaggctagttcagtcggttcccatgttggtctcagttccaactcagcaagagaaggcaagacacaatgtacaagaacctttcttccagtgaagtatttgctgtagttccattggtcaaatcaagtcatattacctagctctcagcttcaaggggaaggagaaatggccttcacagccatttttataagctctcattttattctaccagacagaattgagaacaggttaatggtctttttcacctatgtaaaaaaaagttgaaaattcctttctagaacatgacaagttgtaaatcttgaaacatctctgataagagccaacgtacatgagttgtgtttgcctgtgaaattaaaaaataatggagaaaaccaacatgttcttatcttgtatttcttcaagaacactcaatcattgtaaagctaatattgaattaaatgagtaccaaaaaaaaaaaactggaaaagaaactatgagttatagatttactgaaagcctaactctgctttaatgtcctccttagcaaatacatattttaatattattgcatttgtttttatcagccaataaatgcttctcatttaagaaatcttgaaggggaacctattagatgctaatggtttatactaatacatattaccattttataaactgtgtttgtttttatccaacctgccattttctccaagaattatctcttaaatacaattaagatgaaacaaagatgattaatattaacagttgaaatgtgaattctagggaggcaaagatttttaccgtttgatttaccactgtctcttaagtgtccagaatatgcctagtaagtatggatatatatactttctgaatccctctgattcagcaggattttattagattatttaaaatgaatatctagtatttctttctgatgacaaatgacaatagcaatttattcaaatgaatttcagtgtgaagactaactactgggatttagggaggtcagtcacaagactcaaaatgcgatcaggaaagagaggacagctgccttaaaaaatattttctatgaagaaagtatggaaacttacattgagggtgaatttaagaaaagaaaacatacctgcaaatgccaaaataatgggagagttttttcctttgggaaacaaatatgctcaaatactcaaaactatttattaatgacctttattttctattctgttcctttttcttcccttctcttttctttttgtttgattttaacagatccgtggtggaaaactgatgatctccaataccaggaaaagtgatgcagggatgtatacttgtgttggtaccaatatggtgggagaaagggacagtgacccagcagagctgactgtctttggtaaaactttcttctaaattataaatttttatttttatcaatttttctttgcttttaagtattactaacattaaaaactgggccatataaggacagttactcatgactcatggtaagcagtgacaaattagaattatcttgttttctgtctttctaatgaaagcttcgatgtaaagaaaaaattatttgaaactttaattaacttacattgttcatgtatttgtaagattttgcagttcatcaaaatgtaacgttctttctcaaagtctatttgagatattacatctatctaaagtttatcactcattcaactctcatgcatttatcaggtagctattatgtgcaagatacagggtaaggatttttaaaagttagagagtatagtataaaaaaacttgttttccagttcttagaaattcaaactgaagtatttataatttcaactcttgataaatatactatgtatgcacacatataaattcaaaatcagaaaatggacccctaaaatgagatattttgttatgatattcatgttccttcaactttaagaaccaaggctctccttagctggttaaatgcaattaataggttaaaaactgactagaaccatatcatataaatggtggataaagtattggaaaggagaaaactggggacaaataaagatggccgaggaaacaaatgtaaggaaaatactgcagggcagctgtggaaggttgaaagagagagaaaatgacaaaaaattggaaaaaatagatatgctaaagatactcaaaaatgaaacactcttttagaatacattctatttaaattctatttaaatctctgtatagacatacacatttatagacccacacatgcacacacatacatgtacacatatgtatgtatgtgtatgtacatgtgtatatatacaatcttcattaaacattttactatagcagatattatgtgattttttaggagcaaaaatatcattgtgattttcaaattatttttcagtagcggtaaaataatcctctacttctgtgcatgatttaaaatccctatttctggtcatttcttcaggacacacccaagtgtggcaccaaagccctgcataggtccccagagaaacgtattttgctggcttgggagacgccatcccaaggtgtaatgggagtgccactatagaagagctgtattatgacttccactatatttcaagagttaagattgtgctttgtgcatgtgtaccagaatgcaggcctctcctttcaatcattctgagcaccaggtaatctctggtaacactccctgtggctactaagcagcttgaagtcccaaatgacaaagctaggagaaatcccataatttgttaaaggaattgaatagaaaaaatagaattgttcaaagtatgcatgtaaatttctatcctgcagagctcagacaagtgtcagtttgcccctacatttcatgcagtcctctataagagtctcaagatgtgctccactctgtaatgaataaaacacagttttgcctggtaagaaatgatattagtggtcactgaacgttagcattgaaagcccacaagtatagctcttctatttaaagaaacactcattgctatttttctgtaactaccacaaactctggaatagaaagaaaaaaaaaagctatattactgcagtatagactgccttcagaaggaaattgaaagggtttaatgtcattacagaagcaattagacttaccactaatgagacatccttatgaaatatttactctactttccctaaagaaatgatgagaactactggggattcctaaacatgtcaagagttatgtgggaacttctaaattattttgaaaatagctattatccaaatagattgaatttgtctagaggcagttcccctggcagaattgatttaggaaacggagaatgtttattagatggtgtaagctagtcagaactgacctgaggggttataagtacaagattaagttgaaggaaaaactagctttccattattggtaagaaaacaacatccaaatccaaaagaaaaacaaaaaaaacaaagtgatggtccaaatcaaggatgtgacaagtattgcccgagaaaccccttctgtatcttggctccctattcttagagaacataaaagaaaaaaaaacagtgtactattaatagggaggtcttctttattttatgctggtgctcctacatctaatacacattttccaatacaactctttatattttagcattgttacatattatcatttttgaccaaatatttatataagtaaaactgattgtacttcatactctacctccctcaattttattttcatggagcagcaatttcacttttaaaggtctagctactataaccactctgtagctacagaaggtttttaaaggtcctttgcagttcaatctttatcttaagatatgttttacagaacaagttacattttgttgttcaaaaaaataagtatatatattattattataaatatgatgtaaatatattatattttattgatacctattattattataaatataataaaaatatatataataaagttacatttaattgttcaagaaatataagtcacttgtaaatgtcaagaaaaacaatgaaaggaataaagggttttttccagtataatagctgtctactttccgagacatattgctaggaaaaagaattttctgaattcttcaagtattttgattctagtgggcttgtactttgaagttgtatagtttaaaatttcagcattatatattttaaatgtgccatttgatcatatcaaagatatgatcggtgtaacctaactttaaaaagttactgtgccatactccatgaatcacatattgtggttgatcttctaatagtttttggtcatgaaataacatcctaattaactgggcattatcaaatctaaaaattagaagtaggtatcatagtctacagtagcactgaaatctgtggcccaatctatacaccttcctgaagtatagtccctagaagtttacatatgttaagctctgaagatcctggatggcagagaaagtagagttgaagtaaataatacaatttctaattatgagtagatttcagaaaactgctgtccaaaatttgggttttaaaaatgacatgtggatttcaaaaatgatttttaagtgtttatgaatgcaatacacgaaaacttattttatgtgtaacatttgtaaaatataataagtattacaaaacttagaatgaaatacaggaatctcttgccccaacacaaacacacacacacacacacacacacacacacacacatatatttctcatcattttacgttctgttttatctaattattctgggatttgtttccatatttctgaatatgtgcttaatctgctatttattgatgtatcaatttcatacattatttgacttcctattatagaagatgatgatttggcccacttatagctccttccccaccttctcacctccacttttccttctttttctctttttagtctatgaactttcaaaacattggttatattaatattcagaatttgagttattatagtcatgtcaatattattgactgtgagttgaatgttatagtattatgaccatatttcttttctggtactatttttgttcttctttgaattaataataaacccattttcccatttacttatgctttctatacctgtcatgaattcttgaaatctctaacagaaactataaaatcttctataatcatttttttagactttagctattaagtccccttcactacagtcttccctgaggctgcctgatctgacttggttagacattccttaggtcaacaccgtaaacctaattctgcttttgtcttccttgtctggaatgctggatctgctgttttctgcatcctatgtttgtttctttcttggttaacccctcttttcagaaggggttctcaacttctttctgcttggctgaagcttggagcacattctcaaccaaaatgccttcattctctccagaccttagagttctagtttagaattatactttagttagggaatttgactgaaataatatttttgctcagagtattacagttgtgactctaacatcatttagcatctcatgatgctcttgagaagtctactgtgattctgattcctgtatcctgtatctttgtatgtgatcagttttctttttctttttcttttcttcccaaatgtttggtggtctctttaccccagttttctgaaatggttcaatacattaccttagtttgacactcttctcttttctgtgctgtaagttgatgagcagtctcaatctgaaaactctcaaacaaaacaattcaatgaaatgtttaatttttttaaatttttctttgtcaaacatgttttcatcaattagattttaaacctccttggtttttcttttctctaattcctccttacttatagcatcctgttcttgtttcatgggtattatgacttctcttgtagcagagagtgttgtttttgtaatttgaattttgttttatttttttaccagcttttattaagccccaggtccatgtgcaggatgtgtaggtttgttacctaggtaaacttgtgccatggtggtttgctgcacagattaacctatcacctaggtattaggtcccacatccattagctattctttctgatgctctccctcaccatgcccttttgacaggctccagtgtgtgttgttcccctgatgtgttcatatgttaccattgttcagctcccacttataagtaagaacacgcagtgtttggttttctgtttctgcagtagtttgctaaggataatggcttccagctccatctgtgtccctgcaaaggacatgatctgattcctttttatgactgcatagtattccatggtgtatttgtaccacattttctttattcagtccatgatgggcatttgggttgattccatgtctttgctattgtgaatagtgctacaatgaacatacgtgtgcatatctatctataatagaatgatttatattcctttgggtatctaccccgtaatagtaatggtatttctggttctagatccttgaggaatcaccacactgtcttccacaacagttgaactaatttacattcccaccaactgtgtaaaagcattcctatttctctgcgacctcaccagcatctgttgttacttgactttttaataattgccattctgactggcatgagatggtatctcactgtggttttgatttgcatttctctaataatcagtgatgttgaactttttttcatatgtttgttagccacaggaatgtcttcttttgagaagtgtctgttcaggctctttgcccactttttaatggggttgtttgttttttcttgtaaatttgtttaagttccttgtacatctggatattagacctttgtcagatgcttagattgcaaatattttctcccgttgtgtaggttgtccgttcactctgatagtttcttttgctgtatcacagaattttaataacacttttttttaagtaaaattatcttgtgatgcttctctgcctttatttcctcttagtttctcttccccaccatcccccaccaccatggctccataccacattgttctttgtcttttcgctggaagcttttttcaaatggcacatgatctattgttgttaattcatatttagttgttattctccaaaaagattactggaaactctgtgccaactgattattttcacagtacgatgttcagattgagaactaaccattttggggaagatgaggacagagattggggttgatgatactggttttcagtctttgaatgagagataatagttgataccatgagagtagttgaggtattcagagataacgctatgagagaagatccttaggacccacaccttaagaagtatctgtattttattagtagcatgtggtataagaacatgaggtgttattaagattgttgtcggcaatataatcctttcttgagtatatttattgagcatctgctatgtcccatgccctgtttaagtgcttaaatactaatggtggaatgaataggcagagcccctgctctcacctggactcttatatcatgttatcagcaataacatgaaattttgcctctaatatgtggtgagagaggcattattttcctctgagaacatttatttatatttgtctttacttcataggatgaattttctcaggcaaggaaagttctagccaaaaagaaactaatgcagtcaggatttatttaatcacattcagacagcctgatcattatcattcagtctttttctggaagggcatgacaattcacattcaatgactatcaaacccatccttacctcatacatgcccagttaaataaaaggagacctaccagggccatctgacttccaatttaattgacactacagggtggcaggtctttctgggtgagctgaagtcaagataaggtttacaagcagtggttaactctaatgtccttttattacatagctttggtcttacaggacttaaagaactctacctatgtaattattgccataacactaattttataatgttaagcgaagtttatttttaaaattttatggtcatttgagaaatagctgttaccacacagtgattgacaattttaaagccattttcaatgactgaatacagttaaaaagagaaatttgtttgctgggcacttaattttttcatgtaactaagtaacttaagagatactatgcaaccacatttcagatttatggtattttgtgttaaattgtatatttgctttctgaatatttttgacataactacaagagacttggcatttgattttattatagctgtatataaagttggatttttccaaaacgccattttggaactaaattgacagggctgactacttgagagccatactttacagaaacacactggcaaacaacactactgtcccaagagagattaaccttgtaagcaagttatgcaggtgattcaaatcctgttaatctcacataaaaaaatgttaattgcattggcaaagacattgcctctgatcactctgcagttatataattagagatcagcccattcagagaggctctgatctaattgataagcagtcagcaaacgacccttgagatttcttccccgtttttcaatatgtggtcagacataaggtattaacatgaaaaaatcagtgaccttgttttgacatgttttaaaattaagtttgcttgttattcaatagtttaagattttcatgcatacttattttaattgtacagagctctaattgtccaaactctatggagcattaatagatattgagtgtgatcacttatcaatgtattggatggttttattatcaacttactttctaatccacctagcttttcatttttttggagatgattttgagtcaaaaggggagactcaagttacttccttataatttttaaaatttgtgtctgaaaggggcttggctttgtgtttggcttattgtaacggttgccactgcagatccaacgcatttgaaatacatttttggcctgtacaacttctttagtcttcatatttatgtttctgattctcagattttctggaaataaagttggttaagaaaagtggaaaatagttcttacaaaaaatttcttccatttaaataaatgttaggcaaacctacagtttttaacataatgttttctgtgggtaattatgaaaattgcaaagcagaaggtcagtttagtataattaacagaaaacaattggaataatgaataacacagtttagagataattgttagaaagggtgctatggaaattctcagaataatactttaaaatatgtgaccaagctccagtatctcaggaatttcccatgtcacatgttggacagcacatcctaatacccaggtataaaacccatgttgatgtgtcatgtatgtgcaggcgactttcatctcatttattctttgcctttgttttgctttgatttgtttttctatccattgaattacatttttcaccatgagccaatgtcagacttccaaaaattgtataccacatatgctcctgtggttatccagttgctaagcaactggactctgcttgagggtagcagggtagagagaaggttcattgtgaagtcctgcacccctgctgagttcatttgaacagcagcagggatcctgtatcttgattcttcttgaaattataaatcaagtgcctccacgtgtctccatataaaacaatgaggcttagaacaagtaccatgactaaaaaacccttagggatcctaatggtatccccttgaggaagggacagcttagttttgagacatctctgatgtaacgtttgccatttggattaattatatgttgtgattttgtgactgttagcatgttaaggaaagcatacacaaactttgcctgaaaatataagtattttaatggaactggtctcacatattgtttttcaatttattttatacccagcataatgtcatgaaaacttttcatgttagataggtagatagttttaatattgcaatgacttaacagtttttcaatgtataagtttgctgcaatgtatcctaaaatctcacattttccaatattgtcagttttgctgcaattatcctatggacttcttagttttgttgcagttatcaattatcgaagccactgttctgcattgttatattttgcagagtgtctgcaagtaatggtggctttggttcttcttcagggctcatatttcctttttcttactgatttttaatgtcggcatgcccgtcttgttccggacttcaatgggcatgacttttgtattttactttttttttttttttttttgggacggagtctcgctctgtctcccaggctggagtgcaggggcccaatctcggctcactgcaagctccgcctcccgggttcacaccattctcctgcctcagcctcccgagtagctgggactacaggtgcccgccaccgccccagctaatttttagtagagacggggtttcaccgtgttagccaggatggtctcgatttcctgacctcgtgatctgcccacctcggcctccgaaagtgctgggattacaggcgtgagccaccacgcccggcctgtattttacttttaagagaattttggcatttaatttcttgcaaaatatcttcatcacgtttaaaaagtctgtttgattccttctttatttagatgatttgtaatttgatagctatatctacagatttgatcatatttatcttcatttctcttcctattatataagtaacctcctttatctcattgaaaatttatttggcttcaagtaatataaatctgccgaacaatggcttaggcataagaggttcatttttctcattcttaccatttctatgatgaaaggagcttacacacacaaactcacacacacatgcccacactcacacacaatccatgttttacctgccagtctgtttcaatttgctaaatgaaaagttgagacatttccttgagtttccttttcaccctatgcgtctgactgatcacccagttttgatctctcttgtctgtccccttttcgacatcctatgaaccattgtgtcagtttaagctgaaataatttcttacaagaacgctttgacctaattcacgactttatgtttctcttctaatttatctttcacagacataccaacacgacctttttcatatgcttattcaacaagttgcttacttgcttaaagtccttcaatagctctctatcaacctcagggcagagctcacagtccttgagtggtgaacagggccttcatggtcttatcactcactctctgtctagctttgtctctcaccactttccccaatgtaactaacctgctcactattcaccagcttgaccacttagtgaaagcctctaggagtgggtgcattaacatgtgctgaatgagtcagtggatgagagaaagacttctctagcttgttcatcccagtgtcaggatgtagtatgctactcccactaaaatcaaagggaacaggaaaggtctcctcttgatgaatcatttttcaatctggagtaatatcaatagtgtctcaaacctctttaacattgggttaatgtagtttttggatgaatagctgcgcctgatagcacagaagaagtcgatcccgcttcctatgtgaatgatttattttttactattagcatttgggaccctcataaggatatattaatcctattgcctatttaactaccagaaatgatagctcaataccaactatgccagccccaaaatagctgttttgggcacatagtgtacagagttgaaaaaagtaacactaaattattttatccgacatgttgtctacagggcacaatttgctgctaatttattcagggcgtctaaaatctttagatgcaaccgtgtttttctttagtttttatggatcgtttgtcaattctgcatttacaaaatttttcatgatgaaattctatttgtcttgttttattgcttgggatttttgagtcccagagtacggatactctagcatatgcagaaaattttgatccctactgtcaaattctctggagatatacaatagtcttccttctaaatgccaatggtagttggttttattgcaataaaatatttatcttgcaacttacacatttgttttataaatatggatcttgatttagtcaataaaatcaaatactcttatttatactcttaacatctattatttgaagtaatttattttctttgaaggtttcctgccgaatacattttagtttttgtgccactgtatacaaaattttaaattagaaggtttgaaactcaagttctaagtggctaaatatgtccagatggccagaaaaattgtgtcagcttcctacagatctcatctttcttttccttggcttagttctctttctacctcagtaagtagcaatattgaatttgtttgtgatttgcagatatgggctaataaaatttaaatgacaatttttccagtctcagaccattatccaaaagggaagaaactggacaaggaatgccaatgtctggtgatacataaaactactttttgatttgtatcctcagaggctaagaatcttatggataggaaaagatttttatggatacagacttatttttctctagccttatgtagaagagtgctagaatacaatttaacagtgccaaatacagattaataaaagaagaaaggatgaaaacagtaaaacagattactgaagaaataaaaaacataaaattaagtaaaaaaaaatgggtagatatctcaaacacttaagagaagaccattggagaaaacctcaaaaaattgataaataaatagtttgcaacaattaataatgacagtctttgtatttaagaaaaaaaatcaggtagacatctttccatacatgaagttaaaataatcatgggaatattgagtccttatcaaatcatagcttaagtgggaaaatctaggtaatacatatgtgtgaaagtacacattttttggttttctctagcattcttgaggaatattaatatttgttttttaaatgtttttatccctttcaacttttagttttcccactttgaaccctgataatagattattgtaatcatttttaatctctctttttcctgtagaattcagtgttctgattttttatgataggatccacctgatttagctcagggattcactgaaaaatcaatttaatatttttttccaaaggttgtatggtcttatgtgcaaactgtagctattcctttgttccaaaatatcttattttattgaatgacattggattcacaaggccttattaaaacacagctgaggtacagagttaggtacctgtgtaccaaaagtaaattaggtttcctttgcttttttcataatgtacttaaagcatgcataatagtttatctcattttaccattgtttcattttttttttcaagaacgacccacatttctcaggaggccaattaaccaggtggtactggaggaagaagctgtagaatttcgttgtcaagtccaaggagatcctcaaccaactgtgaggtggaaaaaggatgatgcagacttgccaagaggaaggtaagaccaacatatggatggaagattgttagataaccaatgaataattagaaaataaaaggacagctacaatgccaccaccaaacactcctatgtcttggggtactttcactcatgtgatttttacatatgcaagccacatatttactgtttgtatgttaaagtcctccaggctttcaatgtcactctttcaatgagtatctacattaatgcttgattcttcattccacctcttatccccagataccaaggattcctgggtgccttctttcccctggaccctttgaggtataccattctgttcctgcagaatgccccctgcaggcctccatcaatgactgcccgttcccatgcttcatcccctctggataccctttgtcacctctgtggcccaaagcataactaacaaaagactattgcatgtggctgactgtaagtcctggagtaaaggaaaggtcagcataacactgaaatggtagcaagtagttggcatcatttttcacataggggatttccaacacagagaccttctgtcactttcttttttccatctcttcatggagaccttctcttccatctccttcttattgttcttatcacaaaacccccaaacccaatctctcaaactctaacctgtattcaaaaatgcttttcatcatatataaaaataattttgacttgttgttatagaaatttccttaaggccttgccatttagaatgaaataagtaattcaagtgttttttgttgttgttgttttaacacaagtaattttatctttaagatttgttatgccttcctgctagttctacctgctgatattataaccatcatgcattctccaattactgcctgcataaaattgtacaggctgtgtttttctaatttttcttttttttaaaaaaaattttttggctgggcacgatggctgactcctgtaatcccaacactttgggaggccgaggcaggtggatcatttcatgtcaggagttcaagaccagcctgacaaacagggtgaaaccctgtctctactaaaaatacaaaaagttagctgagtgtggtggcacatacctgtaatcccagctactcgggaggctgagtctggagaattgcttgaacccgggaggcagtggttgcagtgagtcaagatcgtgccactgtactccagcctgggcgacagagtgagactgtctgaaaaagaaaaaacaaaaaacaaacaaacaaaacaacaaaacaacttcgtttctttcaactgactgatattaaccatgcttcctccgaagctgtataccttttatgtgctttcactgctatcagtaatttcctaaatgtaaacattcatttcaaaatctcaattttataaatccctagatatgattggatactttacttcaaaaggcatgtcactcatggattgaataaactggattcaaatgcatcaaccatttataatagttactgagaggttctttacaatctacaggaataaaacaagtgaaaacattaattcagttagtttttcagcctatgtagtggggaaagtcatcattgtgtttgtttcatcattttaatgccagacatctgtctttaaaggaatggtattagtagaagaggtttgtaaatgtgaggcttttcatgccctctcattggagaagcaggttagaaaacaaggagagtttacactattgaattgttactgtccatcctctatatatagtcagcaactttcttcaaatttgagagcatgtagtgaataattttaaaatattaatgtaaggtgaagagattaattctatagtaaaatttatcctagtgtaaacacaggtttattttaaataactgggagtatatgcccttgtgcattgaaactttaaaaacctttaattttagaataattttgatttataggaaagttacaaaagttagtaacagagagttcccatttacactacacccagttttccttattgttaatatcttacatgacaataaaacatttgttacaactaatgagcaaagcttgataggtaataattaagtaaagtgtatacattatttggctctcccaggttttcatcattgtcctctttctactccaagtccagttcaggtaattattgggttgggtatcatagacttctgcatttgttctcatatctctccagtctcctccgtcctgttacaggtccttagtttttctagttttgtgaccttaacaaccttgaagggaagtgctggccaggtatgctatcgaatgtgccccaaacttggattagccggattagactgcgtttataggtttttaaaaagaataccttagaaatgacatgctcttcttagcacattgtatcagggggcacattatatccatataacagcactggccaccctgttaattttcaaacactgagcacgagctagttgacaaaagtattaaaaatagagaattgtaagtgtgcattgcattttaacatgtctatgttcctgaattaagataaaataaaaatgaattgagcctagtttgattatttccagcttaatgtaggtgttaggtcataaacctgacaacttaagctgctacactgttctctaaatcttgccaaattcatttgcttcaaagtacaaatgatacatataaatcaaacaacagcattaaagctacactatcagaaggtatgatatcaaggccactaaacaacaaggttgaaagcatgagaaatcttattttcactaacttcctttaaaacattttcatagctttggcctctttattctttttaccagcatattatggtagtactttgtgtaaccagttaaatattttaaaaatattagacaaatggaagtgctgtgtaagctttaaattgtttttgttagaaaggcttaaagcaaggataagtgcaatgtagaaactgaggtcagtatttcatcatgaaagaagcatgtactttttcttgaattcccagtctttaagtgatgtttcagaggagtttattcattcctcgatttgtatgtattagcataagcctcacttatgcataatgagagagaaagacacctctttccttggtgaggaataacagtaataacttttagccaaccgtagactaaatcaacaacattgattctattacattatttaggtctcagactagggagatggccattgttcttgtataagcaattggtgtggtgcatgacatttctttggcttaacatttaatgaaatttgaataaggtttgtgtagtggttcatgcttaacacatttatacgaaagctttgtagggcagctgcatagcctgtaattactatgtaagtaatatgtgactatttttcttttggagacaagaaaagcttttcaattcaagtttaaatttatgaaatgctgtgagagctattaaaaccttcaacacagaagaagatatctgtgccaacctttcagtaaccagagatgagttaagggagtattttttccccttgccttgaaaatattttttaagtagtactgatatgcctctttcttttatttagtcttaaactcctgacctttctcagtaactacctttaatgaaattacaacagactcttagtgagttgtattaaaacattttctgaaaagatgaatgtttcagtttggtaggaagcatagcaagtctaacaataacccttatgctcaactagggaaaattatttatgtggacattttccatgcgaccaagggacaaaatggaaaggagtctacattatacatattagtgccaaactgttaattccttgcagagacttctgaagatattaccgtttcacaattgagtatttcaggaagcatactgattctgtgccaagtaccaatactgttttctagaagatttcaatacatatgtgttagggacaaaaatttcataacactaacgtgagaataaagtgagtaggaggaacaagcaagtgaaaggcattttatagtttataatgattatgatttttgaagcacatttttaaagcataatttaaatagaagaagatgcacttttgggtttacctacatttagtgagtgcctactacatttgtaatgctcattgcaagtttgaaaaagtaagtcgttttaaacaaggtaagttaactgttatcagttctttagtttttgttttatattagtgagattgggtgacgtgggaaagtatttacattccaaatacagtaaagaagtaaattggaacagctctagttattttcttgggtactgtctgtcttttgcaggcaaatatccaacattttgcttattagtactgtcttgatagagtgccttcaatacatcttttcacaaagtgttttatgtgatagaagttgtcagtatttataataaatgaggtgagtttccatcttatgccatgttccctcataacataggtttattgtatattttcgttatataaatatatttatgtgctaaagctctgtaaaaaagtatcacatgaagaaacattaacataacacaagtaacatgccataaagaaacagtataatacatttgtaaccaaagatataaaaataaattgaaatatgacaacactacaatattctgttcaatttaatattaatgagaattttaaaaaaaatccctctcagaacttgggtaagagttagtgtgattaatctaattgtgaattcttatctgtgcatgtcagcagagtttgtatttcatttcattattagcagtctttaaagaactgtaaacaggagatttaatatctctcatcaatcatataactttcagcatattaccattacctcctttatcttttttatttcatttttattttctaaactaactctaaagtgacactaagttcctcaataagaacttctctcttccacagccgagaaaggaatgttcataatagcttgtcagaagaaaaaggaaataaaatatgccatttacatttttacgtatgcctgcaaattctaaatgcagttgatggcttgcacatagtggatataattaatgaatatttcataaaatagaaaagggagtagagaataagagtttcaagatatatggagcaaaattctatcaattttccttaacccactgacaaaatttccttttctaaagtgcaagtctattttaagagagaattttcagagtttttagttccatgaaatgtgagatttgcataagcacatgattctttaagaaaagaaactgaatggaactacttataattcctttttttttttttggatggcatttttatacaaagtggctctttcttcttagccctgcaaaatgtgtttagattaattgtttggaagctctattgtttagagcatgtgcttctgggacacagagatgctgaacaggtgctcagctacccttaggaggcaatgggccttcttcacatacagtgtatgcatcaaggacatgggataatttgagctcctgataaataaccacactgattaggttggctggtaaagactgggcaagtgaaatggtcttagcaaaagaaggaaaatctaagaacaggagaaaagcaatgaagcaatgtgtacaaaatattgtaaatgacatctaaaaaatggactggttcctaaaagtcacaaatttaaagaaaaagtgtaaatgaaaaatctttattttttatgctatacagatgtcttatccatgtctgtctaaaaacaattggaaacttcatgagcaatgactgtgggaccttttaatacaaattacaataacatacaaatatttaggccattgccaaggggttttagactttaggccttgttctgctactgtttgatcatttagtttatttacactgccgttttctggaaatgatagttgacaaatttctctactgcaaactaggaatgtgatcttgaagaagctatttaaactctatgttttacatcctgaaaatatggcccagcaatgtggtaggactggtgattaacctatatttttactgatcttatagggtgaagaattatgccatccattctaactcaaagggctattaaaatgatataaccatttcaaagcactgtaaacattgtacaatggatgcacatacatggtgcctcagttttacaaatccacctgattggtggcatttattaataatgcagttaactacagggaaaaaaattaatgctaaaaaaatataaaatatataatttgtatataatgacacattttcctatctttggccatatgatttccatagaaacatatacaatattatttttaaataagtatcacttacgctttttttttttttttttgacggagtcttactctgtcacccatgctggagtgcagtggcacgatcccgcctcactgcaccctccacctcccgggttcaagtgattctcctgccccagcctcctgagtagctgggactataggcgcccaccaccacgcccagctaatttttgtatttttggtagaaacgggatttcaccatgttggccaggctcgtctggaacttctgacctcatgatccacccgcctcagcctcccaaactgctgggattacaggtgtgagccaccgtgtctggcctgcttttaaattatatagattcatttataaatgtttctagtgactttgccaagtctgaaagttgcctgcattttctacctttagtaagctatacattctcctggtattgtgtgccacctccagtgcaatcagtcacctgggttgagaccttcacatttcacacatactgttttgtttgtctgtgagtaataagcataaaaccattattataaaaagatgtgtaatgttaaaagcaagtatttagggaggacttaccatgtgccttacaatgcaataaatgctttttacatatgttaattccattatttttaaagcatagtattacagcataatattactcctacttgagggttacagaaacagaagcttaaacaagttaggtttttaaggccacatattaataagcattagggccagaactgaacttagaatctgtctagcatgaaatctctattttaaatgagagggcatgataattatatgattattaattatttaaggatttgagtcacctatgaattttatattttagatagaaacttagataattggttagaaatactatattatgaataactaaataaacatagtatacagcaatagagttaaggtaatttttagaccaacttcgtaagccacacataaaatgtcttgacattataaaaatttaaacttagaacagttcaagtttaccttcttggaaactgaagatatagattttgtttttacaaacaggattaattgacaactttcagagggatgacagaattgtagttttcctgtgttttcatcaaataggtgctaatagttgctgttaacacaaaactaattgccacctacggtggggagtgcaagttgcctagtcctgtgaccacattggcccatctgttaagaatctcagcttaggaacaatgctggaactggcatccaatttgggttctggccagtggtcaactaacaagctggaacacacatggaatatgaaatgccttgaagtcagagatgctctgctgtctgttaactgacagctcttgtgtgtgtgggcagagccaagaccaggtgccagtatgcagagcaaaaggatctgtctgtgtgccacctgtcattgccatgtgcgtaatgtccaaacaggagccacagtaggtgtgtttcttccatcaaagtgtggttgttagagcattcagttaggctgaggtagcgactagggcaacattttaccttaaaccaaactataggacaagccagaggcttaccagaaggtagctctcatatcccgccatatcacacaagtggatggagatttaccactggagacactctcccctgtacctaggttcttacattaactctaagcaaaaggtaaaaaaaaaaagttgtttaattaattatattaacacaaatacttgtgtgcacaagacaatttgtggttagaatcatgcaaataagttttaatcaccccaggggttattctaaaaatatatttctaactgatttttgttattattcttaataagttgaactgtaacataaggctgaaaggtataatagaatttaagagatcaatgttcttatcccagctctgccataattcatcatgttattttaagcaattcatgtaacatgtctgagtaccagagtccacatctgcaaactatgttggattgaatggtttcggtgctgtcctcaaattctgaaaaattgtataattctatgtcaatctctcgaaacaattagagaatcacggcaatattttttttcaatagaagaaaaaaagaaaccagaaaattgaaatagatggacataaagaagaaaattaatattacctgtgtatctattatccagtgacaactacattttatgtatagaaggcatcttgtaaacttatttatattttagacatatttttcattcaaaattgttcttgaccctgaatgcttacttaggcttttattgttaaaaagccggtactgattcaaaatagctgtttctgactgcattttcctttcccataaatataatattaataaatgatatttacacagtgcttactgtataccagaaataatctaagcattttacaatagtgctattttatttttagaaaatgctatgatgtaaacattattatacctataatataaatatcaaaactgatatgcagagagggtaaatatgccaacatcactgactatgggacctaggatgtctggcttcaaagtccacacttttggctactacatagtggtgctgagtgggaagaacttttcttcattttttatttgggattgaagataaggaaaagacagcctagcatatgcttgcctagaagtagaatttttatcatatagtcacagaatacatctatatagaaagcacatgttaaagttttgaaaatttttattataaggacacttatttcccataatatatgtttattatgtcaaataaagaagtttatgtcttttcctttaaaatcattattttatactacttattgacacaaaatttaaaacaaatctattttttctcatggaatgttttaacttgtattcttttcttctcaacactatattgggtaagaaaaaataatttcactggaaacatattagaagttaaagaagtgcttgctgaaagagtcaaatggtgtgagtagggtgtgattggccctctccatctatgggtgccacatctgtggatttaaccaattctgataaaaaacattaaaaagcaacaataaaaataatagaaataaaaatacagtattacaatgatttacgtagcatttagattagatatgataatctacgatgatttaaagttgcaggaggatgtacataggttatatgcaaatactacattattttatataaaggatttggacgtcctcagcttttggtattttcagggttgtggggatggcagtcctggaactaagccccagtggatactgagggaggactatgtatacatctagaatgatgaactcttctagggtattgatagtttaattcatctttcacattcactgtctaacaaagttctcagaccaaatttaagtgtactaaaatatggtaagtatagtcaataataacaattctatattttaaaataatttaaataatggaactggattgtttgtaacttgaaggataaattcttgaggggatggatagataccccattctctacgatgtgcttatttcccactgcatgcctgtatcaaaacatctcacgtaccctactatgtacccacaaaaaattttaaatataaattaaaaaaataataataatataaatggccaggcgcggtggctcacgcctgtaatcccagcactttgggaagccgaggcgggcagatcacgaggtcaggagatcgagaccatcctgactaacacggtgaaaccccgtctctactaaaaatacaaaaaattagccaggcgtggtggcggcgcctgtagtcccagttactcgggaggctgaggcaggagaatggcgtcaacccgggaggcagagcttgcagtgagccaagatcgcgccactgcactccagcctgggccacagagagagagtccgtctctaaataaataaataaataaataaataaataaataaataaaataataataaggctatttggaggaaaaaagtttcttcaaaaataaatcaataggtactaagagtatgatttttgctaatttcctgataatgtttgaatatcaatagttccatggatggttatgagttaacaggtaggactgagttctaggctatatattttctacccaataaatatttttttcatttttttaaaactatgtaatggtccctcaggaaaagttgtaatttgatactattattttaattaactggtatgaattaaaagagaagggataaaaaagaataatttctgagatccagtactacaattacatgaacaaggaacatatctttgttagtgtatgaaggagatataattgccaaatataaggaatgggaggacaaatagtttcaaagtatttcagggtataccctgatccccttcagtgaagtcatttttggggggatctctgttttagttgttacatagtataactcactggcgcttcattttaaaaggccatatttggaggtgggaggttagccctagggctcagtgagtccttgccgagaaattagaagtccctctgagaagtgattcatcatatagacctatgggataacatcataataagatctcagtataaaaattctgccagttattcttatgagcatgatgttaaaattacaaaaggtattgtaataccattcaactcattcatcagtatagacatttgaaacctttataaagatgatctggttgggtatgctatatcattgcaattctttaaataaatggcagttgttataaaaatatgtcctatttctgacacatggtactcaccagttaagacattcagtgcagtgcttctcaaaaaaaaaaaaatgttcaattaaacccataaacattctaacccactaactgacattttctaacagtttgtccaaatatttaccaccacaaataacagaaacaaaaaagtaaaagagacctgttatctttatttgagagagtatttaaaagtgagaaagaaaatgcttttgtcttcattatgaacataatttatagtaagacatatatatagttgattttctcaaacgtaaaccccaaatcgccagactagtcaaatattatatatcaagaattatttcaaaaataatcccattcattgaatattctgtgttgatatttcaaggaataaaaaaagatgagattgttctcaaggattttagtaggtagtgtgagatatgcataacattattaaataaggtgaactatatacaaactatgatatttgaggctctttatggcttcagaaaataaaagatagtctattcctatatgaaactagagataggtctgaaagggaaaattgaattttcataagtggaatagcaatggctatttcaaaagaacgaagcaggatgaaaaagctttggaaagcgtgggccaacaattagtgattcggtttgcctggaacatggaggagtggcacttaaggccacaaaggttagttgtggttctattatgaaaccctttaatttcaagtgaagtgtttatatggaatacaccataaaatggggattaattgaagcacattgaatagaaatgcatctttgtgtccacctttagaaaactgattctttcatgtagagtagcttggaacagagaaagtttggaagtaggcacacctggtaggaagctgaaatatagtttagggaatacattgagtgtattgtgtgagttacacaaatatggacattaatacaagtggtcatacaagaaaacctttttttttttcaattggcaaataattgtatgtcagagttattggaaaaagagaaattaaaaattaatgctgagatttgtaacttgggtgcctggtcaaaaggtggtgtgttcaataaatagagaagtcaaaaggtattattcagtctcatcatttttaatcatgtaatagtattttctatcactgaatccaaggtagaattgattgtgagatttagtagtattttttctctgagttaaggagaggaaaaatgaccaaatcaactatgatatgccatctatgataagatgattcctaattctggaggtgttaaaatataaaaatgtgcatcttaaaatatattaaatatgggagtaatagctaatatttacaagtgctttccttagaaataactcatttaatcttctcaattttcttatgaaacaggaactcttatcattgttatttgataaatgaagaatctgaggggcaaatataaatgagagagatttgaatccaaatccaaatccaaagcccactttcttgactactatatacagtaatttatttctagtaaaacatatttaaaaataatggcataaactaattttattttaagggctcactggctttctgcttagtggctacacaatatttttaattaatgcttccagcagccttaaagtttgagtcccttctttaaacagaggagaaaactgaaggttagagacagtgaaaaacatgctcaaggtcacaggaaacatggtaacaaaactggattcaaacctcaggtctctctaatattaaaagcttgtgctcatggcttatgttggacccaggacgcccttcattccatgtgttagtcaatggctggtgacattttgttttgtatatttctatataactttctaacttgaacaaactcatacagagtccaaagttcagtaaacagaaaataaagtgattcttctgctcaaaatatactgcgtggtgtcccagtgtctccattgtgcacacttggaacaactttctaagagaaagtagtgctcagatcatcattattataattatttctttatctccccaactccctttgccttatttatgtttaatcctaacaatcctaaatatccagtcctatgactgtcacatggtgctcacgagttagtcctttagtgcagtgattctcacgaggggcaaatttgcttcccccatttcctgatatacatttggcaatgtctggagacatttttgattgccacatttgggagattgggtgctactggcatctagtgggtagacaccaagaatgcggctaaacgtcttactatgcacaggacaactcccacagtaaagaataaataatctgacccaaaatggcgatagtgttgaggttaagaaatgctgatttcatggaaaaaatcaatctgggcattgctcaagtagttattttatgtaatttttattttttgtttttaatgttagggcaaaaataatagaatataattcactgaaatacacttcgaagataataatctttttttgttgcctgagatatgatggttatacaaaatgagataaatgaataatatcataatttggtttgatataggcatgtcatcatttaacacaagaagaggacctgttggttttctaatgatttgagatgaatgtatatttttgcaccttttctagaatatataaggcagataatttttcttcatattccttgcacatcagatagttgctgaattggcgaaactagtaaagaatatcctaattagagaagtgtctgaacctcattttcaaatagacctacaaacccacaagttatgtgaaacatttaatgatcagaagtgttcctatgaggttgtatggaattcatgaattattccataaacacatttcaagaggaagtttctcttggcaaaagaaaaaagaagaaagccttttgaatcttccacagcatctcggactgaacatccctctgataatgtagtcacttccccagctagttctcagtttgaacactgatgaaggagacttcttagcatttttccaacaaagacagcaaggtcgccaaatagatggcacattcggaaatacattttaccaattttaccgtgaattggctgtctcttatcacagcatttcttcttgcacacagaagactgcaagaatgggctctgcctatctaaaaacttccagtctgagctgtgagctctgtggattcttgtggatgtgatccctaaagtcctgtcctgaaaggacttaaagttgggttaatttctacccaaacgcacaactatgagctatatctacttttccaaatctaataatgcaatttctagtcctattgtaaaaccagttttgaaagtatttaatccagtaaaacaattatttctaaatgaaaggataacttaacttgcttccacaactttatttgttccagtaggaacaaatgttcttcttagttgttcttcttagttgtaatatatttgtatttttaacagtaaatttccaagttctacttattcaagaacttattgaaaataatacctgcaatatttttaaagtatttaaaagtaataaattcaggaagatgcaccagattttatttaaataatctatgaaaagttactggaaaaattgccaaaagagtgttgcatattaaggacaataatgaaaataatgaaatactcctttctgatcatgataaaccaaagaaaccctttctctataatctaatctctataatgctttggatttgatcttatatgaatgtagaaagaagaagtacatgatttcacaaagcacatatgtatcttgttctcagaactgcagggagcttcaataattgttctgattttcactaaattgaaagttccagccacctctatatgtctttctcaaaatgttgcaaagatatctttatatttgaatctctaatctttaaatatgtatttatatagtatatatatttttaaaatatatagtaaaatcttgaacgttttatatattacaaaaatttatataaaacatatattattataaaatgttgtaagctatatagtgaaagcattatatataaatgtatatattaaaggtttagagatttctatatatatgtgatagtataagataaatatatacatattaaatatataaatatatttaaatctctaaatgtttaggagttctcaatttagtgaaaactagaatgactgtagttgatattaaagttctctgcatttttgggaacaataatgtcattgttagtgataggtcagtgcactatctgcagctattcatagtgtaatgacaaacaataatgaccaccatgtcagtgatttaaaatattctaagtaaattctaaagttgtggcaagttctttgatgttaatatttgatataaatgaagggtttatcaataatggaatctgtttataatttttatcatatgctttttaacttaaacttaatttttatcttaaaatttttttaaaaaacaacatttagaccttgctctttttttaccgctgaagatcaaacttcggtttcttcatctaggcaacaggggtgcatgtgtgaggggagaaaatgtatttttttctcaactctcataagtttgtagttgggatagactgcttcaacaaaacacagattaacaagaggaagagcaaacaggtttattaatgagtgtagtgtatgtcaaaatgagagaggggtaactcaaagcagtggtttacaagtctggtttacatattatcttcaacaaagaacatcaattttagaaaagtgacaagacaaagtagtcgtaggcttcaaagacaggagaataggaaagagtcgtttgctcctccggtgccatctctgagctgatgaaggttgcaagggagaaattacagcctgtcttcaggtgggaaggtaggaaggagggtagaaaggccttttgtatttgtaaatttctgtcctgacttcagcaaacacaaaggaaaagcagcaagttcccctgcatcttgtcttccccagcttaacaatcccgcatacattagggtatggtttccttcataaggttttcaggttaaacaatagaacaaagacaggtgtgagcaaggatattctatttaacttatatctacctcgaactagaggttaggggtggctcctgggtcctgtgaaaaactgtgttaattgtgttaatattcagaattgggagggattggacatagagagaatatttgaagtggaaaatgatgaatagaagatataacttgaacaaacttagagttcaaagttcagtaaacagaaaataaagtgattcttctgctcaaaatatactgtgtgatgtccccagtgtctccattgtgcacacttggcattttgtcatgagcaatatttgatgccgatgagagactataaccttccccttcctgcacgtgtacagccttcgtttattccctcatcaacaaatttgtcacggctgcctactaggttcaagtaactgtactaagttctgaggatacagctgttaataaaagtgacagggtcatgcttttatggagattgaaatctagaggtataagtagatattaaattaatcccgtgtcagcataagcagaagtagttgggctaaagggagagagaggtgggaggtatggggagtgggccagatgtgaaggctcagcatatgcagggatgcaagagacagcccgagaattctggggtatagttgagtgctcgagtataggaggggactggtgaagtggccagagaccaatgaggatgtcacatatagactgagttcagaagtttgaattattccctgagccctccagagagccagtcaagagtgaattggagtttttattaatctactgtatatatttaaagaagacagtaaactgttatattaacataaaattggggttttgccaggcaaatggaacattaaagctatggaacaagataactgaagatatagacaagcaacttatggaccacgacatctaagcagggtagagaaaataaagaagatacaaagggttgatagacatggaggaagaggttcagtctgtgaactgaataagtgaggaagacacaaccaagattatggcaggatccgacatttgaacctcagatttcaaaggcagagccatttcaaaagccagagaggtcagtggccaaagagagatggagacaataatatcactggaggaggttataagaatgaagtgagttcagctatggaaaatgttaggtgacatttattgaggatttactatgtgccttgtgcaaatctcaaaatgtattgagtcattaagttcttataacagccctgtgagatagggcctgttaattatcattttaaggaagaagaaattctaaatatttcatttgaaaactggatgacatgatactcaatgaagctgaattttgttttggtttgctgtattttatatgcacggcagaaaataaatatctcattcaagtaatatttattgagtaattgctctatgtcagacacggagtaattgcttggaatggttggaggcgtggtcttcattttccttcttcctccgcctttactccagagggcaaaccctcagtaaagacccagatttgcattaaggcatgaagaagaaatatctgagaaagacagataagaaggacacttcacaaatcaggaaacaggtagtttagcaagcacagtgaaaaatcctcatggagatgaccacaaaaattttgtgaggggttattttagaggagatgaaactcatttcagaggaaatgaaatacaagagaatgagatgacaggagaagatggaaacttgggcgatgaacaaaaacaacgagctgggaactttacagctggccacaaatttgccaagaaaattaatccctggagcctcccatgtctaccatgggaatgtaagatgggagagacgggcactcagaagacagccacaggctacactggttaaaacttgaaaggagttctggtttagggtgagcaggatgctttgatgtctgaaagagcccagctgaagtttggtttcattgcccacactccagagagaggctctagctccaaggtggtcagtacccaaattccttggcatcggttcaagtcctagtcttttgggcctagttaccttatgagctgaaatctgcacttcattaaatcaactattgtcctgttgcggtgaacatcttttttgtttgtatgtcttcgcttagttttttagctggaaaatgccttgctctctcagctgtgctaaaggaagattagcataggggtttgcgtttttcagtcaggccgaagagagagccagtggtcactggaggatgaaggtaagcaatggtagaatatgggaagtcaagagaggctaaaatattgtttggtttggctaattaagacaagataaggatgccatcatatttcaagtttcattttggttttctgtagaggctttcagaacagaacagcaagtacacttgaatgataaccttgcttcttactatttccctgcaagtgtaacctcccaggattttttctttctttcattttacaatgaatgctgtgaaaatttttattttcttaaaagggtatccgtctctcatacttctctaaggtgccctgcccagaagttgcttgcaacctcatccctaagagaactggcaaatattcacctcacccaaactgtgaacattagcctgcattataattatagataaaaagaaaagtgtgacctgtggttgtctaaagattaaaaacatagactcagtctgtaccaacaaaataatggcttattgtgttcgttttggggtcttagacctcaaaggtgatttaagtaagagcttgcctttagaatacaccttaaatattgaagattaagaaagcatcatatggaattagattgccgagaagtgcttatgtgattcttaataggagtttcaagtgttgcctgtgcaaagatattacttgaaaaattgtgaatggagagagcattttagaaaaattgagcaacttttcctattttcagctctcaaaattgaaagaggtaaaagatttaagtttctgcaggaaagtttatatttcatagaagcgtgccttgaataaatttgtgagttactaaaatgcatgttttaatgtaattgaataacactgtcactaagttctagatggatgtatctccatgtccataacatggtacagtggaactgattagttagtttgtatgtataaaaaatcagtacagggttccataagatgaataagtgattttctcctaaaaattcttctgttgaaagtaagacattacactatgtgacattttcatagaaagctccatagtgaaattttcttgaattatggaactatggaatgcctataattatagacctttactttctgaaagagtctgaaaggtataggttgaccttcggctatttgaattgagtggaagtgtttcaaaaattgaaaacaaacctttcaagtctccttaaagggaaagaaacatttactcatatagacattaaatgtttcctggttcaattcatagtttttactattggccaacttaacgattaatacagcagatgcataataaaattttaagtgctaattcaaaacacttgttctagaattggagccagaaatcttataataagaagtagtaggtgatttcaaaaactaaacatgttgagaaaatacatttccttccaagaaaaacaaaggtgcttttgagatgagaatggccagtcaggaagttttatagagtccttacataattcaaacaaggtgatgagatacacaggcttgaactgagcatgataaaattccagttggtaataaaaattttaatttatatttcttaattttttcctcctcctaaattctgtgttcattgtggaaggcttgggagtccctaaattgtctgaattatattcttaaaagctagaaaatcatgagaagttcctacccttgaggcttaatgtgcatcaggaattgcaaagtatgagtaatgaatgaaatgtggttataaaattttgccagttttcaattcctgtttgatattttaaaaataaatttagccatataggaaatctttccactaggtaggaaagcaggtatgtttatgaggaaaaaataacatagattcttttatttaaatttggaaatgattttagagtgtagtactttttttcttaaaacatacttaatatttctcttttgaagtgcttttaagattattcatcaaatataagatcacacacaaacagaatgttgcatgcaaactgtgggttttaagtattaaaataaatttactttgttttgtttgttattcagctgaacagatggtaatgattttgacacaattcagttttcgttttctttttttcttccttgagaaaaaaaccctgcaaaaacacagagcttcttttccactttgtcacagctggttaccaatcaatctcaattcacggtacagtgatgatagcacacgttgtccaggggccaaatctgattgggttgcatttttcagcagtgtttcatatcagaaaaaataaggtatctctatggtggggactgtcggcacacgattgtacaactctcattaatcaaacttggcaacaatgactgcatttatttaagtcaaagactagcagatttcaaaatgaaaatcaccaaatttctgtttgaatttcctcatcagtaatgttttttcatctgtttctttttttcttggttttaattacagccaatgataccttctacattgacactgatcattacatatgatcaacctcctgtgttgatcatatataatataatattataccatgttacaaagtagctgtttcataccaaaataaactccacttattgaaaatttattctagacttcttaaagaatgctaaatgcaattaaaagcaaaatataaatacctttgattgtttaataggagaataattttaaaggaaatatacatcaggaaaaacatttatgaacctcccagggttacatttggtgttagaggaatattgagaaaaaatattgataaagttagtttctggaggttttgaaactgaacacaaagtcggcagtacataaatacctacttgcccaatgcaaatgcacacagagcaataaacacacacatccaatagaaaatgcatgctgctgtttgttagaaaaataaatgtacttataaagagttccagtcacttcataacttgagagaacaatgtcagcattttctgtaaaattgtgtttggaaacagacattttctctaagttatttactgctgtgcaattatatgtaaagccctgttgtacactataaagatgtctttaaatgtaaggaaatattatttataacttattgtatcactctgtcaatatttgctttgaagggagaaatgcatattttcccaattttccaatgtaatggttacaatgacattaatattaaacatggaccaatgtatcttgaaagaaatctaagaaataaggccacatctgttagacctgggaaaatacttgaaacctattagttttagggagcaaattattgtcttagggaaaccatgacccatgagggaaagcagagactggtagtagatagtcacaagagttttttccccaactataactgcctccatatgtggttttgggaaagaaactttgtcatgttttgcttcagattgcctacatgtgaaattagtaatgagccaactatttacattctagattttgaagttacttagacataatttctttaaaaatagtctttatatttcttaagcttttgcagataggagttaatctgatcacaattacaggcctatcctttctctgacctgagacacttaaggtaaatattcataaaggtatcataatttgattgagtcttccgggatttttgcaggtgcttagcgactgccatagtgggtcggtgatgttgggaggaacagtagtgtctgcatggtgtacaattgtattaggtttgttgagtcagcagagtgaggaagccgaaagagcttgtactttggagtaagacatcttgatttgaaaattcaaatctgtatgttaaaaatgtccacgttttaaattatgtcaattgtttaaataattttaaaatattactaggccaacacgcacacacacaactacaaatttatacaatctaagataaacttcagtacccagaccatgagacctgaattctagtaacaacagccattaaaagcttaactgtgatgttaaccatttattctttgaacccattaggaaaaaattctgagaagcagctactcttttggtagtatatcccctgcttactttaatttccttatatggattcatacatcaggatttttaaaaattgaatgcctatattgtcccttggtaaaaagctgggtaaaaatctttgtaatatagttgatgaaaattgcgccagaagacttagattccaatacggtctaaacctttgctaccgatgaattccagggcactggataacaaagaactatttttctaatattaaaattaggacattagactaggctcaataattttgaaattctttactatgtctcagaatatatgatctgttggtgtcttgaaataaccaattttcatgtattttcttattattgcataataaaagagtatttttatctattatcatagaggtactttatttaggctccatatgttctcttttaatatgaataatattggattagctgaatattttcatgttcactcattcatatcttcatggttttctagactttaatgaagttctttgaaattgttatttttacacatgctataattcctttgttaagaaacgaggaataaaattgaaaataatatcccaatttgtgctatgccagattttataaacatctaagaacagctatatggtttgctttcaggttgaattttgtatatgtacattttctaatttttaaaatgggggaaataatagcttcccactttacctaccagaattgttaaaagtataaatgaaagagtatatttgagaatactaggcaaatatatttttattgtcatattttattttcataagacatgtgacttgaaagctccctgccaaaataatgagcttatatatttgaaagcatggaacaaaacacaaagcttacattgttttctctcagtcttcacatttgttttatacattctgctaaaattatttcatttattttggcggagagagagaaattatttatttgttcatgttactaatttacagagggtaatttattaatgataatatgtaaaccatatgtgtagattgccactcaaattgccaagttatctccatatagctagtagcattaacgaattaaatattccaagttcttacattttcagtatcatatcaatatgaatttaagttacatttcagagctaattgctggtatataaacacaacattactatgcttcttgatacaatatcttgttatatttcaaattagttaatctctcagtactgcatataattgttgcactggtaaccatgctataaagaagtagaggagaatttcaagcatttgctgatgcatcatgatattttcaataagcattcattgaacgcctccaatatctcaggcactgtttggttagacttgggctatacagtttaaagcaagagagaaccagtcctcattcccatggaacatacatgctcttggaaataaagaagacaagaaataaggaaacaaaagatgtggtaaagatatgtgctttgaagaaaataaaacgtattaaaaagtgacaaaagaaagatgaaagcaaagactaaaaagaaagtaattttttaaaagtaactggattggtggatagcaactagaattcttaggcaggaaagacatgtataagggaatgatatttgggtcatcctgaaattcaaaaagggtcagccatggaaaacacaagggaagaacattccaagaatttgcaaaagtactacaaagacacagaactggcttcttacattgaacaagtagaagagaagccatgtgactggaaaatagtgaacatgaagtttgagagggaggcaaggaccagattatctaaaactttaaacaccgtaaataaataggttttattctgagtgaccaaatgagaagccattggatagtttcgaagagttcagtgacataatcagatttatgtttatcaatcagtaaatctgtactgaagctcttaattccctttgaaacccttacataaaataactgctgttacagtcgtcccttctgatttgcagttttgtactttctctttgtggcttcagttacccttggtcaactgtggttcaaaaatattaaatgaaaatgtccagaaataaacaattcatcagatgtaaatggcacagcattctgagtaacatgatgaaagctttcactggccagcttcattccaccaagacacgaatcacacctttgtccagcatatccacgctatgcacactaccttccagtgagtcacttagtagaacttctcggttatcagattgactgtctcgtgtagtgtatttgtagttcagtgccatctgtggcttcaggcatctactaagagtcttggaacattttccctctgaataaaggggattattgtacagtatatggttgctgttattaggaatagttgacctgaagatgagataattcataagaaacccaaaattgaaaaagctgtcttgtaggagagagagtatacttttctgtttggcacaaggagtagtactatcagtagtaactttgggaagaaaagttatcatatgttatcatatatagaagatcttctaatagagatgttcaaagatagaatagaccccttgtcacaggagcaagtgggaggactgattggttgcatgctgcagacaggattcaagtgttgatggacagttgcagaaggtgaacttttaaagatttcatttagcctaacgagtcaatcactttatatatattcaaagtattctgatataaatacatcacataaactgctgataatacttgcagactttcctcaggcaaagattcagcgagaaatgagaatttaaaagattgtgagcatttcaataactaagtactcaaagtctgtttgtttttaaattacaacatcccaatgtgatgggacataacaagacatgtattgtagcatttacttctagttggagaaagacaaggcatggccctgggaaatgtgtgttagctggagagagccaaggaggtagctctgatctaccctaatgtggagacatcatttcactaggctctgaatcctatcaagttgtgtatccccaaattttggtgcaatgcgtagatatgtcatcagcatttcttgaataaaataatgaaatgtttattataatcttttccaacttcagtgatcctcaaggagaaattaaaagatgacaatgataatgagcatctactaattcctaggaactatgctgggcactgttataggctagaccgttaaaaattattacccaaaacttctttttactccaaagcatacctatctcattgggaatggatttagttactttccgtacttacatgttttctaacaaacctggcccatgtcaccagactattggccttggccatagttttacaatctgtatctgaaaacctgttctataggtagaaaaaaaatagatttgctgttttattttaatggcacagtctctttgaaaggtagtctcttttattaattgttaagattaattcattttattcttcccaagtaatatttaattttaacttttcacaaggaaggtaatatgcaatcatagaatgcacaattacttttatccctgatcaacgtaccattaattaaaaaacaaacaaacaaaatcttattcctattcttgtttccaccttcctttaaaatgataaaaaaatctcaggaagtcagatttcagacttagtttgggttcaaatattatgtatttagtaatttttaaataaaaacttttaattttttttaaatttcaacctttattttagatttggaggtacatgtaaaggtttgtgacatgggtatatagtgtgacagtgaggtttggggtacaaattgtgccatcacccagaaagtgagcatactacccaacagatagtttttcagcccttaaccccctccttctctctttcctctagtagtccacagtgtctattgtttccatctttacatccatgtgtacccaattttcaccttccacttataagtgagaacatgatttccttcttttttatggctgtgtagtattccatggtatatatgcatcacattttctttattcaatccactgttgatgggcacctaggttgattccatgtctttgctattatgaatagtgctgcaataaatatataaatgcttgtggggttttttggtaaaacgatttattttcttttgggtatatacacggtaattggattgctgggtcaaatggtagttctgttttaagttctttgagaaatctccaaactgctttccccaatgtctgaactaatttatgttctcaccagcagtgtgtaagcattctcttttttccacagcatcatcagcgtgtgttattttttgactttttaatagtaaccattctgactggtgtgagatggtatctcattgtggttttgatttgcagttctctgatgatttgaataaacaggtttttttcttttaactaaagcaggagatcacttttacattttatttagcttccgtgttgtcttctgtgtaatgaatgtctctaatgtgaagtaaaattttgtcatatgctataactaaatatttgctgaatatgaaattatttttgtccaaattatgtacttatgtgtcttactgttttaagttagcatttaaaaattaaactattttcttgcagagaagaagtacacatagaatgagaaaagtgacacattcagagtcagggttttaattctggtttttctatttattgataacatgactttgaacaggtcattttatttgcctaagtgtcagttttctcatctataaaataacaatttctaattccaaataaggttttgcagatactatgaacaatgtgtgcaataattttttttaactggaggtaacatacaatttttttctcaatgaccaatcgaaataatatacaatataggtatcttttattaacttggaatcatggcttcacatatatattgatccagaaaagactttttagaccattaactttatctcccctcttgtagctcttgaaaaaactcagctatagggcaatgtagagacttctgaaagtcagacaacaagaataaatagctaaacagtggtcaagaattcaatgtttttagatgaattggaaatggctgcaaaatacagtatttaaatgtttctatcttacagctaagcatgtcatgcagttcataggctaactgtagaaaagattatttttattagacatcaaatacatcaccagtaacttttctgaggccattatcaaaataattgtttttctcacatttttactggcaaagttaaacagaaagtgtttatctgcatgcattttagcctagtacttgctctaaactatactcaggtaaagtaatttgaaatattgaagccattcacagttggcctttatatcagtaggaaacaagatatgtatcatgtattcaccactagtgtttcttgagctcctagtagtggaataataatagctaacatgtatcgtgctttttgtgtgcctgttttaagtactttatatgtcatttaaagctcacactcactccacgaaatagatgttatctttagcacttattttgctaattaggagatagagacccagaaaatttaagtatattgccaactcttacaagcacattaagaggccaagtccatgaatacaactctggccattttgctcctgagcctgtgctcttaaccacttgattttgctactggatgttaaaaactctatgtttgggagtgtggatattgcagtgagtgaagcagacaagatgtctgccttcatcaaaatagataacaatacaaaatgtaactaagtgcagaattattgctgtagcaataagttttcaaaaaggcagtaattcgatttttatagtatggtaatggatggcttcacaatgaaagtagtggataaaaaagtagtggataagttttttccctaaccacttatgacatatttaataagcagaattttaaggcaaaacttgcagacagaaaagtaaccatgataattaaaggatggaagagtaagggtagttaagtttagttggcatgattggtaaatagacaatgctttttctcatgtcaaggtctataaattaggactgtattagttcatgccttagcctctaataaaattaagctgggttattcttctagctaaatctagaagtagaagacatctggttatggcagttttaaatgcaagcctaaaatgtttgtatttgtcctgaaaacaataggaagtcacagctagttttgagcagacacaaccaattaaaatgatatttggaaacatggatctaactgtggtatgtatgaggaagagaagcaaggtggccaatcagaaactattgcaaaatgtgtgtttgaaataaaaaccacaggtaaatatcaggaggaaagatcacatgtgaaaaaaatgatagctggattatttagtttgtgtaattataatttcttagaattaaataagaacatattctcatgcaagtactcccaaattttttggtgttataatgttttctgacccacttttttagtctgtttcattaatgaaatggaggtaaaaccataaatgcacgtgaacgagctgaggatgtgcatttccaaaaatcactccaaggcatgttgatgtttcaggagttaatattccttatttaaaaattgattacatacccttaattcttttaactaatgcccattttgtcaatttgccaacaaataagagaaaaattttgttctttaatatatttcggctctctaatagccaaggtgcctaaaaataaatcatagtattgaacacaatgtgactaacaaactaatgaaatataactcaccaagaaactgagatgtatactgttttctttagcagtcaagagctacaaaataaaggtcaaagtgctaattatgcctttgatagttgcgaagtggaaagaattctatacatatgtgaagtataggtaactgacaaacagctaaagatcagatatgaaattgaatttattagcaatatctttaatctaagtaattgcactttgtggctgatttgtgtgtgtgtgtatttgtgtttaggtaaaatacagtataaaaagaaaaatgaagatgaatacttaatgttattatccgtatagctactactatttaataaaaccagttcattttctacacaggtatgacatcaaagacgattacacactaagaattaaaaagaccatgagtacagatgaaggcacctatatgtgtattgctgagaatcgggttggaaaaatggaagcctctgctacactcaccgtccgaggtaagagatttaagatgtcaaagataattgaaccaggagactaatatttggttaaattggtaagtgaacttacgatcaaaataatgaattatgctgttttgttgtactaaaatgcctagattttgtgtcctctctatcattagttgaaataaaattactttcaatatttggttcccaatgatgataatttaaaaagattaattcttatttaataaattgcttatatggtttaacgttaatagtttatatggcttaaaagtaaatcttaaaaatagaaaagatctatactactctttcatttccattgctttcaactacttactgcttttaaatgtcatcagtttcaaaagtactctcatgctttctgtttactagtttgtcactttatactagtagcatactgttttgaagtcctttttaatgtcagcattcaaaacagcaatctgaaaaaactagcaatgcttccaaaggtgaaaatgaatacagaggagctctccagccttgagataatctgatttagagactgatttgtgaagttcattggccttaaataattgaaatagtcagtgctgctcttgtaataactttcactttctgggtgtcatgcacttcctcagtcatggaataatgttcatttatagactccctggaattgcttataagtgaaagaaagcattacttaacttcacagtgcactagaataaattaactgtcttttcagtgggacttgttgatcacgtgagggaaattacatagttcaaggtaccaagtagtaccaagtagacactcacactaattcttgaaacagacattagccatggcatcatctacactcctagaaaatcaaacaaagataggcaagcacatcctttctcccactgctaactgtgcctccttctctcatccttcgtgataaagagattggctgcatgttttcatccaagtctcagttacatcttaccccatttagtcatacctctgacccttgtgcagctttgctcccaaagagattcagaaggttaggaaaaaggttcggagaagtttgaagttgcaggaaaggtgtgagggattctcaggttagtccttcgcgtggtaagaaaaaggatttttaccaggtttatgatttgggcttcaaatcatacaaaactcaactacctccaggttattattaggagacaggcattttgggtacctggaaaaatattggtgcttttcatactactcaatatttcaccaaatccattttttcttctgtagatattctagtgtgaatttagatacaaaacatatttagacaaaattgacagctagttgcataaaaacattttcattcttcattagttaacaggtcataaaggactatgatcatatatgaattgaatatatatatatatatggattatgtaggatgaaaatctgataacctttgtaagccaatgaacacactttatttaacccacactctacatggataacttcatacatttgtcatatgtttgctaggcagctttttgcaaaaacaattcactagaccaaattatccccgaagttttctttttctttttttctaaagtaaatggaaaataataataaacaaccaaccaataaatgctccatccgaaaaatatttgctgactaaacaaatggtgagaaaacgtgaggagttgtttgtttgtagaagcagcagggtttcttttatacttgaatgcttggatgagtgagacttgaagtggtctgtttgctttaagacctttcccagctaattgttttcataatttgctgaaagtttcaggcttaacatttcatttaacaaagcatgctcctcatgcggggatgtttgaagctaacttacaaaactaatagagagcattgtttgttttcaatagttttttttttcttaaatcagcaaaccttaaatagcctctcccctaatctgtatactgtagatggattagagtgtttattctttgtggtatgaatttatcacctctctaagactgaaacctcaaaaactgggtttaaaaaaatctccttaatgcaatataatgtagagtaaaatactgtttaaaaacatttattttttaccattaggaaaagcatttgggttttctcatgctaagagattaacaggaaaaaaaagacaacactgttatctacgacttatttttttttctttgctaatttttctatgcacataaatgaaatgtgcagcctttctttggatcgttttattagaacagggtcaactgacccaagaggccatgcccattttcatccatttaatgcagagacacagttgtgtttaatttgctgattttgaaaacatccacctgctgtttttttttttttttttcaagatgaaatgttgctaatgtaacaaggacaaaaaaatgtattgtgatgtttctgctaaaattttatcataacattcacattagccaattggggaaaaggtaagagagtttattgtcaaaatttgaaacagatctactcagttatttcccatttcaaaaatatgctttaaaaaaaaaaactataaattgaggctgaacatcaagaagctccctttgctgacttggcaaatgtaaaattaggaagaaataaagccagtcaacaacaaacctcctagcattttcattctaatcaattaatttattattaataaaactttttaaatggcttaaaaatgacaacacaaactgcgtatttgtaagcacattttacccatttttaattttttaatttgctttgcataaagatctcattggaaaaatcatattgtttctagagcattaaagccttaattttttggaattattctataataaaataaaatagaaatacattttatttgtttaaaacatgatttctcaccacagtttcttttttttttttcttttgtcaatatcctacactcaaaacgcctttttgtttctgaaggaaacattatgttttaaattcacttgagatggcaagctgaaaagtagcaaattcaaagatgaaaaacaaagttctttttctactggacattttgcaaaattaagagaaactccatctgttagaataagccacaacttcacattattagtctgttatctctttttgatagtcaatcttgtattctgcccctcactcccctgcaaaaagaaagaaatcgtggtacattgggtaactcactcctcttttcctctggctatagcaaacacaccctatatgttaggccacattagggttccactaaaccaggcttttcgtaccactgctacaattgccttattgcctatggtctgaagcttccctgttttaattgtgaataatattataagaccatggctctcatagagatggattgcacaaagctagtattacgatgtatctgttaagtgaatatgtgtaaatatgttttcaatggctgttcctatcttgcccgaagagccatcatcaacacgaaactattggtatgttccagagtcacattacatatgcactagagctgtatctactaaggtatgggcgaaacactgttgaagaaattctatttttaatgtcagatttcatgaaatttcatatactactaagcatattgtttcttcatttggataatgggatcacatgtttcacaatatttgtctattgcttttgtataaaatggtttaccgtctaaattgatagcgtgttattcatttttaaaaaaggattatgaagcccatgtgtatctcttacaatttatttgcattaataacaggggcagcctattaccactgattttagtgattgaaagttatggtataataaaaaaatgataatttgttgaagcagcagtttgaaagccgttctcagtgtgaacaggaatcaacttgtcagtcattgtttcctgccctctgccagaagaagaaaaaagcttaacagtagttagggagctactgagttgaaatctctaaggatgttccaacctatctgttatattttcatccaccctgtccatggatgaaaagtgatgtaatctcaacttattactgactgaaaagcagcgtcaggggcttttctgcagtccttgtaatggttctgactaaccatgcttaaaatccaattgctatttaaatcagacagcgaggccttcttttattgacatgacatttgctagtctgtgacttgaatagttatattcatcaggtttttaactttggggtaacacaagactgtttaactcaagatctttgaaataataactgcagtaagtgatgatgataagactttacctaaaatatctctcaaattgcttacagtcagttctcaaagtaattattttcctagaattatatttataactctcaactttatcagactcagacatcttggtcatacttgaattgtgagactagaaatcactctattgtccatacttaaatgtaacattacacatcatgcattctgataatttttctttcttttttttaatttcttttttatgttctcaccacaccattgtaatgtctacagctcgccctgttggtaagtagccatccttctatccactaagcatggctttgcacagtgcttcataactcatgcatagtaagatttgacagaatgaaatatatttattttacccatgttaaaataatacttgagactgtatgctgtaaaagttgctcatgttttttttactcactttgataaacaattttgtagtgacttttgctacatagcaataagtaggtaacaatttttatgtaagagaataaatgaatgataaatgtttatgaactgctagcttttcttataggagaaaaatatattgtattaggatacaataagaaagcattgctctccttttttgtatgtataaaataatcaattattagttatgtttgatgttaagaaaaaagttatgaactaaattaaaaaattctacgactttccacacttcttttaagttactccgagtcccagtattttagggatatttttagctgctgcatatttattgcctgcatgcctatttaaacaaaattaagtaaaatgttttaagtagatgcttaccctaagtgggggagggatagtggagctgtgttctttggcatgaaatctgagtgtttgtggttttaatatatcttatttttcatttggctttgtgaaatctaagtaagttaacagcttgcttttgcagatatttaagtggtaattatttgtaaacatttggaagataaaatttttcaattcattgacttagtaagctttctgcatctcttttaagcttaagtttaattcaccaataactatgtttaaataaattttggtaattgtgttacatgtaaatgaatagatggatgcataaatggatggatgaaagagtgaccaaatttagtacactgcttctttaatataacaaaaaggtactttaataacaacttattcaattttgagggctttataaattgtccatctagcttcaaaagcttccttcatgtaccagcttgacatcattgacacctgatatatatgttggttcagactcacacatttttcccccttcggttgaaagagtcatggactttgttgctagacagtatgtttttacattgtcagcaaacacggtaaatatactttggtttcccaatctgactttctgatctggtgtttctgagcaatactcccttttgattagtaatttaatatcccttatcctcagtgacctcctctataaaatggagagaataatactgacttatcaaagctgttgcaggaggggactgagtttaagattgattttatatgtgaaaggcattctgtatgccaatgttggtagctatcgtatgcctagtttctgaggcatgacttcacatttcaatattttttaaataaagctatggttcacaattaattgaaacataaactgcagggtgttttttgaaactgatgaaatcaattgtggtttgtacaattgatgtttgaaaattgaagaatatattgtaataatttttaagccttattttcttgtatttgtagggattcctgttaatgataattttatgtatcttttgaatgacacacaaaattaagaaaagaatgagaaagaataagatgatgcagcaacagacaaagaaagagctgatggtagaatacatgaccactctcagatttctttttctcaacatctgtgagctagttttcaggttcagaaattcactcatttatgtgtcaaataagaaagcatgttattacatataataaaataaaataagtggaaagatttatatataaattatatacaacaatgatatagattatatataaaataaaatatatgaagtggaaagattgagaacgatctgacactttttcagatgactatggaatacaaaaactttgcaaccttatttagaagttttttaaagatattaagcattacagtatttataggagatatgaaaatagatgaatgattgaaaacatttctcaatagaaaggatgacagtaggtgttaaaaaatacaggttggttttgcatcggcagcagttgtacttataagctaatgacttttcaaatgaaaaggaaaaatcaccatttaaagtacagatctttgtacacagaaacctcatgccaatataccatgagcacttgatttatgttatagaatagtatgttaataatttccaatatatttaaaatctttaaatgtaggaaaaagtacattgatttgaaaatgtgatatacacagagtattgagatgtatctgtcatctgcaagatgtttccaaagttatttccattttttattcccgtttgaaatgatttcttaaattcccattggactggaactaaagaatagcttcttgacacattgtactttattctggggaagtctgtcatttcataaatctatctcaaatgacttatgacaatgttcagaaatataaagaactatactttaaacttgacaactactattaattttaaaaactgaatgttggatatgttttaattggatttccaaagaagacacataataaggcaattagcctcattttttttgtatctacttcttacatcaattttaattcaagaacatagatatctgaacatttattgtatggtcaaaaagtataagccaagtaaaataatgattacatattaaaatcatagaaaaactacattattatttatatttgttaatgcactaaaaagcacatttttcaactttgcagctcttagcaatagcataaagggcattctgcaaggtagaggccacagaaaggggagaaaaaaacagcttgtagttccaatataaattagatgaagaaatatgtaccaagcatataacgtttagagaaatttcagatcatagtttctgcctagagcttttgaatgaaaattagcaatcattgcagattctggaatacttagagattcagaaaccctcactacattactcactggatgaaacttcttgatggtctgtgtagaaagccccctttagaaatcattacaaacccccaaactgagaattttgtctaaatggatgactcttgtgcgatgcatttgtgttaaagaatttgcaactccttgcagtcacagttggaataaacacctctggcctgtattcagagttttcctctaggtgaacttagaggatgctctagtgtgggaggtattactgaaagcggacgttcatatacttgccaacagaggaaagtgttttacagatttcacttgctcatctgcagtgtcaccagtgggtcagaaagagctctttaatctaacgttcatatttgctggttgccacaaaatctaggcaactatcactttaataattaaaaatccacaagcccttcctgtggttttgacgttttactattccaaaggcattctttatatgaaaagaaaagtacatcgtaggatgtagttaactatgaatgctgaaatattcatttgtttatttggaaaactcttctgatgaggaaactgacagaagaaaatggtctaaattgggaaaaatatcttgcttcctatacccatctgtcttatttttctattggaagcctctcccaagcctaaaaataaaaaaagaacatctattttggagatgggcaccacattttttcccagcagcaactcaaaacatgatgagtaatttggaaaggaactgtggaatctaccagatgccttgcttacgaagccgtcctgttccgtttggtgacttgtataccatatgctagatgctgattgcctggagtataaaactgaaagctgagtacttcacgtgaaacttgtttaaaatatcaaaaaacaaactgacaattcacaacttgatggaaacttctaagtattttctaacttagtgacccaaaagtatgcttccttttgatggaagaatgtaattggccacacaagaatttagaagtaataagaagtacacatgctttttggcaaaattcaccatttaaaaattattttttaaaataagcagccactactctaaacagaaatctacagggacattttttttttaatgtttcaactgcttaaccacagtaattaaatatactattttagaaagttctgttttatgagtcgaagcaaagttttgttaaagcatgtttgaaagcagtctattctgaggccaccaagaagtccaaaaaaaaaaatggtttgtgattgaaaaattcattcagcatgaattataaatctgacattacttgaagaataatgtaacaaatattttgatacccccatctcccaccccaacttgaaatttggaaaatataatgtgctgtacataattggatattggaaaatcacagttttttaaaataagaaaacttaaaggtattatgtatgaaccttttcatgtttggatgcactttttgcaaaagatgttctaagtgtaccttgaaaggagacctagaattttgtttcttgcatcccttttctttggacaagctgttaccccatgacctgaggtaatcatctccctcctgagagctcttaatgtttcctgcacctggcactaattagctactttatgcagagtcccatttacttattattaagcatcaggttttccgttgctccatatgttttgattaaatggtaagtttaaaaaaggcattctgttttatcttctatattccaactgagtttccataatgtgaaacgtttaaaatatcttaagctaatgttcatttctaaagtgaaacacaagcgcgggttacttctcaggctgagctggttctagccttgtgtacttggcaatgtctgtccattgaacaggaggagaggctgggtcttaaattactctcacacttctttctttttttttcctctcagaacttggtaaaaatgtcctattgtcttggtattgaatggtattatagtgtagtctgaaacttaacaaaaaatatatttttttcttggctgggattttcttttaccatatgaatatgcatgtagtcctttctttcaagtaactttgctcagttatatcttggtaatgatcatcctgtaggtaatatttctaggacgcaacaagccacttgaatctgccagttctatgctttaacttgctttatttcaataaccttttcttctgttttatctttgaattttttttctgttttactttctcatttcttcaaattatatttcttcttagttatattggctttccttagtctcaatttcacatttatcaacttctctataataatttcaatcatttttatttcatattgtatgatttctcaatgacaatataccgcgtctctaacttttaaaattgcaatcattatatatttcttatttctaaaatatattctaatttttttgttttttgttattttcttgttaagctctaatataaaattctttatctttacttgtcttttagcctttgtaacccttttttcgtttttaaaagagagatttcattgtatataatttcatttagacgatgcctaagttatttgttttaaattgtttctgtgtttctttgagtaattcttggaagacacaggttctttatctctctttaattaattatgttcattttctgtcatgaattaaataagtaattggttaatatacaggtttttgttaaatttcgttttgcatagattttgttttggttcctatctgattattcattttctggttagctctgaagactagagtttgcatatttggagaagagaaaatgtgaagtagcagggtaattcaataacccttatttagaatgttgttttcaatatcttactaaaaacatactatgttcttctcagtattgtactaggcctggtgatacagaatcaccctttttaagttatgaggggtgtgcattttcctataagactctctcctcatcctcctttatactccctgcttcataataaggatggttttcaggtgtgtcagttttctattgttgcataaaaatgaccacacaatgagcaatttaaaacaatgtcattctataggtcccaaatgcaggcagtctcaacagtgttttctcctaagggtttcacagaccaaaatcaagatattggccaggttgcactctcctccggagactgtccagaggaatccacttcaaagttccttggggtgtttttcggaatctggttccttgtggttgtaggactgaagttcccatttccttggctgttggacagggtgactcactgtgttaagtggctgctcttcagccttcgcacattgctgccaccacaaccttcatagccagcgggggcaccctgaattcctcatgtgctttgctttgtagctctccgaggcctctttctgatttaaagatccagagtattaagtaaggcgcagctgatgaatcaacccattctgaggtcaactgattagtaaccttaagtatatctcaaaatattttttgtaacctaatataatcatgaaagtatttccaggaagggcaagcctgaggtcatggggcctcagaatgctgccaactacagtaggctttttttttttctttctgtcaatacttctttctccgccttctgaattttagcttattttctacagttatgtctcatatttcccatgtctcactcttgactttaagtatcatttttcccataaaaggatcatgggatgggctctcacaatgatgttagataatttttgtgcaactggtattgataaaggattaaggctagttatgttggtgtccagtgtgcatcctcagctttcttcaaactttgctgcatttggcaggggtacttcataatttgtggttttggggctatagtagttttttcttattattcatttcttttgttgtactcaatacaggaaagtgaagcctttactcaattatcttaacctaaacagcaaaaagtttgaataatcattatttttggagcctattcaaataagaataaaataaatattaagtatttctaattagtacttaaaattaaagtactataaatattaaatatcagaataatataaatacttaggcccaaaacggtatgaggagattagtattaagaagtttcactggctgtgtccagaaaaaaatcacattaactttgaattatgtattcgaagaaagtcagaattttcataagttgctgcactttgtagacagggatgtcatgatacatatactgtaaaatatatcttatgatgtgtgttacacctacatatgcatgatatttgaattgctacactatttgcttaaacatattaaatgtcactcaagggaatagtacataattagatttattaaaaatatataaactagcaaactatattacatttttatttcaaatatatctgaatgccttttaaaatctcacttatggcaagtattgctttccagatttactgaggttattattttcatctcccctacaaaactgttagctctttgtcagtaaatacattgttatatttatctttctgctgcctctaggtctagcataacacttacatgtggtgggggcacacaaatgttggtgcagttaattgatacacgcatatgcatacataggtagtacttgcctagaaaatgtttatgcaagcagctttaaatagtgctataaaaagattaagcaacattaatggtaacaggccaatcacatattccccattctgctggtagcagataaaatacaacaaaaagaaggcactaatgagctaggatggtgacttactaagcgtgtaattaatgttattaagaaacattgcagttgcatattaaaattccgttaactaagcaacccttcagcatcagtacatttgttccttggtttcaagtttttctttttctttttctttttttttttttctgattggcatcttcatgcaatctttctctaaaaaatgagataatgggatgtgatcagccctcgtggtttagctggagtgctgacatgacagttctggcaagttgacaggttaagtgagtgaaaatggatgtcttgtctcaccatttacttgaagagccattttaagctatagtttccctctctttactcccacacttacaactccttctatcccaggtatgagaagtcaagttttcccaatttaggaatttaggatcttgaaagaagtttttcaccactttaaactagtcttcttctgctggtcaaaaatgagatcatttctttacaaacaaagagttaatttctctaataatgaattcgtttttaagttaatagcactttttatttcatattaagagtcccttaaagaaaacaaaattttattgttttatttttagtattttaattataaaggcaggtagaaaagcaaagctacaaacgcactggtaaagtacagaataatatgggacaatggaatttaaaagttcagaacttgtttaatattttgacagattttcctagggatctctcaatttatacctatgtataatttaaaagttctgtgaaacttgcatggcgaatctcataatgatttccacagttacatgatttcctatagttacctataattaaggaaatctattttagtaatctgaaatataataaagtttaaaattacctgcaaatgtacccaccttatttacagtgtgagtaaactattactattgattgcaatgtagaaatatttaatatgattataggattagagtggacttgctaaacccagtaaagaccatttagatgaaaaaatacatggttccacccctacaatccctcagtttaatttctgcctggcaaactcgaactatgagcaagttcatagtcgaactatattacttgccggaggccttcaaatacctaaactgactcaaggagcacacccatctagactgccacaggccacaaagaagcaggtggggggaatgtgccttaaagcagtctgcaaaattcctgtctctaacatactgcctttgttttcccctctgggaggagcactctcccacccttccttcctttccaacttaatctaaaagaacaaatcaaatttgtttctctctctctttccctctctctcttcttttctctctccttcttttcttctccctctctccctccatctctttcctctttttcttcctctctctctttctctctctatggtttctccagctgtagaaggccaactgagtcaagttactcttttgcttagtatgtattgtattacaaccttcattgtattgtaacatgtcacaacacaattgtaaaatgtgttgtaacatgcttgattgtttccaggaatgtctcttgtggtaggaggtgacttccacaggacagagatcttagtaccctctgacagaaaagaaaaccactaatgttgtttaaaaaaataattggatagtattatgaattgaattgccatgcaacatctgaattcatttttgtagaaatttattactgtggtacgttccagtaatattttgccttcaaaaacaaaaatataagtgtgaaggcactggcccaagtataaaatggctatgtgcttatagctgttcattacaacactgtttttatgtgcctgcttatgagatctaaaaatgcaagacattttgaactgagttaactcttttcagaagcattctttccattctagattattgtagaattatttcattttgatatttacattgtggcatttcaggcaggagcacattatgtgtgactctaagtgaaagcaaatggtttgaaccactttcataaaacatatacatattttgtggggggggggtgtattacacttaccaaaataaatccaatgcctccttggaattgcctttacagttgcaacacatggcaattcagaagccacttctgttattttgtcgtcatactatgtaattattggctgacttcactgcctttttaagtaatcagattttgaataattgagagttttttttgtggggaggaggttctgatattatatgaaccctccaaaattaatctcaccatcaacaaattccaagactgtttctaaactgtaaagagtaatagctgcataatagtaacatgttttgctcatacaatgaatgaatgtaatttgtatgtatatgtgagacctctcatgggtgtagagtagaatatgaagtctaaatagatgaggaatctaaggattatgactcatggtagtcattctattctctttgattattttttcatatttatgagagcaatatatcatttagtgcttttccttttcattttgacattgaagaagcacatacatatatatgcttattgttgaaagaaaaggtattattgtattagtctgttctcatgatactaataaggacatacccaaggctgggtaatgtataaggaaaagaggtttaatcgactcatagctccacatggctggggaggcctcacaatcatggcagaagagcaaggaacatcttaaatggtggtggcaagagagccctttgtgggggaactctcctttataaaaccatcagatcttgtgagacttattcagtatcacaagaacagcagggtaaagaccctgccccgtgattcaattacctcccaccgggtccctcccaagacccgtgggaattgtgggaggtacagttcaagatgagatttgggtggggacacagccaaaccatatcaggtatagacattggtattttactatggaataaggatttttattattagctacaaggaagtagctggtggcaaagaaagtgtatcactcatctaaaggatttattgccatggactcaataaaaaacaaaaaaaatagttaattagaaaggtaggtaatttagcaatttgatcatttacttttttttttttttttttttttttttgagacggagtctctgtctgtcacccaggctggagtgcagtggtgcgatctcggctcactgcaagctccgcctcccgggttcacgccattctcctgcctcagcctcccgagtagctgggactacagtcgccgccacgacgcccagataattttttgtatttttagtagagacggggtttcactgtgttagccaggatggtctcgatctcctgacctcatgatctgcccgccttggtctcccaaagtgctgggattacaggcgtgagccaccacgcctggccaatcatttacatttcttggaaatagtgacaaatgagtaaaatgtgattaagtagtctctataaaagtgattattttaaatcctatatttctaatttatattttctattataaatacattgcttcctctgagatgaattatgtgttaataagcttcaaatccaacatttccatggcagtgtgtatgcatttccaatattattaacagaaaatcttttgaaatcaaatgaagcattacatagtaaaaattaaataaaattaaataagttgaagaaacaatcacgtatcaattagaacccaaactgagttgaatataaattgagtaaacatttatctcttactactggtctataattgcattgcaaagaaacgatttctcactctctgtttcttgttggtggaggcaagcctattaactaatttttgcagaaactttttaattttttttcttctttttagagacggaggcttgctctgtcgcccaggctggagagcagtggcacaacaatctcggctcactgcaagctccgcctcccgggttcaagcaattctcctgcctcagcctcctgaggagccgggattacaggcgcaccctgccacgcccagctaatttgttttgtattttagtggagacgaggtttcaccatgttgcccaggctgatctcaaactccagagctcagacaatccacccgcctcggcctcccaaagtggtagaattacaggagtgagccaccgccccccggccttttgcaggaacttttaaaacccattgttacacaatgtctttatttgtctgtagtgcttttgttactctggaatgttggctactcatttataggctttgggtcatacattttcaacgttgtgtagcagcactctctacaaaagggcgtatcagaatcggttagatttgtattcaggtaacatacttgaaacaacacatatcagaatcgattagttttttttcaaatcacatatatattgttttcaaacactatatttactactgcaatagtaagtcactgtcactggtgggtatgtgtataggtataatggaataggtataataatgcagatatattattccttaggtataatgagatggaaaaaatattgagtatttgctttagatcaagaattctgttctttttaaaatgtactattccgaggcattcatttagtgttcactgttttgggcttttctaggtgaaaaaaatataccatttatatgctaaattgtagacagcaccccataccagtaaaatcttcaaactgaactaaggaagtcagacatataggctggggaaaaatagagaaggcaatgcaagcaagagcaagtaccttaaattggaaagaacacaagacaagcacaaggtcagagattgttcaggttaatcattgttgacaaagaggaccaaaggataattgatatcggggtgggttaaccacaagaccaagcaaatactagtgattgaaagtagactgctctgctgaaatgctggagctagtttggggacaaatgagtgtcaggattggaaaatcttagatcagctgatggaagccagaatgctacacggagaagaataatttgcaagcattgctatggtaagtattgtaggtttcactgtgatgcgatgaaaagcactataggtttatgaataaagagtgacttgaaggaagtgtgcttaagaaaggttatacttacaggtagtatagaaagagaaaagtaatgggttttatgctaccctaataataaaaacaatcattcagaagaaacgtaatgttattattttgcaaatctttgtagcatattggaaataatagcgttaaagttctatcattcttcttcgtattagatatgacaaatttttagttaatcagatcttggttcgaacggaaccaaatgaatctggcatctcagtgtttaagagttcctactgtggcattcgaataagccagaagtcaaacctgtcctccaatctaatttaactaagaaagctgtatttcttgcatgttgtcacttataagtggaagctgaacaatgtgaacacataggcacagggaggggaacaatacacactggggccagtcgggggcagtgggggcgcgcagggggagggagagcatcaggaaaaagagctaacgcatgctgcggttaatacctaggtgaggggttggtaggtgcagcagttcatcatggcacacatttacctatgtaacaaacccgcacatcctgcacatgcacaggggaacttaataaaccaaaataaattaataaagctgtgttactcatgccctgagtaagattcagtttactggttttacatcattatgatagtagttgaaacataaggcttttcaaatattaattgagataatgcctgtggagggtttaacacaaaccctagcacataataagctctcaatgaatgttaattattgccattctactaaacagtttgtgactaagtgaaattttaactcaagcatatgaaggaagagaatgcttcttaaatatgcttatagaatatgttagtatttaacaagtaaatatatgaaatagcaaaaaaaattctacttgagtttgtcaaaaaattcgaaatggcaattatagaattaaaagtttattcattcaggcataaaattatatccaaagaaaaagagtggctgagcatgactgtattcaccctgtgccacatatgaatgtacgtagctgttgcatgactctctccatgctaatgcctgccataggaagtcatattttcctgttaaaacaactctgaacatgatgtgattaacctttagagtcccccatcccctcatctcaaagcccaactcatgcacggcctgtgcttcctactcatgttcagccatctgatttccatgtcacccactcactctcaccagcaggcattagcataacagagctgcagcgtgactttgattgaagccagcttgggctgaatgcagtatcaaagcatcatttagcagaaatcaaatctaatttactgtgcattgtatttaaattctcaaaacacagtttcaagtgaactgtcccagacctctaatcttaattgacctttttatatttgggtctacttctctggaaatcacacaacatactttccttatagagctattgtttttcagcttgtaagtgttgattaaacactaaattgtgtcattctgtttgcttcgtctcatttctagttatagctgaagcaataaggtataatcacgtgacagattaagcaagtaggatattacatcatagttaacaaaagatttttccaatgctttcaggttttagacagaatataagtatatattttatagtcttctgtctcagagacatataggagaattgccatttttataacaggcatattcttctggagtttataactcaatctctttaattcacattgggtttaagcatgtgtttggaattgtcgtcttgaggacctagtagttttttttttaatacttaatgggagtcattatagaaaatctattttatgtatagcacactttgtgctattgtgctgtgttgataaaatgccacatctgtctactccctctctttggtgccatcagccaaatactgtcttttcagaccattttcactgccacctggcagagacactgaaactgtggagggttattagaagaattattgatgcagtttttcatttaaaacctcaaaaataaattccttcagctgatatcccttcacagaagattgcaatatagatctagggcagacagagagtctacaaaagtaaaagtgattgatgcaatttgtttctttggtccaccttcaggtgataataggaaaggatgtgtattttcacagacttgaatactcttcaaattttttgctttgataaatgtttccattttttcattttttaaaattaaaatatgattagatgattttagttccagcaagatcaatgtggcataagttctggtgacaatagtctattgaatgcatttgaaatacaacacatttccgacttggagtaaatgtacaatatacataaacatcacgtgataatatattttataggataaataacagatgctgacagttttttgttagtggtctttaaaataatccagtattgggtaaaagttccagaaattataatttcctgtcctttttagattataccatcagtggtaaatattatgttttgattttgcagaatttctttgtcctttaaaagccctgatgaaatggtatctttaggtgctactaaaaataaaaattctcaactggattctctgccccaacttgtgaagatttgccagctctttgtctttgctctttctctaatcctcatctacattgcttctaaagcaccctttccaaaatataaatctgattatatctttcttacaaaaatgtctttgaacagatctttagagttttcagaatgaaatgttacacttgtttagcagaaatcatctgtccctatctatatgaccactgtgacctagatttcttttattctcagaatcttttacatgcccctaaaaatccagttcagtgggtctctgccttatgtgctgcttctctttgtcccaagtcaccttaccactcttcgcctagtcagctcttagttgtcctccaaagtacagctctaatgtagccatgccctagcagcttttctctttttttttctcacaacatggcctgattggttctgttccactctttctcccccagtgccatctgcattttttctgttttcattgaaaaaaatcacattttgctgtttttgtgtatttatttatatatttacttgtaagcctctgccacagggcaagaacaattttatttggcttcccatctcctgtaccaaccagaatgtatcatcatttttcgtcaatcagtacattttgtgtgaataaatggatgaattatgtcttttcagaaaagtggatgcatagatgcggtcatttgccagtccttattttgaggactatattttagcagtggtgttaaaatcgtattatctggatgccaaaagcattttgcaaaatcactcatctacaaaaaaaatgtttcaaaagtttgaaaattaaattcttggaagtctgtacttctaaagtacacatggtaattttagtgatagagatttgtaattttactggatagatgaagaataatatgcttaaaactatgaaatacataaatatatgttgatatttcattgatttcatttgatgatttcaatcacgtttattctcagttaatatattttaaaagtttgtaaagaaggactgtatagagtatccaggactctaaggttttactaactacttttgtgaggtaatttaaattctttctggcccaaagcagtacaaattaactaatcagctaaataggtgatttttattcaaatcttttaagtgactgattttgaccaaactgagttttgagtttttaataattttcgatacatgctaaattattcaacactcctcacttggcaagtgtccatgttggcattattatttttctttataggatcacaaagagataactatatactcattcttaactttttcataacaaatataatttttctacaagattgcagatgacggaaacaaaccttaagtgtttttttttttttttggcacaaatacctggtggtttcacatttctattgaaaaaatggtcactgcagtgttttaagagttttctctaaaataattttttaacattgatttacaccatcatttctatgagaaaacatggaacaaaaatcaatgtatctgctgattcgggagaactgtgtggaaataacaagaagattgtaagaagcaactaatctcctgaaaatacaaggcaacctataccacgctctgttcaaacagattcataaatctgggttttccatactgctagaatgagtcttctgttaatctatagttatagaagaaaatgtcatttagtagatttatcccatctgtccctgggttatgcgttagatgcgttgaactaggaggcggtataatagaacaccaaaaaataagtcaatacaaatcccagggaattgtctggaaaaatgctgctgctttttctacgctaggattcttgtaaggatgaagaattggttgcgtgtttggggctgatctacgtttaccccattcttggacctgcacttcttttctcctgaaggactgaaatgatttccagtgacagtttttaccagacatcactcatggttagagggcattaaagtgccactaggttctaaaaattagagttgattttaaagtgttttcttggtctcagttttctagcctaagaagcgagttaaagtggatatagattattagaaaagtcatggaataaacactgtgttttctgctcaacaaaaatggattttggtagggagacgcccttgtgaaaacttccaatgatactgcctactgtctttcactttattctctctcaagatcattagaccaccatttaaatctgaactttcttaggatttttacccccatccctttcttttattttctgtcggagttacttatgtcttggtctcattagcttcacctgtaccattttactagcctcccagccagacttcttgttttatagactaagtggcttcctctccaatccatgctacattcatcagagggttaaagctgccaaaaattacttttgcatctgtcacttttcagcttagaaaaaaatcagaataaaatcctcagtttgacttctgaaaccctcctttgtagccaaaagtgtttacataacttggaccctccatcctgccaaattacacactgtatcctaagcttgttcttgcttcttatactttgctccataatctccttgtttggaatgtgttcatttttccatttacctcaaagctcccataatgcccattttctacacagagccttctgtaggttttacaacaccaagggatttctttctcctgagtcttattgtgtttcgtatatatacaataacttaaattctcttccactgtggtctgagattacctctaccattgcacttaccacagtcttagataagtgttgatttaatttcgtttttgtttttgtcattgtcattgtgtttttcatttcccttagactctaagctctttgatggcttcaggataaaagcttcccatctctgtatctttagtgcccagtaggggaacatagtaattacctgactaacctttatctatctaaatgaaataaattagattgagtcaaccatttcaatacatttatttatattgcttattacccttgtatataattcccatctcttcaattcttcaatgtctttaatctttcaactcttgaattctagatataagcacttttaagaataggggtcatattttataccctttggtatccctgtgccttatataattcttgcagtaactacaaaaactgccaatgcttataaataaattgactttagaggaaggagatggttgagtaagagagtgattcttttcttatctttatttatttaaaaagcagaaccaacttgaaaatccatgtttttccttaaaaatgttaaaatcatttaaaaatctaattttctatgcaagtatatgtaggccaaaggattacaatgtacaacatataaaatacgtctgctaaaaagtttgcttctttcctcacattggattgaatataatgtctttctttttgtgttttgagaaatgtgtaaaagtaaataaaaaactgtagtctctctctggcactgaacagtcaacatagtaccatattttctccttgacatatttttatttgtctatggttgatatttacacgctttcttttcttttaaattatagctcccccacagtttgtggttcggccaagagatcagattgttgctcaaggtcgaacagtgacatttccctgtgaaactaaaggaaacccacagccagctgttttttggcagaaagaaggcagccaggtgagtgtgaggcttcactgcttttctgaaatctctgaacttctactgtctctgctgctcctgaaagcttgccttgcttctcttgttctcaatgtttgaatttattttatttctgaaaaagagactggtgaatgtaaaaataagtaggagtcagatgttctagcaatagcattctttatttgctagtattaatcttttcaaaattctgtctcttacatagaacagcaataaagcagtgtaacaaaattatcgttaaaagtccaaccaaaacctctgtagctatttaaaatctgtgaaggtaaagctaattttgttttcttgtattgagatacgtggtgtgatagagtcaggacatatgcagtacttagaacaatctctgtgacatggaaaacagtcaaatatttgtttaattggcccagaatttcaatcctctctcttatatacacagcataaatgacttttcttacccttaattaaagcatgcttccatttaagagtaggataaatcttttccttctccattcctcctggattcatccatagtggggttagacaggaaataatacatagtacactagaaggaacccatacctgtcttgtctttgttctgccctggtttgtcctctccagggccctctctgggcaacatggcctctcagagtctctatggaaagtcaactggatacactagttttctcatttagaactctgtctaaagttggacaactgcttagcctctaggttcgtagtcaatgagtgaaatttccaggtaaaactagattaaaaattgtgttgtttgcaaaataatttatctgtgcattcccatgggacctggagatattttccttctaaactttctagaaacatgcactactaggcatattctgaggaagagacctactggtggtcttcctcatcacattctgttattactacatgttccagaagaatttccttgggaataatggaaatcattattaaacatctctggaaatctaaaaccttggccagagatgggaaatgtaagttgcattagaagactctgttgattaaagcttacatgtgtttatctgcaacatacatgtgtgcaaggaagcctgtagaagttctgtgcagccattatgtctaattgttgtgggtttctataaattcctgtaccagctcatagtgagcagttctaacagctcagtctggatggacaaatggccttttattcctcactcagctctccttggtggagtcattcctcttgtgatttgtggaatgtaaacgtagtgacgggaatgtaaggaaaggtgatggccactgccttatcccacatcagaactgttccaggccttaactctcaaatcttctttctaatttagtaattacaaaacaggtttctacacatagagttctttaactgtttgctttaaaattcttttcagatgttagcgtctcagactctaaagtaagtgtaaggcagcatgacaattaaacacatacacacacacttagacacacacacatatacacacacatgcagagacagacacacatatacacacacataccacacacatacacatacgccacacacagagacatgcacacatatacacacataacgcacatacacatagacatacatgcacacacatagacacacataaacacacaccactcacatacacatacacatacatacacatacacacacacacacacacaaaaaggagagaattcaaaatccagtttcctccttataaattgtacaacttttgtagtgctatttaaatgtactggaactcattttcttaatctaaaatacagagctaacacattttacttcacacaaacaaagtttaaatgaataagttgctttacacattatgaaggttaagcaaaatgttatgtcactggtagtaaatataatgatgtaaagcaatttgatcattgcatactcacactttaaatccatgtattgagtgaaatctcattataatgtgacttgttattatatagctaagaccatatcaggtgtaaatcacattccctaaagtagctccaagttgaattacaaggtagtgcataaaatgtgtattggccttgtagcttaataaacataggatatttaaatatgctacatctttgttaatggtttcaaaataaataacaattaaatagcatttcagtattcctttttctgtatttgacgaagtggcatataattccagagatattaatgttaaagattacataaaatcttaagtctagttttcttttcctcacctatctctctcccatcagagagatagaggtagagatagagagggatgtggtgggagagaaagagagagagagagagaaagagaaagagatacacagagagaaaatactgtgaatgagaacaagagagaagtgcttgagcaaattataaattctcaaatcatgaattgggatattgggaaaaaataagtcggtcttactatttccagtatccagtttttacagttatctatgaccatccatcagtagaaacagttaaaagcctgaacttaatggtccatatttctcaatatatgctgataatgccaattagctctaataggatacccaggcactctccaaggcgggaagagctgtgaagttcccggtttttgcttgtaatccattttcttttgcctatgtcatgcaagcagagaagaaaaatgatgggttaaccttcatataatgccattttccatgtcaacgaatcatttagaaggtggactgatggtacattgtagaggaagccatcccgtagagaataaagcccatctgatatattagtgctatgtaaattagtattctaatggctaattgtgggaaagtgtgcactttgagttattgtatcattttcaagtgacttcaaaatttagactctctcttttagctcgtttattttgataatacatttggaatctacagtagaatcagctgattctcaaattgtgtttctatgcatgaaaatgtctagccttatataatagtacacattttataagaggtcaatagcatattgaaattacattcctgacatgctagcaaacatcactcgttttagacggagtttaataacatggtaatgtttatgtaaagtgggcttatagtgtcacacttgaatctaataaagtggacatccatcatgttgcaataaagagaagagcttctaattaaaacaggacatcatttgcaggattaaagtcattgagcataattgaaaagtgttaataccctattttatcctcttccattggtattacttcaagggtaaaaacattttaaggtgaaaatgtgtcctgggcctttaattgaatgttattgcctcctgattgcaacgtattgaaactgtttaattacaaacctggaaaattaattactatatggagaaacagatcccagagggttaaaatgtccttttttgtaagtaaatacaacataaaaattgatatctccttatttataatccaacttggaaacatgccccaatataatttattatactcaaatgtttttcttaattgaacaacagtaaagcaacacagttcatccaaattaatgttactcctctcatagatgaactttcacaatttgtaattaggctatatgtatatatgagatatagagtaaactaaagtaattttgttttaaaaagaaagtaatattatgaaattgtttaaggtaacacacttttagaaacattctacattttctttttatcttcagtaatttgcttactcttgcttaaattgtagcatttgtttataaccccattcaaagctgcaaaaactttacagcagaagtacagtcagctctctgtcacacacttttgaacaactttgggagaaattcagttgagtccatcaagtattcaaaatgatcaacagcaatcatattttgcattcttcagagctgtgcggtttatacaacccatacacagtcaatgttatggccagatcttcatgaggccttagtagttgagtcagataagaattgttttgcccattttccagatgaagaaaaaagcttcaaagatattaagtaactagcagaaaatcaggatgagataaagatccccattctttaaaaacacagatgattattctttcaactagaaaatattgacttcttagaggatattattccaccatgatttggaaaacctttatcagtgaaacccactgtgtggcatttaaacatttctgaaccatatatattttaatctgtgtattttctttttcccactgtattccttaattgtagtagcttttattcacataatttttttaagtggaaaatgaatattgatgagattgtgcttgcttccacagaacctacttttcccaaaccaaccccagcagcccaacagtagatgctcagtgtcaccaactggagacctcacaatcaccaacattcaacgttccgacgcgggttactacatctgccaggctttaactgtggcaggaagcattttagcaaaagctcaactggaggttactgatggtgcgatatctttactagatttgtcttatgaaaacattgatttttatttctagatacacgttaaccatgtggagtttgctgatttgttaaatcatttctatgtatgcttatcttttaagtttgaatccaggtcacattcttttggtagtttctaattctccctgattgaataccacttattttccccaaagaagaacttcagagataatttacttaattcttaaaaatagaatagtgcatttttttaaataaatgtcatcacactcactgcatactgaaatgtaatctgtatatttttatttagtcttaggctgacatgattggctctactagacattaataattttatttcactctaggaggaggtcataccacctttaatattatcagagatgagattttagttagctaatcacattaggacattcctatgattttaattatgcattcactaagttaaattaactacctttcaaagtgctgaacaatgctaaaattattatttttattggcacatatgcactttgaatcttaactgaggcacctacattcatagtgaaagttgaaaaggatgaagggctctgcgtaatctggttttttcccagcagtttatttgtcacaattgacagctagcaaatttgagatatttcatgaacctctgagcgtgaatttaatccctattctttgatgtcttaaactgaaaattatttcttactctcctttatttgtgaggatttttacttttgttttctcccctaatgctggcttctgagatacaagtgctttggtctgtggtgtcttcttgatccccttctttctctgatggtgaaatttgatgtgcttttatacaatttaaatttacatgtagattaaaaggtcatttaaaattaatagaaaggcagtattttttaatatctgttcatggtatggcctgattcagtgacatgtcaggaatgggaataaatagaacagacaaacattggctgcagggacattgagtcgttaatggctgcacctgctgatgctgcagagatttactgctatggaactgaaaggagaagtcaggttcaaggatagcagtgatgagaaattcttccttagatgggcaaggtctttgattctttgtacctccatatttctttaaaagaataaaagataattattaatcattaaaaagatcttatgttttcacctgtcaacaaaaatgtccagatacatacacttgaaaaataagatattctgtccaaagcctatgttttattctatattcctaagaacacaccaaatgtaatgcttaagataccggctatcatttaactacttataatattttatagaagattgactctcaaatgtttctaaatgaagaaattgttatggaaaaggcaaaccatatttgtgggaagcaaagttgatgaactagaagagccagttaatgtgactgttatcgttcataaaacaggtggatattcagaattacgtctgatacaattaatggaaaacctttgaggccttacactagctcatgctatattacaaaacagtagttagtctagctttctttctgtggtcaaaaataagtgatgaccaatgttaaatcttctgccaactgagattgctctaaacattttgttacaactggcttgagtattaattcctatattgatttttacttgagtaagcaattacaaagtcaagatccttttgcagagacattgattagaagttacagtgttgttgattttgacagtaaagaaatgaaactataagaactaaatatgtacacacatgttatcaattaatctgtctctaaatatgaagttgccacattggctgatgccttaagcttctacccatagttttgatttttcatacaggttaatgatttaatactatctgagccattatttcattttgaacacatttattttgatataattcagggaattgtagagccatttgaaattccatggtagaatgaaaacgtatgtcatgttcagagaaagaagtgattacaggcataccttcctttgttgtactttgcagataccatggtttttacaaattgaaggtttatggcaaccctgggtcaaacaagtctgttggtgccattttactaacatcatgtgctcacattgtgcctctgtgtcacattttggtaattctcacagtatttcaaacaatgccattattattccatctgttatggtggtggtctgtgatcagtgatctttgatactactataatttttggggggtatcacaaactgcacccatataagatggtaaacttaactggtaaatgtgtgtgctctggtttctttacccactggtttctttacccctgttgttctgtctttccctgagcctccctattcctcgagacacaacagtattggaattaggccagtcagtatctctacagtggcctccatgtgttcaagtgaaaagtcacatgtctctgactttaagttaaaagctacaaaggcttaagtttagtgaggaaggcatgtcaaaaactgagataggccaaaagctgggcctcttgttctaaacagttagcaaagttatgcatgcaaaggaaaagtttttgaaggaaagtaaaagtgctactccagtgaacacaaaaaatgataagaaagtcaaacagcctattgctgatatgaagaaagttttagagtctggatagatcagtgagtcacaacattcccttaagccaaagcctaatccagagcaaggccctaactgtcttcaattccttgaaggctgagagaggtgaggaagctgtagaagaaaaatttgaagctaccaggggttggttgatgagatttgaggaaaaaagccatcttcataactaaaagtacaaggtaaagcatcaagggctaatatggaagctttatcaagttattcaagttatccagaagttcattcatgaaagtggctatactaaacagattttcaatgtagacaaagcatgcatatattgaaagaagatgttacctaggactttgatggctgaagaaaagaagtcaatgcctggctttaaatgacagactaactctcttgtaagtaactaatgcagttggtgactttaggttgaaactgatgctcatttactatttcaaaaattctatgacccttagaattattccaaatctactctgcctgtgctctgtaaatggaaaaacaaagcctgaatgacagcatatctctttacagcatggtttacctaccgaaatattttaagtacagtgttgagatctactctgcagaaaaaaaaattcctttcaaaatatgacttctcatctacgtgtaccttgtcacccaagctctgatagagatgtacaaagagattaatgtttttatacctgttaacacaacatctgttcagcagcccatggatcaaggaataatttcaactttcaagtcttatttaagaaatatattttccaaggctatagctgctgtagacagtaattcaactgaaggatctgggcagggttaattaaaaaccttctggaaaggatataccattatagatgccattaagaacatttatgatttatgggaggagggcaaaacatcaacattaccaggagtttggaaagttggatgactttgagggggttccagacttcagtagaggaagtaactgcacatgtggtacaaatagcaaaagaactagaattagaagtggatcccgaagatgtgactaaatggctacagtcacatgatacaaattgaacaaatgaagaattgcttcttagggatgaccaaagaaagtgatgacttgagatggaatctacttctattcaagattgttgaagtgataacaaatgattcaaaatatcacataaacttaattgataaagcaacatcagagtttgagaggattgtctccaaatttgaaagacattttactgtggataaaatgctataacacagcattgcatgctactgaaaaatctttcctgaaaggaatagtgaatcaatatggtaagctttattgtcttattttaagaaattggcacagctaccccaatcttcagcaaccaccaccctggtcagttagcaaccatcagcactgaggcaagatcctccatcaccaaaaagattaccactctaggctcaaatgatcattagcattttttagcaataaagtatttttaaggtatgaacttttttttagacatagtattattctacacttaatagactccagaatagtgtaaacatagcttttatacgcactgggaaaaaaaatttgtgtggccttccttattgcaatatttgctttattgttgtggtctagaaccaaacctacaatacccctgagatatgcctgtattccgtttagagcagtgtatctgttgtcacatttttgcgcttagactcattttctggaaatatttataattcaaacattcataaaagatgaaattgctaatgatgctgaatagtgctatgttgagcaacaattttactgatcatagattaagctaatatgtttcaatatacttgagtttcaatatatttctctaaaagacttccgcattagttcactggcattgttctgtatttcttctttccttttgctctatctttttctctcagagaattaggaaattgtaatcagcattctgtgaatagagccaatagaagttaaaaagactggggagataagatgtatttatatcttgtactgacaataaatgtcacatcatgatcttatatgaatggtttattgagtatttataatgcatagtgagagaaaaccgtggagttgttcacagatcactggaatccctaaatgttcatttaacctttgacttaagtgtcatggaaacctgtggtcatctttcacccataacatccttggaactgaaaattatgtctggccaggagattttcaattactttattgatcaattcattcaaaaggtgatgagctactcattagggcagtaaaaaaacagaaagaaaaaaactaattagatgacctttggctgcatctaatgatttcagggatatgacaataaaagcaggttataagaagttacctgaattctgcataggtatttaatttggaaaaaaaatcgtttaaaatttaattagtatgctttactctggtaacacagactcactttctcactgcattaaaaaattactcatagtgttttgttcattggccttctctttttgacccataaaaataagtcccatgaaacttttagtttgaatttctatttgcctaattactgacagatgtgccagaattattacaatattctacttcaatattttcttaaaatgttttatttagtattaaaagtaagaatttgatgaaaaaagcagtgaaataaatgattctaatttttgtttgtgaatgataaacagtttttattgtttttcttaggttttatcactgataaaataggtttaggttgactagaatctgcaatgtcttgatatgaaggtaacctgtatcataaattctagcttcaattaaatttggttggctttctcatgataggttctgaaaaggctgcttaactttaatcttttgttccctaaaactatgaactctagtaaatatgatgcaagtaaattggaaagatagtaattttaagctgccatttataaaagctggtgggcaaaggaaatttgaacgttaagcaaactgttttcaattgtatacattgcaatacaaggtgagttttttgagaaacaacagtttatcttcacagttgcttagaaattattagaatccatcattcattttttcttttttgtggaagtctttttcatatatattcttttatatactacatgtattttatatgttacatataaccatacacaataaaaagcatattttggataattaaccaaagtctatgctgtctatgccgaagtttatagaactttctctttagaaagacttccctggacctggacatgtccttttgattatatggtgatcttctaatgaattctaaatgaaatcttacctccggtcaactctatatttttcttaaccatgtaaataatactgtacattttgatgtccttcttaaataatcattaaatacttctaaaagcactgaaatgctactacgatacagttgtattgtactaccgaaatgctactacaaatacagtatttcataaataaaaagcaatactaagctaaacatttagaaattatggaaaatttatccaaatgaacacaacaattgatatacatgtaaacactgattttgcacaagcactgtttttgtcatatgataaatataatctagatgactttcctttgatcaattataagcactaattaaatcaaatcatccaaatgatatgactgtaatttgatgagctcatgtcacaattttggaaggaaattatttataatctaatattttaacatcagcagaaatattttagcctgtataaatacagcacataactggtgccataagggggaaattatgtactatatttatgataaatgcaaaagtgaaaattggctgtactcatatgatacttcacacactttcttaaatatgcatatgagataaaatgaacatttcataggtgactgactgccataagctattcaaattttaattttaatacgactaagcctttttatacaattaagtctttataaaatgtcagaatttatctcaatgccattttaattataggtaatgcagaggaagttattgacaataaatagtatggccttagtatagtatatatgtatgtacatatatagatgatagatatatgatagatttagaatatacatgaccaagaatatacatattgcttagaataagttataagtaatatatattgtgttggggctttaaccttactttcagtgtcaatatatcaagcctactgaactacattgatgttaaaatacctgaaaagagctttattcttcagttttgacagatagacctccacctataattctacaaggcccagccaaccaaacgctggcagtggatggtacagcgttactgaaatgtaaagccactggtgatcctcttcctgtaattagctggttaaaggagggatttacttttccgggtagagatccaagagcaacaattcaagagcaaggcacactgcagattaagaatttacgggtaagtaatattggacttgtacatgaattatcatctacacataagtactgctctatggaaaaattgcatagtgaacttaaaatcttacatcctagtataattgctgcacgtttaaaaacagttaatgttattacttattttaaaaatgatgaaatgaaattagaggaaaggtcacagtttttacgttactcacacattcataacagaatctcgaaacttttattcctgtatcccattccatatgtatacagtcaacaaatctagaaatcttaaacacatagcattaatatgagtagtagggtattggaaatgacaaaaacaacaaatgcttctgatttactttcattcgcaaaagaaattgtaaggaaatgtagataaagtggcttggccaaagagttgagtagaagaaaaataaagagatgagactgagtacataaacggcgagtttgcctggttagtgggaaaccttaggttgtaggttaagttgttgtgtagtttagatttaaacccatggaaagaacaaggcattggtggttttttactgacgtttacatgataaaaaatgagcattcctggcaacttaacaagtcagtcctgcttcaggagcaactcaaaataaaatgtctacttctgaatattgtatcagttatctattattatggaacaatatgaacaaaaatacagtggctaaaagcaacacacatttattacatcacagtttctgtgagttaggagcctaggcatgactgagctgtgtcttttgcttctgggtcttacaaggctccagttaggtgtcatttagagttgccgtctcatctgaagattgacacaggatggatttgcttccaatcaacattattcttggtagcactcagttccttgtggctactggactaacaacctcaccttatcaatggctgttggcaggaggttgcctttggttccttgccatctggatcttccccatatgactacttgcttcctccaagtcagcaaggaagagagtctcctagtaagatgggcactacagtcctgtggaacaaatcacaaacatgacatactgacacttttgcaatattatattggccagaagggaaccaacaggtcccacttacactccaggtgagggattacacaagatacaaataccagaaggatgttatcatggagggcacctgtcctctatcagtacattcaactcattcaactaggtatggtaagtcccttcctcctacctgccatgtagcaagtgctatgtgaaagctggagagtatattttagtaatcacaagattggggatgagacccagaactaaggtagatgatgtaatagtgcatgaagaaaatttcagtggaggagaaatctgtagaatcttgggtccaggttgaaattcagagccaagatgaagaaaaacaaagcaaaacagcatttagaatcttcccattctggagctaaaaagaaaggcaaaaatttttaactacacatatttccaaatgatcacaatttggcatattgttcttttataatgggaatatgtttacaattatatgtttatctgattatcgctatatcatacagacgtatatcagaaaacaaagtgactatttttgctacatgcacacacatgcacacataagtttttactttatatatataatatttatctttaatttttgagatacaggcattaattattgctttaaatagaaaaaatgctgccaagttgagtttaaaaaagtaaattaatacagatattttgagcctgtctttttattgattgtaaattaattgttaaccttctttgaacaaaatggaagttattaaaaaattaatgccaactctctttgtgtaaacactttaacctctatttctgggctaaaggcagacttgggccatagaggttaatgcattttcactgtatcactgaattaaagggtatgcttgagtagtcaagatttctagtagtgtttgaaagaagcaattaaaggtgggtgcttgatgatgtcaaacaaactttgagccctctgacaggcttctgagtagtctctctgagatgccagctccttggggcttgtctgcagccaagtgcacaaggagaaaagtagatgatggaatttgcctgcacattaatctcattttaaagcaatttattaagggtaaaaggacaagcatggaaaagatgagaagcactcctcaccagaaaaagacattatttaaaattaaaggaataaaattaaaggaataaaatgtggtgatgatggtaataccaagagtgagttttagcaacgatatttaggtttatgaggaccccaaaatgaaaacgttgttcttttcctgtaacatgactgtccttacagggagacagaagtgggctttccaatagttcactcatacagtcaagagagtttctgtaggctgtattcctttgtgtctcactatttttttttcagtacttaatgcaagggaaaaaaataatgtgatgaatactgtgttcttctaggccagctaattggtaactgaatctttatcttttgagaagtagaatattccagcactcattaaaatatacctaccgcagctaatgtcatacttgtatctccacacaatgacaaggagatgcagttaagaagcattacctacatacttttcttttagcatttgcaagtaataacaagtgctacattttagttcaacagctataataaaatgcaaattcttttactctttcacagaccatattcaaatgaacatcccattaaaatccaacctcggctcattatatttagtttgtgagtgatgcttcttaaatgcaaagatttctaatgactataatgtgtgcacagccacatttgaaagaatggctctttctacaatggctatccccatcttccctctgtgtaatagaagacaattgtacagagataatatggcaaagaatgtcatgccagagcaatttggaacttaagttaaaatacataatggcatttaaaatcaattaagatagtgaaatggcagtaacatccaggcactaatgatttacctgagaatcaatcgagaaagcttgagtcatcaacacacttatagtttgaacccagcagatataatattccatgagcgactatatttcatcaacaattagactgatgttcatcacagaatattaattctacatcttctgccttgtctgactttgtttggtcatcagtttctcttcccagtgtgacttttcctttactcctaaattgatgagaatgaatgttgtttgcagtgtaagccacaaggcttgatcacacagaattttggagttgcctcttttattgatcttggggctttattcaaaatataatcacagaatcttctgcttcttgcatttgtaaaagaggactcttgattatattatcaactttttctgaaagtcctttgccactcttctgagaataataaaaccattttaagtgatcgatgaaatggcaagtttttattgtgatcaaaaaagagttatgaattatgatatatttatgttccctttcagcttgaaattgcagtcactccatagccacatttttttaatgatactttattctattcatttttccactactgcaatttacatataagtgaatattgaagtttttaaatgaagaagtttaccttaaaaatatttctttttctggctgggcacggtggctcacacttgtaatcccagcactttgggaggctgaggcaggcgggtcacctgaggtcaagagttcgagaccagcctgaccaacatggagaaaccctgtctctactaaaaatacaatgttagtcaggcatggtggcacatgcctgtaatcccagctactcgggagtctgaggcaggagaattgcttgaacctaggaggcagaggttgcagtgagctgagatcgagccattgcactccagcctaggcaacaagagcaaaactctgtctcggggtaaaaaaaaagttctttttcttcttcacttttttccatgtctttcaaaagaaagaaagtgtgatcccttattgtcttattgcttatttactcgggtatgttttattcattgaaacatagtttatttgagacagaacagttttgcattactgcttctctggaattttgtgagattctgaaagagttctgttctgagtcattcataaacaacttagatatagtagagccctgccataaaatggagttaagaggtaagagtattatcacagaggaagaaaaagagaggggcaaattgtttatcagacaaattaacattgaggtgcataaatattattttaaaagccctttggaccaatgttatgaataatattatatgagtttatttcattattttatgtatacatatgattgactctaatgcataatttagacaacaaaatgatacatctaattttaagaaattaaatattgcctggctgtcattgagtaattattctgcaaattgactgaaacaatttaattctctcccttctgtgcacactagatttctgatactggcacttatacttgtgtggctacaagttcaagtggagagacttcctggagtgcagtgctggatgtgacaggtgaggactttgtgaattaggagaaatcttgggccccttttctgatagctcaatatcaaataataagttaaggggggatcaaagtgtttaattcactgaatgtaaattttagcctttacattcaatgccattttttaattcatgcatgaatttgcacacaccattacatttgtggaatttaatacacttgtctttgataaccttattattttatttcctctgaagtgtaaggaattctaatgatcctatgtaaaaacacagcttacttttattaacatgtaggagaagcaaacattcacttacatacttctgattcatggagatgaatttctcactgtctaggtcaggtcctttagtagactgcttccttcttttaggcagtattgtcaacttatgcaatcaggaatgaagttttttctgtctgtcctctatagagtctggagcaacaatcagtaaaaactatgatttaagtgacctgccagggccaccatccaaaccgcaggtcactgatgttactaagaacagtgtcaccttgtcctggcagccaggtacccctggaacccttccagcaagtgcatatatcattgaggctttcaggtatgggacaattccttctttctccactgggttttgtcttagctcctttattctaaaatgtcacctgaactatcctgctgttttattaaagacatgtccaatcaatgcattttaagaattgatctcttctctctgactttattcaagaacagagttaattttttttagtttacaacttaattataagatttaaatatgcattattcatgcctaggtctatggggatccagttcataacataatcacttagctccattctttacccagaccattgtagggatttaaggtgagaatttaggcatctgaactgggtagaaaatattttaattaggcataggcacaggcactttttaaagttatgtgacatttattgaagcagaggactctggcatttatattcctaataattagagcagaacttaaaataatcccaatatttttataccatatattacatacatctattagatatgcctgagagaaaattaacaacaataattaataaatttattccatgtgcttctagttgcttaatggaaaagatgtttccacgtgttatctgaaataattgttgccaatttaaagatttaaatgtaaattagcaaatatcagtataaaattgtcctatgaaaatttgataaaatgcttacacaaatggtaaaatatgctttcatattccctttcaaatgtgcttctacgtgacagtataaattttaatggataaccactgttttttttaaacattaggacaaatgatcactttcttataagcttctctaatcattatttaaggtaatgctaggtacttaattttcaaatttcaaaatactacgtttctatcattcttatgcgtggacagttaagcatatcagaaaaataaactgaccaccctgaaaattacatttgccctttcttctgagcaaaagtggcatttgaccttagacaaactgttctaaaatggcatccatctgtggctggctgtaaatgggtcctcacacacaaattcagagagatttcaccgttctgagatgagaaatcacaatactgtataatgtacaattttattaacaatgtaaccaagggaaaatattcattacctgcttcctctcttcttttacagatatgtagtttagaaggctcagttataatattgcatgtggaaatgatgcaaaagaaaacacaccttgtaacaggaaaatgtattggcataatttactctgtagtccatttattctttctacaggttaattcttttcaaggtatatatatatatacatttacgaggaccatacttattgtataaacttgatgttgtgatcttggcctctgttccttttacaggtattcatttagtgggctgctgtgcattagcaaagggctgtcacatctcctgggctgagtttaattttgttgtgcatggcacttttgttaggtgggctcggctttgttgtggaataaattgaaatcatccaaatgtttcatttattgggctgaatacttcaagtgttgtgtgtgtgtgtgtgtgtgtttaatttccagccattaacctttgtcattgatacccaactccatttccaatcttcaaatgactgttctttaaatgaaatttctgttcgcgtttcagccaatcagtgagcaacagctggcagaccgtggcaaaccatgtaaagaccaccctctatactgtaagaggactgcggcccaatacaatctacttattcatggtcagagcgatcaacccccaaggtctcagtgacccaagtcccatgtcagatcctgtgcgcacacaaggtactttcaacagctgtcaacaagactggttctaggcagaaacatcagatatttaagaacgaggggcttgatgaggaaatatacatgtgcctgcattgctttgtatgatggctcactaggctttatccagggaaggagaaggtagcttgctgtttatcttggtgagatgtgttctctttctggagtttttgggtttattcagcaaaaaataaaaataattgggtacctctacgtcgaatgaattcactaaattagagctttactatatttcaaagggaggaaaatgtttctccttctttaaaattaattacacaataacagaaaagtggtctttaatgagtagatgcccaaatagaggtataaaaattatgtcctattgtttcggaattctgtttttatagtgcagtcgttctcacagtgtggttcctgggtaagcagcatctgcatagcctgcaactgttagaaacacacattttcaggctcaaattcaaacgctctgaggttggggcccagtgtttgttttaacaaaccctccttgtgatgctgatgtataagttttacaaccactgctacagtgaatttcgttaaatcagatgtttaaaggagcaatttattacagacagcaggaaatcaagttttctttctaaagaactcaattctttcgactataatgtaaaatacacacagagtattaaaatataatttcaaaatggaagatttcataattttatccttattacctgtctcttcaaactgagaagtcactggagtctgaggtttaatatacaatgctacattatagtttcccttctgacaagtaggaaaaagaaattaataaaatagaaacggtaattttattatttgttataacctacttcccacagggttcttcagaaagggttaattatttcttatttgtaaaagactttgaacaagatataattcaaagtagtatttttatgcaatgaaaagcaccatacagccataaaatattattataattacaatgtagttcggtgatagtaactagcatgctattataacggagaagggcaccttaaaggaatcgactgaaataaagtcaccacgtgactttgtaacgttgctgacatgatgacagtcaagggaggaggaaatgccattttgctattgttctctaagcagtaatgtgattaattttccatggcgataaagggcctgtaggtaaagaacctgtctcttgagaaagaaaaagcacaacaaggaatttgaaaatctgaaatttgaacctagtcatattttaccttccttaaatctgattgctttttactgtgtttgaattaagtgtgtaaattttattattgaacttaaaatggaaaatgtgtacaattttacgtcaagaaattgtagtaccgtgatcatttatacctttgtgcatagaaatagtttttgtgtgtagccagtgaaacgtagagagagatcagaatgggaagatatttggtgtgattgtatctggcagacctttttgatcattcgataactatgctagtcactaaatcttgactcataaaataactcgcagtgaagaggtcaagaaagattaatgaaaagttgtttgtggtctggtttgttccaatggaaagaatatatagagtgaaagacttctgtgctcttaacaaatacttaataggaaaacccacgtgttgtgtctgaaggtcaggattatttttgggtaccatactttcagcagctttgcaatctgcaaagcatttctttttcaaagaacactttgcactgtgaactcttatttttcaaaggtattaaataacagagaatctagaaatcttttatttcattaaaagtacaaatacttggattatcagcatcaaaacagaacatacatatataggcatagattaatgttattcacataaagggacttttttcaaattaagtaaaacttcattttactgtttatgttaaaaatgaaaaaaaaaaagtagaactggaaaaacattacctaagtattagtctcaattatttacgacccaatttaagttagtgctcccaatttaagtaatagctgagaaatgttcttaaaaatactttcgcgagagtgctgcatgcattgtagcctgagataataagaaaaaacaggattacgaaaataaataactttaaattggacttcctttcttaaatacaatagttggagaaaaacaattcaacaacattgtgtgccagcttaaaaagttaatctgagtatgtgtaaaattcaatgtttaatatcaatttgatggacttagctgcttacgatttatcattttttcttaatggacacagcctataatttatccttttttcttaatggaccgagaatataaaccatcatatggagaaatagaatagtacttaggagactgatgaataatgtggcataacaatgtgtgactgagggtataatattttaaacatgacctttctttcttcccttctccccaccactattcctaaacatgtctgcatgacctcgtgtcaggtattagagtactgctcaaaatgtattactttagaacatgttatcagtattataactatttctgtcaaaagtatctttgcaaatttgaggagctgtttcccctcttcccccaactctatttacctttaatgacagaattcactttcctagtccaccattacttctccatccatgctcccagactgaagtaggtcaagaagaaaacacaacctgcaaattgggacaagggattaacaggtcccttagcatcagtttttagatatatcccaatttacacatccagaaaatcattcaatacaccaacatctgtacaaagctgctctttctagagatctttctagacttctgtagagaagtcttacagcacatactttatcctttagtaataaagtaagtgatcttatacaacagtgtgtctgcatttgaatgcggatgagggattacaaatactcttctattagtatatttttaataaagatcaatatcatctttcattatgtcctaccacagtggtatatttatatatataggcttaaatgctttttgtcacaagagagttttcgttttgtttccctgtaattagttctaaagacatgaggttgatttacataaaataaattgtaattttaatatgaatttttaaaggtgggaatgattctcttctctaactgcagatatcagcccaccagcacaaggagtggaccacaggcaagtgcagaaagagctaggagatgtccttgtccgtcttcataatccagttgtgctgactcccaccacggttcaggtcacatggacggtaagctttcaaaggcaatgttaatagtaatctcttctctttcgggaaagcaaaacatggaaaatgcaaatgaacaaagagtgataataaaaattcccgccatttaaaatcaaggtgtaatcaatgatagtaaagaaaatcaacaaattaaaaagttactagaataaccatagtaagaatagattattatataaacatggcatatcctgtcttctgaattttctaacagctttcttgcgatataattagcataccataaagtgaacaacttcatgatttttagtgtatttagagtttctaaattatcaccaaaatctaattttagaacatttcatcatccccaaatgaaatcctgtgcctgttaacattgattctctcatttcccctaccgtagccctgtgtaacactaatctactctatgtttttgtagatttgcctattctggaccttttatatgagtacaattgtgcaatatgtggtcttttgtgtctagcttctttcactctgcataatgtttttgaggttcatccatgtggtagcgcgtatcagggctttgtttcttgttgttatcaaatagtattccattttatggatacttcacattctgtttattccttcttcagttgatggatgttcgggttgtttccagttttgtctattatgaataatgctgccatgaacatttgagtacaagtctttgggtggacacatgttttcatttatcttggtataaacctacaaattgttcagtaatattggtaactctccatttaatattttgataaactgccaaaatgctttccaaagtggctatagcattttctattctcactagcaatgtttcagtgttccagattctctcaaatccttgccatttttttctcacatccttgccaacacttattatcatctgccatttggattatacccgttctggtgagtgtgtagtggtatataattgtggttttgatttgcatttctttaatgactaatcatattcatcttctcatgtcctaattgaactttttttttagagaaatgtctattcaaactcttggtccatttttggacaaagagtttgtcttcttattgacttaacaagtgtttatatactctattttgtttgtcttcttattatagacttataagtgtctatatagtctagatacaaatgccttatcagatacgtaatttgcaaacattttctcccagtttggttactgtaaccctgttatgtatttaaagttgagtggcatgaagcctccttcttccttcttttttgcttaggattgccttagctattcaggctttttttgttattgttccatgttgttactccttaaagcaaactacataatcagtcaaattattggtttatgagtacaaaattgggttgtatatattttaaaaataagactaagtttataatattttaagagtaattatgattatttaggattacactttcttattccagttttgacataattttgcatagatttattctattttctgcatatattggtttctattcttctgttcccatgaagggaacacaattacgttattatttttacagtggcacagtagggggtattatctgccatgccttttctatctttcagtacccttgagtagatacaaaactaacaaagccaaaatactacgctgtatttttcacagcgtagtagttttcctcattctcaattgaaaaaagtctctgttctgttgcaagttataaggcggattcttttaagctgcatctaaatgtgggaagtctttgggtaagaatcaaagtcattatgttgatgaagttaatcactttaaagtcacttagtttcaagagtaaatagcattagatcaaaattgcatgacagcagactgggagttcttccaggagggggacgttgtctattcatctctgtaccccaagaagctatcattactagtttgcacatctatccccgtcatgggctgtaacttctgtgaggctacagccaatttctttcatttctgtttttttcagagcagagtgtctattatgaagtactctttttaataactgtttgttgaatgatcaaatcagttgttttcatacattttacactttttttaatagaagaaagaattcagttaatatcacggcatattgttctctatgactttgtagttgcacatgacataagtatgcatttgaaagagataaattaagtgaaataaagtcagactggggtgtgtccagtggtcaaataatttgtgtaactcttttattgatgtaatatttttgatttactaaatgcatgtgttatttaaattatcaaaatgttagcatttgctttacagaagtgttggggttgaagggagaaataattccccaccatgtgattaggttttgggccagctgaggaagtttcccagtggttggcaggattaatgaccaaaggcacaagacataactactgtagagaccattcgctgtcccccttctcaccaggctaaacttgaaacaatagttagcaacaactgctttctaaaatggctgcttttagaatgagtgtgggcaaaaatgataagaaacctgctgttccacaaagaaaaatagcaataagtcacttaccgaaaaatgattattctagctttactttttgtctttgttttgttcaaggacaaaaagaattacatactctttgcccattaagcatttttccacagagattgaaaagagtgcttcgacaaactagaatttcagaagtctgctaaaaccagatcagacccttagcagctaaacccatcaaagaaaattcactttgaatttttgctttatattgagttgttatgttgttttgttttgaaaatggaaaaggtaaatatgaagcatcacacttaaacagtttaactagaatgctgattttagggccacatataagccgtcttcttttttagcctgttgcttccttaacaattatgttttatcattgtgcatctctaaagccagcaaaatgctttcacttatatcagtcacttgattgtttctgtgcccttgagatatgggtattatgtgagcaaattaagtaaactgaggttcagaaagtttaagaggttgaagcctaattcaaattgagacctatggctggaagcctgaagttctcgtaatcattttatttttccttaagacaactctttttttattcatgtttcagaaaatactattttaaaaaaatatataaacccatgaatctgtggtcagactctgattgtaatcaactctaaaagaaaatcctctttcttagaatgttaataaaactcgtaacaaacatatggcctaacttgaaaatgaccacctgtcaaaatgagctccaaaatttagtgaggtagaacacacatccagtaaaaatctcacctattttttttaaagtaaatgttcagtgttttcatttctgcttccacctgtaacaacaaatttcgtcctgaaaaaaaaaaatgcattgccactgcacacaatcaagttaaactatttaattattaagccccatacgatatactggccgatgatagtgtacactgaagtgtgcaagtgtgcaaaacaatgttttgtggtaaacattagcttcataaagtccctaaaacacttaattaatgaaaaccaaacatggataaaaccaatttaccctgatttacagactcccttcatctggaaacagctgcttaatgttcttcttaaaaacacagcttgcttctttcagtattaacaagctattattgtgagttatgtctttctttcagtatataaattcacttaaagcaaatgcagagaagtttataaaatgcaaacttagtgttgttttaacatatactgcaagggtttttttgaacactgacagttttgatgaaagtcatctctctttggctctcataaatttaacttttcgcctcttggttgccttatttcatagtgtcagaaaaactcctgcttttcaaagaatgtatccaatggtagaaacataaactggtagcatgaatgaggacttgccgatcaccagcttccatgttacacctgggctcactttttttttttacctgacctcatacaagtgtagcactaatttcagaaagtctttgagggtgagaaagctttcaggtgggtgaaggaattcattcttgttgagacttatctgggaaactggaattagccgtacatagaaacacacacacacacacacacacacacacacactcacttaattgagggagttttctcgtttggacattctaagtatttccttttgttccactgtatttttattgaggctctgcatttttaactttctaaagccaatatttttagctaacattcatttgttgcccccaattaaaaataaataaaacaatactgcaactaaagaagggatattagtagttaatacatgaaagaatacgttttgtttataaactgccgacaaatttcaacatttcaacaaaagttgaaacaaatttcaaatgctgaacaaatttcaaatttcttggataaagaaatttgtttaaagctgaaattaataaccgtctccataattctcttttttatttcctctttctctacaaacttcctgaaatgaggttattccatttcttttccattaatctttacactttatttgatagtgaagtatgtcaaatttaagccttgttagactatagctattaaactatgataagggatattagttggaacatgctatcatagtttgtgtttaaatcaagtgtttctaaaaacatgacaaagtattaaaagatgcttaatttttaaaaataatttttaaaatccatagttgttttctccctgaaaatgaaacaaccataaaaccctggtaaatattttaaaataaatgtatacagagaagaatatatttcattttttaatcttgcatttttatatatttcatttttaggtgattgtcaatagcaaacaaaaacactttttaaaagttctatttggtatgagtttaatcttagattattatttaaaatagcttcttactgtatcttaaataaatgaagatatcaaaaagttgtcaaattttgtcaagaatgggacaattgaagagtcagaagttggtaaattagtaaaagtttttcatttaatatttggtaatgggcataaacgttcatatgcttttaaaacaaatgctctagctctacaactttaatctgtattatatgctttttccagccacagggactttatacatgatgtcctcacatttgttttcctgggtaaatcctgctcttcttgcctatctaagcacttacgaattcttcagggatgctttgcctctgcttcccaactcagtcacctttctctccactataggctttcttagctcttggcacctctcattcttaacatttgtttatgcttttttttttatgattgtaacttgaccatggttcagtcattattagaccactcctaccttctacctggactccatcttctcacctcagctcatgagggcaggggctgactctattttcattgtccattttatccccagagctcagcagaatttctggcacctatgagtaggaacccaaaacatgtgttttgattgagtgatgatgttagtgaatagacaaagaatgagaatggaaatccctgacaaagggcatattacatataaagccacataaaagggaattgttggatgcagaaaatgggtaagcagaggagacataaagttagagatactggcaggtctggcctttgagaggcccttgtgctaatccaaggcatcttaattaattaggttggtatcttagatactgtgaggtattttaaacaggagagagagttctcccaatcttcattttggaaacaatcttaggagcaatctgaactctaaaaggatagaagttattagaagcagagagattagctagaaagtcatgacatcactcagttgatagttatgaggacagaaatgggacaaatgaaaagaggacaaattcattgtgttgtctaaaatactttcctttagtttcaaatgcccttaactatgtttttcaggttgatcgccaaccccagtttatccaaggctaccgagtgatgtatcgtcagacttcaggtctgcaggcgacatcttcgtggcagaatttagatgccaaagtcccgactgaacgaagtgctgtcttagtcaacctgaaaaagggggtgacttatgaaattaaagtacggccatattttaatgagttccaaggaatggatagtgaatctaaaacggttcgtactactgaagaaggtcagtattcagatttcgaatataaatcaaacatgatgaaaccaatttctgttacagtacctatttgttatcttccttagaagaatggaaagatatcacctaaaagtaaattgaggaagtgtcgttttctccttttattctgagaattctatagaatctgacaagcagaaaaaaggacactaatgtaatttgaatttttcttaagtaaccatttgcaccaaatcttatgtttaagttcacttgaattggattattaaatattcccctatattttgtgtagatttagttcatttggatcatgaaagacagacgactggaaatttgagaacacaggctgttcattgtgactactcttcttttgttatagttaagtgtgacattttcttttattagccactttttcctatgggcactgccagtcaaacccatgatttctaatcaggaagggcacttgcgtatttgcagtagctttcttcttagtgaagttccctcgttctccccactttggaccttttcttacctaaaggtatgttaaagtcaatctgtgatgaacacaagctttccaccagttcatttagtagtatctctttcactaaacaagaggcttataataaatgttgtcattaaagttaaaaaaaaggagatgcgaaatgaaataaatccctccattctgcttttgtattaattttgtgctcacaactcttgtaaaaagccctttctttaaacatatttcatacaaaataagagaagcctttaaaaaatgtatataggttgcccacgttaacatctatgtgcttgaccaaagagctcttaaattatacatttcttacacaacatggcaaaaatgtcatcttcccattgttttgcagtgtgatacactggcaggggcaaaaatgcatattcaaaaaggcatcattaatctatttttaggatatgttgaaaagttgccagtaattataatagtatcttttctccttgccaacatgtttaaaaataataatcattatcatcatatctttattcatcgttaaatttcactctgtgttgcaaattggtagtattaatgagtggagcaggtaaccttaacacagaatgctctctttgaagcctgttaccaaaatcaatttcactgcagttagacttttcctctggattagacatttgtccctgttgggtatacattcatctccaatttctgtggctatgtgatggtaacaaatggaactcagctgggctgtgtctgggaatgatgagcggcgatttgggttctttcacatctgtagaacgaagctgagtcctggaataattgacctgtcaggaagcaggcacggtgttctcgccgagccagcagcaaggtgaatgagaaacccattctgaaagtcttatttttcaatgcattctacttaataactacaaggctcgtagacaagtggttggatttattcatcatgccatattttggagcaatattgtcacaaagaggaataggaaagaccagtactctattaacatgttgctgtgtgtgtcctatatctcaatgcaaatatggctatacctaagtgaaatatgtcatgacatatttacaaaacatgggatatctgctgtcaggcttttaaaatatattttaggatatttaggatagtttcaaaaaactaaaccatgtagagctatgtaagcattgatgattctacataaaaagccattaataccaccaaattatttgatattttaaactgttaagaacgatgttatgtaatactatgattttaactacccccacctttgattttaattcagagaatcactgagaatagatgaatttttccacaaagttattatttcttagttctcaggcacattaaatgagagatgtggcattctaaaatcaggaagagcttctctcttgccttttctcagtatggttgtaattagttataggagaaactataaaggcagagaattattgtaggaaatcaaaatcttcccatttcacatttgacccaacatgaactgttttcatttttatcatcagagtcccttgcccatccatataatataagttttcaatcttaacttgcgggtcaatttatagcagtcaattatttttcccagtatgggaagaaaaagaagttttttctgtgttgatgacatttatagttatgtttctgtttttatttagtaagcacaagctaaaagcataccaaaatagctatcaataatgccaccgttcagaaataacatgtgataaatactggaatatgtcttctcagaataattttggttagaagaagttatggttgtttttagaaagacagtctattagagtagagttctaaaatcagacatacaccggctcaaattctgacttgctctttgactttcctaagtctcttacagtaaccttctgtttcctcatctgtaaaaccgagataagagttgtttctacctcctgagattaatgcaagcattaaacctgacacttagctctgtgcggggtgtatagaaaacacttattagaatgttagctgtaaatttattattgagagcatattacaaaagctgttccatttgctttaaatctagatattgtatttaaagaacatttctcaaaaaaactgtcactgttgaacaccgtgtgcattcagaactcctggaagccagagtctcctgcaacttgtctttatactcatattctgaaagtagcatgaacgcacaccaaggcttatagtttgcatttattctaattacttcctctacagccccaagtgccccaccacagtctgtcactgtactgacagttggaagctacaatagcacaagtattagtgtttcctgggatcctcctcctccagatcaccagaatggaattatccaagaatacaaggtaggacccgggtgaagaaggacagctctcatgtaaaggttcccagagaaatctcagtgtctcacgaatgagacacatctctaaaggttctcttattcagtttaagtgtaaagtttttatttatatttctgtgtgacagagaatgaaacaaatgcataggtattagaacctgagttcaaggtcagagatcacacaaacccagttgaacaattaaaccacaccagtgaaatggttttctgtatagtgtgactctacaacctcaaggatttaaagagatgggacacagggtaggttgtgaagcctagaaaatggattttatctttgttattagaattctgcataagaggctttaaggcagctgtttttaaaccacgttctcagaaaaaaagatgcttcgggggttaaagaggtggagtgggttgtggcagcaccgactctcactctagatgctacttttgtgtatttattgaggttgtgtagaatatttcacctgaaaaaaagccactgaacatattttacaaaatactgacttacagaaaaaacagttgattgtctcatttttcaactgatgaatttttggctgtttagaaacatatgtatctattgtttcattgccatcatttggtgtgtaaagtagaaagtatgtctacgttttcaaaataagattctgtttgtgttgtgattagaccacatgtgaatgaaaaacccctcattaatctttgtaaaattcaaaactataatttattaataaatcatctattgatatcatttattaataaatatttctagatttctgaaaatagcatattctatacatctaatataatacaaaactagacacccatttcacctacaaaattcagagttggtatttaatattaagctgaataaatttactcaaaagtttgcagattaaattttatttctaaggaaatattaatttttacatacaattttattaaagaataacttgctaaagcaaatgaatggactaaatgtataaggctttattttaaaatgatttctatcatgttgtaaagacacatgcttaagaaacataagaataaatgcttttacaatacaataattatatagattctaagattttataagcattaggacattgttttaacagagtaacaaattatctactctgtgtgagtttgagtgtgtgtgtgtgttttaatgaggttaggaatttatttttgtaccatttggcactaaatatcctaaatttccatgtagttaaatattgttacttttttttacaacatgatgaattttttttccataagttgtaaatgttctcactctctaggcacttgccatattttggtttcaaagcacatatgtaggtaagagctaaatattccttcactaagaacacagataccatatatcaataaaagaaacacatgattcacaagaattattttttactgaaaaattctgggaacttacctgctccgaaacaaatcatatgttttcctacatatgtgtctacatgtagatttttaaatattgtataatatgaatacaaatgtggatacacagtggatttcttttcataacacatttcatcagaacaatttctatatccaagaagatgccctaaaatttgattcctacttgaaataaaagcctgacttccttaacatcaatatctaaagacttgccaccactttgttctcatgaatgtgtatgtgtgtgtagatatgtgttgatcaatattagatttattgctgtcaacgtaaatattggctttaatttcattttagtcaatacctataacttaggtcaattcatcttgttaactacttctgtgtaagttaatattttcttaaatgaaatataaattacttagatgtctacctatataccttagatattacaacttataatcaccatattttagtggattatatgcataataaatcttgataaataaaacagaggaaattatgtgttttaatccatacaaaaatgccatttgcaaccaaagaccacataccagaggtgttaaagaaatcactgtgctttctaaattactcactatgagcatgcagtgctgagaataagatataaatgaacatggcatagtttcagcttcccttattgttcttcctttaatacaggtgcatgtgcacacaaacacacttacatatacactcaaactgcagaggttgggctttagaagatgtcatttgcaaaacttctataagcctagaagatagacaggttatgattaaaaaatatttgatcagttacagtagtctcgttaccagaaacgataatcttatatccatgtgttattcactttccatttctgtagatctggtgtctaggaaatgaaacgcgattccatatcaacaaaactgtggatgcagccattcggtccgtaataattggtggattattcccaggtattcaataccgggtagaggttgcagctagtaccagtgcaggggttggagtaaagagtgagccacagccaataataatcggtgagtatcaaactatgtggtctgtgctttagaatcagtcagctgacaaggtggatgatgattttgcatcaacctactaatagtgaatatacacttatgaatgatagggtacacatatcatattgacaaatgggttaactgactagagttttttacaaaaatacttggtgcaattgatcatgctcttaaaagtcccagagccttattaaaattgcaatatttaagagtttaaatgctgaaaggtagtttaaaattacttttaatcaattgcctcattagcaattttggtgccattgaaatataataaaaatgagatagttactgaagagagaccatcatgtttcaaatctgtatgcttcctcttagtcagagaaatgtcaaaaattaacaagaaacaggtcagaataagctttgtaatctaaatataccatcccaaagaagaaatcatattaaatctaatatcatcattgcataaaattgttccctcttatcatagattatgtttgtctgttcttgagatgtatataaatggaatcatacagaatgtgattttttaaatctggtttctttcactaaggataatgtttttgaaattcatccatgtatgtattattcagtttatatgttttactgctgagcagtattcaattgtatgaatatgccatattttgtttatctgcttttcacctgacagaatgaatattactgtgtaaatgtttgtgtccttttggagaaatacctagggtctaatgtctgggtaaaagagttgtatagtttgagtttatgagaaactgctaaacaatattcaaattgttatataatttcgtactcccaccagcaagaaaaatgacttctagttgccctacattgtcaccaacatttgatgtttccagtttttgtgattttagccattctaattgggataacctgtgattttaacttaaattttcttttatgactaataatgtcaagcaactttacatgtgcttattggccattcacataatttcttttgtgaattgaccacatgtttgccttttaaaaattgggttgtctcttgttactgattagtaggagttatttgtacattctggatacaaattcttttccatgtatatgtgttacaaatattttctcccagtccatgacttccctattcattttcttaatagtgtcatttgatgaacaaaagtattacattttaatgaagtacaatttatcatttttctttgatatttagtgcttcctaagaaattgtggcttacctctagatactgaggatattttcttctagaagctttataattttagcttttatgcggaggtctataattcatctgatggtaactgcaatgtggttaaaggaatgaggcttatttatttccatatgtttttctttcatagaggttatttataagtgtattatttaatttccaaatgtttagggacttttccagatatctttttgtttctgatttctactttaattcccctgaggccagagcctcagaataatttttctttgtgtaaatttactctattaaatatggagacttattttttgacacaggatttgatctcattgaatgtttcttgtacacttgaaaagtatttgcatttctctgttttttcagtggaaggttttatctcaggtcaaattatttgttagtattatcaggtctttattgatttctatttgcgctcttaattactaaaaacagtctggaaatctattgtaattatggatttatgtatttccccctttcatctataagtttgtgtttcatgttttggctactttgttttacatgagtatgttttaagattattatatcttctttttaaatttaccctttattattattaaatggctacgtttattttctggtgagattccctatcctaaaatttactttgtctgatattagcatagctacatcatcttttgtaagtaactgcatggattgtcattttttcattctttcattttaacccatgtttctctgtatttaatgtgcagttctattaaattgcatattgttaggtgatctctgctcactgcaaactctgtctccaaggttcaagagattctcctgcctcagcctcctgagtagctggaactacaggcacatgccaccacacccggctaacttttgtatctttgtagagacagggtttcaccatgttggccaggctgctctcgaattcctggcctcatgtgatcctcacaccttggcctcccaggcatgagccacctctcctagccagtcttgtttttttttaatccaatctagcaatctttgcctttttaattgcatactcagaatgttattattaatgtaatcattggtgtgtttgtttagaattactatcttgctatttgtttgctaactttgttactatcttccaaatttcctgctttcttttgataaaatgagaaagggttagtattttttggctgctcttggattattaggtacacctcatttctttgctgacagttgctctaggatttgactataagtatcctagagcagtatagtgtcactccttttcctctcatcttttttttgttgttgttattattataccttttacttctatgtaataaacagcaatatacaaattatagctctagtgttgtttttgccttaaacatcagttatcttgcaaataaattcaaaataaaaagtgcagttctcatatttatctgatattctgctccataaattcagtccctggtcaggcgcagtggctcacgtctgtaatcctagcactttgaggggctgaggctggctgattacctgagctcaggagttcgagaccagctgggcaacatggtgaaaccccatctctagtaaaatacaaaagaaattagccgggcgtggtggcgtgcacctgtagtcccagctactcgggaggctgaggcagtaaaattgcttgaacttgggaggcggaggttgcagtgagctgagatcgtgccaccacactccagcactccagtctgggtcactgagcgagactctgtctctccaaaaaaaaaaaaaaaaaaaaaaggaaaaaacattttcagtcccctcagcttccatgagtgcttcagtcttttcaactcagggatgctgttcagcaatgtttgggttagtcttggctgcatcatattttaaagttatctgtaggtacaaagctgtgaaaatattaaagttgtccctgtttctttcccttctgtctgagatcacagccctactcttttctttcacatattttgcctagtcttctacttgtttgcaatgggagtgcatatcccaatacctgttatttcttcatgggcagaagtggaagtgtccagggaactggtcatttcatatattacactttcctgttctataacttccatttgctttcttttacacttttcatttccctctgatgttttccatgtaatcatttattatgaccatattaagtccatacacctattgtaatagctgcttcaagttcttttctccttatttcaacatccatcttgtctcatagtctacttctattgattatcttttctgctgaccttgggttatatttttctggtttgttgcttatttattttcacatgcctagtaattttttactatactgaacattgcagatgaaataaaattttgtgatcttttgaagcatgtttgtgtcctagcaggcacatacattactgtctggtcacctttaaccagtgatgtcttagtttttacattggttagtatgggacttcttatgtttgcccttattctcaagacaaaacctcagtaaaatactttcaaggcatgatcctctcctgggcttccggtgagaagcctcatatgtttatctggtcttcctaacatggtttggaagttttgcggtgaacatgagcttaaacctgtgctttcaccagatcctacaatcttctctttgcatgcacagttcagggttcacctttggatgtaaggggagagtatacacaaatttgagagcatcactctccaccatctccctctttcatatggttctcctctctattttaagtcactctggcctccctgaactccaccctgagacacctcatatcaataagattgagttttttcagctgaggtcctaactgcctcacactgtatggattgcggtgctccctaagggaaagaaagcctcacccctgcagatttcctctggtaaagcgccgttcattcaatacatgcatccccttcagttttccctgcttttatttgcttgccagtgcctttaaagaaaaataaacaaataagaaatcttcttcctagagtttacatgtttttaaagtgtttgatataagccgttctcatttttttctatttatttgctaaaatgatgcatataaagctgactgccagcttctagagaattctttctattacaaataagtattgtatatggacagatttaacattcagtcatagcgttaaaattttttagattctctaggttttctttcttttatatattaaaagcattgtagagaaaaagttacagtattaacttttctttaaattgtcttctctttcttaattagtcattcagactgaattaattccttaacctgagggaaacctacaatcttgtccttctgagattttctaaaataaattggaataagaaagaaatacaggtataccaaaaaggatttaacttacatgtgtgtgtattcatttatagtatttagaaataagcccttattttttcacttaagaagttatatatatatgtatgtgtgtgtgtgtgtgtgtatacacacatacatatatatacatatatatatatacacacacacatatatatacacacatatatatatatatactatatactggcatatatatgccagaaagacagtacaaaatatctatatctgtatatctttatgaaatggattggctgaatataattgttctaagtgaaggataactaagattgtcaagtaactgtcaaataacgtattttcctttcatagttttttttggttatctttagtaataaatactaaattcttaagtagagctttctgtttctttttcttcctagtgactatctgtttgccagatattttatctgtttgccagatatttgggggatttatttccttatagggaagtaaaaaattacaagcatacgatataaccaagctcatgtcatgacaatcacagttatgcactgaacaattgaactgtaacttaaaataataaagttaatgattattttaaaccaaatagaaaatttcacttaatttccctatcatttataaaagtctgagtcttcagatgggtaatgagtaccttttaatttactatttagcatttcatacaagtgttttcacatttttctatgagataaaagtaacctagaaaataatatatctatcttttgttcaaatagttggaatatgctgtactcaaaatgtaattataaaaatagaattacagaaattctattttttgtgtacacacacacacacaaatcacaattcaacctagaaaaggctatttgttcttcagagatttatttctttttaatatctactcttgtactgagaagccttctaattgtttctttaattactccttcgtatctaccttaacatcttgtctgatgcccttatctacacaactgttattccttagttgagaagtgatttagtgatggctaatcttcttttctgtttcaatttacactttcccattgtctattcagaactggaaacggcacttgaagtgactcaaactgtatcacatttcccctttgttttaattaaatcatgtattggcatttgatgtaatttatggttgagaattttagatttgtactatgccagaccatgtattgtttcatctattccttctcagtttagccttccttccagaaagttccattaaggaaccattaattaaaacattgtaaaaatgtaacacgctgccttacactggcgtaacattggtgttgttcttttctgtgcagtttcctatggtaagatgacttttacatcatagtgtccataattctgcatcattgcatttacagacacaaaaatgcaatcaaatacattcagatatatatccattaagcagcgtgtcatataaccaatttacattgacttaagagttttagttatcttgcttaatagtatagttattgcttctctaatcatttggcttttcacgcttacattacatagttggttataatatgtggaacagctgcaaactttcacggtaataggtacaatcgaatctgatgtgtctaattaatttttagtccaacaaattagttttgttcttcattactctccaatgggatgaagacattatatttcattatatttttttgtctgcaagaacaatggagcattacaggtcacacacatcccttgtctatgctctaattagtccaactgacaacattgtttcaaaaataccagcagcataaaaaatagcaatacaccttgagtaacataaatattgcaccttaataaaaatgaaatattatggatcctttacaaaaatgaaggccaaattttcttttctctttgttcaagaagttatttgttttctttctgataattcctaatagttaaggaaatcaccagataggtgtatgtctcatattgaaaatatgagctcattttaaatacagctttgactatgtttaataattatatgtataataatatataatattaaacatataataaatatatgtataataattaaaggcagacatagtgggaaaatgagccagatttactacataaatgacgctggtttttaaatctgaaatttaatacaaaagacctttcaggaatggattataagtatgtataaggaaatgctagcagctataataaaaaagcctgaattttgaaaagattaacaaaataaaattttatttctaattcacagctcagaccaatatgggtcagcagaatgggaaatggagtttctactccataccgttattcaggggttttggatctttcaaatcatagctctgccatttcttggaagcttaacatcctccaacagatcccctgtttctgtccaacagtgaggaaagagagtttcaagtcaaggcagtgttacggatcaggcctggagggtcgtgtgcactttttgttcctagttaccactggctaatgctcagttacttttttgaactctgctgcaaaagatgctaggaagtgtaggctaattttctgccttggaagaaaggagaagcagtgaggtaaacaagtgaattgagatttgcaggattctcaaatctagataatttatcactcatgacactgaggttgactgagaagcccttaaagcagcccttaaacttacatgggtcataattttgagtcaaaaactacatattagcctccacttcaaccctcccaaaatatatgaagtagacaatactggtgccaactaattgacaggggctctagaagatttagtgccctatataagcttactgcttacttagctagtaagtggcagagtggtttcatcaaaatcatgacttcaaagatcatgatctttttaacatattacagtgctatagctaaaacaaggaaaatcccacacattcctttgatgtgatatgctgaaatgtgccatttatattttgcttaccatttaccttttaaaagtctttcattaatcactaattaggcatgatattaacattagaaatcacttaattcccagcatctacatttcttaatctgctaaataagccaataaatcttatgattccacaagtttaagacctatttaaaatgtagattgagattttcttaattatctgagaggcctaaattttccaaacatgactagttctagaataatcttagttcagatttaaatgcatttctcagtaatggagacctcaaagttaatttttaagttgttctttaaatttagctttcaaatggattttcaaattagtttcagatactttaagggaatatatgagtttcatctttttcatattttaattatacacgctgatctctgtgaaggctgtttacataattgtcattgttttgtatagtagttttaatacttcccagaaaattaaaggatattggctcaaaataagttctttggtagaatattaaggtcaacattaagttacatgttcttgtgaattatgaacatttggaatatggaccgtgccttagcagaaaagcaatttgcaaataccccatgttaaaagttgtaattgctttcttaaaaatgagaactgtatttaaaaacacttgatgtaattcaagataagttattaattcaactcctagtacttatttttataatttataaggtgataaatcaactacgttgtgaatccatccatagcaaaccacaacacaagaggtcagtgttcttaatcacatttgcaaactcacgatttgattattcttttgaaaattatgggctatgcttatcaatacttgtgataggctcaaaactaaacaagcatttcctgccttcaaataatttttcttcatttttgatgcaccatgtttatattcctgtgcttattttcgttttaatatatactaatactatggttttttccatagggagacgcaatgaagttgtcattactgaaaacaataacagcataactgagcaaatcactgatgtggtgaagcaaccagcctttatagctggtattggtggtgcctgctgggtaattctgatgggttttagcatatggttgtattggcgaagaaagaagaggaagggactcagtaattatgctggtaagtgactatttccagctaagaaaatctcttgtctgtaggaatgtaatgaaatgaatggaaggaacagaaaggaataacaaatgagtgatttgggcttattttagaaacctgcactgtaaaatgcaattacactcaacatgctttaatgcattgctcttgacctatcgctttataaccataaggcagtctgtttgcttgtagctccagtgaagcataacaagagcacagactgataaaaatgcttaactgtttttctcaactagttctttgaaatcataaactcaaacacacacacacacacacatgcacacgcagactatgtgttacatgctatgaagccatgtttgagaagtggatttatgcatgagcattacttcaatgttcaggaaagaagaaaagtttgaaatatagcttttagtgtgtcaggatgcagattacaataggaaatgtccctcgtgaaaaatactgacaagcaaaaatctcaccagaattgataagactgatgaggcatgaattaagtgatttactgttcacttaaatagactcttattacaatgcaaatgaacagtattttaaaagaaaaggaaaacgaagaaaaagagaaagaagccgaagcagaacaataaaaagaagaccctagatggtctacatcttcacaacaatgttttcttcttagactccaagacagagtttcaagggtgtcctataatgtggccttcaaaatatctccatggtagagagagaagagagagaggacacacaaaattgtaaagtcagtgattgagagaatgaactcaatactgaagcaatgttcaattacaattttaagtgcactttattttaaatattttctccaacaacaatgataagaaatatctcacaacatttcacactttctagaattaataagggagcagttttaatttgacattattttacaaatatgtaagaagtttttgagacattatattcaatcttgtattcctaatattaaatttggtaggaagcataaatgtcttagtaactgattttgacagaggcgtcattgattattaagcttttacgatgctgtggcttgtaggctcctaaactgctgagaatgtggaaatagtgcaaaatgctaagtatagcactgacttggttgccttgtttgttatttgatgcatttatatgtttatgatcatttgattatagcattgtagcttgtgtctatatcttatgaagttaaaatttattagttacttgttagaagacatttccaggactagagaaagtactacagcatatccattgacaagaggcttccatgtttggtgacatgccatcattttgccattctcatttctcattggttgctgcctctctgcttcctcataatttgtcacccaagtgctatatcacttcaacagtgaaggattctttgcagaaaggggtgctaggcagtaactgagtgtcagagtctggaaaattaatgatactttaatgtaccttcttgttatgcagtccggttctctgccttcatcgctgaaggtattgcccatcaacctttctgtttaatcagccaccatgtcatattacatctctgtgatacactcgtataaatcatatgaaatataaggaagaactgatttaattcatggactattttgtgtttatccctttgcttgatgttagcaatgataataaaaaattgactgtgctggtcagttcggtgcaaagttctaatatattcacatttggagtgttgcatttttatcttccatacttcttcattcactcactccttataaataaaatatctctcatagttggtaagtttatactgttagtaaaattacaccagagagacttttcttcttttttttaacagcaattctttgcacaacctatgcacttaaattgaaaatatatgttgatcattgagcttgacaagaatagtgcatttcctgttacaattttttattgttattgctactcatctgcttgtagacgaactgctaactcagaaggtgctatgcccttcaggtgttttggagtaaggccaagccagagagaagcctttcagaagttttttacttaactgatagatggctcactatgaagataacagattttatgaagctcagtaaatataaacaatttaatatgagtgagcaaattatgtgaaatgctaaacacttcacacataggtcttaaaatcatcagtgaaatatacattattagacaaaaccatccaaggcacttaaaagatttgatggattttttatactctgattatctgggctgagttagtgcttattaaaaaaggattaatctgcattcatatttgagaaacagcttatcgggaaagggaatgaggcttgcctgcaacagtaaagtttctatttggagtaggaaaatgtgacctactaaagataggcactctgaaagcttcctcactcaaaatgtcaatttgccacagttatgttttctcctcctctaccccagttgtagcaggcatgagattaggattcatcctgtgaggtaatattagagttactttttgtatgttataatcttgcgaaatctctttaccttatatttgtgtaaaaattgcaagaaattcaaaatatttcatgcaattcaaaaacattttaaattgtggtgtctgcagaactttttggaaaccttagccctattcagttagtgtaagctaaaatattctgtatgtaactccttgaaagttcttaattttagatgctaacagagacttttgattgagagtcacagttattccatatgtatctctaataagcacaaagttactactctgtgattatcaaaattgtgacaagagcaagattgtctgaccaccccaacccttcttacagcttcaaggcaaacacttatttgaaatgagaactacctcaaaatagctttcaatttgctctggaatttgatttgtatgttcatctctctgcacacagacacacaaaatgctgatcaaaacaccagatatgatttccattttaggagttctaattgttcatagttatttgtagtctgccctaaatctcatgatctaatagaagttagttacttttgatctacttttcaaaatagaacaaatctaaaagttttgaagcataaagtaaaaaatgaaacttgaaaaagtgttccctgtttttcccttgctttaaaaacacaactaaataacccattaagataagggtttttaaaaaaattctgacagaaacaatacaaaatggaaatttagattgtgtactaaattgtatgtgaacctttttaaggtcatcaaatatttacataatgtgtgaagttttgcctttgtatacttaatatgcagagatacagagataagtgtctttatagaatattttgacaccctattagcagtctagaatcatttgaaaaacatattttaatgatgacgggaacagaaacagaaaatagattgtcccaaatgcttaataagaaatatttttaaatttaaattattttgctcacagcatttaattttcaattgccagatatgggccatacatactatagtgttcatactctaacaagtttgcaaattaactttaatgcattatgtgtgtatatatatataaatatataattttttcttttgagagagagtctcactctgtagcccagactggagtgcagtggcacgatcttggctcactgcaacctccaccctccaagttcaagcaattctcctacctcagcctcccgaatagctgggattacaggcacttgccactgcgcccggctaatttttgtatttttagtagagacggggtttcaccgtcttggccaggctggtcttgaactcctgacctcgtgatccaccccctccttggcctcccaaagtgctgggattacaggcgtgagccaccatgcccggcctcatgatatattttttatagggttttcagtgttctattataatactttaaactttacatgtcatgaagaatttgccactggttcatgtattaaagttaagggccactcaatgtttgtacctctgtgtctgttgtcctccttttctctaatattatttattgctctggcagtaacagaaagtttgaatgggacaaaagagcatctaaattagggaaaactacttagcttctcacatatctcttgaacagcacattttgaggtgtaacccatgagcatctgcttatttgcatattcacaatgatattcacaccattatcttaactctcttttaacagactaaaacaatcacttgatagtccattaaaaaaaaaaaaaacacaaactagaaagtcacatcagatggaaagctaattagctatactgttttcacattgcatgtgtactaatcaggcatttatttaatatctccagtgctcaattttttgcattaattatttcagattaattcttttttgttaaaagcagttattaaacgggcacaatgtgggacagatgcactgctgattcctgatttcccgcatttcagtgagccttttcatcttctctgagcatgtgcctatagccagtgttgagcagatgcaaaggttatgtcaggattgttttgcaatgcatttgagatattacacataaaattgataaggcagtatatttcaggtaccaataagaagttcctaaaagccctgatatgctttactgtctcatgaagacccttggagtttagagtcatattacctgattatgatagcatgagagataatattagtagataaccttaaaggagggacttcatttggaaatgtgtaaaatttaaagagcgatcatcatatttgatagcccaaacttgagaacagaggagttatggagagttattcaaagtaagaagtattcactatgtgtatatatattaagtggcaatatatcctctatttacttacagtatgaatcaactaattaaatttcatttattttcacctgtactcaccacaggaaaaaaaatcatagtaaatataatcaaccccttccaaagatagggtttattgggttcacagctgtgaaaatagtattttttttccttcatcccggtgattggtttagccaatccacattaattgtggtcagaattgcaggtttattgcacttttgcaagctgtacacttctaaacaccatgtttctttttaaaaataattttctagttaactaatttaatggcaaaatttgatccaaactaatgtgaagctacttgtagactttatcctactaatcatggatattcacattccactgcagaaaaactaaataactttgaatacagtttactgtctcagaacctctttgtaatatgcaaagtatattacttttctcaattctgaatcattctggagtccagatccatttggctgcaaaggtttgggtaatggatgatggacctgaactgataataacattctttggccagtccttaaaatccactttcatgttgttaggtttgtaggcttgaaactatcggctggagagagtggcttcactggctgtggctctggtggatgcttattggtgttgctaataagttccatagttacatggaggattcaacttttctgatcactacatacaattaggaatatattcagtatcaattatttgaaaatttcattttcatgagcatgttattctctattaattatagttcacacctgttgtaattatcactgtttatgagggtcataaaaggatttgtgatggtgaaaaatctgtagtcaataagtatttgtttttcttgtttcattagaacgacgtaacatgttggaactttcctgtttcaatttatattatgagtgttttgtcttatgccttctaattaggacacctttgttttaaaattaaaaatcttgatttgataaattcacaataatgctacgttgatcttgcaataccactatatatactaattgtaacaggtttgacatttaaatacaaattagttctttaacttaaccatggatttggcttaaagaatttgaaaatgtcctattaaaattggagcaaatgatggctttgccttgggccaaaccactgcttgttactctctgtacaatgatgttaattatattttgttaaaattcccagaggcctcagctctaaactaagggccaatatgtagttgttattaattgtaattaatattgactacttgtgtgtgcatgtcttcctttttttcttttttcatagttacgtttcaaagaggagatggaggactaatgagcaatggaaggtatgctacggagattgtttcattattatttttatttttaatcaggactggggaaactctatagtaagagcctattattgtaataaatgatcacttaaaagtctgagaattctaggaggaattaaatggcttaccacaaagtttaatgatctatctgttgtgcactttagaggaatcaagtccagatgtttcataactcccagatgcccctgaagaaattagtagtaaatatcacatggaatgtgttcatttgttagcaggatgtttattgcattaattagacattagcaaatgaagttgctgttgtttaagactccttataggctctcactaaattgctgtgagtgaacaattacacataatcgatcacaaagtaaatgattcatggatgatgaataggctatagattgataggactggattccacaactttggatattcaattgaaattgataaaagctgataacaaactcatatatcctcatctattttccctttgccaatatggagattgtaattaggctctggtaataacttccaatctcccatttaatcaatattttagcaaaaagagattaagtctaatgagagtttgtggatgtagcaagaaagcggttgggtcttcttattgcagtttccatagaaacacatgtttctcttagggattgtaccagaaggggtctatcaaaagaaaagtgcaatgattatagatgttctatttctgtgtaaatatgctagtaatctggaaaggaatcagaatctcatcttttatattaaagaaggaagttctttactaaatatgacgtgaaggaaattttacttatagactatactcacatgctggatcagatcacagtgtatcttttattacctttaaaaaaaacccttaatatacccctgatattttgcaatttagaacttggaaatgtgctatttatggagcagtataaatactgttcattaatttcacttcagttccttgcctccaaatcaagcatgagggctcataacaagggttacagcctagagggaacagatacgtaaggtagctgcaggaattgaggaaggaatagcccaaagtcttagaaatggctgacatagagcagtcactttgagcagttgttcccttgtggtgccaatgtatcatcaaaccttgttttgggatcctagtatgttactgatttctaccagtttcagggcagacacctgaattcatctggacattgacaaaatcccgggcaaggactccctgcgtccactgttaatgtatgtatagccttaatgaattgctggagttctttaattccagggagtctacttatattaatttgaagtcaatgaaaatcttccatttcttaacgctttatattgcatgagacgagtgtcaaaatcttgcattgagctccatgtgttgatttccttgtaatttctgttttagccgtccaggtcttctcaatgctggtgatcccagctatccatggcttgctgattcttggccagccacgagcttgccagtaaataatagcaacagtggcccaaatgagattggaaattttggccgtggaggtaagttgtgttttttaaaatagtgttatttgagttctctctctctttttttttttttgaccttcctggatttttttaaagaaacatatcagagagtatttactcccataattaaaatcaatgaaacatatgcactaacagtgttgtacatttgctaaatattttaatataaaacgattgtatcttcattaccttgagtaaaaccaaacttttaaggaagctattactaaccaagatgataaatatttataatatatatgctttcaggattactagtacaagattactgaactcagagactattttgttaactagggcttatggttttggactagaggtttcccttctccatctcatttaacatgtatttattgagcatctcctgtgtacttggcactatggaagaccataagaatataataatgatataaaaaagatggttcttgccctcatataatatgtcatgtaagaaatagacaattaagtcaatataacatgttgagagagaacttttctgtagttccacaactagtaactgttatccaaaaataaataaataaataaataaataaataaaaaagacaaaaaagtgctaagtagccacatgcaagccttcaaaatttggtgccagagtcctctccctgtgggtttgtaaggagacacaagtaacctactgtaaataactaccacctcccctgacttcaccttttcatccagtcaataggagagagctgggtttagagaatgatgagaggagtagggaactctctgatctcagtgtggcttggcaggttcatgtgagttttccgttggtggaagattgtacagacattaaatgtgcttaaactgccttgccagaaccccatgtggcatgtctaccaattgggagtaagaaagctctatgaacagaatattatttaagttgatacctgaagcaaatttaaaaatgagtcaaaagtatggaaaaaaaaaagtgtttagaaaagaagttgctgtattttaagttccacaaataaaagagacattgacctacttgagaaatggaggaatttcctaatgacttgagtataaaatacgaggaagcagaaatggtaagaaatatagaaggatagataacaaaggaccttttaagccacatagagaatttagacttcgttcagagggtaatcagaagctgttgatggatttttaagaggagaatgctgggatccaagtactccaagtactgttttaagtcatccagcctgctgctggatgaagaatggagtaacggtagaaaattggagtgattaattagaatagtgctgtaatccaagcaaagctgtatgaattctctgtaagatttctgcacttttagaattaatgaaggaggcccagggctctgttaaatttttctgagtccactataagccttgatgggttaatttcatatgtatgagtatataaccagattgactgagaactgagaaggatattcatagcatgttctctttaagaatggattaccactatgtttgactatatttgaagttgtatttcaaataatgaagctactgattattgcataagtctgcattctgtcagtaccaactatgagaaggggaactcccttcccttctgcaaataaaatacagaaaataaccattcctacttcataggtgtgtaatgaggattaaatagatgaatatatatatatatttatttatatagaatatatatatttatttatatagtgtgtatatatatatatatacgcacacacatatatatatatgtgtatatatatatatatcccaaagcttggcataccatcaatcatcaggcatcagtgcagtgagtgagagaatggaaagtaagttatatgactcctcagcttcctcttccgcttctgcaagccaacacaccccacttaggactctcacttgcccagatactctggtagtggcttcctcccctaagtgacccgactgtgagcaactgtcagctatcactttgccatgggtagtttctgtgcctgagcacctgctcatcaggaaacaagaatgtccctccccctgctatgtcgactgattttgtcaaaaggaattctgttcccacagcttttgtcaatgaaggaatagctgactcttttacctcttgtatttttattgaaataatatgacatgctattgttacatgaaaaagtgaatgcttacagatggagaaaatgaatattcagtttccacaggctaccttaacgtctaaaatatctcagtcaaatttaacaaaagggtacacctggagatttgcaaggtttttcttccattttcccttaattttcatgatgtgaaatatctcatagatgaacagcaaggccaagacaacgtttttgtagagttgactgtatcccttatccatgtgatagtcattttaagcatttactatgtgccagaaatactgttaaaattttttgtatattttaattcattttgcttgcatagtaatatatgaaatagtcatatttccattttaaggatcaagaaactaagttttctcaagataaataatttgagatctggttgtagaaaactctgctttgtattgtaaaggcagattcacatgtatgactatataaccatattcacttggaagaataagaatggatactgacattttcccacaccacatgttctcactcataggtgggaattgaacaatgagaacacatggacacaggaaggggaacatcacacaccggggcctgttgtggggtggggggaggggggagggatagcattaggagatatacctaatgttaaatgacgagttaatgggtgcagcacaccaacatggcacatgtatacatatgtaactaacctgcacgttgtgcccatgtaccctaaaacttagagtataataaaaaaataaataaaaaataaataaaatttggcaaaaaaaagaatgaaatgacaatacgtttgaatgtaataaaaatagtacttagaataataaagttactaattatagcataaatccatattttatcaaaggaaaccataaaaaaaattatttaaccattcaagtcagcaagtgcttactctcttcaaaacactgggtgagcaactatgaaaatgcagacataaatcccatatgctcctgtcttcaaatgacttcgtgatacagtgaaggagacagtcatttgtacagataattatataaaacaaaaggaaataaatgtgagtacaagtataaccaaggtgctgaaaaactacagaatgaattaccaattccaagtagaggaagcatttccataactcataggtttcaaacataagtgttaacaagcaccagtcagacagcctaaaacattaaggactggtaggtggggactgctataaatggaaatggaaaaaagacctgctaaatatgacatcacctatttaggtctagcctgttgggaggaaggctagcccagagttccaaatcatctggtattataggactctccttaacatccaaatattcatgtgcaatattccaatatttcgatgctagaatacaattcagtttattttttgaaaatgtagggatgatcaaatcatatttgaagacaatatgcagcctaaaaatcaatacagaagcacttagacttaaaggctgactataattttatctagcagggagaggagagattcaatttccagagccatagcattagttgtatagcaatattatgtaggattagattcttggaccacttttcttcattgtttaacatttgagcacacagccatttgaaaagcttgccatcgaagtggcttgcaatccacatctaaagctttggagaactttaaattcaaggtgtgtgaaattggagctcaagttggggaatcaagtatattcacttaatattcatcagtgaaggacatggtagaagcggcagaaacaaaagtctgaaaaatcacccagaatgaaggatctattgtgaccaatttggatatactacatattaaaagtttttgagaaataaaaataatactaacacttgagaatgcagtatgcttaacatcaaattttgtaattaggacatagctcaaagaaagaagggcaagaaagtagttgtgaagttctgaaatttaaaaataatgttatttgcttatacaacctggtgaaatatgataagttaaaatatgtttaacaacttcactgatacacatttaagatatttacttcaatatcttaagtacatatccgctcagctgtaaaacaagctccaaacttcaaaaccttcataaagacttaagttatgcagtgtacaaaatatagtatacatttctttctacacttgctaaagaagacaatttttagcttatgtaaaattcaaaagcaaaagtaatatttctataagaatttttatttcaggtactattgagtatcagctaatctaaaagttttaagatagttgaaaatgtcctataatgaaagaatgcagtgatttgatggcctcaagtcccatgaaatgaagctttcagaagatagcttattttaaaatgtactatataataattagattcattttaacgctacaggattaaaaacagtgttatttagtgatttctattttagattcacttagtatctttcttccaaaaagggaaaataagagctcaggagagaggcagcagttctgaattataaagcatcatgtaaaaataattcagcataccaaaatgaaaaatggactgattgatattcagtgttgctcctggagtttaattttactctagctgtattacaacatgaaactgtaattctctagttcggagttgatagcataaattaaactcaccgatcactgagattgctttttctatagttaaattctgctatattgtgaaaatggcttacacctgaaaattttcctttgttatacaagaaaaaaaatgcactctccttttctggagcaattaaatcacacaataagtggcaagttatagcttcaaaaaatatacttcatagtcggtatagtataatttttgaaatgttagcatgtatttagcagttgtagtccatgtctcttgggataaagtggaaagagatgtttttcatctgtgagttgtggattcagtatcattgcaactgtaaagtgctaacactttcattggctctaaaacagagtgaacaactgaaagcatttttctgtagtgaagtatgccaaccgtctcattcatggttaaagaaaatagggggaagggtgttttaagcagtgagacgtgaagggcgagcagtaggcctgcctgtcactgaggctgatagcttggcgatggttgtatatcatctacccttcagtggctcatgaagcccatctcagctgaaatgcaaacgtgcagtgtgacacacttatttttcatcttcagtcctgatagttttgggcttccggtgcctcattaaattgtttcatttccctatgttcaccacagatgtgctgccaccagttccaggccaaggggataaaacagcaacgatgctctcagatggagccatttatagtagcattgacttcactaccaaaaccagttacaacagttccagccaaataacacaggctaccccatatgccacgacacagatcttgcattccaacagcatacatgaattggctgtcgatctgcctgatccacaatggaaaagctcaattcagcaaaaaacagatctgatgggatttggttattctctacctgatcagaacaaaggtaacaatggtgagtcaggttcttgtgtcctgaggaggtattttcatatcatttgtgcatgagatagaaattagtatttgttgtttgacttagtgattcattaccaggtttactacctaaactaaaaaaagataccagcatgtttccagtaacttgagtaattcctaccaccaccaccgccaccaccaccaccaccaccaccaccaccgccgccgccaccaccacctcctccaccaccaccacacaccagtgccaatcggtttcatcttttagctctttttcaacctaatgatcaacaatccatctctacttccattagggcagggtagacaaaacattcctccactctcccacaacatctgcttctgagttgctaactgcatgttctgcatgggcttgtgctgtgaactaatcacatgatgccactatgacctctgccctttaacccttagccttactttacattcctgactaccgattggctgagggattgtctaatagaatgccacacaaccagtctcaggatttcagcaccaccagctctcacaacagctcagaaaggagtggcagtctctcaggttggtctcatcacagtaaggagaaatatttgtttgtcaccagcgtatgacctgtgttcctaacaaccatgaagatatactgaatcacagctcactgtcaggcatttatctgtcaaatgacaacagtttatgctaatgaaatcatgccttggtgggataaaagggaagagaaaaatcactgtccccttttatatactaactctatgaggaaatatttaaagaaaaattatgccattctactaaatactattcattaaagaacgagtaaagagaattttataataaaaagatcatacatgaaagtcaattccatgttatagataccaaaagatgaattcaactaaaatgaaaatgattttggagtagttcataatattagtatatcattgatgtgacctcctatttttggacaagatttcgaaataccatataataggattttttatctattgaatgatattctactgcactatacaagaaagttaatatgggaaattaatatttaatttccaaaaaaccatataatctttgatattgctaattcttttatggtataaattttaatatgtatttgagatatatcagctaaactgacaatctataatgtcagtatcatatagcacaaatggaaagaaacaccctttactggacaaaaatatatacctattgtaatgacttatgaatgaaattttcctggcccaaagatccttacctgtaaaatgaggaggttgtagtagacacactctaactttcaaccatgacatatacattgtatggctgatgactttgtgcatttctaatttattccatgaccccacttgtttaatttgtttggattaactatatgctatttgtttgtactgagattttgttttatttttttaattacaggttatttgtaaaagactatagtgtattatggcatgtcacaggctaccaagcatcaaagccataaagagttaaactttttacatcattagggtaacattttctaaattacttttcctcaggagatggaaccctttcagtctgaaaatgttaatgctccctcttcccttcaaaatgggtcatttgctcttcttgcctattggtagaattagctatattatagaatccagaaaattttaaacatctgttatgaatttaaacaggtttaataatataggagaactttttgaataaccttatatgtcatttagactgccatttatttataataagtctcacaattgttctgaataattaaaaagtaatttatcctgggcttcctttttatttcattaaagatatgcaaagtcacatgcagtatgtaaaaataaatctatatactataatccatggattacttaagacttttaaaaatctttctttaagtattctatatgtgttgattgccaccaccaagttttaaaagttgtcttttgagtaactgtaagcagaacacaattcacaatagtacttagtgcttttttgaatccattaatctcctgagtgacatttatatatatctatgaattatattaactacttcatctacatttgaatacaaaattacttaaattgatgatagaaagcattctttagtaggtgagagtgattattctctttttagtttagttcaattgagtttaatattagagttttgtcttatgcttataatcataggtatctttcctaagacttaaatttaagatcaaaccaccttgtggataactaatcatatggtattataagattttcttaatttgtggatagcaatgtaagcaatttaaaataatcacagtgataaaagtggacatttcagaattatttgagtgtattaccctctttgaaacacttaatatttattcaatatataagttctgagcacttccattaaaaatctaaccattaaaaatataaaatcaccagcctgagcaacatggtgaaaccccatctctgaaaaaaatacaaaaattagccaagcatggtggcactcgactgtattcccagctacttgagagtctggggtagaaggatgcttgagcctgagaagttgagcctgcagtggatgtgatcgcaccactgcactccagcctgggtgacagactgagaccctgtctcaaggaaaaaaaaaaagtatatatatagtatatatatacatatatattaatatacacacaaattaaagagtttatatatgtaagtcattaaaatatgctcccttaaaagataatataagaaattctcaccttaaagtgattgaaggttctttgtttgcaagtaacagcaacagactgtggcttacttcactcaaggttcagatctcagagaatgtaagtggctttggttctatgtatgctctccaccatgctatgaacctaccattgctcactgctaaaagaagtcaggtgtgttgatttgtaatcctacacgtactgcccataatgagagagcagaaatttcctcaaaagaagagaaagtgattgttggatagaaagccctcacatatttcttctatgaatcacccgtttcccaaatagatttttaaatctgtttggaagagtaggtaatgaatggctttcttgaactttggacaatgacttcaacagaattcagggctctggaagtagtaatttccagtaaagaaagctgctacattctgaattctgatttttctcttactgggtgaatgtggaccacgtaacactcagaatgaacctcagttgcttcatctataaaatggagatgcaagaacttgtctatttctgttactcagttctggtggtgaccacctaacatttctaaaagtaccatggaaaacgaaaagcactctctctatatataaataaataaggaataaaggaggtgaaactagagagaaagctatggaagacaagtagctcagtctgttccccttttaatcattgaaaccgagttctgatactacaacagaagaaatggttcctgtctgataattttgctgactcatcaggaaacaaaggattaaggttcatctaccttaaagacaaacattacagatgtatattcaagcaagtttattgttattctgagtcaggctgtttgtgggatactcatagggcctggagaagttgggagtaaagaaagctttagaaatcaagaggagctgggtttgctctaagatagaggatatgggggaaaaaaaagaacacaaatgagtggcatttattgaatgttctgtccattctgagtagttgatatgcattgtctcttgtaattctcaaaataactgaaaaaagtagtaactttatatctgttttacatgtgcaaaaatgtaggcagtaactattgagtaacttatccagtaagtgggaaactggtctgtaaacccagatacgaaactcttgtcctctaagcaaaagatgtctgctctccttcctcttaaaatcttttattctaccaaacaagtatactacaaggcaagatgaaagcaatttgtgtgcagggatgttctttgaaatatgtgtgaaggtgtgcatgctatgtggaaaacacacactattttataactggcaataaagtatatatccagtttaacagttttatcacttcctggtgctcaaatatgttcctattaaattacataatattcaacgtggctgatgcagatgagtaattggtagaagtaaggggaatagtaggcttctagtgatattataatacattgctaaatagccctgctacaaatagtttttgctcacaacttgcggttccagaaagatgaagtcgaaagaatcagtaagatttttggcagatattgctgtaggctgtggtgggagccacagaagttatatagtgtcccctgaaatgtcctttgttattctgctccaagaagtactcattcctcatttaactgtagtccacttttaaggaagaagctttatctacttaattttggaagagtaaaaaccatggcactgtccaaatgataaattgtattttttatatttcattaagctccatgtaatcctagatatggctcatatgctgctagcttactttcttctcatattttgtgcatgaattcatttgtattagaatgccactgaaactgattactgtattaatttttcctcctttttggaatattatatgatgttatgcttaaaatagctaagaactattcacatatgcaaaaataattgtgccattcattagttaaaaagtctataaaacgtatcttcgcaaaatatttacaggtattttcctgattgtagctgattgatttttatcagttacttttgggataaaaattgttacccttcctggattaattaaattgaataaattctaatggaaaagtttagcctatatccttagaccttgcattttccactgagagagattatgcaaaagagcattataagtgtactaaaatttgacatttaaaagaatttgttatggcccattatttcctctaacaatgaaaacatgaaggcaccagacgggaataaatcaataagcatgcttttgatacagcagccatgtttttggttcattcagctctgctgttaatgcactggggaaaaaaaaacagtatcattttgagtgatttataaaaatgtttttctgattatatcatttcattgtttatagcttttaacaactccaacatactgattctggtgttttgaaacataaatacaccttgccatctgatgtattctctttattctgctatttggcatctctgaataaatacgttattactttcaggtgggaaaggtggaaaaaagaagaaaaataaaaactcttctaaaccacagaaaaacaatggatccacttgggccaatgtccctctacctccccccccagtccagccccttcctggcacggagctggaacactatgcagtggaacaacaagaaaatgggtaaagatattttatatactagcaaaatggccagggctctcctctcctctctgttgttcatttttgccatcatcttatgttctctcactgtttcctttgccccccaccaccatgttcattgcatttccccctctttcattgtttgcactgtctatatatttttagctgataaatacaaaacagcacatattgaggactgagaatccttggccttcaagtgccttagattgtctgcaatcatgataatgcagcctccatttataatattgcttgttagtttgaaagcaagtacccacagctctgtgaactaaagagccactcctgagaagggctgaaaagggaattaaaataaccttcttcatcatcccttgcagttctctaatgacttgatgtctggccatagcagggcgccactgtagagcaccatcacaatgggataattgtagggacctggccagtgggtagaactttaatcatcagctctgatgggaatttaggggccagaacaataatagagccaatgcatactctgtaatgaaacctttttaagatacaaaattttcttcgagggtctttaaatgggaccagtttccttattctttcccaaatgtctcacaagagttagttttcctctgttactttaagctttaattgattttaaatacaaagacactgatattttttatcctctaattccaagaaaaacaaaaattggtcaaaaaatcatactgtttccttttctagtttaataattctgaatgctttgtcttccttataattcccaggtcactatttattttgactgggcctttatgtaagctaaaaatacagaaaaaaagcagtttttcttttcacaggattttttttcacttagaaatagttagatattaaaataaatctatttatttctataatggttgtttatttattatcttggcttaaaaaatcacatatacatgtttataaatttcttcttcatcctcttttctttgtacataactcctgtctttgaagtcttcagattaatttttctaactagaattttctatgtcataacattggcttcctttaatgatatcatttgcctttttttataaaataaaatatatatacatatatgctctatatatgcattatatatgtatacacacatacgcgaatattttttgtctatgtcttcctttccctccaaaagccttcatttgtctctctgagactgtagcacttattatatatgcatatattgttattttacttcttttaagttcacatttgaaatgggaaactaaaagtatatcctgtgtcctccttctctaacataaaaaataaaattctgtatatgatcttaatttatattaatgttataaatgtgtcagtgtcacataaatcatgagcaaagaaaaaccaaagatgtgtattccacaagagattaatacagagcttagaaacctgcattttaaaagctatagtcagagactacagacatggggacttgtaaaacaggaagagaaagtagtgctgttaaagctttatatgcataaagtcttgaactcatatcacatgaaaactgtggataatttggagggttttttttcccattgagtctactaaaatatacatagactatgataattcctgtaaccccctgcaataaaaccaattaaatcaaaatcaatgctaaacttctcactttattttattatcttgcagtagaattgaaaatattcatgaaatagtagatggtgcaaatttttattatttaacacaaattattttcagtataattaagatataaaacacaaaattgtttctacatatttggaaactttatatatacatatatatatatatatatatttatatgtatgtatgtagtttgagttaccttcaagtttttgtttgtcttaaatacctagtatttgctaaaaaaagaagttatcattcttactaaaaatagtggttagatcttagccagtcagtaatattgacaacaaaattcaatttccttatttttttgagctcagtttttaaaaggctaacacttgaaaattattattttaattatttgtaataaaaacatatttaaagttaatataaaaacaaataaaaattaatagattgggcatgattttgtccattttttgatattctttatacttttatattttctaatcggtaaaccatatgatactgaaaaagaaagattattgaacacagtagagtattctactattcataatattaagtaagtcaaaaaagaaatcttcagaattgatcttctagaaaatttttctataatttagaaccttcataattcaggtttaagcttttcttggcatacaaaatataaaaacttcagatacttttttgctctccatacttattagagaccagacactaacattatcctgttcctgacacacacacatgcacacacacaaacacacacaattttgtatgataagccctagctgagcaatgtggaagaactaataatctccccacagaaaggggcaatcatatataccagggaagccaggggaaagcttgtagaagttaagttttgaggtgaatctagaatcatttactcacaaataatagaaaaacatttggtggctgttggatgccaggcactgagccaaaaataaggacaaagatagcaagaaaacgtctctgtccaaaagtggtctagcattagaatagattgttagtcaacaactataacaaaattttactattgttgtgattttctgtgcaaatggagacaaatttccctggccaaagaccaaaaaaaaaaaaaaaaaaaaaaaaaagaaaataaatataatacaatgaaagacgagaaaacaggaaatagcagatagtcccattagtcttcctttggaaaccccaccctcttttctttaaggttatctgccttaactaaactgttgttttggttattcctaaagcttgctcctctattgtagtactcctcatattgcacttaactgcttgtctgtgccctttatcaatttgtacctgatgtatgaggcttgttgagtttgaaaactgcatagggtggctgggcgcggtggctcacacctgtaatctcagcactttgggaggccaaggtgggcggatcacgaggtcaagagatcgagaccatcctggctaacacggtgaaaccccgtctctactaaaaatacaaaaaattagctgggcgaggtggcggccgcctgtagtcccagctacttgggaggctgaggcaggagaatggcgtgaacctgggaggcggaattcgcagtgagccgagattgggccactgcactccagcctgggcgacagagcgagactctgtctcaaaaaaaaaaaaaagaaaactgcatagggtaggagataatctaagaagacgttttgaagccaattgtgaagccttgtatgtcatattggagttctgatgtttgagtacagatgatggattggaggatgtgaggctgaggcaggtagataaagcatggaatattgcagcagaatggctagcagaatggctaatatcatgtaaatgataagggaataaaacaaagcaaggtcaatgggttggaggaaaggtaagtatttaggagatatacccagctaatggtaatcatcaccctgaaaatattgtctctagttttttgttacaatatttagtattatttctaaaagcttagctatcatcagttttcattctaagcctttccccacaatatcaaaataaatatcaaaatcaaataaaaagtatcagaatatcaaaagttatcaaacaattgcccaaagaagaaaagtatttgttaattcaggaatataacaatgatggcaatgttttctcctatcattattcttctctcagcttgacaaaaatatgtcaaaatgtattaatccctagctataaatacagtgcattttattatactcatatgattccaggaagaattctatggtaattaaattgaaaagtggggcttttctttgctactgcagttagagattggcaagcttctgccagtgttgaactttattgtatttttattagtaatttggtatttgtatctggcctttacaagttaattcacatgaaacattgatttgttgtcatctttatcattagttgccaggcaagacagataatatgatgcctcatagttcactgacaataagtcaaagaacaaaaccttctccaggaaaggttgaccaaaagatctttggtttggcattagcagcattttcacagtctttttcaatgttactacaagaaaaagttgaaattctgtcactcaaataagatgtatatctgtaaaatgtgaaggaaactataaaaacagggctacacttcataaaatttgtagagtcatctgttactttctcatccttcttcggtaactgcatgaaacctaagtatttgttgcttgcaatggattaagacgtgaacaccatagagataacagaccattcttctccttcatatgatatacaccatgccccaactttccttcatttattcttccaggttcttctagtcttttcttttatctcattttccatttttcctcttttggtacatggtaggtagatggatctgtggacatttttcagtttcgctatcccaaaggggtaaagaatttgctccttcttgttctaaattatcttcacacacacacacaaaatgacacagaaaaattggtgataactggctaggcgcggtagctcactcttgtaatcccagcacgttgggaggccaagatgggcagatcacgaggttaggagatcgtgaccatcctggctaacatggtgaaaccccgtctctactaaaaatgcaaaaaattagctgggcatggtgatgggtgcctgtagtcccagctaccagctactcgggaggctgaggcaggagaatggcgtgaacttgggaggtggagcttgcagtgagccgagatcgcgccactgcactccagcctgggtgacagagcgagactccgtctcaaaaaaaaagaaaaaaaatagaaaaattggtgataacattaattctagttaatgggaatagctaatgaaatatgttttagttaattaatgcattaagcaatgtatttgactaatgccaaatacaatatttatatggttaggctctccttggcctgacattatttgattaataaaaatgaattgagtacaccaaattataacttttcttatgttttcttagcacatgatgcatataacacatatttcttctaatatattctctatgaattttttttttttttaaatttcatgtgtatatccccattagattttcaaaagtaaggatatcttactacctatggagtttcagaaaaatcttaggaaataacagactatttccatttgaaaaattgaatatgtgaacattttcgttcttttttccaaggtatgatatccttggcaacgaacgagtgtaagtaaggaaagtccacccattactttttggcagaaaaaaggactcttttgtagtaagagttacaaagtaaatttaattatatctagttatgaagcagaacagcacatttcatattgaaaatagatagttctcttttgattagcctcctcttacgtatttctgtttaacttaataatgtggcttaagtcagataaataaattaggaaaaaagaacaaagcattctaattagtggaatgatatgtgtgttttcaaatcaaatcaatacatacgcgtatgacttactctttttaaggtgttatattagatgtaacaaaacaagaacagttcaatgtcataactataatgcacttgaggaaaaggtattataaacatgtgaaaagttaaatactaaaataaattagtcaagagttacagaaaccagcactggaaatgacataagactgcatataatcaattttcaaagaaatgtacatcaaggaaaccttcatacaagatatgggatttagcctgcatcttgatggatttataagattaagataggtaaaactggaggagtacagcttattggaaataagttggttcttataaataaatgcaccaggatgggaagaaagtacaaagaaagatgaaaacaaattaatttatttgagcaggagattcttgttgtaaaaactgtctgaaaaggtagattgcggcttagacatattcaatggatggaataaagagaagtaaatcttcttattcagaccattctgatattttcatagatgaatttgtaagtggtgggcaggattggttagaggatgcgaaaaactgaaagcagaaaatcccaccaggacagtgagttacaatattttaaagcaataggatcttttttccacatgaaatttaattgtgatctccaacatataaaacagataaaaatggcatcaattttttagagcaatatgttctttaaattcagattagcactcattatatagtcaattaaatgggaatacagtttaaatgatggtattttctagtataaaaattgctatttgtaacacactagtgtgtgtctgttgtttataatgtctaatattatagtagatatttaggaggaaatattcctatcaaaccatacagggcttctgaaacagggtcttgcaactcacttaggtagcctcagcaagagaataaaatggccatggaaatgaaaataaaggagttacaattataactaactttgaaggaagaatctttggaattcgggaaaaagcatttaggggtctaaggaaattgaacatccaaagatgatattattcccccaaaaaaccaaccaaccaaccaaccaaccaaccaaccaaacaaacaaacaaacaaaaaccctttctgtaactatctctcacccacaggaaaatttcaaactccttgtaggggctgataaggccttcagtgaccagcctatccctaactctcttgcctcttccgtggccaattttcttctttctttgccagctcttggcatttagggaagtatttgaactcttcaaattcctttctcttcctccgggcttccacacgtgttgtttaaaatgttccttttactggtggtcaacatagccctgcccaactccaaaactagtttagacctcctgctttctacttttatggcatcttgcatcactgattatttgtttaatatcagctttccccactgaattgtatgctctgtgaaatagattcaggaccctgacacataactgtccaaaaaaataaattaagagtttttttttaaataaagtttatttttacatctgttttaggcttacagcaaaattgagcagaaggtacagatttatcccagcccccacatattgatagcctccccaactatcaaggttctccaccagagtggtacatttgttacaattgatgcgcctacactgacacatcatcatcacctagagtccatagtttacattagggttctctctgtgttgcacagtctatggatttggacaaatgtaatacatgtatccaccattattttataatacagagtggtttcactgtcctaaaattcctctgtgctctgcctgtccatggtttcctctcatctagcctctggaaactactcatctttttcctgtctccgtagcgttgacttttccagggtgtcaagtagttggaatcttattgtgtgtaccttttttagacctttcacttggtgatatgcgttcaagtttctgccatgtctttttatggcttgacagctcatttctttttagcaacgaataatattccattgcatggatgtaatgcagtttatttatccatctacctactgggagacatgttggttgcttccaaattttggcaagtatgaataacaccaataaaaatatacacgttcaagttttatgataaattcagcttttaaacaaaataaatggaaaggcattcaagtgaaaatattcaagaatcatccggacatttataagttactctttgtaagagagatcaagactagagatgtacatttctgatatttactcatatcacagtttccctaatgaatatctcccatgtaccagaaactgtatgaggtgcaagaagtagataagaatgacagctttcttgaatttaagaatctcacaaaatagtgggagaaaagaaacacagaaacaaataatctcaatataatatgaggagtaccacaatataagtattatggaattgcaattaattccatttggagtggggaagagaagacttcacaaaactgatgacgtttgaagtgactggttgaaggaagagtaggcagttacaagcaagtgatttgagaacagtcataaacagatgcagactttagagaaaaatatagtatatggatgttgaggaaatagtgcgagattaagctggaaagatgagtttatcagactaggatgggttttttagacctagctaatgagttggaaaggtttttttttaatactagttataatcactgaataattttaggcttaagcgtgatgtgaatgaagattttagagatataattctgttgcacgtgtttaacaaagggtggaagagaagatgatgataccggaagagtaggaaagctaatgagcttgtttacagcaggaaagtgatgtgtgattgtgggagtgggggtgaagtttggagaaagattcactaggtatttaagaggctgaatgtataagaccactatatccaataatattatttatcttttccttgtctgtgtttaaaaggatgttataatccatttgatttatgaaagtattcagactacagagaattgaaataaaaaagctattgattttgtctcatggttaaaactttttggattaattttctatattcacagaccacagtccctaaaaaaatatggttttaaaataattgtcatattttatactcaaaattttttaaaaggatagatctcgtgttaaagttttttactacaataaaagtattatttttattttatagggcaaggttttgaactcctgttttgtgatttgcatttggatgacaagataaagaggacattagtttctactgagaaaattaagagaatcaaagagatactgaatgcatttatatgatagtcttaatgacatatggaatgaaaggttgtcagatatctagaacaagaacaagtaaaattctccaatacttcttagataatcaatcagcgatattggcatgtaatggtgcacaagtatgaacaggagaaggaagcagttaaatctacaagcactaaattcattaattgtctttaattagcaatttggtttttccacatgagtaagtttgttgggaagttattgcctcttgtaactgtggggtaacaattagctaaaaaggtcttttaagaataaattgagatattgagataacagatgtaattacaattagaaattaagataacagccaggtgatttactgtggtgacaccaacagcttcaggaagaaataaaccgagagaacatttcagataccatgtggttgctacttattgccagtataattgtgtgcatgtatgtgtatatgtatttgtgtcaatgtgcatatttttctcatttaatttcagctatgacagtgatagctggtgcccaccattgccagtacaaacttacttacaccaaggtctggaagatgaactggaagaagatgatgatagggtcccaacacctcctgttcgaggcgtggcttcttctcctgctatctcctttggacagcagtccactgcaactcttactccatccccacgggaagagatgcaacccatgctgcaggctcacctggatgagttgacaagagcctatcagtttgatatagcaaaacaaacatggtaaatatcttcattaagtcaagagacccatgctttcaacacatggaaatttttttcagaataaattcacaagagattctgatagaactacacagctagggttaaaagtgattttgtatgactccttaatcatttagataaatgtatccactgagaaatgttaaataatttggccaaaactagaactagaactagaactagaactggaactggagctgtaactgtaactgtaactagaactagaactaaaactagaactagagcaagaattcaaatctgctgtatttcaggctaaagtgctcttggctacaccagaatcttttctaatttatggtttatcttcaattagcttatcattgaactcacatcccatgatgtaataaaagactccttttagattcctcaaagtgcctgtgattaattctgtatgtggttgtcaatatgtaaatgtgagcttctgcaaatcacatatggtcagtattagttattaaaagactctctttacctgagttaagtgcaacagaaaaaaaaagacaatactagtatcagtaagtgcataaaaagcaggagtaaatcaaaaatttcacatttctttttctaatctataaacttttgtaaactacaggtgtcagtttacctaggtatcctgtggaattaacacagatatataaatgggactaacgctaacagttttatacaggatttttgttattcaatctttctattttaattttcaaaagcccaggcttttatatcactattttaaagctccatgtcatactccaattttcttctgttgatttaccctttgtgcttgaagtctgagtaaattttttaaatagtatttgttttgttttttaaattgttctagtcatggggataaataattcttattctcattattaatgaagtatgtattattaaaatacagctaactatacatagaaagagataccaaaaggaagagtattacttaaagattattacaaacagcctcttttcttaagatattcttgaacattttccaacagtcatcagatgctttctcaaaggtcaaagacaacttaccgttaaacgctgttatttttcatcaatctgcttttaataaaacatcactatgtaagttgaagccagctgcttcaagagccacagggcttccttcacgttaactaatgaagcaatgcagtttggtcatctaaagcacagactcaagctgaagggttctcaaatttgccacattttagaaccatttggataaccttaaaatatattggtacctgggctccactcccagagaaagattctgactgccatgatctggaatttgatccagatcatgggacagccaaggttgggaccactgccgtggagatgaacctgtcttactagctgcatgactttgggcaacttgctcaacatttatatgctatagtttccccatgtgtaaaatgatggtgatgataatagtaattagctcatataggaaattagagggcagtccccaagacaacctatatttctgataccaagtacaagtttcaagggtccccaagaccaccctgaagtttcagaattctctatagtaagtcatagaactcaccaaaagattttacactcaaagctacagtctattacagtgaaaagatacgcattaaaatcagccaaaagaagaaatgcatgggacaaggtccaggaaaattccaaaagtagagcttccagttgtcctctcagtggaatcatagcgttactttcccaacaaagggtgtgacattacacaccatggagaattgccagccagggatgggcacaccttccttgaggtcctgcgacttcattttggctctgtcacacagacattgttgactacccatatggctgacctcaatttccagcccctccagaggctgaggtgacaccatgcaactccaagcccccccataatcatattgcgatgctttttggagtagcctaaggcctctaggtaagcagagagacttttatccacaggacattctaagggcttacagattacctcccaggagtagagggcaaaggcctaacctctcttgggtcgaggttcaattctttgttacatatcctagtttttgtgagaatgaaatgagtatgaacttatatactactgtccctggctgtatattagctgttattagttagaaaggcctaggttttcacccctgagttgttcacttctgtcttcccacacttagaagagtgtcccacttagtaaatgcttgatagatatttggtaaaagaatgaacaaattagttcatctccacctgctgcaaatacccatagaggacaccctgtttcttcttctgagtgtgttcctactcaaccagcaatctttcagaatgccttggctgactccacatctgggagttatgagcttgcatgtgcttctggtttggaagtgactcaccatctgggtagcacatcaacatcataggactgtttaacaaataataattcccaggctccacctcccaggatctgtttctattgattcgtgaagtaaacagcacagtgcctgtcactagaagatatttataaatgttatgtgtcctcttcctgtatttcaatttacctcttaattttgcttaaataggagtacattttttattccatcaaggtatatttgttttatcaagaggtatcaattcataagcatattgatggcaacatttatagcaagatgtgctcatctatcctcaagcttttctgtactaatacttaggaaacttgctatttcttcctatttttcaactagcaggctgtgaggaatgctgaatactaacttggggcctgaactttctaatctgttaaagattgaagattgggatctgatgatattgaggtagcttccagaattagaaatttttttaacattgaaacatctagaatcctgttaacattgaggttggttacaagttcaagaagccagttgggagaggaatattaaacaaattcgggaagattaaaatattttccccaaatcatgcaaatgacaaagaaaagtaatctaatgtctttcattcaccagccaacaataaaaatgcatagtactttttaagatctcacctaaatagcacagccttttaaataccttttatatgaaggcaaagaaaatacttactatgttaaaacatgtagtacactcactttttaatgctggtaacaaataacaataaattcatttcatttagcattttatggtttagaagaaaatctgagtagactcaaagcaaatcaactggaccctactgcccagcttcacactttgttagctacctgatttgaaacaagtcacttaaatttgaccttcactttaataaattctaaagaaggttgggccaagcatgatagctcatgcctgtaatcccagcactttgggttgctgaggcaggacgcttgcttaagcccaggagtttcagaccaacctagacaacatagtgagaatcccactctacaaaacatttaaaaactaattgggcatggtgaagcacacctgtaatgccagctacttgggagaccaaggcaggaggatcgcttacgcctgggaagtcagggctgtagtgagccatgatcgcatcactgcactccatcctgggtggcagaacaagaccccttctctccaaaaaattaaataaataaataaataaataaatgagggttgataatgcatgatctatttatttcataaggttgagattagaattatttattcattgcaaaaggtttatttaacacactagtgttccaaacacagagaatccttagatgaattgtttatgcctttgaggagtttaagactttgttgggtgagacagatacataaatagctactagagcacaaattagttgtgcctaccctaaactgggttatagtgaaagtggaaatagccttccagccttgatgtgagagagatcgtgtggggaggaagccttctagggtgggaaatgtgttcagggttgggaggtaggggatattaggtcctcatgtgacatcttttcttcataagggccagcaggcagcatgggttacacagactgagtagaattttgacactaaactgagaacaaaagtataatatttttggagaaaaatattcactttaaatagttactcgtggcgaatattcctagtcccctctagataacttcttttcacaaaaatactgggcccgtatttttttttctccgtgtgttatcctataaataccaagtgaagagtttaatggtttatgttttccttgtttggtgaggctcgtattcgtagccattgtttctgctgaaagcattatgaactcctaaattagttaatggaaaggaagaagacagtatgagttactatagcatgcatttaattaaaattatgattttgttgcatgttaataagttgcttttcttttttaaatttcatttgaattctaggcacattcaaagcaataatcaacctccacagcctccagttccaccgttaggttatgtgtctggagccttgatttctgatttggaaacggatgttgcagatgatgatgccgacgacgaagaggaagctttagaaatccccaggcccctgagagcactggaccagactcctggatccagcatggacaatctagacagctctgtgacaggtaacggaaccaatttaataggaaaaactgacctattggtaacattaaaatgcatcaaaagtcaactacttccttattgtaagatttattccactccatctatttctgtaacattttaaatgtgttaatattaaatacaaaattcaaaaaggatttggaaatacttttgctttgctgcaaaaatgataagaaaattcatgaattttaaaaagctttaaagacatgaaagaaaactcaattatatctagggctttcatgagaagttcactctactaggaaaccaagtctattacattaaaaaccttgacttttagaaatgatcttttttatatatatcaggaataacatatgaagtgaatgcaatcttaaaatgcttcttgatatttcactctgtaaaatcattcactgatggaaagtaagcacgtctcctgaataagccactttaaggttgcacaaggtattatttttagaatgaagaaaatgtgtagtgagataaaccatatgtttatgcatttcacattgctgcatctagtaaatgcttctcttccaagaaatgcagttattttttctgtttatttctttggcttcctcttgccttgttcatcaaacgaaagagttgcattggtactcttctatgatgatcccaggactaaggtataacctattttcagggatttaaatgtaccaatttttttaaagaaaactttaaatcctaaaatggacacaatgaatttggagaaaactaaaaattcagtctttctattcaaatagatatacactgttggacacacaagaaaatgcctcttacatgactgtgtagaccgagctactacaaactgaagtctggtctctgcatttcactgggtcttctcagaagaccactcatatctgtatttaccgtgatgacatctttcatcctaggagatattttaccacaatcccgcttaattcatttttatgccaacagcttccaaactttcacagattttacacaatgtgttagagttctacaaacactgatgggaactggtttatgacaggataaagcagcatcagcgcctatgattttcctctgtattcctccctgaattactcaatgtgtgatgcatgagcccatttttcagtttttcttcttatccaggggctggtctgcttgccagcctaattaagatttaagagctgcagatacaccgctgtgatttgaaatccagatccaaccgaaggtgacagagcacaagttaaaatcttcaaatgcagagagctgacttattagtgcactattatgttaagcccctttgcctgaatttccagcataatctccttcagggtaaaattctgcatatttttgcatatttcactaatgatactgaactcttttccattaggaatgcagtaacaaattgcaataatgatgaaaaacagtcagctatagtctgtgtagttcttttattaaatattataatgtcaaagatgataaatacgtctataaatcaagagaatgccattttgcacttttacatgctcacctgtgacatgttaggctgcctgatgtgactgcagctcaagcagtctgtatttctcctgtagctagtgtaatgttcattccaaatgaagcttttattgctgagaaaaaaagtctggttttctccttgaattcactgcttaattactgccatatataaaaacctcagggtgtttaagtttgtattccatgatgagtttatcctatgaataatacatctctttagtaaaagaagttgtgttctacacaaaagtagccaaatacaaactcactttttttttcctttctcttccacaataactttgtggagaaggtgtgatcaaagatttaatttgctttctatggtatgtgagtaagtgcttataagtgtgtgtgtgagagagtatgtgttagatgtgtgagtgtattagaacgtgggtgtgggtgcttgtgtagggagtgagtacgtgtataaatgtgtgagagtgtagataaggttgtaagtgtgatatagtgtgtgtgcatgcatgcatgcagacatgtatgagaatagccctgaggtagatgtatatagagactgaatattagagaaatcagcatgccaatgaatgttgttctaacatgcttatgttttcctcagacacttaatgctagtttaatggcgctgaatgaggtggacaataaaacaggcattatttctatgagctttttatgtttttaacatggtaagtgcccatacagtggatgcggatcataccaccagttactttgggttctaaatatatttgtggtgtgaataaattagtcattacctccccctgaaatgctgttagttattttcactttcatgaaactaatgaccattttattaaagagatctaacagttacaggaggcagcatgggttacacagtccctgaaaccctgaaaccaatcagaatattgggttccagtccctgcaactctgaagccaatcagaatattagttcaataacaacactgggatgggctggtaagcctgtatgtaaaattatgcaggattttacttggatatattgcacttcacagctgccacattagggaatatatcagcagttatccagggacagagcccatttttttgtaaagaaataagcatgttaactacaattagttgtttttataacaactaatttgtgagggatctcttaaattttgaaatgatgttctatgagtggaaaaggctaaaaaaaagaagaaaatatcagcagttccatatcccataatctcagtactggataatatgtatatttgcaggtctgctgttaatatttctttcttcctacaacaaacacctatcgaatgcctattacttctaatcacttggctaaaaatttagattcagtaataataataataataggtaacacatatacaacctttacgaagtgcaagccatctttctttctttcttcttttttttttttgtcggagtctcactctatcgccaggctggagtgcagtggcacgatctcggctcactgcaacctatccctctcgggttcaagcgattctcgtgcctcagcctcctgagtaactgggactacagacgcccaccaccatgcccagctgatttttgtatttttagtagagacggggtttcaccatgttgaccaagagggtcttgatctcttgacctcgtgatccatctgcctcggcctcccaaagtgctgggattacaggcgtgagccactgcggccggcccatgcaaggcatctttctaagcagtagcctgtattttgtgtggtctcattagctaagaatggtttttcacatttttgaaagggttgtaggaaaacaagaaactaactaacaaacaaaaactaagaagaatgtatgacagagacagcaaagcctaaaatatttactatctgtcattttacagaaaaaagtttgctgatccctattataaagttttaatgtatattaattcatttgatcctcacaaccctattaatagtattattttcatttaatagattaaaaacagagggttttaaagcctttgtccaggttacccacctgataaatggaagaagaatgttcaaaatcaatcagtcttactctaaagacaaattatcatgatccctgctctggaaacacacaactttcttctaatctgaggaataggtatatttaagaggaaaataatatgctggtttgttgcttcatatgtggaactgagtgtgtgtgtatataaacacacatgaataaatatgtatacaagcacaacatataattttctctctcgaaacattagtcctttttccttatgcatttaatcaagatcaagatattaattttagatgtgacttttgtgattcatttttttcacattcagttctatgtttatttaaagtgacccatgctaacaaaattcaactgtatcagcactttttgcaatgaacctcattttaataattttcattgtaatctatgctcataatgcacacctatttgattgtaataaaatacaacatatttatttattgcagctcattgcactctgtttgggctagaaagtaaacataaaggcttgtttctgtcttcaggaataagcctgtaatttcttcctaaatgccaaaccgttgggtaacggggagggagagggctacaatacttctttctgtaatttccatggcaggagtcaatggtaattgtttcccaaatttcatgacaccaccaggaaaaaagaaacagaaggcagtaggagagagtgcagggggaaaatgccctcaacgtgtagcaaagattctaactgcctcagtgatcacaaaaaggaagactgagattgtgtgctgttcagtgaaacaagtaaaaagtttccttgactgctggaccccacatgaatatcacagctgaaaggaaatcatggctctatattttgtgttacgtttttggaggtttgttgtggaactcccacaacagatcagtatggaaacaatgaaacctggtggcctcaccatctgactcgaccacacagcttttagagcctcggccactaaaatatttgacctgaaactttgcttttctacaaaacttaaaggaaaataagtttagtattagggaaaagttcagggataatgctacagtaatcaaattaatttcttagactacttttacaggtttgatgcctttaaagaacaattaaatgtgtatttcaaaattgaacagataaaaaggggaagtgggatattacacgtgtaatttttatctgagtgaaacaaggtatcaagcatcgtatgtcctaatgaagatatttttaattgcttattttgctttccatatatattacacattccttttctttctttctttttttttctgagatgttgtctcgctctgtcacccaggttggtgtgcagtggcactatctctgttcactgcaacctccgcctcccagattcaagagattctcctgcctcagcctcctgagtagctgggattgcaggctcgggccaccacgctaagctatttttttttttgtatttttagtagatacggggtttcaccatgttggccaagctgttctcaaactcgtgacctcaggtgatctgcccattttagcctcccagagtgctgggattacagatgattacacatccctttctctctgaggcacgcaggtggaattgttgcacattcaatatgtttgagtgaaagaagaagttctgtagatttgacatgtttttctacgtgtaggcaaaggtcaatatttggattaatttgtctaaagacatttgtagctgcagcttttacttaataggtagacaaataacatttaataggaaaagttcatagattaaatattggttgaaaaaatggagaatggctagtttttgtatctcataaaaatggtaatgcaacaattagcagggtcatcttataaagcacagactttagcttaatggatctaaggataagcatttatcagcaaggaaagatttagcataaaatgacatgtaaatgaattgatgactgatcataaattaattttagtgctgaagatgtaatagagacacagcaagatgccactttatcatgatattttactgctcagtaacatctgagcaacaacttaatgtcctatgtgcagtactactttaacagcttgaatacatttgagatttttttttgccttttctgcaatttaaatcagggaaatttggaaagattgaaaatgtaaacacaaataaatttggctatctaacataaattcattgttcattaaatgtttaaatatgtattgattatgtttggggctgaaacatgtcaaattggtatggagtgcttattaatttgtaagaagcctctagccgaattggttttacctggtgttcattttaattttcgtgtttatacttatgtttgtgaaagaaaatcagttatcacaaaagtgacttacttttaaatttgtagattaatgtttttattttcattcattcattatcttttcttctctctctctctttttgtggggggggggtaattgtttacctaaatcttcagctcattgctcttgtttaaatctcaacatttttccttttttcagaaaggccactagacgtaaaatcagtagatgttcaatacattttagccattttacagaaggaattctaacatcttatatactatttgattcatggaatgtggccaaatgtcttttaaaaatatttaccataaatatgcccattccatacatcttaaccaaactgtagaggaagggatgtcgaaaatcccagacagagaggcagagagacaaagagaaggagagagaaaatttctttctatgttccttgccctccgttttgaaggcaaacacaactacactaacgtgagacacttccctctcttcagattgggtcatgagatttcctgttgcccaatatggccaagtatctgtggtcacatatctttaattctgaagtcatctatctagtctctttgctcttacaagaagtacaaaagaaagaatagctgacgttctttctgtatttaccaatactcacttgaagccctggcttccatgtgactctctcttcccagagggagacaaaaagcagcagggaaaacttcatgaataattgggagttttaaggacatacaaggagcattaaaggctgggagaaaggcagagcaaagacacaaaggctggaagtagtccatttgtttagagtatcacaagtgtgtgtgtggaaatgctcggatgaagaactgtcaagttaccacagggagataaacagggttatctgaggcggaaagttaggctgattctctgctaggaggtctcacaggatatcatttctttagtgatgctaccgtggtgtaggatttactggtttcacctgtcaatagctacaccacagtcagttttataggttcagagactaaatgtgtcactatgctagatcctcaggctggaattacacagcaagcagacatagacaggaaacgaaagaaactcaactatttttaggctggttatagtggaaaaagaaaaattttagaaaacaaatcactgggccaagtgcattaagatggataaatgaggatggaaaagttacactccaaagaaacttagctgccacttaatgtaaattttttatcttaatttgaataagatattgctaaatatcaatattcaagtatatcaaagcataaccaatacacatgcatatatatcacatatatgtatactatttatatagtgtcatcatattccttatttaataaactttctaagagttcttataagaaaattctttctatagttaaaataaggacattgctaagaaattacacatcaaataatgtcatacacagaattatagaataatgaaaacgttgaatgcatttaattccatatgcctactgtttattgaatttctaatgtacaatgtcactggacaataaatatgaaaataaacatgaaatagttcctaatctccagaattccattgtctaggagaggaaacacatgtgcagtagaccataatatatagagagaactgatatgcgagtttatgtgtagtgtttggaaaccaaaggaggtagagagattgattctcgctgtaataggacagaatcatggtgataacagaaatggcatttaatttagactttaaagtttgtcagtggttaatagtgttagtggcaatatctctgtctaaagaatgaaggatgatgttacataaatgagcaaggagacacacaggctgtaagagtgaatgaggactaatacacagcaggtatattagtctgttttcacactactgtaaagatattaccggagactgggtaatctacaaacaaaagaggtttaactgactcacagttccacacggctggagaggcctcaggaaacttacaatcatggcagaagacaaaggggcatgtcttacaaggtagcaggagagagagagcaggggaaatgccagagatttatcgaacaaccagttctcatgagaactccctcactatcatgagaacagcatgagggaaaccgcccccatgatccaatcaccccccacaaagtcccccccttgacacatggggattacaattcgagatgaaatttgggtggggatgcagagccaaatcatatcagtaggctagcctagatatggaagggttgcaaatatttaattagaagtttagatatggcattggctagctgggtaaggctttaaacagaggaacacatgtatgtaagtgcttcacaaaaataatgtagaaagcaatgaggaagatagaagagactagagggaaatcaggtaggaggggtttaggagtaaaacaagatgaagattaaagagatgcttatttggaaagtaagagcaggtatttagaaatacaagagcaggcatttagaaatacagaaaacagcacagggaagggactgggagtgaactttcaaatgtttttaaactatcctccgttccagagtttcatattcttttgtgaccccctcactgaatttctttgatttttttcttatctagtatagcattatattgcaaagcctactgcattatttcttctttcattttggatcgttggtccttgacttgtggttattaacccagaaatgattctctcagaagaggctcagtttctggtgttatctcggcttccttgcagtggcctgtgtcaagggaatttgtttgaaaagtaaaaagtgtatctctgtgcttttggcaaccagaatcaaaactctatctttctttgctacacttaacacccttttaacttctccgatcattctaaccagttcagcttctgttttctctgtattgaaagtgcatgaatccgtgtcattgtatcctggcctcttgactaaaattacaaatacagcatcaaggcaacactcctaactattctgttgttgcttaaatattacagaaaaaaattaaatggtctatagcatttgactttcatctcttttatgtaaatatgtatttggtttatttagaaatcttaaattagtttcttacaaatattttttgcccctcttctaacaaatttaggataagcaatacttggtagttttttgtgtcatgaattaatggtataccaacataaatcttgtaatattaattttattaagtaggaggttatgttctcagtctgtttttgtctaagaaaacatataaaattgtaaatgacttgctagaaaattaagaaaaaatgtttctgagtatcctcacaacttacagctctttaaacgtaaaattaaaattattttcctctattctcatgttgcattttgcagaaaaaattcatattaatgctgatgatagtccttataagtgttactttttaatataaatatcagtattaaagagaaaactggagttcttaaataacttaaaaggcaaagtaagcagaaagagcatttaaattaatagaacttctttaaaatacattttttcttatgttctaagttcatttgctttgatattgtttatacattttttgtttgtgaatttttgttgttatttgtaattaagtttaaattttaaaatcttgaaataatttttgcccttttatgatatacagtgtagtttctatgcagattatcattggagtctgcgttaaattcaaaatatattcacactatttcttcaactgagtctttgataagtttaagtacactaagtttgttttactaaaagtgttaatttctgaattatagtaacttaaaatacacatcgcagctctcttttggaaaacgattgtgtaataatttaaacaatgtaagagttgaacagtgcagcacatgctttgcttatgtgctgcaaacagatacaggtttcaaatgagcttcattcttctgcacaaaaaatgtttaaaatgtacatgatacttgcatttggctaaagaaatcatgatgaaacttcaaggaagaagcatggacaacttacttgctcattagtatagtgtgtacaagcagatgagattttcaatatatacaactcactagacaactacatttgtttttaggttcaatggtaaatggatggggctctgcatctgatgaggatcgtaacttttctagtcatagatctagtgtaggtagctcctcagatggctctatctttgccagcggcagttttgcacaagcactggtggcagcagcagataaagctggttttaggctggatggaaccagccttacaagaacaggttggtagactccaagtcaacactctttgcatgagagaatcttgtccttggacactgtcctcttttctcctgttctttctccttagtgagtctgactgtagggctttctttaatacgcatgaatacagtttggatgctccattacccaaactctcttctgatgctagttttgcagagccaagaatagactcctcctcaacactttctcttattttcctttctcttcacggctttactgattaattggaatatgcttcctttttatattacggcaaagcagcaactaagattgccattaaattttcaataacacattttgcaaaatcctcatacaattaataatgtacccagtgattaaaattactcagcttttatctccattactttcctttgcctcatctctttctgcaaatgcattttctgggaaggtttccttagcatggggtgaatgggtctaaggttgtcggtcttaccagttcaaatagcttatgatctttttaattgtttggctagtaagattttaatacaataatttattatttgtcttaaaggatgctaattaaagatacacccactgcatttgcaagttgaataaaataatgactacatgtgtatttctctttagaataatttaattttgatttctgagagtgataagtaatcatataaaagaacaattatataatttttcaagtgctgctcattccacaaaaaagaatgtgggattaataatagatcagtaatttgtaaacttttgcaacaaaataacttaggcatgatgcgtgcttttacatttgtatgtataattcttaactatacatataagaatattctaatatatgaattaaactgaattaccttgcaaagcaaactaataaaacattaagtacatttgcaaaatcttaactgtaatcaaatagtaaagaaaaaagatttttacccttcactaaactctcaggttataaaaatgagtcttggaagttttcttggaattataccatcaatatttcttttaagcatacattagctatctttaagtgaaataaaaaagatcttctaagcattgcagaggtttatttttcaaatagcatccaaactaaaatacgttgtaatagaactgttatttgaattgtcttgcattataaggcataagtctgaaactttatgttgcttgagtgctttttgcagcattagctgtaaacagagcagtgagaacgtgcaaggaaactaatacattagaaggcacaagtgcatttcctgcatgtatgctaatagctaacacagcattaagtaatatcatatcacgtcgtcgtaagaaaatgtaactacatataataatgttgtatgaaatgaaaacatacacaggagaataaatgcatgcacataaaccaggcctctgttactacaataaacatggtattgaaatcataagttgttgaaaatttattagctaaccttttcccagaataaatttccccgtatacctactctaaaccacaagaaaaggacacagcacatatcatttttcaatgagaatttggagcctgctcagatacaataatattaatcagaaaatacctattgcatgctggatatacaaggtgattttaacctgctatcctctacacagatgttgttgagtttctgccaaaagagatagaattcattgtgtatgtggataagtggtaaggtcaatttaatatatgtgtctgagcagacctttcatgtaaaatttcagatgtaattactatatgacatttttctgtgttcagagagattttgtaagtttccaaggatgaaattttattaaacaaatacaacagtatatacttcataaatagcttctttaattttaagaaataaaaactgcatgaatttgcatatatctttgacaatatcaataatattgtcaaggttaaataaaagtataatcatgcaatattgagttgtggattggtggatctgttttatgttcatttgtttgattttgagggggccagtgggggtgttgttagcttattaaaaattgaacaaaatatgtgcagctgagaatgtagaaaatacatttttctacagagatgcaccaatatttggtatcttcatatgttatctctaggtagatttacaggttagtcatagtgcagaaatataggacagaatcagtgtgctataatgtcattctctagaacccattccctttattttcattttaggaaaagcctttacctcctctcaaagacctcgacctaccagcccattttctactgacagtaacaccagtgcagccctgagtcaaagtcagaggcctcggcccactaaaaaacacaagggagggcggatggaccaacaaccagcattgcctcatcgaagggaaggaatgacagatggtaggtttcttccctttactcttgtttcctcgctgaagagacgtgctccatgcaatcatttacttagattaatgtagtcatggtagattagccattgcttcattacataacaagacaaaaacctggcaatatggccttgtttaaataaaacaccatttttaaaaacaatctagaattatttctatattattaagcctcaagaaatacattccatgcaattttttgaggttgatttttttttttttgccattctggcatatttcataaatgctttttagtgagcatttaagagtagggaagaacataagctgcatgtgcacttatatgatcagaacttttatcatattaaattacaatatcttagctgctatttcacttttggaaaaaaagacttttgaaatgatttagtaattttttagtcacaaatttcagagccaaaatcaggctacagtagttgaagagtgtcttagtctgtctgggctgctataaaaaaatagagtcatgcattgtatgacaatgtttcagtcaatgacagactgcatataagacagtggtgccataaggatgtcatactgtatttatgttgtaccttttttgtttaaatatgcaaatatttaccattgtgttataactgcctataacattcggtacagaaacacgctgcacagatttttaccccagatcaatggtatgtagtcagctataccatctatgttcgtgtaaatatactacgtgacacttgcataacaacgaaatcacctaacaccacatttctcagaacttatctccatcattaagtgacatgtgactgtaccataagctggtagattccaaacaacataaattttctccacaaatctggactctgcaaagtccaagatcaaggcattggcagatttggtgtctggtgaggacccactttctggttcatagagggtgccttttcattgtatgatcacatagcggaagggacaaggttctctctggggtgtgttttatagggtgctcatcccttcatgaggactccaccctcatcatcgaatcacctgccaaaggccccacctcccaatatcatcacattggggattaggattttaacgttgaattttgggggtacacaaacatccagactctagaaaagggtcagcaaacttcttctattaaagtctagatagtaaatatctttggcttttgggacatagggtctctgtcacaactactcaacactgccattgttgtatgactgcagctataagaaaagtagaataggccaagcacggtggctcaggcctgtaatcccagcactgtaggaggctgaggcgggcagatcacagggtcagaagatcaaaaccatcctggtcaacatggtgaaaccccctctctactaaaagtacaaaaattagctgggcgtggttgcacgtgcctgtaatcccagctactgaggaggctgaggcaggagaattgcttgaaccagggagtcagaggttgcggtgagctgagatcacaccactgcactccagcctgggcaacagagcaagactccttcttaaaaaaaaaaagaaaaggaagaaggaaaataaaagtagaatgatggaaatgattgacttccaataaaacatcattcacaaaatgggcagtggctggatttggcccatgggccatagtttgctgatctagctcaatatttttatttatatatagcatccaacatttgaatacttgcttaaacactgttagtttcaggaaacacaatattactggaagatatccatgttcgataatgagtatttcattagctttacagaatatagtctatttcccgtatttttaatttaattcttataacttttaaagaatgaattaaaatatgtatcctgaagttatattctaaggatatgtaacacatatttaaagtgtgtagtacaatgtcagattgaaaggtgaatttctttttccttttcagcactgtaccctataagcacacaaacattatcctaacatagttcaattaaacaccaaaaggataaacttttaaaaactgcacattagaaccatctggaaagctcttaaaatataccctagatattcagatttaattattctggggtgaaacccagttacaggtaattttaaagctccacaagtgaatctaaagtataactaccttagagaagctatgacttagtccttagcacacttacacttatcattataggacagaatgaagcttagttgaaaaagaagaaaagcattggttttttattagtttggggaagggagtatccaatcctgcagccctatttgtgctttcttttgtcatcttgcaaaggtaagaggacttaaaaagccaaatatattgttctacatactttccggtttacttatctttcctgcttcctttgttttcaatagaatatgaaggttaagggtagaattgagatttttgagtctctataaatgtgtatcctgtggtgagtaaaaatggtcaccactgcctttctgccttatatgttcagaagattagctgagcatttaaaactattcgtagtgttcatctaattcttcgtaaataaaaaaggactactttcactgaattgctaggtataaatctagtaattgataattttgtatattttttctgttgtgaatattgtggagagagaaaaatgtctaggtatagaattttctgtggtttttcagaaatgtttgaagataatattcagaatatgtggaagatataaaatataaatcaacaaaatacagatctctttttttctaagacacttttattgcaagcttttttagaatgtttccttaaagcaagctacctcctagtttaaagtatgatcaatatattgcttatctttctaaaaaataaatgtttctaaattttcaaaattgccagcatttcaaaaaggggttatggattatgtgttattagaaaatgatacattttagaagtagtgatatagcaaaggaaatttcagcccacatatcttcccaagtgcttaatccaaagccattttaattatgatacagtgcaaagacatttattttggatggtgctctacaggttatccttaagaacattgttattttgcagcaaatgcatatgccatagcatttatatggtatggatccatatgtcagaaataatttcataactttttatgtaaaaatcaagttgttctttttgggaaggctgatacttagcagcattgattgtacagacattttacaataaaccttttgcattatagattttacaacagtgtttgctgttttctaagcagtattgtaaagatgtaggcctttttagcactgggataccatcatttctggatcagacctttatggtttctgaggggaagacagaacatgagtggttgttgggaggttgtaatggcaagtggcacacatcacttctatttcattgaaaacaactctgccacgtggtgtcaaactaactactggggtgagaaagctgccttccctgtgtcccataagagagattatgaatggtgggaaatgtcagtctgtatcccaaagactgaaaaacccacacacatcttaaagagtgttcttctcccttttgtaaagtttctccaaagcaggcattgctgagtccaaatcttgtattccatttgtcttataaatcaaagaatacccttggaagccaatatattaaccaatgctaaaaaagatagatctgtctatccatcaacctgtttctcctagataatttatttccagcctattctccctttcacctagctttttttttttttttttttttttttgagagggagttttgttcctgtcacccaggctggagtgcaatggtgcgatctcagctcactgtaactcccaccttccgggttcaagcgattctcctgcctcagtctcccaagtagctgggattacaggcatccaccaccacacccagcaaattttgtatttttggtaggtagggacagggtttcaccatgagggccaggctagtcttgaacttctgacctgaggctctctgcccacctccacctcccaaagtgccaggattataggcatgagccaccatgcccggcccctttcccctagttcttaatgtcctgttcagagaaggggctctttctcagctctgccacatactagctttggcctttgagcaaataaatttacatattaattaatctattcactcaaatacttattaagtatataacatataatagacaatgggagccaaacagacaaaatcccctgcctttttatattttagttggggaagatagataaagaccaacctaagtacatacatgaacatataagtaagatggtgataaatgttatggggaaaaaacaaagggaagggagttgagaagtataggtgtagggaggaagtatttttaagtagagtgactggggaagtcctcaccaggaagtcagcatttcagaaaagactggaataacataagcaaaaaagtaatgctgatatctgaggaaaggttattccaggaaatgagaatggcaagtgaagcttgagacttatttgataaaaaggaaagggaacgatatgactggagcagagagagaaacaagatagagtacgaagtcaggcaagcaaacaagggctagtgtttgtgagacctttaagctaccataatgacattggctcttactttgaatggtaaaccactggacggggtgtgtatatgtgtgcatgcatgtgtgtgtgtgtaaggcagggaagtgacatgatcttatttgtatattttttaaaaagtcattctattctagctgctgtgttgagatgtactaaatgaggcaaggtggagattgtggaagctacctagggaatagatgacggtggttcataccaaaggagaatcaatggcagtgttaacaaaggttggattttggaggtagagctaacgggagttgttatgaaattaacataggccataaagaaagcaaaccacattactctgaaattttggctaacttgtagaatgtaactgtgaccaactgagagaagaaacactgcagaggaagcattttttttttttttttttttttttttttttttgagacggagtctcgctctatccgccaggctggagtacagtggggcgatctcggctcactgcaagatccgcctcccgggttcacgccattctcctgcctcagcctcccgagtagctgggactaaaggcgcccgccaccacactcgggtaattgtttttgtatttttagtagagacggggtttcactgtgttagccaggatggtctcgatctcttgacctcgtgatccgcccgccttggcctcccaaagtgctgcgatttacaggcgtgagccactgcgcccggccgcatattttatataggatgatctagagctgagttctcatacatgaaatttgagaagctttctgaacacctaagtggaactgtccagtgtagctctggttacatgagtctggagttcatgggaggaaagatccaagctggagatttttaattactttgtgccttcattttcttgtctaaaaacagaaggtaataatggcacctatctcattggactgttgtgtgcctgaaaagagctaatcctcggtaggccagtaagagactttatagtgaattgatttagtggaaatgaatcaacatagaaatgaataataaatttaatttaagtaaatgtatttgattacatacttttatttttcaaaaaaccattcttaatcccatgtctttttccaattagtttatttcagtgtgcatgtaatgtcctttcttaaaatatacaaactccaaggatattacttatgaagctatataattttaggttaaattaaataataatcagaattttagctgcataagcagatgccgttttggccattttaaaaattaagctgctctgatgcagaataaaaatcaatgacaagataagttattttggaagaaaatacaataatttctcctcactggcagtctaagttcaatcaatcaaatgaaataattaatttgcatttataataacatatagtgaaggaagtcagtactatcgaatataaaggaaacaccaaactcattggattatccaacaaacagatatctcaatattggattagctcttcattttggaaaaatattccaaatgcaactttatcctccgaaacagagaccctgttcccttcagttattagcaattcataatttaacatgaggacatacgtaagaactggcaatgctgctccaacttaggaactcagaggagatgctccagagaccaacattatcagtccaatgcagattagtatcactttgctcataaaagagagtataaaggttcttgaagtttttgaaaggagcggcttagctgactgttaaggaagctatcttttgtctacaagaaatttatactttttccttctaaatttcacaaacagaatattattagagacaacagaatacatttacaaaaatggcatcagaaataattgaatacattgtgtacaatatcttctattaatgaaataaatgtatattttatatgatatttggtctttatgaaaaaataatataattaccaatattctaaggatgaacaaagaagtttacaatagcatgcaagaaaaatgagaagaaaatgatacaaattgatgttcagaagatttcaaaatcttcagcaaagtaatttcagaactaatacatacttaaaagagaaagaaagaactgtgatttcacagtcgaaggcatacaaaatataaaggtattatgatctgaagagttaataaaagagagatgaaaagggagttgatattggaaccttaaattttttcctatctgatatttactttaaagagcttttctgaaaaattatctcttctactctatctcaaatttctgtgaggcattgtcttctctagcaccataaaacacattcagtctttactctgaacattggttattacttattaaaattaatacatcggaagattgtaatatattagttgtaactcattagctaactcatgaaacgaacagccagaattggttgtcaagcagaatattaattgcatttaataaatgttagtttaatgttgttaaatgtgccacatacatgggtaaaggcagtcatatgttgcatatgacacggcatacagttctaaatttcccgagggtgacattccctttggagattggcaggagagcttttgttcttggggccttttgttagtacagcttcaggaatttctagtgatcttattttgtgtcatggtatttctactttggggaaggagggttggacaatggatggaatataaacaatgaactgccctttacaccttgaatgatagcctcaatatgtaactgaaaacactttccacatttaactgttgaataaaactagtcaattttgtttcaatgatgctatggccaaaagacagcagagagagcaataatatgagctttggaaataaataattgacttttattttccccaaattttttttgtatgggtaatacctgtataagggcaaagattttcttcaacttgaactaaaacctgtatttttcattaaattttagtccattctaaacattattcaaaatttttagatcttccaccaccaccagatcccccgccaggtcagggtttaaggcagcaaataggcccgagccagcaggctggtaacgtggaaaactcagcagagagaaaaggaagctctctagagagacaacatgcatccagcttagaagacacaaagagctcattggattgtccagctagaacctccctagagtggcagcgacaaacccaggaatggataagctccacagaacgacaagaagatatacggaaagccccacacaaacaaggtgtcggatcaggtgtgttctgcacagtcccaagaaagtgtggactgttaccatttcttttcctaccaggtattctagaaatggcagttgtttaagggcatctgaaaaacatttgccttcaatcgtaatggaatttggaattccttaggagattttaccagtacatgccttaaggctgattccaacgggcattgctcctcagtcagcctctccacagggtctttgatcccaagagacttccaggcttcatctaaacggctcagtagaaaattttattttttggcctattaatgtttatattgagtactttaaagatcgctaaatttaatcttttctgtcagtttaatctctgccttcagcaagtttgttcattttggctgaaataaccagtcattcgaaaggagaactcacatcaaatatgtgaattcattaaaattacaaagttgcagaaaaatgcccaatcacagatcctcaaattagataaggttatactgggcttgcactttctccaactgttaatcagttgattgatttagttggttgttaatctgtctatgggaaatgctcttttttataaatcaagcttcctggaaatgtcacagaaataaatttcattgtttgtagttagatttttttggggggagaggtgtggcgcgggaggtggggagcctgctttataaacgcattttctgagacatctcatgtcaggattcattgagtactgaaacacacacatacacatacacacaatctttgaaaaaatgtcttttcacttattcatttggacttaatgtgttgtagataggcctctccatgcatttcccataactacattttgtcacaacttggtgctcaagtttttggaaaatgtcatttgtgcaagggccagtagatgacaattttaatatctaggtttagtgaaacatttagaaaggttacaccattcaggctgtgagagaaaaatcatgtggttcttgtcattgaagactatgtaaggggagaaatagtaaattcagtgagcattaatcacaaaataatagcccatacatagaaagaacgtgaaagacagaggggatggggtgtggagagggagcaatgagaatagagagggaaagaaaaaacaatttttgaactattgagtgattatttgtaacatatgtcatgagttatttgtagagagacaatctgtaaaaaaaaaaaattagcatattatttatttaaatgtgtgagtttctcttttacttttaaggaaatacatagccctttaaataatgtatttctgtctcaaaaagcaacataaattttaaaagcttatttaactaatatatagttctttatctaaatcaattgagaaaatgttgccataatttaagctgaaacaaaaaacatgtttctttaatcttaatgggaaaattaaattggagcctcattgaactttagaaattattctcagatatgcttttgttaaactgtagttcattgtatgcagctctcttttataatgaatttaaattttgcaaataatatataacattgtgtacttatcccaagatctcttttaatttaattctgctttggttcctattgtaggaaatgttgcttgcacatagaaatttctttaatatccggtcctgattaaacttcataattttaattttattaaagaatgaaatggtaaagtaggccattcacagtgttatattcaagagttaagtttagtttgcctccatgtttctgttcaatttagcctttgggttttttttctttttcagaggaggccttggtgccctatagcaagcccagtttcccatctccaggtggccacagctcatcaggaacagcttcttctaagggatccactggacctaggaaaaccgaggtgttgagagcaggccaccagcgcaatgccagcgaccttcttgacataggatatatgggctccaacagtcaaggacagtttacaggtgaattatgtaagtgcttaggtcatttaaaaggctatcgtgattcagaaagaatcttgggttaataacattgccacattaaacaaatttcagattaatagaaaacttgctctgttacaaaaacaatcaattgcaattttcaacaagtttggtcataacttaggccattgctatatttattgaagtccatttttataaatgtttctgctatttcacgttggatttatgctataaaaattgttttaagttaggcaagtagtcttaacacttatacatgaaattaaatatagagtgtttatcattttctttgcctttttaactgaacacaataaagaaatggagacactggccttttggtagttttaaagaaactcctaaggaatgcttcattttcaagttactctatatttattttttaaatttgggtagtcacccttgaagagttgatctttgattgttaattaaattgtaatgttttgactacaataacattttataaataaatttccatttatgaatgaaaactggcataggtagttagtacaattaattttctaaatgtaaaatactaggtaatagggaaaattaagaatgtcacagcaaaaaatgttgaactccttgtgttaatttcctcaggaaagttaccaatacagctttgcattatcagaaacatatttgctgaatatttttaactgcctcatcagaaaaatagcattaccattatcttcacatcacagattgtttggaagattctgtgagatgatgaaaagagaaataatttcaaaattataaatttctttattgatctcagttgtcattgttgttgactattgctaatctattattaagattcatttataattttaatttgattcataactacttgaatttttctttaacttttttttgaagtaatgacagactcacaggagtaccaaaatagttctactgggtgtttacatttccaaattctatagtgttttctttccttttactctttgatcatctccttcaagtaaaattacttaaattcacaaactcatctatctgaagaccttattttcattgattatctgttggctttgctttttgttatgctggtcagaaaagcagaatgcttaatttatattttatttctacttttttctctttctttagagtaaatgagaggagacatacaaagctgctctgaaggaccatcaggtccggactcatggaagtgatgactctaaacagtgcaatgaacaatttatttatgtactattaaaagaactgtaaatgcaatgtaaagacacacagccacacatatcccacagatattttcattgtgttcttctcttaagtacaccacccaccttaactctttcttgtcaggagtatataaaaaagaaagaaaacaaaactcgccctacaggaagaaaaggattctcctctgtatataatttcttttgtgcattgctatgcaagctcactctttttagctctgctcatattattgtctgttcttattggtctgttgtactatatgtgaattaataggctgtggtgccatatattaacttttaattgtgtaacttttatgtttaaattttgcactgcaattttatttggtgataagcacaaatctctactcctcatgacatgaagaaaaagactgaatgtgaagggagtttctgtactgtaagctagattggataatgatggctgtaacaaatcatgttagatggttttcagttggggtgtagaaataggaagatgcaaaggaacaatggtgttggcaaagtcttctttgaatatcagggactgagtcaataaaaaaaatagtagaaaggtggcttttactattgacaaaagccggggtcaaaaaaagtagtttaagtcttaagactgaatatgcattaaagtatgcaggtagcaaagatgtaataaatttgcttaaaaaaagaaattaaagttttatttagaatcaattttacctgtcattgtaattgacccatctgagaattacaataagcaagaggaaattaaggtgttttgcaagagctgtatttatattacagttttttaaaaacattttctgaattatcgtaattaagctctccaactcgttaagtcagaatataatatgaagttccccaaggaaacgaacaaaatgaactctagaatatctagcaaatagttaaagaagcaatttattattagggcatactcgggctgtttccaaatataaactctattgcaatatcttatttcatctttctaatacatgtacagtgcacactagaggatagagctgcatcacttaaattcatgacttaaaaaataatacagtttatatacaacttgttttttatttgattaagaagtgaagtttacgccacccaatgtatagccaaattgtacgtgcttaaaaaacagtgccgagagtatgttcagttcgcagtaagtagatttattggaataaatattctatggtacattctcagaaattggcttccaactaaaatacgtttgacccattttgaataaggaaattgaaaagaaaaatttaaaaggagaaaaaaatgcatgtttataaactttttaaataaaaccagaccttgtaagtggacattaataattgtcctgcctcatttgttttcacgactttgacaacaagaagttcctgaacattagtcatgtatgctcagaataaatgtgactttgaaatatatgttagctactgtacatgtatagtcagtcaagtagaagaggaccttcctgaaattcccacttgtgacattttcccatgggtttcctacacaatcttaaattttatttctgtctatactttctcaaatttttcctatgataagttcagttgttggtactcttctaaaaatattcaacgtgattaggatcagttctaaaatacgggacccctttgagtgacaattcgcactccatgcattattggctcagtagccaatttttgtcacgtcgttataacaaggagatgacataattaaacatttccatcctttctattccctgagactgcatcagcacaggcaagtatagaatgtaatgttcttcatgggccccaccagctttttggtgccatgtaatttatttcttcgctgaagagaaaaagaattctgagacacagttattaaaccctttatcaactttctaccatcagtgcctgaattctaatgcagtgtgatttctctgggacaaagagactgaggaagatgaaaagtttcttcaaagagtgaatacatacttattcacaactctaggatgtgaggactttaaatatctctttatgaagttccctgcctaacctctttctatttaaaggcaaacaaatttcgaagaggttttgtgttccctctttatgtttctctatgacccagtttagtctaaaaccttagttcattacatatacaacacatagcctttgatccctggtaactggcaggtgttggtgattaataaaccaaggcttcaaagtgaagtatgtgtgtgcagatgacttttggaataacgtgggcatagcatcataccttcctgattgtcttcagcatataaaaattaactgttgtagttaaaattatgtcagtgcagagcttgtggttacttggaatgttctttcagaatagtccatgttgcctattaaacctagttttaaacacattgggcagtcaatttatgcacccaaaatatcaccctcaggtagattgagggcaagataaaatgctgtatgtagctatacaaaggaattcagaaacattactggaaagcaaagcctttgtcagcttgctactgacaaagtagtaaaaagctactaatcagtgttgagtcagatgtcaacagaaaaatacaaatacctatgagagccacagcagtttctcgtttcatagccgattcaatgaatatgattagaaattcactgagctcactcttgcaggtttaaatggaggcctgcataaggactgcaagaggaaatctgggtgggagagaatgtaatctgatcttgcactcataggcaatgctgcaatgcaatcatgtccaatacaagcacagcttcattcataacaggaaacgtcttctttgggaaaatagctctattggtgcccaaactcaggtatgccagtgtatgcaggtggagtcgccctacccctcttccaaacatgtcctgtgagatttttaaaataagatgggatagtacaggggcatgaaaagaattgattccttcacaggatttgaatccagttcaagggagaatgtagaaaattcaaaaccaacatataaggtatcacacaaccaagaaaagtaaaaccattgcaagtttacttgcgttgagtacaaaacagatttaatggtgttctatgtcatagtttaatgctctgggtatttaaatatgttttcaacaggatttgagttgaaagtttgtaatgtgctttgatggaacacctctcaatttctattcaataaacttatgtaattgtccattgacaatataatgataacagtaccattgaactctaaactgtggtttatcttcactactgggaagcaactgtgcatcagtattaaagatatgcagaaacataatattcactaatttgttcatctgcttctgtatattgtttatggaattacatggcaagaactgttctaaagcaacatgtctttccacattattttagaggtgaaattacttttgttttgcttctctataatgtgtacttcaaatgaaacaccatacttttttctaaaaaaagatgttcaatttactaatttttttaaatctcataatttaaaaagcatttgttgtgattttaaagtgttgcaagaaaagggattttgtggccgtgggtagactttttatactttgttttatagatggattttttttaactgtagtttgtttaagtcaccaagcagcatccaaaatcttaatgtgtttcatttgatgttgttagatcagagaagaaattggcataaaatcggttaatagtattgtcaaagaattgtgtattgtgtactcactgggaaaaaataaaatatattcacatttcaa

SEQ ID NO: 145 - DNA, 68515 bp, Homo sapiens
caaaactgcccacctatctgtgaggtgcttcatccctgcagtggaagtgaggaggaagaaaggtgaactccttttctcaagcacttctgctctcctctaccagaatcactcagaatgcttcccgggtgtatattcttgatgattttactcattcctcaggttaaaggtatgtcttgctctttttatcaggactttcttattatgctgtgaggttgtgtctctttagtcacaaactttaaactgtaagtgataaaaacattaaacgttgatgatttttctgagagcttcgactagattacagctaatcatgagactccatgcatctgtgtaatgccatatcactcttgaacattctgacccacagtgaggaggagaaaggagtggacaagtactgcatatctgcagcatggcaggcactgtgctggccattagctgctttgtatgttaaagtgtttaaaatttgaaattaatatctccactttacagataaggaaaatgagactatttacagatcagagaaattaaatatgctactgctggccacacaataaattggtaaaggcttgattcaaatcagagcatattccagaaaccccatgccctctcctttttattgctctttaagtatcacaccttaattaagcagggctcatctcacagatgactatcaaggtgataggacatgaatagaagattatggttggcactgatgcagggctacccaaaattctttaacaggtaaaggtcttatacttaactacgaaaggtaagactttaaatgcaaacatccctggaagaccaaattcagtaatttacattcaaacaggacaacagtgcaggctttgacaggagacaaaatccagaggttggcatgaggataacaaaacgacaactgcaggccagacatggtggctcatgcctgtaatcccagcactttgggaggctgaggcaggtggatcacctgaggtcaggagtttgagactagcctggccaacatggtgaaaccccgtctctactaaaaatacaaaaattagccaggcatggtggtgtgcacttgtaatcccagctacttgggaggctgaggtggaagaatcgcttgaaccggggaggcggaggttgcagtgagccgagatcacgccactacactccagcctggctgacagagcgagactctgtctcaaaaaaataaataaatgaaacaaaaaataaaattacagctgcagaacatggcgaaaatatggaggaaatggagggacactgatttctttggctcctttccaagtttccttatattctcctgatttgtaaatatcagtgtcaatttccttgccagtaaagtgggaataacatttcatagtgttgctgtccatggctgctaactgggggcaaatgaactgtattagaacaattctgtttttcagccgctgtagacgaatgttaatgtcagacggattttttcctcttatgtttcctcgtagaaaagttcatccttggagtagagggtcaacaactggttcgtcctaaaaagcttcctctgatacagaagcgagatactggacacacccatgatgatgacatactggtacaagttttgatttagtaaataagatttgttgctttcacaggcatgtagacagttgtctctagctccaaccagaagcaaatagggagagaggagtttcaatttttctaaggactcccattcggcatacaccatgtgcttgggaataagcaacccctcaatgggttagaaaacagaaaagagtaaagcctgggtttagggaataccattctaaattttccagtttatggagttccaccaacagctttcaggctgacttataacaacctcatttgttctgagccggtgcctggtgaatgtcatcttgagcatgttactttcccagaggtctggtatgcaaggtttttgtttatagagtctgcagcaaagatgtgcaactttcagaggaactcaaaggcctgcttggtctgttgctcagaagggtatttattcagatattaacaattaaataaaaacttgaaagattactttcaaaagtaacgaatgcttattatagaaaatagataatatatgtaagagggaacaggcttgaaaattaagatgttttcaatttccactgttataaaagacattagatgaatgtccttaggtatttatcattaggcacttgatttttaagccttaggttttaattgggctcatagagaatactgacaggcacgttgcccaaacgtactatggaaatccaaacccttcccaatgaatttcttctgtccaccattagagcagccagtttttcaagttctcacttgttaggtttctcagtcataaattagatacacttcacttttctaaacagtcccactgagatctgtttcctatggcttgagatgattaaaataaaaagcaactctccgtctcctcccgtttggaagtaatatgtaactattttgttcaacgattctctttaatatgcgactctattctcactttctcagactttgtcttggctgaagattggtactcagctaagggggctttcaccagctttctaccacccactgtgcatacactggtggcgtcttctcacgactactgtcctaagacttaatcaagactgatgttaaaaatctcattatggctgggtgcagtggctcatgcctgtaaccccagcactttgggaggccgaggagggcagatcacgtgaggccaggagttcaagaccagcctggccaacatggtgaaaccccatctctactaaaaatacaaaaattagccaggcatggtggtgtgcacctgtaatcccagctactccggaggctgaggtgaatcgcttgaacccaggaggcagaggttgcagtgagccaagatcatgccactgtgctccagcctgggcaacagagcaagactctctcaaaaaataaaaataaaataaaataaaataaaataaaataaaataaaaatatcattatgaatataccagataagcttggataagggcaaggaatataaacaatgaacctaaagcttcttgtataccagaatatgctcaaacagacaaaacaaaattcaaaccacattgaaggggtcttgtcaaaagaattcagaagccaacagaaagagctcccgatggccaaagctgggataatgtgaagaacaaaataaataacagctttgtattatgacatgaagtgtaaataaatatcatgagcccatactgatataaataaatgactgaataaataatatataataaataaataaataaattaaataaataaattgaaaaaatggacacttcttctgggagaggaatcaaataatttatgtagatgctgtcctctccagggggtggaacctaaatccccacccattaagtgtgggttgtagattgtgacttccttccaggaagtaccatactgaaggggggaaagagtcattttacagagagaaagatgaaaacaccacctcagccacgtgatcaggtttaacacttgctaagtcctgtggctagtagggtgtaataaaatggcattttctattatggctctcacctcaaaatctgtaacatcagtctaagcatgagaaaaatatcagaacaaaaacaaattgtaagacgccctacaaaatgcttgacagatactccccataaaggtccagatcgtaaaaaaaaaaacacaaaaaaacgaaaaaacctgagaaactgtgagacttcaggaggctaaggagacctgacaactaaacgtagtgtggaatctgggatcagatcctgaaagagttaaagcacatcagggaaaaactaagaagacctgaataactataattaatagtagtttatgaatctgggcttattcgttgtgacaaatagactatagtaatgtcagatgctaataaacagggaaacctgagtgcagagtatatggaaactctgtactatctttccaacttttctgtaaatctaaaatgattccaaaataaaaattaaaaaccaaattgttattaaaaacagtattaatgacacaatttaaaatatcctattaacaatattgacaatattaaaaatcttctaatatttgttaatataaaatccatatctgaatttccaaaaaagttccattgccaccattacacccatacatgcatgtacacatacatgcagacacacacacatacacacctctacacatacaactcatcatgttgcaaaatgtgaccaaaccctttctatctgattaagtacccaccctagtttcttggcctcccacgaaaacaaccttaactaatgcacacttaacattgaataaacacaaaactctccttcccaacctcatagctgaccctcttcagatcctccttgctatagtagcacagctctacaagttaaacaaatcagaaatctgggcttagtcttgactactctctcttactccatctgactatcactgaggcttgtagattctagcatgtaaatgtcttttaaagttatctactgcttactcctctgctcaaatcatctgcattcatcaacagccttaaatggttttcctggctatagtactgagttttgctaatccattatctacaagaagtaaagtactaaaacaccatgcttgctatggcatgtttctgcctagatattttgcttctctttgttcataggataaggcccaaatctttgacttactaggttgaacatgatttactccttcccactttgtcatttcatttctattcaacttacacctgattttccagtaatattgaacctctgtctgttcttcaaatgtgtcatgttccttcctggctcagagccttggcatgtgctgttccctgcccctgacttctccttgtaatatccctggcacagtccttgcatttctcctattatgatgctcattacactccactatgtgtgcttggttatccagtgtttttctctgccaagcagggacttccatgagggcagagacctccaccgtctacaccattgtattttccatattatctctgtgcctgaaatagtagtcattgaataaatgaatgaacagtcatctcaaagtaatgtgcaacatgtatgaccaacaactgtgaatcttaaattatagagaatttttaagaagcatgaagaaataaaataccacaaaagaaactggtgaaagggcatgaatcagaatccatatgaaaactacaaataactaaataaataaaggaaaaatattgatgtgaatgatcatccaggaaaacaatttatcacaataagtcatcatttcattgtttaaaatatttgtattaatcataatatctattattggtaagaaggcaaggaaacagaaactgctataaattgatggtgaggttctaaacatgaccacttcctttcttcatgatagtttggcaatagttataaaagctttacattttttttcatgtcattgaaaatgcagctctgtccaacgacagggaataccccaaaccaaatttctcatagtaaatatagattaaataaatgaagtttcactcacattgtgcttagctgcctaaagacacatactataaaaaatttattaaaataggaaatagtcatgatttatcattgagtgcaaagtagacgaaaaaacagtatgtataaaaatcgctttaaaaatgcgtgaacaggatatctgtgtatagagctgctacatggacatatggtaaatggtgtatccttggatgaggagagaatctgcattttccatttaattgtataactagaaactatatataatatgctatattatattatattaaactatattataacatgctatgttataatataaatagttgtaatataactaataatataaactataatataaaagaataactatatttatattttattctaatataactagaagaaatctagttctaaaatataactagaatgaggtttgtaaaatcttccttctaatattagctctctttcaattcatctttatcagtattttgcattttggctgaaaggactgctgggtggattggagatagggaacattcacccaaagcactacttgctccagaacacactaaatgagcccatgttgaagtcacgtgatgcctcttcttttttagaaaacgtatgaagaagaattgttgtatgaaataaaactaaatagaaaaaccttagtccttcatcttctaagatccaggtaagttctattgtgattccagtaccttatagattttagtaattatggtaagccaattttcgtaaaaactgccagtgaagaggattcctcaatttttatttgcacgtaatctgaatttttcctcttcaaataaaagctcttcatgtgtaagccaatcacatctcaaaagcttaaagacaatcacagatgccactgttctcccgttcctaaataactccctactttgaatacttgcagttttttgagctccatatagtcactctaagaacagggttgatacattactgtgttgggaatcagtggaacaaaagagatgtgaaaaacatggtttttaaaatgacttctaagttgtgtaaactagatatcaaatcaagttccattgcagagtaaactaagaaatgtagcgcatttgcttcgtcaagacatcttgtgtaaccaaatagtgtaattgcaatgtctataactttcttcattggctttcttcaaaagaatgtctattgttgccgctgtttaagtttcattgtttttccactgggccatttctacacaaaatagctctgtctcagagccccagatattaaaaggatgaggagctgtcaaatgctaagcagaaagaaagagtgacactactggggaattgagactttggtctattagctaaaagtaaataacaaaacacacacacacacacacacacacacacacacacacacacacacacaatcccaaaccctccctctattctgaatccgtcaccagacaaatgtgccgaataataaacataatcccataaccatattgataatacatttagactctgcatattttcaccttctcagcatgaaagaagcaaagatttattgagagatttctatctctgttactttttaattcctgaaaaatgtatatgagacagatattgtttaatttacactttgctgaggaagaattataggtacaatgaaaagataacttgtccagggtcacaatactcataagcacatgatgatgcagatggtctgactgaagagttccaagttaccttcacaattaccccaggctgcctaggcctctgagtcaatttcattgtattagccactgcgtaattctgctaatcagcctgtagtggcatgttagtgaattgtacacacagagagcagtttaatctaatttcaacatctgtaataggcaacactgcctcattccctcagttctacaaagtaaatgaatttagtgcataccacagagcctctaaatctgtgaatattatgtgattggatgtttttgtaatacagtaacaaacagaaactgatcttattaatttagatttctatttgtctttctctccatgaccacacttttcaacatttcccctctaagtttcattcagcttgtttattattattattattattattattatactttaagttttagggtacatgtgcacaatgtgcaggttagtttacatgggccatggtggtgtgctgcacccattaactcgtcatttagcattaggtatatctcctaatgctatccctcccccaaccccacaacagtccccagtgtgtgatgttccccttcctgtgtccatgtgttctcattgttcaattcccacctgtgagtgagaatatgcggtgtttgcatttttgttcttgcgatagtttactgagaatgatgatttccaatttcatccatgtccctacaaagaacatgaactcatccttttttatggctgcatagtattccatggtgtatatgtgccacattttcttaatccagtctattattgttggacatgtgggttggttccaagtctttgctattgtgaatagagccgcaataaacatacttgtgcctgtgtctttatagcagcatgatttatagtcctttgggtatatacccagtaatgggatggctcggtcaaatggtatttctagttccagatccctgaggaattgccacactgacttccacaatggttgaactagtttacagtcccaccaacaatgtaaaagtgttcctgtttctccacatcctctccagcacctgttgtttcctgactttttaatgattgccattctaactggtgtgagatgatagctcattgtggttttgatttgcatttctctgatggccagtgacggtgagcattttttcatgtgttttttggctgcataaatatcttcttttgagaagtgtctgttcatggccttagcccactttttgatggggttgtttttttcttgtaaatttgtttgagttcattgtagattctggatattagccctttgtcagatatgcaggttgcgaaaattttctcccattttgtaggttgcctgttcactctgatagtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggctttaggtctaaagtttaagtctttaatccatcctgaattaatttttgtataaggtgtaaagaagagatccagtttcagctttctacatatggctagccagttttcccagcaccatttattaaatagggaatcctttccccattgcttgtttttctcaggtttgtcaaagaccagatagttgtagatatgtggccttatttctgagggctctgttttgttccattgatctatatctctgttttggtatgagtaccatgctgttttggttactgtagccttgtagtgtagtttgaagtcaggtagcatgatgcctccagctttgttcttttggcttaggattgacttggcgatgcgggctcttttttggttccatatcaactttaaagtagttttttccaattctgtgaagaaagtcattggtagcttgatggggatggcattgaatctgtaagttaccttgggcagtatggccattttcacgatattgattcttcctacccatgagcatggaatgttcttccatttctttgtatcctcttttatttcactgagcaatagtttgtagttctccttgaagaggtccttcacgtcccttgtaagttggattcctaggtattttattctctttgaagcatttgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatggggttttctagatatacaatcgtgtagtctgcaaacagggacaatttgacttcctctttcctaattgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatggatagctcttattattttgagatacatcccatcaatacctaatgtattgagagtttttagcatgaagggttgttgaattttgtcagaggccttttctgcatctattgagataatcatgtggttttcatctttggttctgtttatatgctagattacatttattgatttgcgtatattgaaccagccttgcatcccagggatgaagcccacttgatcatggtggataagctttttgatgtgctgctggattcggtttgccagcattttattgaggatttttgcatcaatgttcatcaaggatattggtctaaaattctcttttttggttgtgtctctgccaggctttggtatcagaatgatgctggcctcataaaatgagttagggaggattccctctttttctattgattggaatagtttcagaaggaatggtaccagttcctccttgtacctctggtagaattcggctgtgaatccatctggtcctcgactctttttggttggtaagctattgattattgccacaatttcagagcctgttattggtctattcagagatttgacttcttcctggtttagtcttgggagggttatgtgtcaaggaatttacccatttcttctagattttctagtttatttgcgtagaggtgtttgtagtattctctgatggtagtttgtatttctttgggatcggtggtgataacccctttatcattttttattgcgtctatttgattcttctctcgtttcttctttattagtcttgctagtggtctaacaattttgttgatcctttcaaaaaaccagctcctggattcattaattttttgaagggttttttgtgtctctatttccttcagttctgctctgattttagttatttcttgccttctgctagcttttgactgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcattatgtacccagtagtcattcaggagcaggttgttcagtttccatgtagttgagcggttttgagtgagtttcttaatcctgagttctagtttgattgcactgtggtctgagagacagtttgttgcaatttctgttcttttacatttgctgaggagagctttacttccaactatgtggtcaattttggaataggtgtggtgtggtgctgaaaaaaatgtatattctgttgatttggggtggagagttctgtagatgtctgttaggtccacttggtgcagagctgagttcaattcctgggtatccttgttaactttctgtctcgttgatctgtctaatgttgacagtggggtgttaaagtctcccattattattgtgtgggagtctaagtctctttgcaggtcactcaggacttgctttacgaatctgggtgctcctgtattgggtgcatatatatttaggatagttagctcttcttgttgaattgatccctttaccattatgtaatggccttctttgtctcttttgatctttgttggtttacagtctgttttatcagagactaggattgcaacccctgcctttttttgttttccgtttgtttggtagatcttcctctatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggttattttgctggttagttgatgcagtttcttcctagcctcgatggtctttacaatttggcatgattttgcagtggctggtaccagttgttcctttccatgtttcgtgcttccttcaggagctcttgtagggcaggcctggtggtgacaaaatctctcagcatttgcttgtctgtaaaggattttatttctccttcacttatgaagcttagtttggctggatatgaaattctgggttgaaaattcttttctttaagaatgttgaatattggcccccactctcttctggcttgtagggtttctgccgagagatctgctgttagtctgatgggcttccctttgagggtaacccgacctttctctctggctgcccttaacattttttccttcatttcaactttggtgaatctgacaattatgtgtgttggagttgctcttctcgaggagtatctttgtggcattctctgtatttcctgaatctgaatgttggcctgccttgctagattggggaagttctcctggataatatcttgcagagtgttttccaacttggttccattctccccatcagtttcaggtacaccaatcagacgtagatttggtcttttcacatagtcccatatttcttggaggctttgctcatttctttttattcttttttctctaaacttcccttctcgcttcatttcattcatttcatcttccatcactgataccctttcttccaattgatcacatcggctcctgaggcttctgcattcttcacgtagttctcgagccttggctttcagctccatcagctcctttaagcacttctctgtattggttattctagttgtacactcatctaaatttttttcaaagtttttaacttctttgcctttggtttgaatttcctcctgtagctcggagtagtttgatcgtctgaagccttcttctctcacctcgtcaaagtcattctccattcagctttattccgttgctggtgaggaactgcgttcctttggaggaggagaggcgctctcctttatagagtttccagtttttctgctctgttttttctccatctttgtggttttatctacttttggtctctgatgatggtgatgtacagatgggtttttggtgtggatgtcctttctgtttgttagttttccttctaacagacaggaccctcagctgcaggtctgttggtgtttgctagaggtccactccagacctgtttgcctgggtatccgcagcagtggctgcagaacagcggacttttgtgaaccgcgaatgctgctgtctgatcattcctctggaagttttgtctcagaggagtacccggctgtgtgagatgtcagtctgcccctactggggggtgcctcccagttaggctgctcaggggtcaggggtcagggacccactcgaggaggcagtctgcccattctcagatctccagctgcatgctgggagaaccactgctctctttaaagctgtcagacagggacatttaagtctgcagaggttactgctgtctttttgtttgtctgtgccctgcccccagaggtggagcctacagaggcaggccggtctccttgagctgtggtgggctccacccagttcgagcttcctggctgctttgtttacctaagcaagcctgggcaatggcgggcgcccctcccccagcctcgctgccgccttgcagtttgatctcagactgctgtgctagcaatcagcaagactccatgggcgtaagaccctccgagccaggtgcgggatataatctcctggtgcgccattttttaagcccgtcggaaaagtgcagtattagggtgggagtgacccgattttgcaggtgccatctgtcacccctttctttgactaggaaagggaactccctgatcccttgcgcttcccggggtgaggcaatgcctcgccctgcttctgctcgtgcacggtgcgctgcacccactgtcctgcgcccactgtctggcactccctagtgagatgaacccggtacctcagatggaaatgcagaaatcacccgtcttctgcatcgctcacgctgggagctgtagaccggagctgttcctattcgtccatcttggctgccctccccctcagcttggttttaataataataaatacttattttataaactcatgttgagaaatagcgatgaatctttctaggacaacaatgttaaatcagattgtacattcattctgtggaaacgttgattgggtcaattttctgttcgctataataaatctattaatagatgaagagttttatttgtatgtgcgtatgagtcaccagaaatattaatttagaatctactatacaaccaagcagtttattatatattttatatatgctatttcaaaacaaccacaaaataattatattctatttacctgttgcatctagttaatgttcccaaaaagtttactatgataaaattttaacacacagagcagaattgaaaaaaatccatatacccgctaacatatacatatacccatagatccattaagttacacatattcactaatattttactatttctgttttatatcatctttctcatctatccattcatccatcaatccattcatcctccatgttatttttatgcattttaaattatattacagacatcagtttactttcccctcaatacatgaacaaggttagcattagagtttagtatttgtttttgtttgttttgagacacagcctcactctgtcacccaggctagagtgcagtggcacagtcatggctcactgtagccttgatctcaacctcctgggctcaggtgatcctcccacctcagcctctcaactagctggaactacaggcacatgccaccacacccagctaattgtattgtttgcagagatggtgtttcaccctgttatccaggctggtctgaaactcttaggttcaagcagtcctcctgccttggcctcccaaagtgctaggattacaggcatgcaccactgcacccagcctaatataggtttacactgaattttttctttgtataacattttcataaaatgaaatgcacaaattttaaatgtccatctacatatttgttgaattttatgtatgtatgtatgtatgcatgcatgtattcacttattgtaatttgacaaactatgattgtatatatttatggggccaaagtgatgttatgattcatgaatacaatgtgtaataattaaatcaagctaattaacatatctatcacctcaactacttatttttttttttgtggtgcaaacacttgaaatttactctctaagattatttactctcactattattaagtaaattcaccatgcggtgcaacagatcccagtaaaactcaaactaacttactcatcccatgtaacttgggctttgtaccctttgaccatcatctccacatttttcctacagctccagtcactggtgaccaccattttattctctgcttctatgagttcaatttttctagattccacatataaatgagattatgcagtatttgtcttcctgtgcctggcttttttcatttggcataatgttctccaattccacacatgttgtcataaatgacagaattttcctctattttaaggccgaacattattccattgtgtatctttaccatattctctttatctattcatctgtcgatggacgcctaggttgattccataatttggctattgtgaatagtgttgcaatgaatatgggggaggagacatctttcccacatagtgattccaaatcttttacgtaaacacccacaagtggaattgctgggtccatccattgagctctggcaaatgcacatatctataaaactcctataaaaatacagaactaacactcagaaaagttcttcatgcttctcctgagtcacctcctctaaaaatctgtcctgggaattttttttttttttttttgccgtagattacatttgtccattctggaaatttttaacacaagaatcacactacatgtactcttttgtgtaagacttttaaaatttagcatactgatattgagattcattcatgctgctgcatttatcagaggtttgctttctttattttcttgcagtattctgttgaataaatatactgcagttcgttcatccactctcctattgatagacatgtgggctgttttcagtgtttggctatcattagtaaagcttctatgagtgttcatgtacagcctttttataaacatatgttttcatttctctttggtaaacaccaaggagtgatattcctgagtcacaggatatgtatatgtttagatttatagaaatctgacagattcttttccaaggtgtttgtcaaattttagtaactaccagcaatgtatgagaatactacctgctgtatgtattcctcatcattttatactgtcactttaaaaaattttagctatactagttgtaatatttaactattattaaatgttatgtttcctgttgaaaactttatgtgcttatttgatcatttgtatatctttttaatctttaaatatttacccatttttattggattgtttgtcctgttattattgagttcgaggagatttttttttcctcactctgtcatctaggctggagtagagtggcacgatcttggctcactgcaacctctgcctcctgggctcaaatgattcttgtgcctcagcctccccagtagctgggactgcaggcatccaccaccatgactggcaaattttttgtattttagtagagatggggtttcaccgtgttgggcaggctggtcttgaactcctaagctcaggcaatccacccgccttggcctcccatagtgataggattacaggcatgagccactgtataatttggagaccagcccttagtcaaatatagttcttgttatgtttgttcctgtctgtgaccttttaattcatttctaaaaattgtgtcttttaacaagtaaaaatttataattttaaataaattttaatttatcagtttctttctttatggtcatcattttctaggacctaagaaaaattgcctaactgcaaatcacaaatatattgtatgtttgcttctaagctcttcatagttttagcttttagttttggtctgttatgaccttaaatttgtgtatgtgcatatgtgtgtgagtgtgtgtgtgtgtgtgtgtgtgtgtgtaatttgctggagaagtcaatattcttgtttttccctatttataggcaattattccagtccattttgatgaattgtctttctggtgctattggattactttggcaccttcggccaaaatcaaatgactatttcttggctctctattctatcttattcatctatttacagtctgtaagccatggccaaactgccttgattactgcagctttttagtatactttgaaggcacaatgtgtaactcttctaatcagaattgtttatttattctaggtcctttgcatttctatataaaacttagagtcaccctggcaatttctattaaaaggcccgctgcaattttactgaatttcattttaacttactgactctatagataagtttggagagaactgacatctcagcagtgttgagtattcacgttataactcatctactttaatgtttatcaacatcttttaaagttttcaatgtggagctctcacctgtcttgttaaatttatttctttatatttactatttctggtggttatataagctgaattgtctttattatttcatttttctatgatttgtgtctacaatataaaagcaaaatggattattttatttaggctttggatttgagaagcattagtaaatgaatttattgattgttttgtagagtacttagaaatcttctaggaaatttaccatcttgtcatctgaaaatactgatagttttgtcttcctctctgattattctttcttttatttttatactttattttatgacaatggctaggaccttcattacaattttactggaatgagtgagggcagccttacacttttcctgatcttaaagggaaagtgttcagtattaaatgattaatatgacagtacctgtagatttgtcattgatatactttatcaaattaaagttccttgaaaagttttttgcaagtattctgtctgaatccattgaaatgtcgatatggcagtgtacactgatttttgttcattataccttatatattattttataataaattattttatttaatttgccaatatcttattaagggtttttgaaattatgttactgatggctattctgtgtttttagtttttgcaatagatttgtcaaattttgatgatagattatgttgtgcttctgagttgggaaatattctctcctgtattttcttaaaaaagttattttcaaagtgtttgacagaatttacaaaggaaactgcatgtgccttgagcatatttgtgtgtatgtgtaggaaagaggttttataaccaattcaagtttacttataaggggttattcaaagtttctattttatcatgcatcagttttaaattacagttttcaaaaaaaaatgtctatttcacttaagttgcccccttttttggcataaagtgtttcataatattatcttataatttttaaaaatgtaataatttatttagtgataactctttttaaatttctattattggtaatttgggttcttcttatatgatcaatctaaaaggggctatcaattgtcgaccttttatttatttatttatttttattttttgtttttgtttttgagacagagtcctactgtatttcccaggctggagtgcagtggtgcaatcatggctattgcagcctcaacctcccagtctctaggcatcctcccacctcatcctcctgagtatctgagactgaagccatgtgccaccatgcctggctagttttttaaaaacctttttgtaaagatgggttttcgccttgttgcccaggctggcctcgaactccaggcctcaagcaattctcctgccttggcctcccaaagtgtcaggattacaagagtgagccatcatacctgacctgatttttctttagctttgtgaataattgtaattggttgtctatttatttcactgatgtcttttatcgtttgtattattttctttattattcttattgagtgtttatttttctctggttatagaaatatttaatattttctaagtatttaaaatattgaagtcatagcatttctctcaagtcttcatttagatacatctcaaaagtcttgattttttttattatcattcatttcaaaatatttgatttcttctgggatttcttctttgagtcatgaattattttagagcatgttatttaattaccaatgtttggatttgtttgatttttttaaaatgtatctttgggccaatcatttgtgtattttgcagtttgttatctgatattaacacagctattccagccttatgtttactatataaataagatactattcttttattcatttcctttcaacatatctgtgtctttacatttaagatgtatcttttgtaagatggaaattagtttggtcctgatttttaatgccttctaataatctctgatttttaataggaatgttaacattaacattgaatgttaatgttattattttttaataggttaacatttaatgttaatgttaccgttcctattaacattacattaaatgttatgattggcatggttggaattatttcttttatgtttatctcctctgttactatcctttttcctttgatctttggcttactttatttttcactttccctgctggcttcttattaatctcttaactttgtaacaatgactctctacattagatttaattttcattttagagattgcagcatatatttacaattaatcattaagttatagttaatgtcatgtcattttatgtgaaatgtaaaaacattgcaataagttcatttacagacactccttatttgtgaaaagttgccatatatatatacatatacacatatatatgtgtgtatatatatgtatgtatgtgtgtgtgtgtgtgtatatatatatatatatatcccatgatgcatgactataatttggctttaaacatttatatgtatcttatgtgaaaatatgttttagtttattcatttatcacttcttatctctccctttttgttacaggttcagtttttttcatgtgttacaatttcattgagactaaagaacttttaccaatttttgtagcatagatctgtggcaaaaattcacttcagttttattttatctgtaagtctttgtcttccttcttgaaggctatttttgctgcatataaaattctgggttcgccaattttctgtatgctccaccttctgggttcacgccattctcctgcctcagtctcctgagtagctgggactacaggcacccgccaccacgcccagctaatttttggtatttttagtggagacggggtttcaccatgttagccaggatggtctcgatctcctgatctcgtgatccacccgcctcagcctcccaaagtgttcggattacaggctgagccactacgcccagccggttttctgtatttttttaagaaaagatgatgactgatgatgttctcctcttctggctcacatagtctctaatggaatgttaatggttgtacaaatttctgttccccagtatgtgtcgtgttgtctttctcttgctggttttgagattttgtctttatttctgatactctgcaatccgacagtgatgtgcaaaggtgtgactttcttctcgtaaatgctgtttgatgttttctgaacttcttgaaattataattcatgtctttctccaaattgggttcattttttgctactacttttccatttttttttctgataccctttctccactttccagcactccacttaatcagtatgttagtcttttgatgtaatctacatagctctgaagctcttttttttctgtctctttttcaggttaggtaatttctattaatctctcattgagtttgtcaactcttttatcagttttgttcttattttaaggatatcaagtaaaacttatctaggtagtttttagctataacattttcaatttgtttttaaaaaatataattccatttatctgccacagttctacatttttgcatgcattgcaaataactttcttttactttgctaagcatagttatagtagctgctttaaaagtcttatctgtaatttcaacttctagattaacttgagataagcctctgctgatcatcttttctcttgacgatagttcaatgtttcatgtttcttcattgtgtaaatttgaattatgaactgaacaatctgaatgttgtgtgaaatggactccaaattctgttacgttctgctgaagagttctcatattttcattttatttggagattaactttgttggacttaaacggcaaattctgtcttttgggtggcatcaaattttagttcagttgttttattcttagcatggctacttttaatctatccttcacatgtcatagttcagggaaaattctgaatttgagactgagtttgtttacagaactgaggattctccccgctctctcatttttttccatgattactgtgtacattcctgttactgtgattactccaaactctgttatatggcttttcaaataagaacaactgtggttttctagcagagttttatccgtcctctataaggcagacttcagcctgacctcaagctaaatgctgtaaaactggaaacttcatcttatgctgtgccttcttcacctctcatgctgtgccttctcccctgagcctccttccctttcccaaaggatgctgacatcccttcagagtctgcctgcttttgctcggtacctagatccttgaggtactttctttttatgtattatccagaactaaatatttatacatggaatgtctgtctagtagtagcttattcagccataggaggaatgaaatgctatatttagttcattttaaacattagttcaccatttatttttttgaccactcctaatattccaaatactatcttaaaaactggaagacacaaataaataaaaatgaaaagtccttttcctatggtagttcacaggtaacctttgaagactgacatgaaatacatcatgggtgaacaaatgataattggtacaccaaattgggcatgttttctattaatgtataccccttaatctaagagtaatgttcaaaatttggaatatttggagtaaaaacagcagcaacagtaacaaaaaatgaaacaaagaacatgtaatagcagccacatatatggccaatatagcctcgaatgcttattgtcttcacctgtacagaaaaagtttgctacatttttattatgtagcaaacatgaaaatgaatatcttttgaagtgtgaaatacaccttatgaagggatctcaaaatctgcttgatggagtcaggatgtgtgttttgcactgagttttgaagaacttctagaagattcttatgttcaggttgggatcaagaagtggccatgggtagtccaaaaagatgttcaagaaaaaattattcagtgacagttgttaaagcactgtaaggcaggctttattcaggcccatcactatagatatagagaccactgcaatggtagggtcttgccatgggggagagagattgggctcaattccaaatacagcatgggtagtgtgaatttattataattaatacatattacttttatctaaatatgtagctgttaggttactatatattaagacgtactcgccacatatatcttatgatgtgatgaatataagacatattcatcacatttattaatgcatgttttttgcattaattttgatctctgatttttgcttagataacattttctccaagctattttaaaaatactgctttgctaaaactgccagaatctattttctagcttctctacagtctttatgaaccatgatatttaagtagaaaggctcttcatatgagtgggcttgattttgctttactatttctagcggaagaggatcttgctgagatttggaagcaaactggacacttctccatcacattataggttttatctgtcaggtttttagaacgaacaaatctcaccacctgtctgccctctttttcagggagttcctaggctcaaattacagtgaaacattctactccatgaaaggagaagcgttcaccaggcatcctcagatcatggtatcttatggaactttactgtgtctcttctctaaaagcagtatttcctgatgtgattttgaaaccctgttctagctgtacaagctgtttcagaaagtactacatcagaaataagctctgaattgattactctcactgaaaaattatagtataaaaatacgattgtgtggaccctaacctcttactgcctaacaagcaaatcaatgactgctaatatagctttgcttttcctaaactgatttctgtacactcaatatggtgttaagtctaggagagggtaaagcaggacaccaaaaatataaggcaccttatgaggctgtgatcaagctaaacggataaaatctgaagctatgaaacaactttaaaatctccattaattgatccttatgtgattctcatccccttgcccggtttttctgacgcaccaatgttgaggtcttttcttcaatcctcaaatgaatttttgttcatttattattattattccattaattttaataaaatctagatacagattttatttttacatccccattgcttttttccagaacatgtcctctgtaaccttctaccaagaacattacttttaccaaacctatacatttaaaaaagtatttcctccatttaaagcaatggtgaactttgttttgttttgttttgaaacagagcctcactctgttgccaggctggagcgcagtggtgcaatctcagctcactgcaacctccgcctcccaggttcaagcgattctcctgcctcagccatccaagtagctgtgactacaggcgcatgccaccgtgcccagctaatttttgtatttttagtagaggcggggtttcaccatgttggccaggatggtctcgatctctccaggctggagcgcagcggcacaatctcagctcactgcaacctccgcctcccaggttcaagcgattctcctgcctcagccatccaagtagctgtgactacaggcgcacgccaccgtgcccagctaatttttgtatttttagtagaggcggggtttcaccatgttggccaggatggtctcgatctcttgaccttgtgatccacccgccttggcctcccaaagtgctgagatgacaggcgtaatctaccatgcccagcagcaaatgtcaacttctatgagagctaagtcttcatgcaatcttcaaaacaggacaagaggaaaactgggtaacattcttttatgcagggggtgggttatttgtgagggtgtgaggtccctggaagaccacagaaagtgtcatccatagggaggattttaacacatggaaatgatgggaaaaataattacctgattggactaccatgggcagagcatcaagtagggagtaataaagacaccaacttgattgaaacagagaggctggagagaaaggctagtttcgtaaaaattttagggtggattaaaaagtaatatttctaaggaaaaggtcacaattctaaaactactgtcgtcattaacagactattaaatttgtagaggaagaatctatactttgctttacacaacataatcacataattaaggtaaaatgtctctgaagcaggctcaaatatttccaaatgaaagaatttaatgaatgaatgcagaacaaatatcaatgcaatttgtcaaaataaaacattgatatattctgaacagaaaatatttagatattagtatctatataaaatcaatatttatacatatagtaatagagtcttcttctattttaggatcattgtttttaccaaggatccatagtacacgaatatgattcagctgccagtatcagtacgtgtaatggtctaaggtaatgcagaatatctttctttttcctttatgagttttcctatggattttcaaagaagttaactttgttgattttgttttatcactcctggtatatagaaaaattaatgagaaaaaagctgctgtgcatttttagcagtttcagctgtagcctatgatttacattttgacaaagagatgcctaatgcatagtcctgaacaagacaagctttgcagtatatgaataagggattcatatttggaagattactgaaaatcatttagtctgggctctcattttatagatcaggatactgactgaaattagaagctttctcctgaatattccatttgctagtggtaaaattgagcctgaaacccaggtcttttgaaggctagttttgtgaattcccattatgccgtaaggcttgactcttttagctttttactaaattgagctgtgtttgcagcctcttgaaagtaaaaattcagaagtaaagcctatagttctctatagatcataggctcatggacaaagaaagatgatgtggagaggtaaagaggaaaagaacaaggaagttctgtctttaattacgggaaatttgcttgactagttcttagtgttttcaagaatgagaacccctttaatgacacagttaccacatattagtatttttactttcatatatttactttcatatatattccatgtcatgatagacatagaaactcacataatttttgcaataactcttaagacttgacagcggtccacaaccaccagtgggacttgctacactacctgtactcaaagcagatattggactgtgaaacttctgaaaatctagtaagttgactcttagaaaaaagtattgattcagtcaaaggcctcatatcatcacatttccttaccactgaaagcactctcctacctgttcatgaagcactggctttgtggtttctctttcttgaaaaggcaaagtcaatacaatgaaatagagtaattataggccttgaatacaaattgtgttcccaatttctacaggggattcttcagaataaacgaccaaagatacctcattgaaccagtgaaatactcagatgagggagaacatttggtgttcaaatataacctgagggtgccgtatggtgccaattattcctgtacagagcttaattttaccagaaaaactgttccaggggataatgaatctgaagaagactccaaaataaaagtgagtactttattattatctttaccccaaatgaaacaccttttattttcttgatgatgtctagggataaagtatgagtccagttactgaaatatatgtgctactttcagtctggcacttcatctgatatttgaaattggaaaattttttcttgtctatgtaaaaagtgtttatttcatagagtttgtttaatcagtttcaagaaaggatgattctacaattctatgtatagattgataacattggggctatgagtagttggaaatcatgaaattttcaatgtcctaaaacctaatctagagatagtgtctttccttttcttccctgccatttttttttgcagagttattgatgacaagctatgttctcccctttttatcattcaaatgttttaatggttaaggatgattaaggataaaacaagttcagtttttggtgggatggttgtataaaagtagtccttggagctttaggcttttctatacaactaatccatatccccttaaattcccagtggatgttagtctgtaagctacttggttgtttttcttcttcgtatgtccatgatttgtatagtgtctgacacatactgtatgcctaatggatgtttcctgattgaataaatcaacaaataaatgattacttagtccatagaaaaagatttagccaaatctttgaacaatttacctctgttttgtcctcagagaatatgtacatacctcagcgcatgcacactgaaagctgaatacttagaagaatttcctggtattggtgttttatagacataaaagattggccaggcatggtggctcatgcctgtaatcccaacactttgggaggctgaggcgggccgatcatctgaggtcagaattcgagaccagcctgaccaacatggtgaaaccctatctctattaaaaatacaaaatttggccaggcagtagtggtgtgcgcctgtaatcccagctacttgggaggctgaggcagaagaataccttgaacccaggaggtggaaggttgcggtgagccaagattgcaccactgcactcgactctgggcgacagagtgagaccctgtctcaaaagaaaaataaataaaaataaatttaaaaaaaagatctatgattagcaaaatttgtacatgtttgcttggaattgagactactgaaaattagaaagttgggaagcaggggaaggagtacaagaaatgcagtcagtcctgttggtccacactatgttttaactctcagttacagatggatgtttttcacgtgagcttactaatgaaacacttactcagtaaatgaaaaaaaaaaaacctgaatgttaaagtatgtgtttatgattatttacaactcttatttgacctgaaagcctaaacaaagcattaggaaaaagagctaatgcatgctaggcttaatacctaggtgatggggttgataggtgcagcaaaccaccgtggcacatgctcacccatgtaacaaacccacatatcctgcacatgtacctcggaaattaaaaaataaaattaaatttaaaaaaaagaaaagaaaaaaaagaacaaatagaaaatactaaaatccgatgtataggaccccatgtttaatcgtatagatctcatttagataaattcgtacaatttttatatattcatatgcctccccattttgtatcaatatcaacatttcttaccttgaaaatactaggattttttttccaacttaaagggttaagatagaaagtgttaactatacttcaactgaattttccctaactttacagggcatccatgatgaaaagtatgttgaattgttcattgttgctgatgatactgtggtaagttttcaatagaacatttctctctttattcttccttttggaacttgtagttatcattctagcatagagagaaaggtattctaatcagagttctattctaggctcaaagtcctatttttagcttcccaaaacagacatacataagagattatggggtcctttgccacaatagcagactgacccaaaatagaacacccctccccattaagaacatatggaaatgctgaatgacatacaaaaagttgaaaatattttagcaacctgttgttaagctcaaaagaaaaagtggaaaatctccaagtactaaaaatgaagaagaaaatctctatcagaacagtgagtaaaatttaaaggcttggtgaccccgctatacagaatacaaaaagaggcaattgtaatgtaattgaatgtaaacccctgagaagcacaatactgaaatttggaaatgagacctctgcattattctcagagccataaagggctgcccatctcagaaaagggaactagaaacgctccacagaaactgcaagagataagggaaattttctgtctgcctatagccatgagcaggtaaaatgttacacatgggaaaacaaatctcctgtctgtgttatgcacagatgtgggacatgatattatatatttcttcagatgcagcactgccaagcaaattttttaatataaaaacttattagagaaccgctaaactgctggaagtcaagtcaaaaatgccctaaagtgactcttcaataatccaagataaaatgaaccacatgaggaagagtcaatcaacttaaaaaaaaggaaaataagctcacctggaactgtaaatcatccaatgatatttcagactgtgctgtgacactaaatgttttaaagttattaaagatgtaaaaatgaattaaaatgacactgaaatgactagaaaagactggacaaaacaacaggcatacttgaaaaactacctgttttaacatttataaaaggaaaacgtatatacccttgaaaaaattaaacagaagattagacacatgtgaagaaagaattagtgaactagagaatggaggatatagagaaaccaccatttctccagagaaataaaaagttggaaactgtaaaagagaacataagagacattaattcagaatataaagcttataaagagtgaatgggaatgattggatgacagatgacaaatgagagacaattcttgagaattttccagaaggaaaggaataagcaaatcagataacatggtagaaaaatttctgaatatcaaagacaaagaaaaaatcttttaaaatcaactgtaagaaagaggcagattgactataagtaaatcacaaacagagcatacgttttaaacaacagaagatacagtttctagaaagtaagttcaaacagctaatgaaaaatgttataaaatttaaattgagtactaaagtatcaggcaaggataatatattcggagaaagaaatcatacttaaaatgttctatggaattttagattaggaatgtaaaggtagtcacaattttacacttcataagtaaagtgtgagtattaaaactttaattgtaatcactatgaacctagcaattagaatgtaaatatcccaaaagggtagagggaaataggtggatttgaaaataaaaaaaaaaagaccaatccaacagaaagcctcaaagaaaatacacacttgcacacatacacctacagtcatgcaccacataacaatgttttggtcaacaatagaccacatatatgaaagtggttccattagatgataacaaagcagaaaaattcctatagcctagtgacatcgtagccatcataacgttacagcacagtgcttcactcatgtgtctgtggtgatgctggtgtaaacaaacctactgcattgccagttgtatgaaagtatagcacatacaattatgtacggtacacaatgcttgataataataaaaaacaactatgttactggtttatgtattcactatattatactttttgttgttattttatagtgtactcttattgatatatttaaaaagttaactgtaaaatagcttaggtgagtctttcaggacatattccagaagaaggcattgttatcagaggaggcggcagctgtatgtatgtaattgcccctaaagaccttcagtgggacaagatatggaggtgaagacaatgatagtgatggtcctgattttgtgtaggtttaggctaatgtgtgtggtttttgtcttagcttttaacaaaaaaagtttgaaaagtaaaaataaattaaaaaacagaaaaaagcttacagaatagagatataaagaaaaaatatttttgtacagctatagaatgtgtttgattttaaactgatgtctaaaaaaatcaaaagtttaaaaatttttaaagtttataaagtaaaaatgttacagtacgctaaggttaatttattattcaataaataaaaatatacttgtgtaaatatagtgtagccaagtatagagtgtttacaaagtccaccgtagggtacagtaatgtcctaggcctttatgttcactcaccattcattctttgactcgtccagagaaacctccaggcctacaagctccattcatggtaagttccctaaggaagtgtaccaggttttttttttttgtcatttataccattttttattgtactttttctatgtttgcatacacaaaaagcattatgttacaattgcctacaatattcagtatagtaacatgctctacaggtttgcagcctaggaacaataggctataccatatggtttaactgtgttgtaggttataacatttaggtttgtgtacgtatgctttatgatgtttgcacaaagaagaaatcacctaagaattcatttctcagaatatattcccattgtcaagcaatgtataactatattacatatatacatacacacagaatagtaaatacaaaaacagaaaaaaatatgtgaaggtaattccaaatgtgtcagaaattagagtaaatataacaattacatctgcctgttagaagttagaaagtctcaaattgaatataggaaaaggacattatgacatttataagaaatatacctaaacttctcaagagacctaaaaaatctcaaaactagtttcttctctccaaaaatatatcttatgattttaatagtatataaaagagaatttatgatttaaaaagttatttgagataaattggggaattaatcagaaaaagagcaccaaaaggatacaaaatatgaaaatacctaacaacaaagtataaaaagataacaaaaaaaaaaaaaaaacaggtttgccagaaaagtagggtattttttagctcctctccatcagaaaatgtaaggtcaagaggaaaagcttcagcaaaaatggacaagatttgaaccacataaatgcaagtttcatttaaccaactgatatactaccttgcatttaaaaaaaaagaatatgtatttttttcatgtacaaataacatatttgaaaaaattaagtgggtatctggccacaaagaaaatacatagaaatagcaaagagatatcataagatcactgttttcttttttaccacaacccaattagaagttataacagaaattgttaaattaaaccactaaaagactattggtttggaaactgaaagtacaatatatttccaaatattaattgtctaaaaaatcaaatctgaaattatggactatttataactgaccataaaaaatagtaaagtaaaatttattagatacaggtagcataccagtatttagaaagacatttgtcaatttaaacagttttattaagaaaaaagaaagaaaataaatggactaagagtccaactagagagattagaaaacaaaacaatataaatccaaagaaggtataaagaagaaagtaattttagcaatgagaaaaatcaataaaaccaccaagcaaaacaaaaaataccacaatggagtagttcaacagagccaagtactaattctttgaaaacattaatgaaatagacaagcttctgacaatgctgattaaaaaatatagaaatatatgtaaaattagaagacaaaatataaataaaagttacactttattaaaaatatatgaagaactatgtgccaataaatttataaacagatgtagtaaaatgctatcaagctgactcaacaataggaaaccccaaaaagatttacagcagatttgaaaaattacataagtagtccacaacctatcagcaaataaagacaccaggagcctcagattcgtttagtggcaaattttaccaaagttttttataaacaaacaacctttgtttaacaaagataaataaccttatcttttacaaactgttccacagaataggaaaagaggaaaaaaccccacattttataagtttattataacctttgtattatttatctaccactgtgtaatcaactactcaaaacctggtgggtaatcaatgactcatgcagctgcagtaatctattgtgtccaatggctggctagtctaagatggcctcagtcatttgcctggtacgtgatattgggtttcagctggccatgtatctccaataggctagctagttgtgctttcttgcatcatagctgggcatcaaagcaccaaaagagaggtgaggctgcaatgtgcaagaacttttcaaccttctgtttgtacatgttttcatgtctcaagcaaagtaagtcatatgtccaagactagaatcaacattggaggaaacttataaaaagatatagatacctgtaagagtgattccttgagtcattacagtaacaatctatgacaactgataatattggtaacagatctagacatgatcttatgagaaagtaaaattataagctaatgtcccttataaatgcaatttcaaatgtccaaaaaatatttgcaaacccaagccaagatatatccataaaaatttacatgagagtgacggtttcctccggtaatgtgaatattgctttgctttgacatgaatagatttttaaaaagtgataatttcaaatatctcaaatttatatatatagtatatatttgtgtatgtatacacatacatataattcaacactcattcataataaaactcttaggatataaaaagtggaagaaaataaagtatatttaccaaactcctattcagtataaacattaaacttattaataaaatgttggcagttttcctccaaaattgggaataaggtacatttgttcattgtcaccagatttctttcaacatttttactgaaattcccagccaatgtaataaaaaaggtaagacccatcttaattgaaaagatgtaacagtttttacacattaaagatagaagaaactataattaacctatgaacaaaattttaaatcaaaattagtaagttctaagcactaaacagataggcttacactggcatgttgctgagaaattttataaagaatgctgagacactttgctcttaataataatatatgtgttattaaagaccaagaataggttattaaaatttttactcatatactaggtgaagggttgcttggtgtgattttagttgcattaaactgggctttagtgtatagctcttgctcatgctgctttaatagtatcttaaaatatttaaggttttctttatttagagaagttcctaaggtaaatcatccattttcattagacaaatagttaatgagcattcaatatgctaggttctgagtattaatgatatatatgatagccaaataaaaaaagcagcagaggtcaggtgcagtggctcacacctgtaaacccagcactttgagaagccgaggtgggaggactgcttgagaccaggagtttgagaccagcctgggcaacacagcaagacctcatcatgacaaaaagaaaagaaaaaaaatagctgggtgtggtggtgtacacctgcaatcccaactacatgggaggctgagacaagaggatcacttgagcccaggaggtcgaggctgcaatgagccatgttcacgccactgcactccagcctgggtgacagagcaagaccttgtctcaaggaacaacaacaacaaaaagagcaagaaagcaagagaaggatagaaaatttgagcattgcagtcagataaaataaggaaaccaaaggcagtctttggaaacctgttgagaagtttatatatctccacaataatgaggaattctcagcaggaaagtgaagtgaggatatggatgaaacactgacagctagcaagttgaaaaagaagagcagaacacaaatgtctgaatcctgggaaacacccatcattaaataaagatttggcaataaaagtgcaaagctcatacctaaccattcctcctccctcccctctgattgaaactcactgattgataaagcatctaatctttgtgatccctaaaatagcttcagaatattctccacagtgaattttaggcagtgaattttgggtaatttttatcaatcaatcaatggaaatcctgttgtgaaacacatttgtcatccagcatttaagggataatgggaatgcacaataaaatagtaggagtgtccggggtaatagaaaccaagaagaaatttcttgaaacagaaaatagtcaacattaaatgtggagaagatgaccagaaaggaaaatatgttcacaatgtatttgataattaagagaatatttgtgggttattaagaatagtttcaatggaatagtggcagttataatcagagtgtagtaggttgaatacgtggaagatgaagattgaagagattctaatgctatatcttagcagtattttgatctttaaggtaacaggacagcaatggcatggtaacaagcagatacttgcgggattcaggaaaggcaggttaatttcttatttttattatgaaagaagtttgaccatttgcatttatccctacaggacaccttatgttattattaagtacatttgatcaggtctaaattgataattgatacaagatcccgatagtacaaaaagggaatgcagttataaggagacaacaaaagtcagagtagactggacatgaaaagtctggtttgccctcgtagctatttcctggagggaaggggtagctacagtttcctgtccctcttcagcacttctccagctccagtgggtttttaaattacatattccttattttgtgaacaccaaggacacagaaggactaataaagttgctgttcttcgccatatagattgctttgtagctttaataggtttgtttcatcaatgtgataaaaatggactctaaagaacactaatcagttggtttaataaattaatgcaatgtagtacaatgtaatgtgaaaaggaaacagagttagaaagaaaagcttgaagtaatactacacctaagaatgtctttaggagggctgtatttagttattttatatcaaaaatgtatttaagttgtctagtttttagctgaatgaaaggagttctctttcttcattaggccaatgatttttttctttgtaatagctgatgaatgaagtattttgttgagcttttatgcaactcctattattaatgaatattaatatgatatttatatttccagtatcgcagaaatggtcatcctcacaataaactaaggaaccgaatttggggaatggtcaattttgtcaacatggtaagatttgatacagtttttgaatcaagccaataatacgaatgcaaagaacctttcagcgcagttctctgctggactattgtagttacctgatattaagggagtacaaagcacaaagactaataagcaaaaatccacgggaaaaaataataacaacaaaccacagctctgaattttcaattttcgatgtaagtgacatttaatattgaaataagtttcaaaatttggtctctaatcacaaaatttatgaaccaatgtacaaagaatatgaaaatcaatcactgtaaaccaaatcacactactttaaatcactgctctgtgacgttgtataacaaaaagtcttaagttataatttgttgtccatggtttggcatagaaagtggagtaactgtttcagtaaaatatattaaaatgcttaatttgtctaaattagaatgaggtatataaccctttaaaaaaacaaattgtgaatggcaacacattttttttgccgactcattctaagacacctcagccctattactaggataaagagaccccataagaaaaagctgtaaggaaggcccctctaggccaatggttactaattcaccagttgagggacatttaatctgtttgtagtttttggctattgtaaatacaatggctttaaatatttgtatatagttgtatgtgcaattatagaatttcatttattttttgtaaataacgaagaagtaggaatactgggtcatatggaaagtgtatgcttcctcacaataatatattctttgaaagaaagttactatgcacggctcacacttcagtggaaattatgctcttcctccttgacaatggagcatctacataaattagttgaaatttttctatgcaagagatgtatctcttttcttccattaatatgtatttaataatttatttatatcagtatggactcatggatatttattttgtactttgagttacaacctaacactactttattttgttgctcaaactgtttcagttttgtccattgggcaatattttagctggtctatgtgtcccttgggcataccctcatcagtgtgtgtgtgtgtgtgtgtgtgtggtatttacagtgttggattctctgaacttctgggatctgtgatttgctgttttatactatttttaaaaattattgatcattcaaatatttcaaagaaattgaaatatttcttctgccttgttatctctcttctctttctcatatttcaattatatgcatattagatcctgtgattttcccacagctttggaccttcccctatgtggttttcactcttaactctttgtgtttccatttggctaatttttgttgggccaacaagattctttcctcacccatgtctagcctactgatgtactcatcaatggtattctttgtcactactaccatatatgtactcagctaatttcactcactctctcttatagtttccacctctctgctgaaattccctcatcttttcaagcttgtttttcactatattcatttttttattactgcataacaagttaccacaaacctagcatcttagaacaatactcattaactatctcacaatttttgtaggcaggaagtctgggtacaacataactggattctctgctcaggatctcagaatgaggaaatcaggcctggggatctcagcttgttgttgttggcagaatttatttcatgcagttacaggattgaagtcctcaaattcttgctggcagtctgctggggccatctcagttactgggggccctgacaatttcttgccacacagtgctctctcggaccctttcacaacatggcaggtttcttctttgggccagcaggagaaatgctgctgcttcaaattactagacttgttttaaaagattaagttaggtctacccacagtaagttcactgttattcaactcagaatcctctgatttgggtaccttaattacatctgaaaagctgtaagctccctttatctttgttctgtttcataacctaaatatactagtgaaattcatcatagtcacagtcctgcccacgttgaaagggaggtcattccacagtgtgttactgtccaggaacaggaatccttgggggccatcttcaaattctgcaaaccacatccatgttttccattagagccttcaacatattatggataactaatttaaatttcctgttagacaatttcaacatgtgggtcatctacgagtttagttttgtcaactcttttctctccaacagtgggttgtcttttcttgctcttttgtatgttctttaatgttttattggatagtagacagtatgtataggatagtagagtctaagaaaataatatttatgcctgaaatggtacacttcctcttttgctaggtcattaacatgcggaattggattaatctggtcagaaattagctgattttgttgctactgctacctgaagtgcactatcaactgcatattcatctagtgttactttgtgcttagggtgggtcctgaattgttggggagtttttctccatatttctgttcctttctcgactttaggcttttattgagagccagcacctcagcacgtttattgagagccagcacctcccttcacattctcactgcttcttcagtagtggcgtgttgtttgttcctcagtgccttctagcctagttatggggtccagagcatgttctatcatcctgatttaacctcagtcttagggaagccctgtccatgggtcattgggtgagtatttctcagtgttcattttcctctccattggtaggagatcttgaatggtctggattcaggacagtttcccacctgtcctccaggagtagaaggctatttttgttttgttttgttttgttttgttttccttttcttcagctgtaatacattttaatttgggttctgggggaaaaatttactatagctcccttggcagtttaaagcttttgttccttgagggaaagagttcggtagattttataattttttgcaaaacagcaattctccccttcttcaggcccactccactgagggagccatcttgagtctccctctctgtctcccactgtggttgttggcgtccatggaggcccatggagatcaatctgtgtgtgggtctgagatccctgtgtctggatctccatagggctctgcattctccttctctcccacacttggcctgaagcagttcatcaatgatatttggtcagttctttctacccattaaaaaggtgctcaacatctttctttctcattatctgccacaaggaaggtgctctggcaccatttctccttgaaggagactgtcttttcttagggttcaggcacacttgttggccctatggcctcagttctgtggtggatacagaaaaaaatatatgattttctagattctctggcttgtcctttttgtcaggatagaggcaacattctttctaactttgtactttgtaggcagaagcagaacttctcccaactgtttcaatttatgtccgtggaaattgaaaatttcccccatgcctttttgtaagagggaggaaggaacagtgtggagtgcaatgattacatctcatagtcacttctgttttctgccttgccttgtatcttgcaattatgtcttttatcacttccctagcattgacaccaagtcaagactcaaactctctccttggtttctcatcttcaagtaagcatacatacaaaattgttgcatattgctgaacttttactgaagatttgtagtttagattgggaggttacatagcacattataaaacaaacaatttaagctaacaaagtctaaaagcccgtgtgcctggccattgtatcccttcttactggccctttatccttcacagagcccatactcacgttatttcactgggtcctttcttattttgacttttattatgtcttcaccccttttaactcagagattccatagttgtttccctactataaagagcagttcaactctccacaacattccaaatgtgtgtatccaaaactatccaagaatttagcagataaagcatggcttttattttatatgttcttatgagaagaaaatatcatcagaaggacaaataatatttccgtttgcacttgtgtgtagttttgtaaacgtaaagcccatttgtgaatagagagggtctgaaaatcccacgttaaaataattattgctatgtagtacttgatttctaaagtttaccatacattaagattagggtcaagatcctggtgtggtgactcatgcttgtaatcccaacactttggaaggtcaaggcaggagaatcactgagcccaggagttcaagactagactgggcaacaaactgagacatcgtcccaacaacaacaacaacaacaaaaagaaataaataaataaaatagcaaggcacagtggtgtgtgcctgtagttccaactactcaggaagctgaggtgggaggatcctttgagcgcaggagttcaactttgcaatgagctatgattgcaccactgcactccaggctgggtgacagaatgagaccctgtctcaaaaacaaacaaacaaacaaacaaacaaacaaacaattcagggccaagaggaataaggatgcatatcacaggctccagggtagatttgaagtcagagtttgactacatgtctaacttcgggagagtttaaaaggcacctaattcccatgattatgaaatgacttctttggcctctactgacacatggaattgagtatattcatatcatgtaggttaagaaaagtagaatattaacagaagtttattgttataggaatgatataattattacacttcttattgactagttacattgcctagtaacattgtatgaatgatctttccatttctgttcattcagtgttgatagtttatcattcacttcctttcaacctacttgtactgactattgtagaatataaaactgatacaacacatagtcctttctctcaaaattcccataataactgcataaactctaacttcttttgtcctggcataaaagtacctatcacccaggtgtttacagagcaggtagaaataggtgtgaggtttataggctacaactatttctgcctgcttagagcaacccctaatgacatttctcagattaaataaaaaggtagttacaaaattcaaacataaagatcaaacacagcagttaagtttttgaaaaccaataccaactttctaacctgccacagaatgaacacttggcctgaagtatgaaggtgcataaggagcactcacaccgcctgccactgttagtaaatttatgcttttaggccagttctaaattcagaactttaatacattcttccagcacatcctgagacagtgcctgtaagacttatgatagttcgaggaggcagatctttctgatcaaatttcaccattgcccagaaaattcaccaggtattctgggcaatgcattctgtcccattttgatatatctgtttgcaacatgaggcttgcactgtttactaatgtacctcacaagttcaaattattgttttttggggaaatgtaaaggaatatagtaatattgaagactgtttccagcaacttgactttgtgaaaaatgatttcttctttgaacagatttataaaaccttaaacatccatgtgacgttggttggcattgaaatatggacacatgaagataaaatagaactatattcaaatatagaaactaccttattgcgtttttcattttggcaagaaaagatccttaaaacacggaaggattttgatcatgttgtattactcaggttggtgattgctctattttcttgcatacctttggtggattattacaaaagaaaacaaaaaaaaattaacagaaaaaaaacattttttaagcatttgacttttgggtagcacacagggacaaaatgttatttgtagctacacagaaaatttccaagcaaggaaccgtagcatatatctttaatcccaacattttaggagaccaaagtagaaggattgttttagcctaggagttcaagaccagccccaggcaacatagcaagaccccatctgtacaaaaaatttaaaaattagctgagcatgggggcaagcacccatggtcccagctacttgggaagctgaggctggaggatctcttgaatccaggaggttaaggataacatgagctgtggttgtgccactgcactccagcctgagtgacagaatgagaccctgtctcaataaataaataaatagaaagttttcaagtggactatttaataatctttctttctaatattaatactagaaaagaaaaaatctgatatattcatattccttggtagacttaaaaatgccattaggtaagcaaagtgcttttagaatccatgttacattttttatcagcatccagtgctaactcctctcgccctcccatgttgtaccgttccaatattcttccaaaatctgcctttctgggaaagcacctcactctctgaacatttcccctcatcaaaatctgcctacctggtggccagcccttcaataccatcttctctactatacaattgaacaaacaactaatctgataagtgaaacctgtcagagctttaatattcctaagtaaaagcgtgactttgtctagaccactcaatctttaatttctttaaaaaggggaccatttttatcatttttgttattcaagatacctagcgcagtacttagcccagaggaaaaggataagtaattatggaactgaatgtaatacaacctaatatttagcacagtcctgttatcctaaagaatgctaaattgtggaagaagtcctttggagcgatgccatcttttagaatctcttctgaagcccttaaagctactgtattaaaatagtgctcactcttcctactttatatacccataatatcggtatttctcctaaggtctgcaaacccagcgtgctaatcttctattattatttagacgttgactttcagtccgaactcaaaaacctgaagcttccaatacctgtagtcagaagtcagattcagtcctttggcagattaatgagagtgcatcagacctccaaagtaacataattcctgttttctatatctgggatggcccatagcatatatcgccagaggcatagttgtgcctggcttgtacttgaatattcatgcattagcatgccccaaaatcatggggaatggagcgtggtaaaacatcgccataaacttcagagtgggcaagattaactcctttgccctctctttatacatgtattttttaatacttaataaataaaaccaaaagtatttgaatgggtgtaagtagaaaacttttaactactttagaacacctccgattctaaccagtagcttctcatatcaataggatgtctgcaagtgaggagatggggtgaaatgctactaaatagccaattgagcatcatatttgggacttcttatgtgttaagtttcttgggtacctgcccttctgtattcacttagatgtagaagtggcaagacagtatatatggcattatcatgtgttacttgatttcatgcaaccatgagaggacactcaagattattcttgtcctggcgcttcccctccatacatgtggttttctcaatacccccagagtttaaaaagaccagaattctgtctctccaagaagcatagtcaaatactgatgcctaatatgtaggaagagaaacatttcaataataaagagaaaaatggagtgtatcttaatcaaaaaaggtaaagactgaaagaggtcatctaatctgaccacctatcttgtctttgagttctattacattccaggtatgaccctttagcccctaatggctctttttaaagtggttcaactctaaataatattcctgaaatcaaatcaaatttggattcctataatataaatatctacatttgtcttttcaagtaatccaaggaacagttctcattttatctgacaactcatttaagtgttttattatagctatcaaatcctacctgagtttctatggttgattaaaagtcttaacatttttcaattgtagctaatcaatcatggtgttaagtccattcattgtgttactttgtttttccttctaaacacttttacattttacatttcattaatttctggtcttgtaagtggttttatccaaagctgagggcagagtagactaaagtaaaatgggatttcaattgtattttttgatttgtatttttttgttttttgttttatacctttctacaatttcagtgtaagattgcactggcttttttttttttttttttttttaattgaggtggagcctcgctctgtgtcctggagagcagtagcatgatctcagttcactgcaacctccgcctctcgggttcaggtgattctcctacctcagcctcccaagtacctgggactacaggtgtgcaccaccatgcccagctaatttttgtattttcagtagagatggggtttcaccacaatggccaggatggtctcgatctcttgacctcgtgatccacctgcctcggcctcccaagtgcactggctttttcaatgcctctaatatcccacaggttaaagatgagctcaatatcaactaaggtcagcctcaattccaaaactccagaaataagaaggcattttcacatgcaaaagcattggcattgctggggttcactgcaatttgatctttgtgttaattaaactactaactcagattgaagactatttttgcatctttttcatagtgggaagtggctctactcacatgtgcaaggaatttcttatccagggggtatgtgcctgccctattattccaccagtatcattaaggtgggctgtgttttatttatattacttaataatgtttgaataaaattgttgtaatgtcctgggttccatggaaagagactatgtatgcattttgtcatatatactcactaagatatgtcatgaacagactgttatgcttcctttattaaatgaataaaaatgttttattgaaaaattatagataaatattgaaggtaaacccattttgtttagagtttaaacggatagtataccacagatcagcatgcaatgattagtaaagctcttttgcatatgaaatatagctacttataaggacaaataatgcacataaaggttgatggctcatttaataagtgaggataattgttctagtgctgataataaggcacataaaccacttcctatatcatatcaagacaacctttcaattcatttttagaaagcataagacctaaaaactgttgactcccttttttttatgtgatcctttccaaagtctctaagcttctagtaaatgttgtccaagtaaccccatctgagagatgcttgaaaacacgaaggtttctatttattttctttatgtcgcgcctaattgttgctgtgccttgtctggtattaagataaaaaatttcaaagctagtacttatttaaatgaccacatgacttacttattatatagttattttgtgtgtatagcttttcctatggtatttcagtaacataagttttggatcatagagtcaatttcatctgatatatgctgttagattattgctactcatactatgatacacgctacttagattatgctattataatcactccaggacacattttaaactttatatgagtaagatgagatgaccaaattaggtatgttttattagctttatagtaatctgatagcccacctctttttggaaattaattctgtattaacatagaaattaaagcatataatggaactatgagccaagttaaccaattcttgcatggatttgatatatctgacatttaagtttttcccataatagaaacttcgtctttaagattgtatagcattgttgtgcaatgtgagactataagctgaaaacaagaacctcatatttttatttgtatagaatttggatatctagtacaaagaggacaatcaatattacttattatattgtgtaggatatttatcttagctcattctagctgctgtaacaaaatatcacaaatgaatgggtaagaaacaatagaaagttatttctcggaggctaggaaatccaagattaagtccttagcagattcggtgtctggtgaagccctgtctggctcacagttgacaccttcttgctgtgtcctgacccggtagaaggggcatggatctcattcaaacctcttttataagggcattaatcccacttatgagggctctgcccccatgacttactcaccttccaaagacttcacctcctagtgtcatcaccttgaagttagttttataccttcgacatatgaattttgaagaggtaaaaatcataataacattagttcatagtttttaactatttataagaatgagcttctataaattgaacaatgactatcaccatgccacaaagaaagaatttcaaatgttagagctagagatacttaaaaagtcactttcttgggtttcttatacaattaaggaaactgaggtacagaggagagaagtaactgagtccatgcctttttaaatagataccagttaactaggagctagaagccaggtctttcaaccactagtttgaagcactatgtactacagtatgctaacttttgaaaatttctaatgcaattgttttatcatcaggatcttttacctgacacaaacataattgcaaacagaatggcacatcaactggggcataaccttgggatgcagcatgacgagttcccatgcacctgtccttcaggaaaatgcgtgatggacagtgatggaaggtgagattcgaacaatgtacagaatacacttacataattcagaagtgggctgggcatggtggcttatgcctgtaatcccagcactttgggaggccgaggcaggtggatcacctgaggtcaggagttcgagaccagcctggccaacatggagaaaccccatctctactaaaaatacaaaattagccaggctggtggcacatgcgtgtaatcccagctacttgggaggagaattgcttgaattcgggaggcggaggttgccgtgagccgagatcatgccactgcactctagcctgggcaacaagagcaaaactccatctcaaaaaaaaaaagaaaaaaaaagaaaagaaaaaaatatgtttcaaaagtggattttgagtcaaaatccattattgtaggatatgttgtaaagctatggaatttcctaaaaagtctattccataactaggcgtggcagttttctttctggggctaaatcttgccaactggtagtgtctctctctagtgataccgtgagagaaatcccaaaactttctgggtacactgcaaaagtacaccatgaacaattagtaccaattgctaccaaggcaattaggggacaaatagactctacatgccttgttttgtcatcttttctataagctataatgtcttccttcacatctttactcaaatgttattcccaccgatgttttccctggccacctgatctagatcatacatacatcctggcatttcaactcccactccatttgttttttgtcttctctttagtacttattactatctagcatattctctgtttcatgcattcagcttatttataactgtactcttctgctggaatataagctagtcccacaaggtcagagggttttgtcttttggggtcactgttataacaccactgtactagaaaagtcccaaacacatattaaacactccataaacagttacagaataaatgaatatccagccttccccattgtactgtgaattaccaagcagtcaggtcctaagttttgcacatctttgaatcccttcggagcaggtatacataaagcattgtatatagtaagaaaagtttcgtggtgatcaatgcttccacacattgattaaatggagtaaagtgactaacacaactaaatgtgatggctggcacagaataagaacacagtaattaatatttagttttacattattatttacataattagtagtattttacagagtcctagtatctcagtctaatgtgatcaagactctaaagacctactgtattgaactattatgtcaataataatgttaaggaagtcagaagaaaaggaagatggaagggagataaatttcaggttaagaagtatattacattcctatggatgtgtatattattaaataaactgtttgtcttaataaatttatagagaaccactttgtgccaggtactgtgttaactaatgtttatttttttaaaatcacacatgatacaattattgctttgagatgcttgtaatctagtagggatgataaacaaatacataggttatttcaagaggaccaaattaaagaggatgtggaagcagtaaacacagacaaccagtctgtaaggtgggcttcaggaaggatttgctggaggatctataaccaagatattttcactaacatagcatgtgtttgctgtgttttgaaaagatattttctataataaaggacccagttacttccctgctctaacagtaaacatttacatttgttcttttcaaatgcttcataaaatgctcacagccactgtaccactatgcattgatatgattaatctttatttttacctcattctatctctagcattcctgcactgaaattcagtaaatgcagccaaaaccaataccaccagtacttgaaggattataagccaacatgcatgctcaacattccatttccttacaattttcatgatttccaattttgtggaaacaagaagttggatgagggtgaagagtgtgactgtggccctgctcaggtatttgcaaatgaagctatctttaaattgcaaaatttatgatcaggtagaacctaggcagggatgtggccattaatcaaaccaaccgtggtgttccttgtaaaacttttaaaaattttgctttccatttttattttgattttataaaacaaattattggtgcagcctcattccagggcttcttatcaagtcatgaaacatgtgtaatgaccttgctggagatcagcagcatcagctttccttgttaatatataattggttctgcttgtgacaagggcccataagtgtccttaagtctgatgtctcatgcagagtcagaatctgctctacaaaatctcttactcaatcaagttttatttattaacttatgaggctagcctgtatcacagctggacagttcctgttaatagaaaactctttcttaatagagcagaaaccttcaaatgtttcatgtatttattgtagttgtggtctctggaacatttaggaaaagcccttgaggcaatttttaaagtaattcttaatatgcttttccctatcatagaagctatttctttcaagagcttatcacatagatatgtcttctagacaactgcctctgaaattaataagtgcagatgaatcaccaggggacattgttaaaatgtgaactcagattcagtaagtatggagtggttctgagattctgtacacctacctagcttcaaggttacactgatgttgctggcccgaggaccacaattttagtatctacagtctagataatgcacaataccaggaggtctagtaggacagcagttagagactccataatcagactggggacagtaacctgtccaaaggttataagaatgtcttcaaatgtctcaggttaaacgcaaagaggctcttaattttggaaaatgatcctcctgtccatatgcattctttggaatggttccatagattcattctaacacatgaggtaccttatccggccacactccattttctttgagtttttattttgtttgagaaaatagggcataagttaccattttgatgttatttaatgatacattaaaaaataaaagtcagcctgaaataatggacagcttgagcaaaaggtaaaatcagatcttcagcagttgaatagtctcacatcacacttcagtacagggaagcagtatgacccttcaaggaaatggagataattaggataactgaagattataaatgttggactctctaattctgtcaatgagaatccattacccgtaatgtaccaaacagcacgagagaaggagaaatagttaaagtcccaaatacccgttctaaacagtaatctttatgtatgtaccacagccaacaatcatgcatcactatttaactctatcagaatccacagaagcacaactaattaattcttcaaacaggagtcagagtacataccaatttctcatctctcttttgtggttattgccaggagtgtactaatccttgctgtgatgcacacacatgtgtactgaagccaggatttacttgtgcagaaggagaatgctgtgaatcttgtcaggtaaggtcatgtgccaggagaaggtttttttttttcagtttaagaatatgtaggatccaagagttatctaaccactggacagccctgcaccactgactccaaaatgaagctaggcttgcaagtacccaacagagattcttgtgagatgctccaacatctgagcattgggctgtgctatggcctggggtagtggagaaacatcaagtagcaattggaggtttaggagggaagtcacatgaccagctctattcttgctcctttgtaaataatcaccaatctgtttaacctcatctaggaggatagttgaaatcccaagggagagctaaaagggaaaggggttatattagcattggaaagtggcagtggctagtaagtggagaaacgttcccgaggaagacaaccagaaaccccaatggctctgtccaagagtttactgacacttctttcactcaactttattgtgaattcacaaagaaaacaaacatatcttatgcatcttcaaattcatccagaacccagcgtaattaaattcttattgaatggctgaatgagagaatatctctatgcagttccctctagcagtgaaagcaagggtatttttctccagttcatatgcaggaatctgatttattgggactggagatttcctcattataagcaggggttcccaattcgaggtgggtagggggtaggcagggtatgtactggatcccttgggacaaagaaaagacaagataaatgagaacacctgcccgtttcttcatttgatgtacatcccaactctccctaaggctgctgtaataccaaacttcaaaaacatcattttgtcattcttaaaattacatgagtgccaacacattgacaaatgacaatgattcttgatggaatggagaaggaagctatgatccatccttaaaaccttttttggatgaatgggtcaactttctgtctacttacgaaaccttacctacctaaatgtatccaggatttagtctctttgtttttcctcaacagataaaaaaagcagggtccatatgcagaccggcgaaagatgaatgtgattttcctgagatgtgcactggccactcgcctgcctgtcctaaggaccagttcagggtcaatggatttccttgcaagaactcagaaggctactgtttcatggggaaatgtccaactcgtgaggatcagtgctctgaactatttgatgatggtgagagataatcacagtgaagtattcacacagatggtggcctctatttctctgttattgccctgtaggaattgggtcaagatcagatataatgtcatttgtggcattattccaagatattgcttagcatttctctggatattacctgtcatattagttgatcttacgtctaatattaactatctcagtatatgagctatgtatatttgttactgttttatatctccagcctaaaatattctcctgaggcaataggatagtttttaaataatttattccattctacttcactatgacatgattctgaaagtttaattacattagaaaaataaggtcttttatgattcatgatagtcatgctttattgttttacttttataccattttttaccccagaggcaatagagagtcatgatatctgctacaagatgaatacaaaaggaaataaatttggatactgcaaaaacaaggaaaacagatttcttccctgtgaggagaagtaagtgccctgtggaaaaaaagtaatttgccttcttacagcactttgtcaaaatcagaatggctcctgtccccagacctgttaatctctttttactgagaccgggagaagagggaaataagaaggaaatcttggtgtcctgattaaaattatgctaattcaaattactaataaaaaaatattcccctgtaaacttaagccagtattgacttgtgaggttcacagggaaatccaaaggaaatatgatcattttacattttttacggactcatctcagttcccagggccaagactttgctcagtggttttctctgcccattacagcctccttaacttggcaagaaacctggatctagaaaaagagtgaccgggaggctccattgccagcctagtctcaaaagttgtatttctagttccaagtttgaatattctgcctttccttcagagatgtcagatgtggaaagatctactgcactggaggggagctttcctctctccttggagaagacaagacttatcaccttaaggatccccagaagaatgctactgtcaaatgcaaaactatttttttataccatgattctacagacattggcctggtggcgtcaggaacaaaatgtggagagggaatggtaagacaaaagccctttgttttattaaaacttcttagttcaatcctttaaaaacattactggatactgtaattgcttccaaagaggtctagatatggaaaaggaaaaaatattgacaagtatttttttaatgaggagcagagtagcaataacactgtaataaacatccattttgcctaattttagtcatgccaaatgacccataattgttacagatgtgcttaattagtaaaacttacagcagatatctaattagacatggattatagacatggatttttctaattaatgtgagtataaagtagccttacatcttcatttattttattcattcactcatatttactagccatatactatggtgccactgactgtacactaaaggtaagcatacatgagaatttcatacagtaaaaattacatgattacagttcaaaaaattgctttcttagtggtgtgaccaatgtatattgatgtctaaaggaaaagtggctgactttgctcagagaagatgaaatggcatcttaaatgagtaacatttcagctttgacttgaacattttaacacacaggaaatgggagaagacattttagcaaaaaatgcctgcacaatatgtaaaggtacaaagtgtatggcataattcagatgaccagcaatttcagagtggcttgacctttgggttaaatggcaaaagatgaaattgaagagaagacagaatgggtccaaattggaaagagttttttatggcaagatgacaacattagaatgcatactctaaacaatagctggctcataaagaatatatggaaaacacatgatattttacccctaaaatcagctatttgaaactgaataggttctctatgtgatatgtcttcccttctctctctacactatcaccaaaaatattacagtgacatttgtacagtgtgatagagaaatacattggaaaaccaaagttcagaatgtaaaaaaaagaactagaactaaatatttaatagcgacttacattttgagtctatatatttaactatcctacttcctgttaaaatcattaaatgaatatcaacatgctaagaaagctatgtttgtgaaaattaaggtatgtatgctaaccacaagctaaaaaattcaaaggtattcaacaagactaagtgtgaagcctgaggttgaagaaaataccaaaagatttgctattcacctcagatacgaaaaaccagcctgagatacaaagtgcttccttctttaagagtggcaaggactgaagaaaggggctgttagaaaggcagttgtgaaggaatccatctccatctcccaagtacactgtgaccacgtactccgcatagagagcttattccttcaagagaaggcttagggcagaagtacatccatcacagtggtgccagttcttcagccaaattctaatgaggaaattcatgcatagttaatgccagtctatgtaggtatcacaatgatgtgagtgaaaaaaaaatctctttttggcattgatatgctatttttagactatgagctatgtgggaccttattcaaatctgttgttttagcagggcttctctaaaaccaaaggacaagaaaaggagtaggctaacgagatggaaaacattttggtaataattgccccactccaaccaaacagcagggaaaaattctatggtctgactcctcctgcatcagcaaggatcaagtgggaagcctagacttccattttcttccagctctaacagatgccctggctccagacagggtttcagtggaggcttatggggagtcaggacattcaccacagctcagtggtgatgaattcttccaaccccagtgtcatgaaagtatgtgaggaggctgggtttccaccccagctggcgtgagtgaagcagtgattctcttccataacaggaatggttttagagaagatctgctaaaacaacagatttgaataagatcctatagctcatagtccccagagtatccagaatacaaatgagccactcttcaaacaaagaaccagggaaatctcaattgaaatgacaaaagacaatctctagatgcaacaacaaggtgacacatatgttgaattacctgacaaggaatttaaagcagcctttacaaaaatgcttcagtgaacaattatgcacacgcttgaaataaatgaaaaaaatagaaggtctcagcaaaataacaaacttccagaaaagacgtataaaatataagagccaaatggaaattttagaacggaaaaattacaatactggaataaaaatattcagtgaatgagttcaacagaagaatggagggaacagaagaaagaatcaatgaatgtaaagaaaaaaataaaaattattcaatctcagttgccatttcaagtaaaggtgaatgtaaggtgaaacaggagcaaagatgactcttgttatgttttagcaaagagactggtagcattttgcccctgctctagagatttgtggaactgtgaactgaagagagatgatttagggtatctggtggaagaaatttctaagcagcaaagcattcaataggtgacttgggtgctgttaaatgcattcagttttataagggaagcagagcataaaagttcaaaaaatttgcagcctgacaatgtgatagaaaagaaaaacccattttctgaggagaaattgaagctggctgcggatgtctgcataagtaatgagatgccaaatgttaatcccaaagacaatggggaaaatgtctccagagcatgtcacaggtcttcatagcagcccctcctatcacaggcccataggcctaggagaaaatggtttagtgggccaggcccagggtccccgtgctgtgtgcagtttagggacttggtgccctgagtcccagccactccagctgggactaaaaggctccaaggtacagcttgggctgttgcttcagagggtggaagccccaggccttggcagccttcatgtggtgctgagactgcaggtgcacagaagtcaagaattgaggtttgggaacctcagcgtagatttcagaagatgtatggaaatgcctggatgcccaggtaaaagtttgctgcaggggcggggccctcatggagaatctctgctagggcagtgtagatgagaaatgtagggtcggatcccccacacagagtccttgctgaggcattgcctagtggagctgtaagaagagggccaatgtcctccagaccctggaatggtagatccacccacagcttgcactgtgcacctggaaaagctgcaaacactcaatgtcagcccatggaagcagccagaagggaggctatatcctgcaaaaccacagaggcagagctgctcaagactatgggaacccacctcttgcatcagtgtgatctggatgtgagacatggaatcaaaggagatcattttggagctttaagatttgactgccctgctggattcagacttacatggggcctattagcccctttgttctggccaatttctcccatttggaatggctgtatttatccaatgcctgtacccccattgtgtccagaaagtaagtaacttgctttttgattttacaggattttaggtggaagggacttgccttgtactgaatgagactttggactgtggacttttgagttaatgctgaaatgagttaagactctgggggactgttgggaaggcatgattggttttaaaatgtgaggacatgagatttgggaggggccagggacggaatgatgtggtttggctgtgtctccacccaaatctcatcttgaattcccacatttgtgggagggacccactgggaggtaagtgaatcatgagagcaggtccttcccatgctgttctcctgatactgagtaagtctcatgagatctgatggttattataaggggggattttcctgcacaagctctctctttgcctgctgccatccatgtaagatgtgacttgctcctccttgctttctgccaagattgtgagacttccccagccacgtggaactgtaagttcaattaaacctctttcttttgtaaattgcccagtctcatgtatgtctttatcagcagcatgaaaacgaactaatacaatgttgaaagatttcctcctttatcaagaaaaattttttgaatgaaattttaaaacatattaaacctatataaaaaagtataatttgagatcaaagagcattgccttcaaagtacaaaccatgattactggtttatatgtaatgtggccagtaaaccactgaattggatattacaaaaaaaatcagtaagttagaagctaaacttcttaacacaataacataaaggaatgttaaaactcaaagaaaataaataaaaccaggaaatagagttctaaaaaattcattacagatttaatatgaagtctaaattaaaaacacagaagagaggtgaaaatatagttaatgaaataatcacaatatgtccctaatctgaagaatgtatgaaaaaattcacttagtaccaggaaaaatttatagaaagagatgaaggcttttacttaccctcatgccttgaatgtcaaaaataaagaatacatgccataagcacaaaagagaaaaggtcattaatttgctacagaaagaaatatcaggttaccataatacttctctgcaacaagtatccagaagacaatggagcaacatctacagaggtttggggaacataattgttgggaccctaaaactatatttacagccaagtttttattcagacagaaaagcaatgcaatgatactctcacacatattataactaataaaatatattgtaatatatagactgcacctattttttgaaaagaaaaatagtcaagaacgtattccagccaagagagaaataaatttaaatttagaaggtaaaataaggagataggatattaaagaaatgattgcaagcaacaaactccataagacttttgagtaaattctagttattaattataatatttttattacaatgatgtaaaaaatctcaggaataataaataattttgacaatgtagtatctgatttactcaatcaaaaacttgaattgagagaaagaggaaagaagtaaaaacatgataaatttcttatcttgcaaaaggaggagttaatgttgattttttcttgaaaatgatagaattatttagattcaaatatattaatgtaaatcaaattaatctttagaaattagcatatatagctttcaaattagagaaaacaatagctgaataaaagtgataaatatagtaaaaggtaagccacaatgtctaatgttggaaatcaggtaaataaaatgaaaggactaagagtatatatatatatatcacttattccaataaatatagatgtattaagttctccctacagaaaatgtaaatataatctttgaactggtggcaataaatgaatgtttaattataaataaaatgtaaaataacatttaaaaattaaatagatgagtaaggatgaatcacgcaaagaccaaaaataacaaaaccaataatattttagtgatcaaatttaccaagagaaaggaaaatttaaagcaaaaatattaaacacaaataagattaattgatattaataaaatgaccatcaattgtggtataataaacatacattgctaaaccaaaagaaaaacttcattgaaacaaaagaaactgttgcaattacagttgtagaatctttgacagattaacgctgaagtaattactcagaacataaacattttaataactaatgagtttaaaatatttctttgcatgtatagtacacaccccaatcatctatagaggatttctctatccacagaaaatactacatgtggaattttacagtaggaaaaattacataacttataattaaatcatgtaaattgaaatttttcatatgtaaattacatgcaaaattgtgcacttcacatgcattacatgaaattacaatttcacatcaattgtaagtcattttaattcatgcttggttacttcatttctaggtgtgcaacaatggtgaatgtctaaacatggaaaaggtctatatctcaaccaattgcccctctcagtgcaatgaaaatcctgtaagatatgactgctttcaaaattaatgtcttatcagccatatatttactttattccccagcctatatgtgcatgtatatgtatgtatatatgtatttttgctgctttctaaatcaaatatatatttgggattcattttttcatgtgttatcaacaaaatttatccaaggagcaaaatcacatattattatacacagatacagccagtattacaagtaatgctttcattattgtactggttatctagaaattcagtgattcatgtatgtataaagtttaaatctgatgtttaaagttgaatctattgcaacatatcttatagttaaattacaccaatgtcaagttaagcttttgagaaaatcagcaaacattgtatattttttacaaaataatatattaacactaataccaacaattactaacagttagtgcctaacatcgctcataagctgggttaatcagtaacacttatatagtaatacacacacacacacacacacacacacacacatcacacatcacacacacacacacacatacatatcaggttaccatatttatcatatatatcatatatttacctggaaagataaatcatgctgtcttgttcatctgcctttgaatttgtcagtatcattctcttattcacaggccgttttcaaagatggctgcttcttgtattttgtttacttatttttatacatcattgattttgttacacagtttaataaacgaataaaaagttcgcgcttgtgcttgtgtgcatgtatgtttgatgtagaggtagcactaaagtaagtgagttgcagaacacaacttatatcagtcatttgagaatatatcattgactgctcttccaggtggatggccacggactccagtgccactgtgaggaaggacaggcacctgtagcctgtgaagaaaccttacatgttaccagtgagcatcctaaaacaaaatctttcatatatcaaaagcctacccagcgaaaaaagtttttcttatttttcaagtctgctacttatttgctgtgttttgatatggatttgtatggtcttcatattattgtgcatgaatacccaaattgattttactgcaattaccttttacagcaattcccttttacagccaatgtagtctcttctagctaaattaaattttcttaggtatcccacaaaccctcaacacacaagggcttttctatagttattaactgacaatcaaaactcttcctgatgattgtggttcccttaaatataacggaatattgggtggagtgtcagttgcaaatacaaatgataatttgtataatgtttgggctttttactttacataaaaataattgagaggaaaggagaattgaagttctatagaaaggaataaggagcattgtaacagctccattaaatgttaatattccactgttttacaactgataccctcgatgaagcccatgtttcttcatgttgcagatatcaccatcttggttgttgtgcttgtcctggttattgtcggtatcggagttcttatactattagttcgttaccgaaaatgtatcaagttgaagcaagttcagaggtacatttacatttttctatgtgttgaagaagggaattgttactgagaatatgtaagctttgtggttatagaggatattcaatggggggaagtataagcttcttactgaagatcaggtaagaatagtagtaactcaagcttttatgtacttgctcatatccagatgctaatatcaatgattcccaaacttgtgcacattgaaatcaccaacaggtctttcaaaaaatactgatgtgggttgaagacattgtgatttaattgttattgggtatgacttgagcattagtattttaaaaatcttgtagatgatttaattttagccataaatgtatcccatagtttgtttatcccataatttctgattcttcccacatcaagaatcaggtgacatcactgaagattgtacaagtattaagttgataattagacaatataaaaaagcattatttcaatatatttaacattgtaatgaaatggaaatttttgaaatataaaaattactaaagcttactcatgaagaaataaataacctgaatagccctatatctaataaattagttgttcaatttccttcttgacagcccacctacagaaaccctgggagtggagaacaaaggatactttggtgatgagcagcagataaggactgagccaatcctgccagaaattcatttcctaaatgtaagaaacttccatttgcaacagttaatttattgattttttttttttaagtagctgaatgtgtttaaagtagaacccgtcctaagctaagtgacatgggaagtgcagaggagcaatttaacatggttccacacacatgaagctttgaatctacatgtagggaaaggaaagagggcaggattcaaaacagatatggaacaataaccaagatactatatcagagcagaatatattggtttaataacatactaatttgtgcactattggaaaaatttacaagcataaaccacatgatgggccataaagcaagttttaacaaacttaaaagaactgagctgggcgcagtggctcacgtctgtaatcctcacacttctggaggccgagacaggcagatcacctgaatttgagatgagcctggccaacatgggaaactccctctccactaaaaatataaagactaaaaaacaagaaagaaaagaattgtagccacacaaaatatattctcagaattaaattacaatagaagtaagtaatggaaagatatcactaattagaaaaattctcagttgaaaattagataatgaattctaaggaactcaactttcaaaggaataatcaaaagggaaattagaaagtgttttaacctgaatgaaaattaaataccacgtgccaaaacatgcaggtgtagtaaaatcagtagaggaaaatgtatagcgcttatctgcttctgtttgaaaagaagaaaaataaaagatcaatgacctcagcttttactttaagaaactagagaaaataaagaaaatgaagcccaatatatgcagaaaaaaagaaaaagtaaatatcagattgatcactaatgaaatagaaaacagaaaaataacagagaaaatgtattttgagaagattaataaattttataagcctccagccagtctaactagttagtacatattattaacatcaagaatcagaaaggcaacatcaatgaagatactataaatattaagttgataattagaaaatattatgaaaaaccttattttaatagttttgacagtgcaatgaaatggaaatttttgaaagataaacattactaaagcttactcatgaaaaacagataacctgaatagctcaagttaaatttgtagtaaaaacctttccacaaacaaaaaaatatttgacccatatggctctactggtgaattctatttaaaaattcatgaatgcataacactaattctacataaactttccagataattggaaagagggggaaaattcccaatttattttatgaggccaatatttctctgatgcctacctataaaagtcattacaagaagaaaaagcactactaactaatacactaacaaatataggtgcatgaattattattagatgttagccaactgaatctcatgatgaatgataatgcatcatgatcatatatagaggataatgaatcatgatcaagtattactgcaataatgcaaagaaactttaacattcaaaaaagcaatgaggctaacttactgtattatcagtgaaagtgtaaaatcatatgatcatatcaatagaggcagataaattatttgaaaaaattatgtctattcctgagaaaattcagtaaactaggaatgtaagcaatatatgaagatctaagaaaaatgttgaaaatcctgcagaagtccctgcaaatcacagcttgttcaataattgtagcaacagcgataatttccaatacattcagctcacttaaaaaactgttagaatggtgatcattaaaaagtcaggtaacaacagatgctagagagaatggagagaaataggaacacttttacattgttggagggagtgtaaattagttcaaccattgtggaagacagtgtggcaatttctcaaggatctagaactagaaataccatttgacccagcaatcccattactgggtatatacccaaaggattgtaaatcattctactataaagacacatgcacacgtacgtttaccgcagcactattcacaatagcaaagacttggaaccaccccaaatgtccatcaatgatagactggataaagaaaatgtggcatatatataccatggaatactatgcagccataaaaaaggatgagttcatgtcctttgcagggacatggatgaagctggaaaccatcatttgcagcaaactatcacaagaacagaaaaccaaacaccgcatgttctcactcataagtgggagttgagcaatgagaacacatggacccagtgaggaaaacatcacacactgaggcctgtcgggggatggggaacaaggggagggatagcattaggagaaatacctaatgtaggtgacaagttgatgggtgcagcaaaccaccatgccacgtgtatacctatgtaataaacctgcacgttctacacatgtatccctgaacttcaagtacaaaaataaaataaaataaaataaaataaaataaaataaaataaataaaataaaaaaactgagtggccaggcacagtggctcacagctacaattctagcactttgagaggccaaggcaagagggtaatttgaggccaggagttctagaccaggctgagtaatatgtcaagcctttgtctatataaaaaaagaaaaacagccaaacataatggtgcacacctgtagtccctagctacacgggagactgaggcaccaagaacctctggagcccaggagatccagactgcagtgagctatgatcatgccactgcattccaacctgggctacatagtgataccctgtctcaaaaaacaacaatatcaacaacaatcaagacaaaacctgtaaggaaagatcaagaaactacaaaggcattagctttaaaaaaaaaaatagctgatgaagaaagcatcatttttgaaaagattatctctttaaaatgatgaaactgcccattaggatttaagtcatgaagaagggatcgaaaggcccaaattttaaggctaataattaactgactcttgctagatgcaagtgccaataaaaatattatattgccagtattttaaaatcaggatatttttggttggtggggtggtctggttacgtagttccagaggtttcgaatgctttgccacggctttaggcatgccataagccttgtgatttttactgcacaatattgcagagcatacccccactctatcccccagaacacatatatgacattttagtggaaatgcctctgatgaatttcactggcatatagagatagtgaatctttctctggttatatatgttagttatcatttttatccatttatactctttattatgccagatgtgattccaagaaggtaaaaccaagtcttaattgtccattagaatggacaaaataacaacgtgtgattttttttaagtttacactgagattttcaggaaagaaaccgcatgatgctaatgtaattctcattcatttgtcttgaggtttaaatgagaaattgtatgtaaatatacttagcacagtgattggtatacacttagcacttaatatgtgttattttaatctacgatgcctcatgtgctgttgcagttactttcctaattacattttccttaaattaatacgttaaaataggtggacttccagagagatgagtcaggaaaggtaggctgagtactgctcaatgatgaataaccatagagcgtaggacatatttgttatgattatagatcctaagcttcctttaagggcttttggttttttggttaaatgaggggcacctagaagagaagatgaataaatatctgttgaatatgtgaataaattcaatttactgttgatggtatatacaccatgatattaacagagataggagagttggatcctcaaacatcacatttagggtttttgtattttttggcatgaagtattataaacaataatgatttaactgatgcttatttgacacagttatccatcaaagaccagtcctcagcaaacctggggtttgggggaggtccgtctttggcgtcttttacctattacgttaatgatgtttgttttttgtttgtttgttttttctctccctgctctggcatccaggtcctctcacagatcctgcttccattggaccatgctttctagttgtattaatatttactggggagttaacagaatgcactttaaagagggaaacttaatttaggaatttttgtattttaataggaaattgtggagtttctcaaagacattcaaggcccaaaggaatgtggctggttagggaatttcaggcatacagtcaattagcgatagtaagatttggtggctagcagacctgcctcatcatattcatatcacaatgtataaattcccactcttctcatatgtaaatttgtcttatagacaggccctgagatagactcatatgttgtaggataacaatctacacaagaatattatgtctgggtctttcagtattggtatatttactaggaattgcaggttaatagtatctcttcttactagcagagaactccagaatccttggaaagcctgcccactagtttttcaagtccccactacatcacactggtacgttcccctccccttcctcttggtggtgggctatgtcctttccaataataattttcatgaaacttaatcatttgttggttccttgaaaaggaccaataatataacatcgatagctctctgatcggaggtagaaatgggacactctgacactctggcatagagacctacttcttaacagggtgggggttagggtgaggagagtgaagtgagccaggcaagtcctagggcagacccaagtttttgtttaaaatgttggcattttgttcaccatgatacatgcattttcttgcaaattaattttgatattttaaactaacacattagcacaaaatttatcttaattactgaattagttttctccccttaaattctgcccctgagaccaatgcttcactcacctcactctagtcctggcccctgttctaaaaggtaaaacacagcaatggttttcagtgagtccttgatcagccagagggctctcccctggaaccctcagttagatgaagctgtgtaatccctgcatctttatttataagggagaaacaaaatattagcacatattagcacacacatgcattagagactgagtcaaagcacacacacacacacacacacacacacacacacacacaaaatagaaccactacaggatttctaggaattgcccaaatgactagaatctctatctctacatcctcaaggttactcagtagagcacctcttactcagaactgggcgctgaatacacacagattttcaactttgtatttttaaaagcagccattctcattaagctttctttatggacgactaaaacgctgtgattagttgattagtttctaatctgtggttgcagagaatcctcagatcacacaaaaggattacagaaagtggcagacagctgggggagttgtatgaatgaattcttccttgaacccgggcagtccatgtttaaaatcaattttactgagattccaacagagatgttatcggaatgaaagtgctaatactttaaaagtgtttgaaaatctcttacctaatatattctagggaagattcacagattttacaaccaataatggtttctgatacaactttgcttaaccaacaccatctatcctcctctccctcaatcccataggaatttacaaactgtcttaagcaatttacaaactgtcttggatttttcatggagcaagcagaggtggcctgcgtgtgtatgtgctcatgtgtatgtgtgcacatgcatgtctgtgtgtggatgcccatgcgtgtaacatctgatgtggcacatgatacaacataatttatttattatagaaacctgcaagtaaagattcaagaggaatcgcagatcccaatcaaagtgccaagtggtaggttaccctgacagatagtacctcccttttttatttttcaaatgctggcatagttttgtgttctttaccaactcattgatttactggggacatcctctgtacttatcacaacagattaggaaggttagaatttttttttttttttgctgatatgcttaaagttctaatatataattctgctaaggatgttttaatcaaaactttctaaccggaccaaaggagcaatccagaattcaacagtgccacagtctcaatacaggttaggaataacgaaagcagcactattctttcagacttttgttggtcagagtatacatacccacaggttttcttcaagtatgttaaaagacttcgtaatgttgggaatcacagaaaaggaacagtttccttcatgattccttttttagatttttcacttatcaaatcaataaatggaagggttgatttcacatttgacttagtatgtctatattagaaaatttatccaaaaattgtgatttatgtcaaagggaaagaaaatgagcatggcttcagtacattttgagtttgttttcatttcttcctcctttatttctgctgagtttttacagtgcactaggcactggattagtatgaagattccttccacaaagcgttcttatgaggtgtaataagatacaccgcccacctccaccgaaaagcagggcattttctaatgatctttccactccacaatgacaaacctgtcccacagagagtagagagtgaagacactccttagtgccagcaaactgtttggcatcccataatggaaaacaaaattattttctttctttcataataggcctatttattttataactgcttaattagcaatggctagggagatctataaaagcatgaataaatgtaggactacagaacacagaaaggttattctaattagtagatataaatgagtaatggaaatacatggttcacagatttcataggaaacaatctatttttaaccatctgtttctatttagagcttgaagttggatatccaaaatggccgtgcaagcttaggctggggattctggatgcaacgtctttacaaccttacctagatatctgctactcacatttttggtagtgtttcaaacgttctttatccagacagacaatgtttaagagaaacaacttatttctgttaatatttaccggtagaattcacaccctctatcataaacatatgctgcagaaaaaaaatgtcttgtggtctttcaaatgctctttagcacaatataaaaattcgtaaccttgctgtagtattttcctacaaaatgttactctgctttcttttaagaatccaaactttaaggatgataacttacagtctaagaagaaaacattgcatataaaaagttacttttttggaaacataaaagtacgttttaaaacttgaacatgacatcattagcactaattctggtttaaatgaaagtcctgcagaaatgccaaagaaggcagggcagagcggcacggattctaggtaattaaaagtgaaagaggcagaagaatagtggacagaactgcaggatagtccttaaaataatggtggtgggaaaggaaaacacagaatgctcctggcaattctaaattcctaggtttgcctttctagaattccttaagaagctgacagagaaatcagagggttacaagaatttcagaaaatttactccaagtgagaggacatactcacaactcctatgaagggtttctaaggtctttgtcctgtgcaatttgacaatgtgccatttctgtgctgtctctgccctctccctatccgtttgttatgggatgggggattaccctgggaatgatttcagctgcttcttacacagatgcctctcaaggtgttcttttgtgtcctctattttcttcttgtgaactgttaaagctacatgcattattttttttccatttactgaaataaagttttcaagttctaaataaaaatattctgactcgatgaaataaataaaggctacaaaagaaggaagaa

SEQ ID NO: 146 - DNA, 515200 bp, Homo sapiens
tttactttcttccaattaaataacccagtttcgatcatgaaaagggcacttgtttctacaggagctgtgtccagcttcctcagttccaagtactgtttccacacttcttccttgtcattgctgaggttgtatatccacttactcaggaagcaaattccacaaggttgcaagaactgaccccctaagttgttctttcagattctatttctccatagagttcagctaactttttaaactcgggtccccagtctccaaggtagtgataatcctggtctgattgtgtcgttgctgaatccagcgagctgatagacccagcttctgatctctgaccctcataggcataagtctgaagagagtcataagggggaacgctagggtctaggtctgcttctgccagtctttgcttaataaattcctgaacatctatgctttccagggtggatgatgtctggtgtctgggagtgagcttcacttcaggtctgatatccctccggtacttgagctcctcagcagcagaaggattcctcaaggctgtgatgtcaaaggcctctgtgtcttcctctccgcctccttcatcatcataggtgaccacgttctcccgtacatcctcttctgaaatgatcaagggctcttttttgctgcgcctcagggtgataaaaagtaccacaattgctgaggaagaatggaaaaaggatgaagaattaagaaaacaggaaggaaattcttagagattttacaacagcaatttcccattttcccattcgtcattaaccacattccagagttaggctggcattgcagcacaactcactctgtgctctctgaataacaccgcaaggtactgtaatgcctcaaataatgtaaaagatgattaccccaggagacattgcgaattgctgatcttctatagaaaaccacaatactctcagtttgctaagatgtaggtttcttggctcatatttcagtaaaaccatttagtgattaaagtgagataaacacatgatgaaaaaataatatgaaattttaactcaaaaaataatgtagtgagctggtctctctatagatatttaatccttctaggtagatacactaaagatgttttaagtttctggaatattggaagaaggagccttaacgttaaaccctttaaattttgatgctttgtagaaaatcaaagcagaaatattttaatgttgatctcttttgtcaattatcctttaaaattatattatcatgcattaataattgcattttcccattcagggacaaaataatgtttcattatttgtacacaacttgtttcataggaattttttgatttatgaatgttctttatataacttatttatttaattctcacagcagagctgtggctttactctatttttaacccatttatgcctgaggttgcaattttttgtgtgtgaaaaatcagactttggcgataaccttgagcagtaggacataaataacttccacaagcttaatgttccaataatggaacactaggcataaatgagaatgaggaatctgagactcaggaaagagtatctaaataaccaagatcaaaagataagatcacacagatggcaagtggaagagcttgtaccataatgtgatttctcgcatcacaggtaatgatatttctactataaaaatactctacttcagtatttcaaagacatgaaataataaactgagtgtccaactggacatgtgccttaggatagctcttgctaaatatggtggatttgtctttatttccaataatgctgcaaacattagaagatgtgatagaaatgtgtcttgggaactttgctttggccatttatcaatattttcaactgtttctatttgatgaaattaaactgttactaaatagaaatagttccctcacatcaaatttgttataggctgtgttactaggctgagtattatttacttcagctctatagactgctcttttcctgctcagctgatattctaggctttatgatggtgataatgatgcccattaatatttttaacattctttacttcataataatcagggaggtacattcgattgacatttaaggttgttatatttagcaaacaaaaataaatggcaggattctcaattaaacgtgaatttgagatcaataacagcacacacacacacacacacacacacatgcttctcaacctacagtaagcttacattcttataaacccatttgaagttgaaaatatcttaaatcaaaaatgcatttgatacacataatttagtaaacattatagcttagcctagcctaccttaaatgtgctcagaacacattagcctacagtttgccaaacttatctaacacaaaacgtattttataataaagatataaagaattttgaatcagaattcaaaatatggtttctactgaatgcatattgctttcacatccttgttaagtcaaaaaatcttaagtcaaactattgttggttggagaccatctgcaacacacacacacacacacacatacacacacacatacacataaggtattaagtgtgtcccatataatatttgagatacacacaggcaaatattgtgctaagcatacatgcatatgttccaaatattattatattattccttgtgacatatttatgttatatatacacatacatacctatatacagatatagatatatttcttatttatctgaaattcacatttatctgggtatactgcattgtgtctggcaaccttgattataagtgaacttgaatgaatggttgtgaatcaaacaccaggttatctaactctgataaagaacatactttccccccagaaactgcccttttactgcttacctctgcaaagtaacttttatcttcacttttatcattatggttactttgttcttctttatagcttaaccattttaatgtataactctaatctatatggactagttttatctgttttaaaactagagaaaacttgtggaagaggagtagattttaaagccagagatggaaaggaaagtgagagaaagggatggtcactgtgcactgggaggtacccagttttgcagaggaaaggcaaatgggagactatgaaggaaccaaaaagacaggaaaaaaacatctgtagagaaagtcatagaaccatccagaaacgtgtgaaatgaaaagatattagcattgggaaggtaatgagaaaattcaatgagggtcactacagcagacatgggaagcattgaattactactgtttaaaatgaagtggttacagaaagctgaaaatgaaatgttggtgctacacatgccctgatctacaaatattatgcacagaattacagattttcccatatacgttgcctatatgtcaaagacattgcttaatatatgcctttattttggggtaaaaaaggcttttgctgaacataggaaatatgcatttaataactgcctgtgtattttagcataaatccaccttacagttttctaattcaaagctccaaacaacatcctcaagtaattcactccactgtattcagaagtttagatttatcatgcacgatatatatctctgttcatctttataattaaatgaggaggctgttctagatcgaaagacctatttataaagactgcctaatttattataatacaatttcttaccttcaccaataaatcaagttattttcttttatattgaattggttggtggttgatgtcaagggaatttatgtgcagacacaacagggaatatgtaatcaatactgccatagaggtatggaggtaatttgcatccttcaatatttgtgcaatttttcaatctttgcatatgtatcatattcacttaatgaaatacagggataatcctggctttttaattatcatggcatatagtttctatttctcaaaagttaagaaaataattcagatatattatgattcaaaatatagagaccatttacatttgaacgttgaaggtttacatctaccttttccccagaaaaggtagtatttgctacctttctggatattatttgctagtattcagtgattcctaggcttgttacatacttatttaataaaaggagatatatatatatatttatatatatatatgtataaaatcaaaatctgagacatttttgagtgaaaggggatgttgttcataattatgtcaggacatcagggcaaatgcagacataggatccctctagttaaagataaattcaaatcaactcagaaaaatgttgtacattgtgttcctgatgaacttattttcattcctgttggttccacagatatttctggagcagatggcaccaggtagatactccataaacaattatcatgtggacaaacaaaaaaaaaatctctgtgaaaatggtaatgtgacattgtgttaagtgaattaccctgaacagtaatagcctcactaggaaaataattttaagatattttttaaaaattagcttatggttactaataacatcaaactcctaattgtactggagaatatttcttaatgtttgaaaaacaaatgaaatgtttccaaaaaaaatcctaagaccaaagtatattttaaaagaatgagtgcagataataattatacatataaatagagtcaaatccttatttaaaaactgacagtcaaaagaatgtattcaaatgaccctgataacctatcaaagcatacacattggcaaggtacctcttcttacagtgagtcatctggtaaaatacaatatgagagaaccaaggtggtgttacaaaaaaaagaaaagatatagaacttgtttttctttgtacaaaataataaataatttatgatataatttgaagccaactggattgaaacttgaataagctgtagaattttttacatgtctttagtctaaaataaatattttatccttggttagtgaatttctttttcttctgttcaagtttgggcagaattttaaatgcccgtgagattatcattttatattataaattagaataaatttgtggagttttatgaattaattttatcatcaagtaattcaaagatggggaaacattttttgtatttgttttctcataatatgtattttttcctatatattatgtatcattccagtgcttggcatactaagtggctttcagttcccataatataaactatcatacaacttgaatttgaacccattccatactgaatctcaacatactcctccctaagtagcttgcatagcagaattttttaaacctcaaataccacttgattctttgtcataccatcatatgttggcactgaatttggtagaattgaggtggcctgagtcagggaggttatttttattgacttacggagtgtgacttgccacacttgggagtggcatctctctctgaaaccttagatttttaaaccaagggtagcacacaaaaccatttgaaatagctcaaatgaaaagcaggctgacctttatctcctcaccaattccatcttcttctcttagttcaccacgtgttcacaccaactccattctgatcctcatttatcaggaaatttatatccaatattagggagcaatccatgtctcacttatggtggcctcacctaggttacctgcttatatgtaagctgtggactgaaagggtagctggaagaggtcccagtcagatcccgactcaatgacttatgcctagtgtgatcaagatttgccttgccaactactctagtccctctggcaagagatggggtaaagttgggaaataaaagtcaggcctctgggagggagagaggatttcagctacctctactgtcatggtaaattctgattgcatcataaaggctcactctaaattctcttccatccatcatatgcaatagacctgaaaaaggtaacctcaacagacagtaactcagctcataatgtttatatctatcatttaaagttagcctctttggttgacaagcaccattcaacgtatacatagatggattccgaccatgttgtaaaatgttgaaccatatgcaatctttaataaaacaagaataagcatttcaaaattctacagaatgactctaaggtcctttcaactgaaatgtcattctcacaggtttagaaatagaaacaagaaaaactgaatgtgtggctttagatcacacagttattggcaaaactagagctgggtttgtacaatcatagccattttcacaaacaagaagctgagagggaaaattttttaatattaaaatattaattttacaatttgtttagctgcgagggttgaacgttatttcagaattacgagttcaaaaataaagttttgctacatttggttttgtcgatatttatgccgaaaatcataatctcataaattaacttcaacattattttaaaattacagatggctatatcctgtatcccttggctagatactttctgaataacaataaaaacgaatcaatgccatgaaaagcaaatattgcattataatatataattgtagttatatattttcactaattttattagttgaaacttaaatatgcttttagagcatcttctcaccaattccatcttcttctctttgtccaccacgtgttcacaccaaacccacttcgatccccatttatccggaaatttatatctaggataaggagcagtccatgcctcacttacggtggcctcacctaggtcacctgcttatatgtgaggtatggactgaaaggggagctggcagaggtcccagtcagatcacggctcaaatatgcttttacagcatatttgagtttcaactaataaaaatgaaaaagtaaacatatcatatagtaactttattagtcttgagggatataataaaatttacaaatgttctattacttaccccaaatgagaaaacattttcataaaaaccaattaaaatgaagtatcattccatgaaaacataaaatgttctttcaataatgcacctcaacatgtacctagacatttaacacattaattacatttttgatatttatcttagtaaacaaaaatagttttatgatgataaacaagctcaaaatttgaagataacatgcttcacctaagagatcgacttttaagagtaagaacgctggaagaactctcattaaaatccctgcgttctattctctatgacttcagttaggactctagagagatccagggtaattgttgtgcagccttgttttctctttctggagtgtttgtgctcttcttcttttcaaatatacacaaaaaagaagtatgttaatatctaaagaaaacagcagttctgaccaataaatatataaagtttattttatttatttatttatttatttatttatttatttatttatttgagatggagtctcactctgtcatccaggctggagtgcagtggcgccatctcagctccactgcaagctccgcctcccgggctcacgccattctcctgcctcagcctcccgagtagctgggactacaggcgcccgccaccaagcccgactaattttttgtgtttttagtagagacagggtttcaccgtgttagccaggatggtctcgatcccctgacctcgtgatgcgcccacctcagcctcccaaagtgctgggattatggcatgagccaccgcgcccggccatataaagtttctaaaggctcttttcctgactttcctctccaccatacatttactgtacatatttatttgtttttatttatttatttatttttgagacagagtctcactctgtcacccaggctgaagtgcggtggtgtgatcatggctcactgcagcctccaactcccaggctcaagggatcctctcatctcagcctctcaagtagcttcaactacaggtgcatgccaccatgacgagctagaaatgactggaatgcagtgaaatagttcttgctctggtgcaccaaacttccatccttcatgttgctaagtacaactgagcattttggtgctcaatttattgaacttgtaagcatcttttgactttgttgacaagatttactacaaagcataatgctccttgataccctcttttccctcaacgtttgtgacattatactttactttcttcctactctcacttcttcactgtcctctgctatctcatccttatttagtgatcacattgtagtttctcactgtgtaatcccagtccattatctctctacatatattctcttgctgggcaacttgaatgaagtggacttccagtgtcctctagctcagggtagttcaggatctacattcagcaacatataagaagttatatttgaggccattctaactcatgcaggtatctacattatcaaagatcatttttctgagtccattgaaagtacctagatattattcacttttcctcaggtctgttataagtatgctactctaacacgtactgtgtcgaagggagacaagggcagacttttcctaactggtttccctacatgccctcttgtcaccaggagttctattctccatttcattcacagtcatcttttgcaaattgaagattttataatgggactctctagctttaaacctttctttacactcctaaaacaaaactcaccagctttgccatctcccacaagtctctggatgctctcaccctttcctacaaatcccttctcctttccaagctcattacactttaatatccactccatctatacaagttatttgtcttcaaccccaggaacaaaacaaggaacatattttttcaagaatacctctttctcagaaaaacagtcaattatcttttcatgtatgtcagtaccataaaaggaataaaaaacaggctgctaagagaaagaaaaaagactttggacacaggtccccacttgatgaagcagaaagattccttacatccatctttcttgttattacaatacagatttgctatcttgtttcaaagagcattctaaagagtttatagttatagaagctcttcatgcggctgtgaaaagatttagattattacaacagataatgtaaaattagagaaagtgtgttttttaataaactgtaatgaaaatttcaaataaaaaatttattttattttattattattatttttttgagactgagtctcactttgttgcccaggctggagtgcagtggcgcgatctcagctcactgccagctccgcctcccaggttcatgccattctcctgcctcagcctcccgagtagctgggactacaggtgcctgccaccacccctggctaatttttttgtattttcagtagaaacggggtttcactgtgttagccaggatagtctcgatctcctgacttcgtgatccgcccgcctcggcctcccaaagtgctgggattacaggcgtgagccaccgcacctggccaaaaattattgtttttaagggaatataattaaattcaataaaatttaatatccctctaagaccaaaaaatatttagtcagtatgttaataactagctaacattaatgattaactaattattgtgaactagtagaagtttctacaagttatctattttttatttggttttcagattcgttttgttttatggtttattcatttatatatttaaggtgtgcaacatgatgatgttttcccaataatagttttcactattattacacagtgaaatgcctagtgtagtcaagcaaattaatgtttctgtcatctcacgtagttacactcttttttcacgtgaaggggaaaaagcacctgaagtttactgtctttgcaaatttccaatacaacacaatattgttattaattaaagtccttttgttgtatatttgatctctcattttttgtacatttactcaccctaaggccatatgaccctcaccctcatgctgaatgaatgggtgacctcctctgatctcagaagctaagcgggctggggtcttggtcagattcatttagaatgatgccgcttagattcttgccaaaaatttttaaaagctctttcacggtgggattctgaatattttaatattaattctttccaaaatatacactttcaaaagctatttctttccgattttatccttcttctgttatttcagttcttccaacatatttgaatctaactattttgagattaatgacagtattgagaaaattaattcataggaaattggagcagctgtttccttacccacattatggatgcctaatccttaagatttgtcaaaatgattccctctcattcagaattgccatcatgcaaacttagggtttagaatgacttacccaggagaatgagaacacagagaagaatagcgattaaggctcctgtactcaaaccagccgaggacaggaaggcttctgcatggcaggtccgcacacgcccatctctctcgcatgcacaaaccctgatggtgagggtgctgctgctgctgagagaggggattccaccatcagagatcataatgggcagataatacacatcctgaacagttcgactaaatctcctccgccttgtcagaatgctggctgtgttatctatgatagacataagcaaaacaaaatacacttagtcaagccgccattcaagattcacatttcctttaatggataaaatggggatgtgtatctttcttgtttcagtttatgaaatggacaagggaacacgaaggggcaattattaaagagaagctaatattggttctccaactgagaaacctatttagaaaaattaatacagccacactaaagatgaaagaaaatagtgggaagacaaagcaggaggaagcaatgaacattttggacatggacctaatagctataagatttaaagggatgcggacggcctgaagtcatacacttagggtcctatactttgaagtgagccaatgagattttctccaaacctagaggctctgaatataggtaataggagcacaaatctgtatttttagcaaactactgaggtgaagttgatgcataaaacaggtataagaataactggtttatataatatttctatggagacagtagatcaagcaacaaactttttagacttggctgtgatttgaagctgtattgtttgaccatggggaagttaatgatgaataaaatagctaatcatatttttaaaaatgtgtttattaaatgcaatgtactataataaatgcctgcatgatatattgtgttcaatctataaaactttatgagggacaggatgctaaattctttaattcatagctgaaaataatttttgttataaatactaatttaaaagtaaataaccctagtcccagagtgttagttgcccaaaatcacaaagctagtaaatgataaggataaaacctctattctagaaccctgctcaacaccacaatgtcacattgcctcatctacaattcactgccaaatggtattgatgtccgcagtgcgcataatatatgtttcattgtactgttattcctcgtccctgaatgcatagctgaaaacccacatggtccatacttggatgtactgttcagatcccttcataaaatttcctgttgccgtagctatagattgccacctgcccccaggtcacacttctggaatagcatataactaacgactcactgctgaaaggttacaaacgttgggccatcccccttcctgcactactgacaatactgatggacaactttagctccagagcttttccatagggtcagccattaagagacattaagagtgaatgtcagctccatctgtcactctacgctgtcgttcttccttctcctgtgatctacagatgttgatcccaatggcatactccactaacacctgcgctccaaatgccaattcaactccagggaactcaataggcagctacatctatgagttaattattttgcactaaaaagtaagtgggtcattagacaattacaattagggcctctttttctcttaacaatgtcttttattctgaaaatagaaattgtattttatgtaggtatgtttataacagtcacagtgcaatatcctaaaatgatattatttattgtacattgctaaattaacataataaaaaagctaatttttaaaatattcaatgtactacatataataaaacacaagaaaatatgcacatacatacatatatgattgagttactgaaaatcagaaataaataatctaatgagaaattgaagaaaattttcttacctagtgaaagaagaatttttaaaaactacatcagctgtctattcttttttttttttttttagatggcgtctcgctctgttgcccaggctggagtgcagtggcgccacctcggctcactgcaagctcagcctcccgagttcatgccattctcctgcctcagcctccagagtagctgggactacaggcgcctgccaacatgcctggctaattttttgtatttttagtagagacggggtttcaccgtgttagccaggatggtctcgatctcctgacctcacgatccacccgcctcggcctcccaaagtgctgggattacaggcgtgagccactgcgcctggccagctgtctatttttaaacatgttataggatagagaaagaagtggagaaatgacatcacgtgtattatataataatttatcagtcatgtttactctcccagaaaacctgacttttgtggaagcagatctatcagctgtaggatgttgcatcacaatgaacagaagtctttagtctatgggaaatgtgtgaaataagtattcacgggcacaaacatgtttgacaatcttacagctgctcctctgaaaaagagatgtgagacactggtccctgaatctcaggaaacacgaataataacatgtgaaatgacagaacatgcagtgtagatggcggctctttcatggctcaggcctagcatacgtctcatattaataatcttgaagcatgctattttcaggaaaactattggaaatgcaatcagaaataagacaaataccagaatatgtttctagtgcattttaagtcctgaaatagaaatctctaagacataaggacataaagatgttcattcctgtttttcccgttaaagttttgacttttgaaaagaaaggatgattcaggaggcaagagcttcccacctagaaaggcttagcacagcagaataatgaactcttgacaaggcatattctgtacctcaccggaacagtacaaaatgtacttggcagaaggctcactgaacttgaaaaataaaattttgaacactgaggaagaatatgaaaggaagaagaaatatatatatattatatagatatgtattatatagaaatatatatatacacacatacatatatacacatacacacaaacacaacacaccatacacaccaattcccacatgtacatatatatgtgtatatatcagacacaataaaatacgtcttgctgaaattgcaaaattaggcgacaagacccataacaaatctctaatgcgatatacaatggttaaaaaataaatgagggccaggcgcagtggatcacacctgtaatcccaacgctttgggaggccaaggcgggtggatcaactgaggtcaggagttcaagaccagcctggccaacatggtgaaaccccgtctctactaaaatatacaaaaattagctgggtgtggtggcgggcgcctataatctcagctacttgggaggctgaggcaggagaattgctggaactcgggaggcagaggttgcagagagccgagatcacgccattgcatgccagcctaggctgtcagcagtgagactctgtctctaaataaataaataaataaataagatattatagaaagtctcaaatggcatccaaatgaataagaaaaattaatataggctgaataaagagaaaacatagcatgatagaacatctgtggatgagaagtactaattgtcaatgtcaatctctaataatgtgcaccatagctgggttcttaattctaactctctatagcttggatgaagacagcagattatagaacacttggaagccaagctagtaaagctaatgtattagattaagattcgaggagattttgtatagccagaacaaagaaatttaacaataagacaggaaataaagatgcatattagaggctagactttggaaagtatcacatagggaggatcttgaatagcagctttattttaaaatatagatagatgattgaaaggtaggtaaataggtacataggtaaatgatagatagattagatagacaaatatagacatatagccataagtctacagagctgtcaaacaagctaaacaatctgagagcattcaataaagataagaaatttctgcttctctttattgaaaggatggctgcactggagtactgggcatagttttgggttcactgcattaaaagtaaaattttaaaccaataatatgtgtttagaagactttgagaccttaaaaaatagtttggaaaatatttcacatgaagaattaacagaatgtttacatgtcatatatgaattttgttgacaaaagggcccctgaaaatgtccagaaaattttggaaaactttttatctttttcattataaccaatatgttcctagtatttccataaaccatacccttagtttaatgcagaaatagtgttgcatgtattttaatatttaaaaatagatgacaatgcattatttattttgttatgtgatcccatttcttgttcaaaaagaatatggacacaaataggatgaagcagggaggttttcacatgcatatataatatcaggcttatgcctacactctaataataccctgtgataactgtgaaataattgaaatttcatttatttgaaaagcaatcataataataaatataatttatccatctttctagcaataaatattccaaagatgtttacaattggtaaaaatgttgtggggctatttcacaaaaatatttgtcataaaatatattgttaggtagttatgcattcaacttctgtatttctacaggccacagaatacattagtagaatacaagtcacatgcttctggagatcagatgtagttttcttgagctactattatatgtctcatttttttgttcaatagtttgaaagaccttgcaggatagactttaatttatgtgccactgtagcaaactataatacagttcaatttaaaataaggcatgtctttaaaataggttttggggcaaaaataaatcctattttttagtccaaaattaccttatagcttagaaaatattaaaaagtatgtgttttttgaaactgaaattatcagacacctactctcagttatatcagcaaatttcttttctgataatgcaggcaaagatatattttatttcaagcatagcctgccagaccattaaagtaatatttccaaatctatcagaacagcagaaacatttgaaatcctcagatgtggatctctaattagaccaaaaaattttttaatgtgtatgaagagaaagctaggaaatacggctcaacttccaccagacaaatcaataggcatggtttcatattgtctctgagtttttttcagtcttgcggcagaaatagaatctattcataatttaaccattatcagagtgcatgcatcaaacaatggtgttttgcattccctcaaagctccctttccataatcggtacttgattaataatgatttgaactacactcagcaggaacttgtcttctgttacaattttattatattgacatggaggaagaaattgaaagcaaaatgaactaatatatcttgtaacacttcagcagcatgttctctttatgctctttaacgaaggtttatttcttcgtattctctgacttccctttctttgaatcttacagtggcttaatctccattttcggactctggattctgcttgttcatctcagtttgcaaacatccttgtggccttacttgtctttctgccaaactacaaatgcatgatccaatatgtcattatgttctgatctgcaccctggaatgtcatccctttgaccatctgccacactccttcctacttgataatcttaaaatcctggataaatacagtgtccattgtctatttctgctttggattcacaaataatgctgatacaaattataaccatcttaactgattccacctagtatatagaaaaatttaaaataaatgtacttattttataatctccgaggagattagtaatcaatctgttagtgtttgttcttttttttttctttttttttttttttgagactgagtctctctctgtcgcccaggctggagtgcagtggtgcaatcttggctcactgcaacctccacctcccgggttcaagcgattctcctgcctcagcctccaaagtagctgggactacaggcgcccgccaccacacctggctaatgttttgtatttttagtagagacagggtttcaccatgttggccaggctggtctcaaactcctgaccttgtgatctgccccccttggcctcccatagtgctgggattacaggtgtgagccaccgcgcctggccaatatttgttcttttatcagatgctacacagtagctcttctaagtttcttttgtcctttttcttctgagctgtttttccactctcgtcacgaaaacatctttttctgcaaagaagctgccatctattaccaagatttttaaaaaaaagtattttaaattgttcaatctttctttgccattacatctgtatattcaagactgtatttcgggctttacaaaataagcacaaatacacatgaaacaactatgtgattcttgaagaatatcaggaaatgtgcttatgaataacacacaaatttgttgaagtgttaatttaaagaggagggaaatgaagaaaaagtgagcttttaaaataaagtccaagccaaaatgtaaaataattcataaacatacaactataatataataactgcagaagtagagataagaacagctgtttttttaaaacaaatataggagtctgaactccaagagaaaacttctacccgttatttatcacaaaccttttataaacagtatttttttagtagagaatgaatgagttaaaacagaaaaaaaaactatgtttggagtcactagatttataaacactaaaaaaaaattgtaagcataaatcctcagagagttttaacaagtgaatgtataattctatttttaaaatagtttttcttcacctgcattaatgtacatggtggagcaggtgactcctgtagcaccatgtggttcttagtaaggaaagaattaaagcagaagaatggaacctactttttcacaaaaggaaagcaagtgacatgcaatgataaaattagttttttttatatatgatatatcacatatataaaaatctgtttttttttttttttttttttttttttttttgagacagagtcttgctctgtcaccaggctggggcactggagtgcagtggtgcgatcttggcttactgcaaccttcacctcgcgggttcaagtgattctcctgcctcagcctcccaagtagctgggactacaggcgtgcaccaccacacccagctaatttttatatttttagtagagacagggtttcaccatgttggccaggatgatctcaatctctggacctcatgatctgcacacctcagcctcccaaagtgctgggattacaggtgtgggccactgcgcccagccaaaattagcaatgtttttgttttgtttttctacttctatttttttgcttagtgaatatgagtcagttttctttcatttgtgagtaggagtaaaaaggtgagaggtggtgtgggctggcaaatccataaggggaaaaataattttatatataggtaaaacaacaatcaatgtttctatgttttacatatatatataaaacaacaattaatagagtttgaaataaccagagagagaacaaaagcatatctttctacctaaagcaatagagccactaaaatggatcactacagttaatccacaatcttttacattttagggtcaagattgtatacatgctctttaatttctcactagtcaagcttgagtgtctgcattcaggtaaaggatggtgtaattctctcaaggtgcatctggataaatgttagtatttgactgataggagaaaggagagccactgtagaataaaatccatgtgttccaacctcgtccctgaccttagataactgactcagcaggacacagttacagccacatccattagaggatatatgaggcttgatttgcaacttagggtggattatatgtgtgttattttgtttaggaatgtgaggaatcactaaatggtctcttgaaaccctgtggataaaaacaaaattttaaatggttatactctgtagagaaattaagcatattacaacaccagctgtgagttcttgtttgaaggacaaaaataaactacgggaatgttgactgctacaaatctggcaatgccaaagaaatacaagataaacatttaaaaattcccttgatttccaatgtgtatcaaactacatacctgcatttccctaccaatggagtgtgaaatttgaaaagactccaaaagacttctttctaacagttacatagtcaacactgaaaatatcccttattgtaacttctatgcaatatcagcttaaagttatatcttctttcgccaaccccaaatagccacaagaaaaaaagttttcctgtttccttttaagtgttttgttaaaaattataaagcaacttataaatgttatgatcatttttaggagaatgaatgctgcaaaaaaaaacaagtaataaagccaaagaaaacagtaaatcttcagaatgccaccaacaaagtaataatgacactccaagaaatcttgtttcataggattaaaaaaattaatttccagtgcattttttcttgtcttagaaataatgtgttatgttgactcatttatttttaaagaattcaagtatctatgagaatggaaaacacatacaaaaaaagagaacataataaaaaccgatgtgagtagtagatattcctgatagcaaatcatcaaaaaaaaataagcattttcaaatgtaaaagacaaattaaatgtgatttagaaccctgtaaacagagatagaaatgcacacacaattactaataatcttttgccctaataaaatctgtaagatttacaaatgtaccttacagttagaattaagccggagaattaggttggcaaatctctttacatcaaataaagcacattccctcaagaaacagcaggaagatcttgaaacagaatggatttatctttgtagactaatgatttcatattgggggattaggttgcacttgcatattacaaatgaatgaacatggttattatattcctggaagtctggctcaagcctatattcataaatttagtaataatatggccatagtttattcactatagatgtgaagttaagcagttaaaattatacaatgaaattatttgatgttaaaattaaaagttgacatcacaacttaaagtaagaaaaaaactacattttaatcagaaaacatttcatacttttttgttgttttagaaaatacaactttaaatgctctaacttaaaaatcatctttgaactctggtttttaaattttaaataaagttatgttattaccaacatattaattaacgataaaaataaggtcaatattaagcaaaattatgtattttacaatatatattataaaagaaaaacccttcacttggttattctctgaatcaatgttaaatatttaataaattgggagaaataactttccagataaatacggaggatttcttggcacaattttttctagccaccacaatttggtactaaagcaactaaagaatgaatgtcagagtatcttatactggagtacagaataaggcacagtgcttagtcattagtatgttctcatgagtgaattaaaatgccattgagtctcttctttgctacatttccctctctagatttttccaaccaagtaattgacgctgcattctgtcatctctatgttgttttaatctactacttactgaaaagtaatctctgagtcactctccctggtggaacagcctctatccttaaagtcaaaccatgttctaccacttttaacaatacaatttgtagtgatctctctaaagtagctcacatttcacctccatcaactgcaaattacataattacatttcatatcatcctcatttccccaactagacagcaagccccttgaaagcaggacctgtgtctttgaattccttgaatcagaacagtttaaataactgctgtatacccagcagacagtacataacactggaaaaattaactagcagaagaaaaacaatgttaagaactgtctacagaatttctcttaagaagaaaggcgttctttccaaggaacataaggaagggtgatgataaataataatttgatgtgaggctagagtggtacatgctggacagatagcttaaaatgtcagcccgagggaattggggtgtgtgtgtgtgtgtgtgtgtgtgtgtgtgtaaagcgtttgtcttcattttgaattaggtccaataagtgaatatattcatattgacaatatgcaaagtgtatttaatagacatttcataagaaatcctatattttcaatcaatttatcattgtttttatatgtgattatattcaacacttcattgtttctggtaaatgtttaatcacattagtttagagaaagtttattttacacttcacctttgaaaaatgtttattcttatttcatcttattgtcatttggcaataatagctccaacagttacatagtcaatattgaaaaatcccttattgtaactttttgccaaatgaattttattataaataatacagttgttgttttctgtaacattcagtattttgaaataccattgcttacttgtctcatgagtgttatcttagaaaaggattcttttattgtagttctttctttcaaatatcactaaaagaagatcaactggctgttcacttctaattttacaaatgagtattttgacactatctactacttttacaatttaaattcactgtgtggaaatttgtaacattatttcatcatctgtcaagttagaagatttccactcttaaatctatatttttcttcactcaggataatttctttagttattccattattgtttttccatcgatttatttatgttttagttatcttcaatgtgcctattatgactcattacattgcatgtgtgttttcaaattctttattgtttcatctctatgtacactgataaaataataattgcctatatgtctccattttacaaaagagaaaacagagatcccgtaaacataaggaagtggccatagtttcacctataattactagagaagccaggcttcaaacagcagcaagctgtttctagagtctaactccgaaacattctatttgtttccccttttgaactttctgctcactgatgcagtttttaatagtttccatttgaattgtatcatcttaccagattttttaaattttcatgttagctcaaaaagtctcacttagatatataatcacgttcaatatgtcctaattcataataactgcctctgtccttgaactaacttgacccctgccatgtcctctgatctttctctaagaaaggtgttttgagctctgattcccagagattcctccaacatagtaagggatcgtaggtagaattgagtcagcatctaaatatcttcctgtaaatctcaaagtctctctgccttggaggtgacttttgggatccatccataggtcaagtttatttagctgtccatgttatcccagttaagatttggaaaagagaatgagttggaaatcgattcttaggctataatttctgtcacctgatatcccttttcagatggctactaagctggcctttcctttccctgcagtctgtacactcaaactttcattaacagttcgtactgtgagaacataattctttgggaagaattctttgggaaggatatgtagcaggcatgtaaaagtaatagaggcaacaagtgcctgagaaacagggaatattggttgaaatggtgactaatcctcagagattttggagagaaacttggatttgctaggtacatgagatggggttctaacccaatttaattaaatttgaaagagcaaatatctgtagcattcaaaggaatatccaggcagcaatcatcttcatgataattagactatcattgaacggcatcctttctctgaaactccatttatgtcccaattacttaatgaaacttttctcaaacaaatggttcttcatttataaaatgtaggtctaggtaaaatacgcagtttttgatcgacaaattctcccactaaaaacaaagagagaagcttaaaatatcaataaaatctcagccgggagctgtggttcacacctgtaatcccagcactttgggaggccgagatgggcagatcacctgaggtcgggagattgagaccagcctgatcaacatggagaaaccccgtctctactaaaaatacaaaattagccgggcgtggtggcacatgcctgtaatcccagctactcggcttgaacccaggaggctgaggttgccgaaagccgagatcccgccattgcactacagcctgggcaaaaagagtgaaactgtctcaaaaaaaaaaaaaaaaaaaaaaaaagaaagaaagaaagaaaagaatatctccacttatgggcagcagaaaactgctgaagtgagataaatagaggagttaatattctagagaagaagcaaaccgttggttgcaaaacagcctttcttctataggtatttacttatattaggaactaagaagaggctgggattctaagctggggacagagaaatgaggggagtttttggaagtttcctggatctacaattaaattggaaattgagggacatggctgattttccctaaagacatttgttacattcaaaatttagattgaaagttaaattggaagtttaacagaatgctaaacctctaagctgaaaagccctggaagacaaaagaaaagcttttttgttatatcttggtgttgaacagtgattaaagctaaaggccactgtgagtgcacaaggaggctctcagtctagagccctagagggtcatcttctaaaaacagacaaatcagagacaaactgaaactaaacaaaactgcaaatcagctgtgactcagttcagactctgagtggattaaagtgactacaatcctctctaattgcttaccagagaaatggtgaatactctcttgggaaacatattatcatttgatcttctgttagtgctatagcttgaatgtttttgtcccgtcccaaattcatgtgttggaatcttagtcaccgacacaataatgttgggaggtggggcctaatgggtggtgtttaggtcttgagagctccagtcccatgaaggaattaatgccacagtaaaaagggctttcaggccgggcacattgactcacacctgtaattccaggattttgggaggccaaggcgggtggatcacttgaggtcaagagttcaagaccagtctggccaacatggtaaaccctgtctccactaaaaatacaaaaattagccaggtgtggtggaaagtgcctgtagtcccagatactcgggaggctgagttaggagaatcgcttgaacctgagaggcggaggtttcagtgagctgagattgcaccactgcattccagcttaggcaacagagtgagactccatctcaaaaaaaaaaaaaaaaaaaaggctttcaggagtgagatttttttctcttccactgtcctgccacataaagaaaagtgttccttctgtccaaaggtgtcatcttggaagcagagcccaggcccttacagacaacaaatgatcttagagttcccagcttccacaactgtgagaaataaatttttcttctatacaaattctcagtctcaggtattccactatagcagcacaaaacatgtgacattcaataaaaaattctctatatatcaagaaataagaccatgtgttccagtcctgtctccactttcccctacccccaccaggacaaaaaaaaaggcaaacaaacaaaaaactggcatttgttctagatattagaaaaggctgacaatgattgtaaaatcattaagaataaaatgctaaagaaaatgttaaaaataaagaatttcactagtgatttacatgtctataaaataatcaaatggatatcaaccaaagctgtatgtgtatagaccacattttctttgaatggatgtatttgttcttataggactgttgcttccttaagcagttcattagctccatgctagtatttccaccaatatattcccagcacatgtcacagtaataaaacctaggtccaaaataaagaaactttaaaaataaacatgatggaacattaaagaagacatttgttctgcaacgttcaggtgaatcatcagattccaaattcaagagggttagaacatatgtcaggaaagatcccatgggaatgggaaagatccgacaaaaccatggaacattgtgttacatttagttatttagcaaagcagatttagatattaaataggagaatttcatcagagtatagatgggcgaagatcttcttggtgtgaggaaattagctaccttatgtaattctaggcataaacactgctaaagtattctctggtatgaactcagaatgcatgcattaagaagttataataagaacataggtgtttttacaatagttgctcgtaggagttacttccataaagtgtcaagaaatgtaaagggtgtgagctgagattgtacctacttacatgctagtcagttagcctgacacagtgttatagatgctggaagaaaacacaagcctcctgagtcaaagacaaaggattttttacttacatcacagcaaggagcataagttcttcttcagatttgtttccttataccttaaggtgaagaggagtgatgtggaggccccaggtggtgtgcagcacacagtgggtttgtacctcaactaaggaatcttaaatttagggagcctggatctttgataataaattgtaagaaaacatgcccaatctctgtatcagagagtatcattatccttattaatactatacatcaaataaatacgtcttttcaacctaaggaagacactgtatcttccaaggctgattggtatacaaacactgcagaagagacagtctggaagaaaataaaaaattaatgcctctgctcgcaagacatgaagaaatgcaagagtttcatgagaaattgtgccctagcatgaacatcctgaggagaagaattgaagatctgaagaagtcctggtattattgctcacaaagggaaactgttccgtagtcttaaggtattttacaatagttacaattaaagatgattgataccactgcacttccttgctcacaatccattatctacatatcagccaaaatattcctttagaaatcgtactacatcactcatgttaaaaagttagtttcgctatcttccattgaaattatgattgattttttaaagaaacaaaaactgagattgacttctcacagcctaagaaatcaagctggctatagattgcctctccagacaactctaactttaatttccactttcaatacctatgttgactttatatggaactttagccagttccttaagctcactctgctactcttcctcatatcttagggcctttaggcttgctaaacttcttgcctataaattttagccattccctcttttcttgttaagcttcattcatcattcagttgtcaagttacgtatctccatctttaggaactagtcctaattccccattccaggacagacacatctcttatatgctggttgagcagcatgtttattctttgctccatttcagtgtgtgcaagatgtctttgagaacaagaaatagcctgaccacacctgtgatgagatcatcacttgccacagaaacctacaggaatagtgtttacatgcacgttggttgaatgaatacatgagctccaattttgtgcctggaaacatgctaaacttgttttagtgaactctgtccctcatgtagaaattaaaagaaaacattaccacttagatttgaaacacattattatgccacatttgtttctgatctctttttaagatataagacattacagttacagtctttgctttctatctgatcccacttcttttctacctaactacagattctttcccaactatagatttcaattgtactaaatatttatacaattttatgtagttcctagttgttcaatagctataattgcatatatgtgctatatatacatatgtgtgcatacatataattaaaattaaaatttctgaacatatatatagctacatatatatcattaaatttctacatatctctatgtggatctatatagttctctatatatgtcaaaactataattttattttgacatgaattttctaattttttatacatatttcttttactgttgcctcattttgtctaaccaatttttttatcttttttgtaaatatgttattaatttatttctgtattttgaagtaacaaaagcatttttgtcataatttatgcatttttcattagtcagagcaaattcatttttctgatttctttctcaattcattcactatcttttaaatttttggttctcaggcttatcatgaacaacaacatgcatctctttctctctctctttttttgaaaaatctgtttctgtgcccttgctttttgtcatatagcaatttgggagatgtcactaaaccaatagctttctgatcactcatcctggtttcggggctatgtctgatttctgttgtttctctcaatacagactttcatgtgagaagtaggcacagaaagtaataatttttttctagatttatttctttatattctgggggcttgtaaatgtcagttaacttacataggcacagaaaatgataaattttcttctagctttttttttttaatgttctgtgggcatgtaaatgtcacttaacttacataatacaaagcccaagcacacaagaccctgcagtccagcattttctgacccttattccactgtattttcattttaattgatctccagagtacatgaataaatatatgtatgtaagcatgtgcatatgcatgtatgtatacagtttggtagggctattttatttttaatttcatctttatacagtattatctataattgctttgtctatggaggcaagaccatttgattctaatatatttatatatggtattattaaatctaccaagggtactaagccagtgattgtaatcatggaaaatggatttaagaactgaggctcaggaggtttaggggctgaatttatggaggacaaccaagactgttaactcaagtacatgttttcagctatgtgtcaatatttccatccaaaagaattgctgcttttttctatccaagataaattatttctgtgttatttataatttcaatactcaaaaattgtaaaaatattctaacaaaaattttaaacatctttagcactatgcaaccatccacagacttctcacactcaagctactgtagctgatgtaaacttcatttgcatagttaaatgttaaaaaatgtacacacaaactcttttaaaagcatgtacatattttttaggggaaaacctatatatgagttctgacactagtaatgttgtcaaatcatttaattaagacatttcaaatataatgggtaattagcggccagtcacggtagctcacacctgtaatcccagagctttgggaggctgaggcaggcagatcacctgaggtcaggagtttgagaccaacctggccaacatgatgaaaccctgtctctactaaaaaatacaaaaaaattgccaggcgtggtggtgggcgcctgtaatcccagctgcttgggaagccaaggaaggagaatcgcttggacccaggagctggaggttgcagtgagcagagatcacgccattacaattcagcctgggcaacaagagggaaactctatctcaatatatacaaatatatataattacatttacatatatataaaaatatatataattacaattacatatataaacatatatataattacatatataattacaattatatatatataattttaatttaattcacaaattccagctataacaatcttttatgaagaacttctcattaagaatgtgggatttggccaggggcagaggcttattcctgtattcccagcactttgggaggccgaggcgggtagatcacctgaggtcaggagttcgagatcagcctggccaacatggtgaaaccctgtctctactgaaaaaaacaaacaaacaagcaaacaaaaaactagccaggcatggtacgagagcaaacctccctcttaaaaaagaaaaaaaaaaaaaaaagaatgtgggattcaataatagcaaaattattctgttttttctaaaatacattcagagttatacctatgtaggttaaactgcttgaattgaacacatcttcaaatcgaagtcaaattttcattgtaatgttatcaaatttaaattattttaaaatataaatttttattggaatagaaaaaaatgcaactgaaacataagtacatggatcaacatatgattccaatctcctaaggaagcaagttaaataacctctgccaaattttacaattctttgaaatatggaaaaatatgattttttcacaagtttcacatagttaatcatactaagtatatttgaattataagacagcctgttctaatgtaagtaaatgtacaatagtcagttaaatgcaatttgtcatacacaaacatgcacaaatattgattcccataagcagagctgacatagggccacttaaaatgtgagagacaattaagctttaaatgttcatatagatcttttggctttgtgcgcattttgatactttgttatatttaaagatgttcagggaaaatgggaaaaatgcttttggcaggttgtcatttagtgacttgcatttgaaaatcttctcccggaagtgaagagaaagggaattcaatgtttacttcaaaatgtatgtgccactgttttctgcatgtgattctgaggcaagtgttaaattccaaatagcagcatattcagataaacataatcaaatatatagtttggacaaagaaaaagttgatcctaatcagaaaactgcacataccatatggcttaatgtttccctaatgtatgaagaatgacttatatggaaccttgagaaatgtaccaaagaggacatctaaataatgaagaaacttccgtagttactaaattatgggattatttttaaccacactatacagaaggctaaatgaaaatgattcaaaaatttccaaaatatgctgcatacttctgtgtatccttctacccatattttggacaatgcttataataacaagaggaaatataatttgtaaagcacatcttgatagccttgctcatacaagatgattgcaagcattgcatttcctttagtaactgtctctaggatatatttttcattttttcctaatttgaatattttctacctccaagcagtggcagcagctctcataaacaagtttgtcagctaagatttctcttaaaatttgcccaagagcatattacatgtacatttcttgtttaaagagatgcttctgaataaattcaatgaaagttatttgtacatatggctcaattttaaacacaagctattcacagatcataacacagtagcatcaaactgactttgaatgctgatttgcaagatgtttgtgtgtatataagaataaagcctattacatataaggtcaaagcagataccacatagataaacaaatatgtgtatatatgttcaccttcattgtccttcagagtgaagtttggatttacaggcaggcgttcatcaagaaagaagttaaaccttggtccattggcaaaatcatctttatcagtggcactgatggtatgaataacctaaagaaaagacaaactctaaatcgtaaatttaattttgcttgttctcttgattttaattacactgtattatttctgtttaaaaatatttttaaaggatcttttcttccaacttgagttatttttcaaattcaggtcataaaacaatcaactaaattgctgtatcctgcattagattttaggaaaaacacagtatataatttctaaacattcatcacactttattttctagcattgcaaacgcattgattttttttttcttaatcagccatggtactgtggggtcaattagatgcaatgttttcacatgaatacctgttggaggagacataaagtattgtttgcataaatataaatatcccagtgttgattcagaatagcttatcactgtatgttggtctaagtagtaaatgcaagaacagtggagtcttggttttattatttttttcaggaggccttcaagatcatgatctagtccctgtatgttacagacgaggagcctgaatcctggaaggatggtgaggtgccccaaatgtctaaaataatggcagaggctaaacaagaccttccgtgatttatgaataacttctcctctctagtgctcaggagaaagcaattctttagaatctggacttaatgtacactaaaaagcagagtaagttagaatttatggtggcccaagagaagaacgtgcatttcaataggtatggccagtctgctcttaaaaaataaatatcaaaataaacagacaaaaagatattttcctcttttgaaaattatcataatgcttaggtgtcttcattcaaccctttccttagaaaaacgagaaacaaagagagagaagatagagctgtgaaaataatatttcctgtttctgaaatacattgaactaatatcatttcttagaacattataactaatttcaaccagttcaatattttccaaagaaggtaattcaccaaaggatatcacagttaaaacttaaatttctctgcgtgttctgagcccattagtttgtcagaaagatgaggaggaaaataaaagtactgagaagtgggggtgagtgacagtaacaccagaaaagcatgtgttttcatgaagtgacagtgaagaaagtacttcaggatacagaagagatcaacttcctcattatgtttactgggctcactctttcaccgcctttccatcactgctcaaaagatacatgtttagcaagatcctatgtgctccttacccctgcctccatctccaaataagtctctatccttcttgatttccctccatatttatttataagctgaaaatcttttttttttatttgaatacaactagtctctgggtagattgtttttccccttgttttcacttagagtaggggaatacattgatggataatcagatatattgtaaaaattccagtgctgcctcatctgaggaacatatatacattagctagacattagttacttaatacaaaattgaaataaaatgtcaatattttaagttttttaagggttaaataaatatttaagcaggcattgcatagtccctcacttcctccaacacatacaaatatataatgttacctcttttttccccttctttataaaacaaatgttctctcaccttgctcttgaattttagtgattctccagtgtgtgaccctattttctccatcatacctcataacatagtgatacatttgcaagtttactttttatccaagaatcgaatttcggagtgattggtgaagaatatttcatttgagttaactgagccagtttatggtttctgttatcactgctgtgggattattattttctttactatacatttcagttagtatacaaattattttaattatttcttaatatttttacaaatatgagcttattatacctgttaaactctgatataattcctattctattgtgtttgtaaggcatctttttcacttttttacagataatttcaaatgcgaattaaacagaaagctcacatatgacaatcgtgtttttttaagagagaaactccttgtgatttttgcacattgattttgtatcctgagactttgctgaagttgcctatcagcttaaggagattttgggctgagacgatggggttttctagatatacaattatgtcatctgaaaacagggacaatttgacttcctcttttcctaattgaataccctttatttccttctcctgcctgattgccctggccagaacttccaacactatgttgaataggagtggtgagaaagggcatccctgtcttgtgccagttttcaaagggaatgcttccagtttttgcccattcagtatgagattggctgtgggtttgtcatagatagctcttattattttgagatacatcccatcaatacctaatttattgagagtttttagcatgaagcattgttgaattttgtaaaagtccttttcagcatctattgatataatcatgtggtttttgttgttggttctgtttatatgctggattagctttattgatttgcatatgttgaaccagccttgcatcccagggatgaagctcacttgatcatggtggataagctttttgatgtgctgctggattcggtttgccagtattttattgaggatttttgtatcgatgttcatcagggatattggtctaaaattctctttttttgttgtgtctctgccaggctttggtatcaggatgatgctggcctcataaaatgagttagggaggattccctatttttctattgattggaatagtttcagaaggaatggtaccagctcctctttgtacctctggtagaatttggctgtgaatccatctagtcctggactttttttggtttgtaggctattaattattgcctcaattccagagcctgttattggtctattcagagattcaacttcttcctggtttagtcttgggagggtgtatgtgtcaaggaatttatccatttcaaatcaatgtggaaaaatcacaagtattcttatacacacataacagagagccaaatcatgagtgaactcccattcacaattgcttcaaagagaataaaatacctaggaatccaacttacaagggacatgaaagacgtcttaaaggagaactacaaaccactgctcaatgaaataaaataggatacaaacaaatggaagaacattccatgctcatgggtaggaagaatcaatattgtgaaaatggccatactgcccaaggtaatttatagattcaatgccatccccatcaagctaccaatgactttcttcacagaattggaaaaaactactttaaagttcatatggaaccaaaaaagagtccacgtttccaagtcaatcctaagccaaaagaacaaagctggaggcatcatgctacctgacttcaaactatactacaaggctacagtaaccaaaacagcatggtactggtaccaaaacagagatatagaccaatagaacagaacagagccctcagaaataatgctgcatatctacatctgatctttaacaagcctggcaaaaacaagaaatggggaaaggaatccctgtttaataaatgctgctgggaaactggctagctatatgtagaaagctgaaactggatcccttccttacaccttatacaaaaattaattcaagatggattaaagacttaaatgtttgacctaaaaccataaaaaccctagaagaaaacctaggcattaccattcaggacataggcatgggcaaggacttcctgtctaaaacaccaaaagcaatggcaacaaaagccaaaattgacaaatgggatctaattaaactaaagagcttctgcacagtgaaagaaactaccatcagagtgaacaggcaacctacagaatgggagaaaatttttgcaatctcctcatctgtcaaagggctaatatccagaatctacaatgaactcaaacaaatttacaagaaaaaagcaaacaaccccatcaaaaagtgggcaaaggatatgaacagacacttctcaaaagaagacatttatgcagccaaaagacacatgaaaaaatgcttatcatcattggccatcagagaaatgcaaatcaaaaccacaatgagataccatctcaccccagttagaatggtgatcattaaaaagtcaggaaacaacaggtgctggagaggatgtggagaaataggaacacttttacactgttgatgggaatgtaaactagttcaacccttgtggaagtcagtgtggcaattcctcagggatccagaactagaaatgccatttgacccagccatcccattactgggtatatacccaaaggattataaatcatgctgctataaagacacatgcacacgtatgtttattgcggcactattcacaatagcaaagacttggaaccaacccaaatgtccaacaatgatagactggattaagaaaatgtggcatgtatacaccatgaaatactatgcagccataaaaaatgatgagttcatgtcctttgtagggacatggatgaagctggaaaccgtcattctgagcaaactatcgcaaggacaaaaaaccaaacaccacatgttctcactcataggttggaattgaacaatgagaacacatggacacaggaaggggaacttcacacactggggcctgttgtgggttgggaggaggggcgagggataacattaggagatatatctaatgttaaatgacgagttaataggtgcagcccaccaacatggcacatgtatacatatgtaaccaacctgcacgttgtgcacatgtaccctagaacttaaagtataatttaaaaaaaagaagagagaaactcctagtctctacataaaaaatgaggatttgattatcatgtcttgtttaacaatgtcccaatcatcttgaactcttacagagttgttgataatgtatgtaagcttcaatttttattaatcgtatttctgaaaaaaaaaaaagcttccaaaaacgagaatgtcagtctgactttgtccaaaatgctgtaatatttgcttggtctctgctctgtattggcatattcaatatttctgttttacaaatcaccttgtctctttcatcatgtaatagaatttgcattcattgttaccttagactttctttagaaaatatacctgggaacttaacatgtttatggtttttagaagttataaacttctggcagatatctagataattgccaggtttccatcatcaaattttctatccctttgtcagaattctgatttatatccactgtgttaccttgctatttctttgtccaattgctttagtaatataaaatccctaagaatatcttttttgattcatgtgtcttctaattgaacccaaatgttatttatcacatatacatgatctaattaatacatagaatggttatttatttttaaagatatcaaataaatgatattacaaatttagtctacattacaaaagcaaagggtgaaaaaaaatagacagttgctatttataaataattaccagggagtatttttgatatctacaaatagatgtatccacttttaaaaatatactttcaattgtctgttaattgagacagactgttactgttaattagagttactgttactgttactgttaattagagtactttattagggaaaagtcagtatcacaaatatataaaatttgtctaatctaataccataatgttagttttggcaaatgaacttgcttggcttaagcattttaaaaaggaagttctttctttcttttctttttttttttttttttgtggcagagactcactctgtaaccaaggctggagtgccagaggcacgatctctcaatctcagctcactgtaaccttcacctcctgggttcaagtgattctcgtgtctcagccaccgagtagttgggattacaggtgtaagccaccatgcctaatttttgtatttttggtagaaatgggtttttgctatgttggccaggctggtctagaacccctggcctcaagtgatctgccctccttggcctcccaaaatactgggattacaggtgtgaatcactgcgcctggccaagaatgttcttaactcagaaatagaaaaccaaataccacgcgttctcacttataaatggaagctaaacaatggggacaaaggaacataaagatgaaaataatagacaacagggactccaaaagggcagagagtgggaaggggcaagggttgaaaaataacctgttgggcacaatgttcactatttgagtaatgcatacactacaggcccaatccccaccagtatacaacatacccatgtaaaaaaatgcccatgtaacctctcgatctaaaataattttttctaaaatacatagtgtcctgtttagtcaatgcatctgcttcataatataatcgttaatagtatctgcatacatttatttgataacatcaacttttgttatttaaatgagcttgatttttgacagtaaagaatctctattgacctagttaattttttcatgcaaagctatatggttaataattgtatgtggtggaagcagagaatgttatgtaataaaatttcttttatgtgttatttttgtacatttatttctaatgaaagaaagaatacagaggaagtttaatatgcataaaatagaatagactctctttattttttcaatgtttccactttaggcatatctaaatttttcttaaatcattctactttgggaactgtcttcaaatttcatgcatgcatgcctttctttttaatatttttctcaggcaacatactaaaagattttttttttcagaacaggaaaatatattaacttagagaactatattgttgcagtttacattagtatctctatttacctgaactctgctgttatacggggcttaaactttcataaaaagccaatctctttgacatagctacatgctgatacgtttagatgtgcagcattcataatagaaatatccgtaatttgaaaagcaattgtcattgaaagaggaacagtcacacagcctggcaatacaaatacacttcagaaaactgatttcgccaattgttgtttaaatagagtttcttattccaactctgcatcaggatgcatcggatttcttcaaaagtgttttcaagatatggttaaaagagtcaaacactatgaaactaaagaatacagattcgggccatttcactctgtaatgggttaatctcacaagcagagcacatacactggtaatgatttgtctaaatgtggatgccacaagctacacttacaaacaatcttttctcccatcaattaaagcttaaagttattttggtggaagaggtgaaaacaaatacacaagcaacagcataataagttcaattatcttataatcacatctaaaactattcaatgttaaaggcaacaatggtagctaaatgtatagtgttttaaagtgcaaaaaggagtaaccacataatcaacttacaaaacttaatcaaaatattagaagggtagtaatgtcaaatgctaagtgtagtaattacctttttgatatggttaggttttgtgtccccactaaaatcatattgaattataatccccataatccccacattataatcccacataacccctacctggagagaccaggtggaggtaattggatcatgagggtggctttcccctatgctgttctcctgttagtgagttctcaggagatctgattttttttttttttctgagaccaagttttgctcttgttgcctaggctggagtgcagtggtgcaatttcagctcactacaacttacgcctcctgggttcaagcgattctcctgcctcagcctcccgagtagctgggattacaagcacctgccaccatgcctagctaattttttgtattttgaaagagatggggttttgccatgttgggcaggctggtcttgaactcctgacctcagatgatctgcctgccttagcctcccaaagtactgggattacaggcatgagccaatgcacccagccgatctgatggttttataagcagctcatcccccatctctcagcacttctctttcatgcaggcttctgaagaaggtgccttgcttccccttggctttcccccgtgattgtaagtttcctgaggcttccctagccatgctgaactgtgagtcaattaaacctctttcctttatacattaccatgtctcaagcagttcttaatagtatgaaaacagactaatacagtaaattggtaccacggagagtgggacactgatacaaagataccaaaaaatgtgaaattgactttggaactgggtaagaggcagaggttggaacagtttggagggcttagaagacaggaagacgtgggaaggtttggaactttctagagactcgttgaatggctttgacgaaaatgcagatagtgatatctaaaatgaagtccaggctgaggacggagatgaggaacctgttgcaaaccagaataaaagtgactcttgctatgctttagcaaagagactggtggcattttgcccctgctctagggatctgtgaaactttgaacttgagagagatgatttagggtatctagtggaagaaatttttaatagcaaagagcaccctggtgctcttaaaatcattcagttttatgcatttcaaagggatggtttgaatttggaacttaggttttaaagggaagcagagcataaaagtttggaaaatttgaagcctgacaatgaaataaaaaagacaaaaccattttctgaggagaaattcaagttgtgtaagtatcgaggagccaaatgttaatcaccaagacaatggagaaaatgtctccagggtatgtcagaggtgtcctcggcagcccctcccatcaccaacctagaggcctaggaggaaaaactgtttttgtgggccagcccaggaccatgctgctttgtgcaggacttggtgccctgcatccaagtcatagctaaaaggggccaatacacagctcagcccattgcttcagagaaaataagtatcaattaagccaagagcaagggctgggtgttattggcctagatttgcagcagactacataggtagcatgggactagcaaccattgttgtgccatattatgagaatatactttaaccttaaagctttgaaatgatcttgaaatttaaaaatacaatctatatgcttatttaaatgaatttttaaaattataattagtccgaaaacaatgtctgatgcaaacataagcccatgcttggttctttaaatcatatttcaaatgatatttttaatttaccaatttttagatctctgagtaatctaaaaatcatggaaataaagatccactgaggcaaaggacctaagttttaagagttgccctctagagagacagtagttgagtgctaacaagggtaacatttactcttaggtgtcttattttcaatgtaatggcaaatggtctagtgtttcaacttaattttctaattgtttgtggtatgagaactctaaataacatgtttatattgacctgatatttagcaaatttgttaatgtcattcaaaaattctacctgcgtatagcagcattgtcacggttgttgctattattaatgggtgttgaattttcacaaatgctttggattctcctgattaggtaggtttttatttttcatcgtctctttttaaaatactatccttttttgctttatatggtttacaaatattttaattatgacatttattatatctatgatcgtgcagagaatagctataattccacttataccttttgatgttaaagttatgctggcatcataaaatgtgtacaaaaatgatcctgccaccctttttctgaactcttgaataccttttacaattactgtcatgatttttcttaaatttttagtagaattcaccattaaagccatgagaagagaatttatttgtggaaaggtttttatttatatatttaatgaatttaataaatacaactttaatcagtccttatttatttatttatatttatttattttctgagacaaggtctcactttgttacccaggctggagtgcagtggcaggatcacagctcactacagacttgacctccagggctcaagggatcctcccacttaagactcccaagtagctgggattataggcatgagccaccaagcccagctaaatctattcttgtgtcagctttgacaaactttacttttctaaaaatatatgcattatgtctaaactttcaaattttagtaaaagacgacattgtaatatacaattggcttctgatatctgtaaagtctatagttacaagaggcggtaagcctcttgattttttcctaatattcttcatttgttctatttctctcttttgtttttaacaatttaccagggacttatctgtcttttcaaataactaagctgtgaactcttcaatgttttcttttggttcatttccatgtcattaaattcatctcataaattgttattctattttatttggattaaattgatttatttttctaacttcttaagaataatgcttaggcttttaatttgcattattttatcttctttattatatgcatttaaaattataaatttcctgttagttatggctgaactgtttcctagaaatttttatatggacttatttacattatcatttcatggaacttgttttttcatttaagtttgttcttcttcatggaatattaagttacttagaagtgcattcctttatttgcaatatgattttttttttatactttaagttctagggtacatgtgcacaacatgcaggtttgttacatatgtatacctgtgccatgttggcttgctgcacccattaattcgtcatttacattagatatttctcttaatgctatccctcccccattctcccaccccatgacaggccccagcgtgtgatgttccccaccctgtgtccaagtgttttcattgtccaattcccacctatgagtgagaacatgcagtatttggttttctgtccttgtgatagtttgctcagaatgatggtttccagctttatccacgtccctacaaaggacgggaactcatcgtttttatggctgcatagtattccatggtgtatatgtgccacattttcttaatccagtctatcattgatggacatttgggttggttccaagtctttgctattgtgaatagtgctgcaatgaacatacatttgcatgtgtctttatagtagcatggtgtataatcctttgggtatatacccagtaatgggaccactgggtcaaatggtatttctatttctagatccttgaggaatctccacaccgtcttccacaatggttgaactagtttacattcccatcaacagtgtaaaagtgttcctatttctccacatcctctccagcacctgttgtttcctgactttttagtgatcgccattctaactggtgtgagatggtatctcattgctgttttgatttgcatttctctgatgaccagtgatgatgagcattttttcatgcgtctgttggctgcataaatgtcttcttttgaaaagtgtttgttcttatcctttgcccactttttgatggggttgtttgattttttcttgtacatttgtttaagttatttgtagattctggatattagccctttgtcagatgagtagattgcaaaaattttcacccattctgtaggttgcctgttcactctgatggtagtttcttttgctgtgctgaaggtttttagtttaattagatctcatttgtctattttggcttttgttgccattgcttttggtgttttagtcatgaagtccttgcccatgcctatgtcctgaatggaattgcctaggttttcttctagggtttttatggttttaggtctaacatttaagtctttaatccatctcgaattaatatctgtataaggtgtaaggaagggatccagtttcagctttctacatatggctagccagttttcccagcaccatttattaaacagggaatcatttccccatttattgttttgtcaagtttgtcaaaaatcagttggttgtagatgtttggtgttatttctgagggctctgttctgttccattggtctatatctctgttttggtaccagtaccatgctgttttggttactgtagccttgtagtatagtttgaagtcaggtagcgtgatgcctccagctttgttctttttgcttaggattgtcttggcaatgtgggttcttttttggttccatatgaaatttaaagtagtttttttccaattctgtgaagaaagtcattggtagcttgatggggatggcattgaatctataaattaccttgggcagtatggccattttcatgatattgattcttcctatccatgagcatggaatgttcttctatttgtttgtatcctctttgtttcattaagcagtggttggtttgcagttctccttgaagaggtccttcacatcccttttaagttgtattcctaggtattttattctctttgtagcaattgtgaatgggagttcactcatgatttggccttttgtttgtctgttactggtgtataggaatgcttgtcatttttgcacattgattttgtatcctgagacttggctgaagtttcttatcagcttaagaagattttgggctgagacaatggggttttctaaatatacaatcatgtcatctgcaaacagggacaatttcacttcctctcttcctaattaaatactctatttctttctcttgcctgattgccctggccagaacttccaacactatgttgaataggagtggtgagagagggcatccctgtcttgtgccagttttcaaagggaatacttctagtttttgcccattcagtatgatattggctgtgggtttgtcatacaaagctcttattattttgagatacattccatcaatacctagtttattgagagttttttagcatgaagggctgttgaattttgtcaaaggcctttctgcatctatcgagataattatgtggtttttgtctttggatatgtttatgtgatggattacatttattgatttgcgtaggttgaaccagccttgcatcccagggatgaagctaacttgatcttggtggataagctttttgatatgctgctggatttggtttgccagtattttattgaggattttcacattgatattcatcagggatattggtctaaaattctctatttttgttgtgtctctgccaggctttggtatcaggatgatgctggcctcataaaatgagtttgggaggattccctctttttctattgattggaatagtttcagaaggaatggtaccagctcctctttgtacctctggtagaatttggctgtgaataagtctggtcctagactttttttggttggtaggctattaattattgcctcaatttcagaggctgttattggtctattcagcgattcaacatcttcctggtttagtcttggtagggtatattgtccaggactgtatccatttcttctagattttctagtttatttgcaaagaggtgtttatagtattctctgatggtagtttgtatttctgtgggatcggtagtgatatcccctttatcattttttattgtgtctatttgattcttctctcttttcttccttattagtcttgctagtggtctctcaattttgttgatcttttcaaaaaaaacaagctcctggattcattgattttttgaaggttttttgtgtctctatctatgaattcaccacaatttgcttaaccattcacctattgaaggatgtctttgttggttccagtctgggttttttataaataaaactgctataaataattgtgcacattttgttgtataaacataaaatttcatatctctgtgggaaatgcccaaaaatgcagttctgaattttatggtagctgcatatttaattttttatgaaactgtcaaaatatgtttcccagtagcagtaccattttacactttcaccaatgatgtagaaatgacctaatttctccacaatttaccaaaaagtttagctcttatgctaggcctgtagcgatatcacattgtagttttaatttctatttacctaatgtgaatagaaataatttttaaaaaatatgtggaatatctttttatatgctggttggctctttctatgtccttgtcagtaaatgtctgctcttgtattttgcccattttcaaattggattttatcttctgtttttattgttgagttttgaaactatagtactataagtagaaagtctgtagtttgtcttttttttatcatcttaacagactttttcaaagagcatctttttcaaagagcaaaactgttaaagtttgatgaaattcaatttatcactgtttccttttatggatcatgctttttggggtcaagtcaaagaatgctttgctttatcttaggtcctgtgattttgattgtggtatcacctatcttttttctcttgctgcttttacttttgctaatattttactttagtgcactgaggcaaatttacctttgtaggcagtatgcttggtggttttgtttctcttgtttcttgagtgtttggcttgatatttccatcaatttggaataactttcagctataatcatcttaaatattatttcagtcccattctctctcatatgcctctcagaattgaaaaacttttatattacacttgcatgtcccatatgtctctcatactcttatttatattttctttttctttccatgcttcaacatggatttttttattctgacttactttccagttcccttatttttcttgcactatgtctaagctgctgttattaccagtaattgagatactgtattttcttaaatttaaattttccattagaatgtttaatattttttcatcaactgtgcttttataatgtatttcaagaacattatgttaggatgtatgcatccatttttaatagaattgaaataaaatttgctgaatatttaataatatatttatactataaaagtatttactggttttgaaatcagtgcatagaaaaatatttaagcatataaaataataatcttaatattttaagtgaataaattatataaactgcacaatgctttcaagtataactttactgtgtcctcattcatatttctaattttctcatgggaaatgttaaattaattaagtaggaggccatatcagcctgaggctatcattgcatttttagtttctgtgtaacaaaatgctacctaaatatgtttgatggttaatattgagtgtcaacttgattggactgaaggatgcaaagcattgttcctggtgtgtctgtgagggtgttaccaaaggagattaacatttgagtcagtggactaggagaggcagacccaccctcaatctgggtgggcaccatctaatcagctgccagacaggctagaataaaacaggcagaagatggaagagcagacttgctgagtcttccggccctcgtctttttcctgtgctggatccttcctgaccttgaacatcagactccatgctcttcagatttggattcttggacttacaccagtggtttaccaggggatctcagtcctttggccacaggctgaaagctgcactgttggcttccctaatattgaggtttagggactcagactggcttccttgctcctcagcttgcacagggcctactgtgggacttcaccttgtgatggtgtgtgagtcaatactccttaataaactccctttcatatatacttctatcctattagttctgtctctctagagaactctgactaatacattatgccaactaaaagaaacctaatttaggaatataattttagtaacaaatagctgggtttcaggcaattacaagacagccaactggtcactaatgcccaaataaagcaaacgcctagctgtacccggtcaggtaatttctctacttggcttctgtgttcagcctttgaaagcctgttgctcacactgctggatggagctctttaaacttcttctgattgtgagtgtagcccaatttgttactcattttttgcttaaataagcccttttaaatgtattatgtctagagttttttattttaacaacagtgaacatgaaaaaagctttatgttacaaagccagacattgagatagacatatatttttccctgacgggactaaaaacaaataggtaatgattactttagcaagcctcacaattgtccctcatacataaacacaaaaaaggatgcttctcaggagtataatttcagcacaagtttcaaaatgacttggcatgatttgggaaggtatactcatttgggttcactaaagacaataatagagtacttttgactcagaaagggcatattttgacctataccctttccacttctggattcatccacagcagatagattttaaggtgctgctcctggaatgcacgccttcctgtaatccctctgccttcagtgtgggtatgacctgtgtcttggttctgaaaacagaatatggcaaatgtgttgatgcatgactcacttgattacattacattatatgaggctgttttgcctgcaggcttgctcctcttatttgcttgatgaaataactggacatattggggaggtccaaatggcaagcaactgcttgtggtatctcagagatatgggcagccttgaggagtaaaggaaagtcttgactttctcgggtctgtatcagaaagaaactgaatgttcccaacagccctatgaacttggaagagatccctgagcctcgggcgagaaaacagccctagcagacaccttgattatagtcttgcgagactcttgcaaagacccagctaagccatgcacaaatttctgacctatagaaactgtgagataataaatacatgttgttttaagttgcggattttgtataatttcttatacagcagaaaaacaaatgcacaacccctttcagtctcctacttgctctatttgctataggcaaccagccttccaaattgccatgcttctttgactagatgcacatgacatccagcctcttgccccatgatccagatccatcttcactctcaccaccctattaatacatatatactcttcatgtttctaaaattgaatcatcgtttagcatcagcatcactcaatcatcattcctgtgtcactcctgcagatcctccaaaatagagctagtccctctgacacaatcaagtccatcaacctcattaagagagaaacgtttgctatttcctcctcacttaaagtagggttggacataaagcattcaatatcattttattggtataatttgtgcagcattcatgaatgaattcatttttctgagttacatttcggatccaaagaaaattcaattgctttgattctccaaaaattatttggtacttaaaataaagctttatgaaattatttccactgagtacaaaattacactgtgggctttgggggattatacctaagaataataaaaataaaggcgcttgcatttattccattcaaatgaggaggaaggaaacaattaacttacctggccaggcttagaattttcacatacaataatatcatattccctggcaagttcgggtggattgtcattgacatccagaactctaatacccactgtgacatggctcagcaaatcaggattatctgcaaaatacacaggaatgtatttagtatttccatgcacactttagaggctcggtttaaaacaaatctctttaatactgtagcttgtcactggttccatatgccatagctggacttttggcaaacgacaactttatgaaggcgctctttgctagaactcattaacttacaggaaaatgaaaaatgaacaccatggcatgacatgaatgccaaaatgatattttgtcatatcaaggaaattacatgttatcaggaacttgagtgggagaaagttgtcagaattcattgtatgctgtcagagtctacaggatgaacaattggtttcatcattaatctaagaaaaacacagcagttggtaaaaaataattacctaatctttaaaaaagtttaatgttcaaatctaactaaactcaaagaaaacaaaaaataaatttctttacacaaagaatcattttcttatggcagaatatatgcagagtgtgatgttaagtcacgctcggggaaaaataaataataattgaaatcaaaatttagcatgagattcatacatgcaatttacatgtaactctcgtagatatcaaaatatattcaatagtttcaaaaacatcttaaactaagactttttatcttttcagtgggtttattaattctgagatgtaacaaaaacataaatgtctggtatattttacaagtccaagctagagattcagaatacataatgaacaaattaaatctctctgtctggctttctctttgctaatgtatctgtcattctctgaagcaattcaaatttaaattgtaacaacatacaatacattaataataagactagtaaaaaagatacaacaatattgggaaaaagggaataaatacttatagagaagttattcatgatagtaagaaaatagatgggttaaaaagtgtcaagtagctctaaaataaatagaaaatctaagtagtgctgtattaaagtaactagagaaaataaatttttcagtaaaaagttaatttttgcaaagagagaaaaaaatttgtcccagattttttacttaaagtaacaggtaattacagtctacacattttttccctagaaaatataagaaagaggaaatatttcaaaatttttatttatttatttatttattttgcttgtgaaactttggaaccaatactagacactaccactcacgacacatattaagtgtcaactgcctaaacaaaataatagtaaacacactccactgagttgttcttgataattcttgatcagttttgtcccaggaatgtttgtttagctcaacaaaaaaagacggaagaggtacagaaaagaagtaaattttcataaagatacaataaaagttattcacaagttagtgaattaaatgaaagatgataaagcatatacataatcactcaagaacatattaagaaatacaaaaaataaaatgcaatattcatatattctaaaaaccatccaataaaacaacaaatgacaagaaaaattgcatcatacatcattcttaatggtgaaaaatctaagaattaaaggaacctatgaataaatctaacaaagtatatgaaagacccatatgcagaatactttactgaatttcattaaaaaagatataaagatattaagagctgtattacgtctgcggttaaagagacaaaatgtcacaaataaggacataccatccagattgatggtatttccaatgtaatctaatacaaatccaatgaaagttgttcatagcaattgaaaactgcttctaatatttataaacactaagataattcagacttgtatgaagaagaggaataaagcagaattgcacgccgggcatggtggctcacgcctgtaatcccagtattttgggaggctgaggtaggaggaacacctgaggtcaggagatcgagaccagcctggccaacatggagcaacctcgtctctagtaaaaatacaaaaattagccaggtgtgtttgtgcatgcctgtactcccaactactggggaggctgaggcaggagaatcacttgaacctgggaggcggaggctgcagcgagctgagctcacgccactgcactgcagcctgagtgacagagtgagactccttctcaaaaaaaaaaaaaaaaaaaaaaggagagttgctgtaccatttatcaaggcttactacacttaacaccctacgactatgtcacagggatagacaaacagaacagaaacacaaaacagaacccagccaaagacccactatacatagaaatttaatatatggtgatgatggcattacagatcaatggtgaacgtacgggttaatcaataaatagtacaacttgttattcacataataataatagtagtagtaacaataagaataatgacattgatcttatgttacacttacacaaaaacatgttttaaattattaaagacaagtatataaggcaaaatcatacatattttgggaaaaatggttagcattaatatgtgcacttaagttacatgcacaatttcaaaacacaaaattcactaaaacaagaaggaagaattgataaatttgattgcactaaaacatgatttcttactcattttctccaaatatatcatgaagaggaaaaaaattacaatttgggtgaacacatttgtggcacacgtaactgacaaaggacttgtatctgtaatatataatttaacatattgaaacaattttaaaagccaacacaatataaaaataggcaaatattaatggccaacagttaataggagataatataaataaaaaataaacatgaaaaaaaatcagtctcattagtatgaaaaaaagtaggttaatcaaaataagttatcacttaacataagccagactaacacaatactaagaagtttggcaagatttctccaaatgctggattgaatatagacaaagaaaggcctataaagttaactcataaggaataacttgtatattctcatgctctagatgatgtaatttccctgatttatacctataggaaaactcttgaatatacatactatcagtacaattaatggcaacaacgacaataggaaaataaaaatattcaacaactcctgaatggatacaaaactttgatgcatttatatcatacagaaaataaataacaacacagccaccatgtgaagcaatcttagaaacaaattgttgttctcagaaatgtgtcagaagactgcattcaagtattgtaaaattttgtaaaaatagaaaacaacacgtaaaagtaaatattatactgtaaaactaataagataatgtttaggataatgcttttgtaactctaattcttaagtacagagatgtgttaaaatctgtttattattgtattttgcaacatctttgtagatatcaagaattacattatatatatgttaaaaagttatgacatcttgaaagtaatatattaataccttcatatataatttatattggcatagttaataactgattatctacttatagtaaaagataatatgatgcttgtatattattatattaattatatattatattgataaatgaatatatacattaaattaaattacttgctttaaatatatgtttacttatcatgaaaatgctaaaacttcttttagaaactaacattaaatatcactttattttgttattacattatttcaaaactaacataataattagtcaaaatgcttattttataaattataaaaaattgaaattgacacagtttaaatgatttatctcagcaaagggttatattctacttcttttgactattaccactacatacatatatattttctattctacatatcataaaagattttatgtattcctgtatctcccaattttaagcagacaaaagcaatctcttttaaaaatctggggtaagaataattttgtaagctctagtcataggtatcagcaaccttacttgttcctgagtaagtaactctctgctcttttttttctgagatggagtctcgctctgtcgcccaggctggagtgcagtggcgcgatctccgctcactacaagctccgcctcccgggttcacgccattctcctgcctcagcctcccgagtagctgggactacaggcgcccgccaccacgcccggctaatttattgtgtttttagtagagacggggtttcaccatgttagacaagatggtctccatctcctgacctcgtgatccgccggcctcggtctcccaaagtgctgggattacaggcgtgagccaccgcgcctggccaaatctctgctctttttctgaaaaggcagggttaaaagcaactccagtgaagtaagaaactgtgttttctatgaaaggattctggaaaaaccatatcttgaggaggaatttgaataaaagaacaagcaagcagttgactgctatcagctgtcacctctcactgtcctacctctgccttgttgcagctttcccctgggactggaatgtcttttcatgcattccacacttgggcacaggaagctaaatccttctgcttcaacatagactctgtccattatgacccaatattactttacatccctaatgtacaatcactattctgtaacaatgattaaaagcatagcatttgggatcagggtaatatcagtttcgtctatatacctactatcattcagtgtcctgtaggaaacagaatttaatcttaccttattgagcatgtgactcatgatactgcctgccctgtcaggggcaaccacaggaattacgaaaaacaaaatgttagagtaaatttaaagtaatttctggtgcaaattcaataactgctgtctgttactaaaagtaggatgatgtataaaaatgtggctgtgatttcagacaattacgagtgaaaactcactgtcactttatagccactcacagccttcttgcagcattctggtattttatgatatgagatatttctgtagttgtgaactgaaaactacccatgggtctctatatattatttcttgtgtccttgggtcagtattttaccctttaaatgtcaatcactctacctataaaatgtaaacctattcatgggatttacaagcattttgctaaggctaaaattggataattccttaagaccttaaagcactatttctattattgttattataatttttatatttatgcttcatttctagaaaacaattttcatattcttttgacagcagagtaaataaaatatattgaaatcatgcaaacataaatataaatcatattctcagcactcttcaggagcagaacttcaataaattatttgcaatttattgatgtgcattaattatttaatttgtaagcctataataagagttatttaacttgccaagttgtgtttttgagaaacaattaacggtaactatgtcaactttataatactgagcctgggaaaaagcagaatgtacatcttaataatttctgaatattaaaatagaaacaaagccaaaatatatgcatgtattttccagcaccaactatgctatataaaaatcatctgtgctttatgcaacattaatacaatagggactcatgtcatcagagtgccccctctagagatagtgatacagagaaagtgctattgcagtgcaagtggaagctgtatgctacaatatgtagaagatcttttataacttgagaaacaatacattttatccagtgattacttttggaaagactgatatgtgcgtaacactatgatgggctctggagaacacagaacaacaaaatatgccattcttccagatttcccacttatggacattgaatggaaaaaataaatactaattttttcttaaatatcatgacttaaatctttaatttacttttagcccaaagccattattatttaaatatgtgccacccaaacaatctaaatcatgtctatgagtgtatgccttctagggaatttggtagatttctaatctgattattcatattcgaaaattagtattaaaaatatttgtcaaatatataaataggttaatataatattgcagattattttcctaaaatgtgcttttattgctttcattatgaaaattcactcaaaatgaaaagacttatctactactataataaaaatttacagggaatatgaacttaaataatcacatttatagctgtctaagtttcataaatgcccatgagaataaagatggtttataaattgtatttttggtctgtctgatttagatttctatgaaaagatttccttataggaaaatttagaactaaaattactctcattcttttgaatacttactgtgggctgatgctgggacattttaacgtgcttggttaatgctttgtttgttaacaaatatgtttccattattttctttaataaacatgtaacaataagttttgcaaacaggtgctcaaatgaaaacaaactatccacttaagtgtatttgtttgatttgaaatgagagtagtttttccattgtaaaatcttgtatatgaaagtcatattaagttttagttaaaaaaaagtgagctaaatcaattaatacatattataaactactttataatactattaaatctacttaaacaataatttatatgtaaaactctcacaatgtctggtacatgctggtgccactaatatgcttctttttctcttttttaaatatattatttaaatatcagtaaaaaaaatcaaatattgtattcaaaataatttgctataatttatatgaaaggtgtatatcatatataataaattactcctcaaatatccctttactgtatccatataaaaagttttaaaataaagcattctgtgaattttatgcaacagaatattaaaccaactctgtgtttaaggtctgttatttcataggaaggagcataacacgtgtagaaatatttcaaaaattacaaagcatttagaaacacatcacataaaacttatcccatatatttattcaacttttgtcagtttacagtaagtgctctcatttattacatagttatcatacaaattctagattgaagtgaattatttaaaatgaatcttgactcttttcagtacattattttgttccagttgcctataaatcctccaataattccttatatatatcattaatattattacctgagagtaacaggagttagaagctttaaaattaaagctgtgcctttgctgttaggaatgaacactttgttccgttaaccagaactacaaagtcaaagtaatttacctctagttgaaagtaattacattgagagaatgtaagaaattgtattgattataaagtaaacgaaaaatatgtattctattcttgtgaaaatgtcacaattggcccactcaattatataagaaaatctaccaaatataacatttattttctactttttgtaataattcagttttaacatgttttttctatcttggcctatttgtgtataacgcctgtgaacttttctatcttttatctttatagagtatataggatttaccttgtgatgaacttttatgctgtcttttgcatttataattacaatcatatttttaatgctgcttagaactttactaacaaaatggattataagtttattctttctttttctgggtgtgcaatctaattataataaaaatttccttatcagatagaatcaacatcaaaaataataatgttaattaaagcaaaacagctactatgtaaaataattaataaaaataatgatatatatattttaaatgtttgtataaatatattgaaatgcataattattcatcaaactgcaatctctcaatgtaggagtatggacctaactctgagaacagatttgttgctgttcggggttaacaccaccattcttgtaaagataacacactgagttatttatgaagctatttatgaagcccaaaattgattgattctaagtgagggaagaacttgaagattctttcaaaacactaagcgtggcaacacttctaattctataaaattacctgagattttataattgcctaactgttctccttaattggaacataattttagcaaatctcttttatgaagtcttgggaaactttcaacttaaagtacgttacacaaattctgaatccattctgtgcgtatatcccattattttgtttaatatttaaataaactacataattacaataagaagtttgactggtttggaaatagaacttaaaaaaaaaatccaccttagtcaggaaagagcaactgattaaaactggcctgccatcacaaaggatcgtaaaatggaataaaatatataaaaaagaaaatagataatgctaagaatgctctctgggagaagagacttacataatctgagccccaggactatctcaggctttgataatacattcattatgaccaagtgagggatatcctaggaaaagaagactggttgtttaacatttaaaaatcagtgaatataattcactgcacacattcaatacacacataataaaagttaacaaatatgacatttttaacaagaaataaagaacacttagcaagttacaaatagaaggaactttctcaacctgaacaaaactgtaactatgatcacccttatcagtgaatactgaatgctttatcccaaggatcagaaataaacagaaatgtaaggatatatgctctcagaacttctcctgaacactatctttagggttatagttagagtaaatagtaaaagaaataaaagtgatgtaaattgcaaaataaacaaatttattatctatgaagatttattatctatgaagatttattatgattatgaagaaaataccatataatatacaaaaaaatagaattattaaaacagtctagcagtatcacaggatacaagttcggtatttacatatatttctatcagaatgaaagtaaaggaagattttaacatctaacttatataacatgaataaacatgaaaacaaatacgtgaaatgtttgtatgctgaattctacatatgttgctttgagaaatgtttaaaagacctagataactgaaaacatactgtgtttactcatggataaaatgctcaatgttgttcattgaggtgtccatgctcccaaattgaaacttagattcagtgtaataccaaccaaaaatccgatattgttgaataatttgataagctgattctaaaagttatatgcaacaaaaactgttctaaaataacccaaacaatttcaaaaaggaggaagaaaaatgtaggagaactcacactatctgattttgtgtcattataaaactatagcaatcatagcaccgtagtattagtatatacattgtcagtggtaccaatgagagcccagaaattgataaatacacaaatgctcaagggtttatggacaaactagccataacaattaattgagaaaatgatagcattaagacaaatggtggatccattgtaaattcatattaaagaaaattaaacttgactcttaccactcatcatatataaaacatggcccaaaggaaaccatagatataaatataaaacctcaaagtttaaatatataaaactaataaaggaaatttttgttaccttttgtttggcaaagaattattcgaaaaaaacacaaaagaaaaaacataaaaaagccaataaattgtaattttctttttttattttattattattatactttaagttttagtgtacatgtgcacaatgtgcaggtttgttacatatgtatacatgtgccatgttggtgtgctgcacccattaactcgtcatttagcattaggtatatctcccagtgctatccctcccccttccccctaccccacaacagtccccagagtgtgatgttccccttcctgtgtccatgtgttctcattgttcaattcccacctatgagtgagaacatgcggtgtttggctttttgtccttgggatagtttgctgagaatgatggtttccggtttcatccatgtccctacaaaggacacgaactcatcattttttatggctgcatagtattccatggtgtatatgtaccatattttcttaatccagtctatcgttgttggacatttggcttggttccaagtctttgctgttgtgaatagtgccgcaatatacccttgcgcttctcgagtgaggcaatgcctcgccctgcttcggctcgcgcatggtgtgctgcacccactgtcctgcacccactgtctggcactccctagtgagatgaacccggtacctcagatggaaatgcagaaatcacctgtcttctgcatcgctcacgctgggagctgtagaccggagctgttcctatttggccatcttggctccacctccaataaattgtaattttcaagaaaatgttctttgaaaaactcactaaatacagcgttcattaagaaaatgaaaagataagacacaaatatgtgaatatattcaaaaaaatgaacatctgattaactcatatatctgcatatattaaaatctcaaattcaaacaataaaaatctaaataactttataaaattttgcaaaatcctgaacagaaaatccaccaaagaagaaaatgcagatggcacatgaaaatattttcaacatcatttctctgtggtgaaatgcaaataaaaaccacaataagatgtcactacatacttattagaatgacggggaaaaataccctggcaacacatgcggaagacgtgaagcaactgctgatggtaatgcaaagttgtatagccagtttggaaagcaatttggcatgtttccataaactcgaacatggtattttgtttgacaatcccacacctggctatttacccaagacaagttaaaatgtgtgttctcacacacacacacacacacacacacacacaaacaaaattgggctgggcacggtagctcacacctgtaatcccagcacttagggaggctggcgtgggtggatcagctgagatcaggagttcgagaccagtctggccaacatggtgaaagcctgtctctattaaaaacaaatgcaaaaattagccaggtgtggcttcctgaaaataatgactcataagcttgactcataaacttgactcattaacgcaaaagcttcctgaaaagaatgactcaaaggtgtccacagtatctacttgtcattctcattacatttgaaaaaggcaaaactataggtagttaccaggacttggaggtgagagaagagaaatccctttaacttttgtggacgaaggttgtggaaagtgactagatgcctctgcaaaattcattatactttacacattaaaatggtaattttactatgtaaattgctctccatgaaagctgacttgttaacaagagtgatgtattctgaggcattaaatttgtagccaatgtatttttttgggtctttttttttaaatgttagacttccatttgacaacatttttctaatgcatcattctaacaaagttctttccaatgaacttttagtaacaacataaactttatcaatgtattgcttctattgaaatactaaatattataaattattgaaaatattccgcatttatgcttgtcactgggttgttgacaccaagatgatctgaagcaatagttaagaagtaccttatacataatttctgatgattaacatttttttattttcatttcctttacccagaactaaggtgaaaacagaagacattccttatctttaactttcgacaagatatttgtatatgtgtgagtgcctgggtttgtatcttggttcattcattatgagtgtcatattttcatttatttggaagtatttgatttgacttagtagtatgtagtatcacttatgttttaaaaggaacattatgacagctgggtgaataacaagaagtctaagattaagacccaaagcccaaaggaagctaaggttaggacccaaagaaagctcttaaaataccccaggtaaggggtgaaagttgttcgaactgcggtggaagtgagataaatgataggaaatagttgacttataaatagtttttaaaggtatagctgacaaaagtttccaatggattggatgtggaacatgagagagaagagacaaatgactgcatggtttatatgagcaatctggactatagtcatcattccaaagatagataagacatctgaagaagattgagggagaaatcagattttacagagatttacctgcagcatgtcgagtttgagacctccaggaggagatattaaagtggccaatatggaattcaggggaaaaataacattgcagctgcagattaaaatttgagagctatccaatccatgagactgaatgaaatcaccttggcaacaactcaagatacatttaaagtgtaaaacttggtgtctcacaattcaatacatagagaagcgaggaggaactaaacagcatgcagaaagaagagccaatgaaggatggagttaatcaaaaggatattatgtccgtaagccaaagaaagaatctttttcttgaaagagttgttaatcgtatcaaatgttgatgctttgttgagtagaggaataggattaggctttggattctgcaacatggaggttgagaatgattgtgctgaagtagcaaagtcaagagtcttgttagaatggatttaaaacagcatggaagaaaagagagtacaaactgtgaacagagtaaattatttcaaggagcttttcagtcaaaagaatgagataacagagatgtatttggaggagaatattagatcaacagatgttttcaggttttgtttgctttgcatgaattaattttattttcagatagaaaataaagcatgtttttgaggacaggggcatgctttagacagtgaaaaagtaagaattcaggaaacaggataaaatagaaagagcattgtctcacagcaaacaaataagaacagtataaggtcatgtgaaggagtggccagagacttggcatggacagtgcatttcaggaacctgaaaaaagccatatttacagatatcaacatccactagctaggttgatatacaggatggcacgggaatatggaaacccctttctgattgctcttattttataagtttttggagaagcaatgttatctgatacaatacatgtaaagaaattggaagaggtattagaaatttaatgaaaggaaacctataaaataaatatctagcaatgctgtgtaaaattatttgagtgatttgaagtttcttttgaataaagaaacttgttctaattgtcttacaatatgatactaacactgggatattgcaattaataaatcatcaaatgtattggcacattaagtaaatgtggtggatattgtgattgtctcatcaaattgctccttattgtgtagaacctaaaaggtatgaaaggagttaaccatgagcaataataaaaatataggcctgatggtcctgagtcagtgtccacatgcctttcattttgttacaataattcatccacttatggacaaatttcatgtattaaatacatttttaaggcagtgaaaggagattaatacattaaaaaaaaactgaaagcagcaacatttttaatggctatgtaaaatgacaatttatctccccaggttgtgaatgagaatgcatgaacccaactttagcgtcactcatcttattaccatgttacaagttaacatacaatttgttacttgttactataatatagcaacatgaaggaaaaaggtgacgttaaaaaattcagaagatgaaaaatcagggagaattggagacagatacctgatcaaagcaaactcatagcttaatttacctatacactttacagatacatgagccaataaatctcttttaaatttgagaacaaattcaattatttttacttgtgtgcttttttacatataagtaaaaacattcgaacaaattctggcagccacctccaagacgataccaattattccagcctggtattcatatccttgtataatggctttccatatttaacaaggttttccatatttaataatattaaatacaatattgcagaagtaacaatgtgtaatttctgaggctaggtcataaagaagatggttgccttcaggtcactcattcttggataactcactctgagttggccagctgccatgacaatcaagacactcagcagtcctatgaaggagtccatgatgtgaaaaactgagttctttgccaaaaaccagcaccaacttgctagttatgtaagtgagacatgttggaagcatctccctggggcccagtcacattttgaaataattacagccctaatcaaaatctgggtgacaacctcttgaatacctctgaacctgaataacccacgtaagctgttcccttattactgagccaaagaaactgggtaacacactattgtttattgatgttttctgttactacattatgaagtaatctgttatatggcaatggattgatacatatatgtatacacaatattcctgaaaagcattttgtttgattacttttgatcattggttaaggcaatactgatttctttctgtgctattcccttcgcgagctaagtaaaagtgctaattaggatctctttgtgtgctaagggaaattggtaatacaaacacatttgtggaagacaaattgcatacatcaaaataagcacattgataataataaaataatgtttataagctacagggacttaaaaatactcactccgaggtgacgggtttttatattcttagatgcagctgctaaccaaaaataacttcatattaaagggcaacaaggaatacactcacaaacactaaatttcatttctattatctgacattaacagttggattacatttgaaatttgtggattctagtctttggatatgtttgcatgagagtcgagaaaaaaataactaaaaagactcaatgaataaagaaaacacaaacattggtttgtggactcttatgtccacaagtgaaaaagagagctgaagcaatgtatacaatatgcaatttttgttgtttcatttgtaaattctggaaatagcagaagctttcagacacattgaaagtttcaataaagtatcatctcccaaactttggctcttttggaaatttatctattatacaagcaatgaatgattagagtttccttttggtgaactgaccaggtcaaagaaatttttacatttagtgcacagaacaaggttaaataggatatttgcattaaatgaagaataaattgtgtagtgaatcatgaagttgttgagctggtatgatgggtggagaaactaggagcaaattatatttatgtatttaacaaaatttactaaccacgttctatacaccaagacattcactaagtatttgacaatactatgatgaacaaagataagttagaccagatttctaaacttgacatggttacaagcccatagaggtgaaaaaatactacaatgaaatgcaataagtgttatacttaatgcatgcagaacatttaactgtggaagaaaagaaactgtacatttgtctaagttgttgaaaaacttttacagttgtgacatttgaaacagttcttaccagtaaataactttggaaagcagagcaaaatgaaaacaggtcactgaaagatgaaagggttatgaaattattgaaaaaacctggcctgtttggagactatgatgaaaagcgtaatacacatttttcagaggattaagctgaaaacagagagggctgagtcttgttaaggaaattgatacacgtggagtttatttcttagacaatcaggaaatgtgtacgtatctctgtgcatatgtttgtcataggattggaactaaatggagctatgatttaaatcaaattgtggttagaaacaatgtttcttaaccttaactttacattggattcatatagggcaatggtccttaaactttagcatgaatgagaaacagatggaaggcctggtacaaccagggtcgctgggcctcaaccacagagtgtctgattcactagatctgggccaaggcctgaggatctgcattatttgttcccatggaacacactttgagagctactggtttggaatgtaaaatgctgaagaccttctccaggaaaaaatgaatctcagaatctcagatgagcagtgggtatggcactcgaggtgattcaaaaatataatgtgtagtcaggtttgagatccagatattgtgaaagatcactcagataacggtgcaaatgatacagtctatggtactgtgatggttaattttatgtgtggacttgattgagccatggagtgctcagatatgtatagttacacattattctaggtgtttttggatgagattagcatttgcatcaggagactgagtaaagcagacagtctttcatattgttagtgggcctcattcaatcagttgaaggcctgactagaaccaaagtaattcccccccagtgacagagaattctcctgcttcacagttttgcatgagtttttctggttctatagcagtctgcctgccttcagactcaaagtgggatacagagtctgcagatttgggatgtgatagcttccataatcatgtgagccaattttttataataaatctacctgttccccctctctctttctctctctctttctctatttatcaatctatttccagatctcaatatatgtacatatgtaagtgtgtgtatgtgcacatacacattacacacacacacacacccacgcatcctccctatcgctctgtttctctggagaatcctaatacacaaattcagacacatttggaatcagaagagaatatgcagggcaacctttactcatccctcacctcaagactgaatccatgcattatcctccctatgaaaccttcactgatcctcttagagtgattaaactaccagttttgtagcccctaaaaaatctctcttatccctaaaaaatcctctttctgcagtaattttccataatgcaattatctacttaccttgtcttatgaataacactcaaatgcctcaaaggcaaaataatattctcaatatccctggtgtctaaaataccacactgactagcaagtatcatttattaatatattctgcatgagttaattgaaagatactttaagataaagattataaagtacccaataccaacatactggaatagtagctaaaatacagaaaattttaagaggtaaaagaatgatgaacatagtcaaatgtcacaaagaaatgacggaaagataaaaggtaaaaagtattgataggttttggttattaggcagtcactgatgccttatttgtagttcctaacaaagagttggaatgaaaatatgcataatatgcattataccagggacacataaagggaaaattgcgtgatagcatgtaagtttgaaggaaagtttattatccagtaagaatctcatagccattggagaagagctcatcccagctggcacatgatctcagccttttgagaccttaagtagagaacccagttgagcccacctggacttctgacctacagaaatcatattattatatgttacacaacaacagaaaactaattcgaattaccaaacagctgtattatagattgcacagagggaagatggtgttacccactgcagaaatgttctgtaggcctttacttagaaagtactttttcccaaaaactgtgatatatgatgagaatacaacactttctaggtccctgaccatactcataatgtcatctttatcgcactcataatgtcatctttacatttgtaagagttaatttacttcacaatataaatttaaaaaataaataacaaaataaacgttagtgagctaaaataacctgaccaatgattgggctcaccaaacatcagcttccctacagggccatattagaataagcacagatttagggactggaatatttctattgatatcttgtatgaccctgaaacaaggcctactcacaagaaggaaggagcactgtttttcccttgccctcattcattcctaaatcctactgcaatgcctcacctgcccagaggaggcacctttctcttgttggcataaatccctaggtagccttataaaagtacttacaaacattcactactaaatatcacttcacaaaacaactggctcttcagaaacggtacattaagaagatttttaaaaatcccatttgaaaaagtaccagctacccttccaaaacagaatatattagaaaatacttgggtagcgtggtgatgttgaggttaaggttgacaaacaattgtacatggcaatgttcccaatgacattaacaggcaattaagccacggaatcggtgcatgcatttcatttctaaatacagtctcccaacatggctataaaatctttactagtgctctttctttctatacacctgtttatgattagaattaaattatattttagtaatgctcattgaggtgttctccaaggttgttttattaccacctaaaaactcagaaaattacaatttactgtactgctttacttcatagatatagattaactcaaaccccatataaagtactgcacataataaaaatatacctatattttaccaagtaaatatataattaggatgttacttagtaaaaacaggaatttattttggtgatgactgcaaataacataattttcatgaatgcatgaactcatatatattcataaactacattctacttaattcaaatattatttggagtgaggtagtgaaaaaaaattaatctaaagcatggcttctgattgaaatgcttctggagttgattctcttttctgaagaattagctcaatgcctttgtattagtctgttctcacactgctaataagacatatctgaggctggggaggcctcacagtcatggcagaaggcaaaggagaagcaaagtcacatcttacgtggcagcaggcaagagaaagcctgtgcagaactcccctttataaaactatcagatttcatgagacttattcactatgaccagaacagcctggaaaagacgaggtccatgattcaattacctcccaccagctccctcccacaacatgtggaaattatgggagctacaattcaagatgagatttgtgtggggacacacagccaaaccatattattccactcctggcccctcccacaactcatgtcatcacatttcaaaaccaatcatgtcttcccagcagtcctccaaaggcttaactcatttcagcattaactcaaaagttcacagtccaaagtcttatctgagacaaagcaagtcccttctgcttatgagcctggaaaatcaaaagcaaattagttacttcctagacacaatgggggtctaggaattaagtaaatatagccattccaaatgggaaaaattggccgaaacaaaggggctacaggtcccatgcaagtctgaaatccagcagggcagtcaaatcttaaagttccaaaatgatctcccttgactccatgtctcacgtccaggtcatgctgatacaagcccatgggcttgggctggtccacccctgtggctttgcagggtacaagacccctcccagttgctttcagggctggcattgagtgtctgtggctttttaaggtgtgcagtgcaacctgtcaatggatctaccattctggggtctggaggatgttggccctcttctcacagctccactaggcagcgccccagtggaaactctgtgtgggggcttgcacctcacgtttcccttctgtactgccttacaggtcctccatgaggactcaccccaggagcaaacttctgtctgggtgtccaggggtttccatacattctctgaaatctaggaggaggttcccaaacctcaattcttgacttctatctaccctcaggctcaacaccatgtggaagttgccaaggcttagtgcttgcaccctaggaagccactgcccaagctataccttggcccttttttgccacagctggtgcgactgggatgcagggcaccaagtacctaggctgcacacagcagggggccctgggcccagcccacacaacaatttttccctcctaggtctctgggtctgtgatgggagggtcagctgtgaaggtctctgacatgccctggagacattttccccattgtcttggtgtttaacatttggctccttgttacttatccaaatttctgcagcaggctcgaatttcttcccagttaatgggtttttctttttctatctcatcaacaagctgtaaattttccaaacttttatgctctgcttcctcttgaactctttgtcgcttagagatttcttccaccagataccccaaatcatctctctccagttcaaagttccacagatctctagggcaggggcaaaaagctgctagtctctgctaaggtacaataagagtcacctttgctccagttcccaaaaagttcctgatctccatctgagatcacatcagcctggactttattgtttatatcactataagcattttggtcaaagccattcaacaagtttctaggaggttccaaactttcccacatcttcctgtcttccgagcactccaagtctccaggatgttccaaactttcccacattttttttatcttcttctgagccctccaaactgtttcaacttctgactgttacccgattccaaagtcacttccacatttttaagtatctttacagcactaccccgctctactggtatcaatttactgtgttagtctgttctcacactgctgataaagacatacccgagactgggtaatttataaaggaaaaaggtttaatggacttagtttcacatggctgggaaggcctcacaatcatgaaagaaggcaaaggaaaagcaaagtcacatattacatggcggcaggcaagagagagcgtgtgcaggggaactcccctttataaaaccatcagatctcctgagacttattcactatcatgagaacagcatgggaaagacccggcctcatgattcaattacctcccattgggtccctccgatgacaggtgggaattatgcgagctacaattcaagatgagatatgggtgaggacaaccaaaccatattaaccctcataatttttttcttggatatatttttccattcatccctttatttcttaactaagttttaatgagtccttattatttaaccgccatttaatttgttcttacattactaaggattcacaattgctaacgtctggttattttgaagatgaaaataaccagaaatgattacaattgaactcactcatggattctttagagaacccctttaaaagtaattagtgaaaggttacttttacagagatattatggtgaaaaactaattcaaatggaagccacttgagctaattttgcagacaccaaaatccaagtagaatcaaaaacactgaagtagcctcatgactgctacataactaagggcaatagaagcatgcataaactacagtgcaataccacctcacacccactagaatggctataataaaaagacatatagtaacaaatgttggtggaaatatgaagaaataggaaaccctattgctgtcagaaatgtaaaacagtgcatccacattggaaaacaatctgctagttcatcaagtggctacacataagagttaccagcaatttcactcctaggcatatactcaagagaaatggaaacatttccacaactacttttacaccaatgcctacagcaatattattcctattaggaaaaaaatggaaaccagattaatgtttgtcaagtaaagaatggataaatatgtggtatatcaatacaatagaataattttggcaataaaaaaatgaagtaccaatgacacatactataatatgcatacacattgaacacatcatgctcaatgatacaaacctgtcacaaaagactacctattatatgattattttatatagcaaagcaatagcaggcaaatttatagagacagaaagtcaattaatggcttcctgaattaaggtgaaagagtgtgggggattatgactaagtaatgcagaatttttttttttgtagtaataaaaatgttttgaaattggttatggtaatggatgtgtaactctgtgaatattctagaaaccattgagttatacacgttaaaagggttcattttatgctgtgtgaattgtatatcaatgaagctgttaaaatttttaatgttttagaccctctgaaagaaaaacagaacgtgattttactttacatggcactattttcaaatgtgaagtattcttaatctctaatatattcatggtttttttcatgaatacatcaaaacatttcctaaatgtatgtataacctcttcgtacacttttaaagtgaggataattggtacttttggtctacttacgaatatgttaaaaaaactttattgttatgaagatggattcattttcttagagttatattctaatttcatttaacacagtcatatctacctttatgattccagaagtattacggatatatatttttttatgttgtttcctgagcttaggtgtttatcacaatggaatattctgggtggaggtagaacaagagtcatcctcaactgtagatcacgtatgttacttgaagagagcctaaacctggctgttgaaattccaagaattattcttttactgtaagttctataagtgtttttgaaacttgagcagaggtattatattgacaaaataatcaatgtgcaattatacatttttctttctttcttttttcctaaactatcacacatatcaagtcattccaatgacttgatagtgtaagtaaggcaaaagcaaatgaaaaagcaagtctcccaattagaaggagaaccaaatgcccttgactcaaggatgaggcataagtgttctgtgatgccacttttccatcaccatgccagaattacagtaaggaggaaggcataagacttattcatgctatctgataatgagaaattatatctaatacactccgcttactctcctagatcctgatatcaaaaataaagattatgagagccctgctcttaaggaaatttcagtatgtcttcttgtacaagtgacatcttttactgtgatacataaagtagtttaccaatttctgaagcagtgactgtgatgttgtaccatggagtttcttctctgtcgagaacctttgtagtcctaatggtcccagtattggcatcaatgttgaaaaatctgtcgtcttcaacattgtagttgatgaagtatctagagaaaaaaagagaagtttttacttgatgttataatgaagaaaatacaactgaaccaaggaaagtattatatctaaatacattaaaatattcaaatatacttttaaattctatatttgattacatggcaactttatatttttatagaacttatatcaattattcttatccatcagtctttaattctaagttcaattactaattcaaagaataattttataaggtcttaccaaattccatgaataaaagtagatagcagaaacagcgattaatagtggagagaccaaaagaactcacctcttggaagcctataatatgtttaatgaaaaaaaatattaaacctataataagacttcttgttgttattattcaaaaaaaattagaatccttgaagtcagagatgaatttatcttgaaatttcattgtagctaaggtttaaaaataatataaaatgaaaaacaaaacatttatatttattaacattgtacctccatcacagttcaactaaacccttgtttagtcaaagaatgagataaaaaaataaataaagataggttgaattataggccacaaattatttttccctcttcaattcatgtaattttgtagagttctcttatattgcgttagatttcagcttacttttgtaatcaaatgagctgaaagtgatggtgtctgtcttctttctgggcctaggtttcatgagactttgtatgtttccttgtgtcctatgccactgccacaggaaaagcatgattgggctaattaacttgtcctagcaggaggaagggaaacacacggggcaaagttgtcccaattaaggttcccaacctagcgtagatcaatctagtaaatgtgcagatgcacgatggagtgccccagagataaacagagctggcatcaaaagctagcctaattcagctagccctcagctaacccaccgacacatgcagtgtagttagacacagcttttttttaagacccctgagttttggagttatgtgttatttagcaacagctgattaacatgtctctgaatatatactattaaacaattatcatatgttctagaaaagcttcagactatttcttcaactatttaaggagataaatattctctcctaaagcctctaatgcttttttctctttttaaatctcagcttaagtaatattttatctagacctgaaagatgaaatggactgattaattatgtgaaaagtgctagggaagaatatatgaaacagagaaaaccaagatgcaaagatcgaaattaaagaaacagtttcaattggttagaaaacaaatctatgtcaatgtggctatggagactgaatgacatgaatctccaagagttaggacaaggtaggacaaggtatcttttgtgaaagcaatggcaagaatttcaaattcaagaaaataaaaacagatttattaatgctctgaaaaataacagtggctactttttatcatatactgtagaaagttgaaaacaatttataaaaaaaattatttgtcaacttggacaaagatggaaagatagaagatgatggaaaaaagtgtacaacatactgttatatatgaaatgaaattcatagacttcttgttgcagtggcattagtaaagcaattaaatcacaggtgactccatttccacacgtgtttgacctactatttaattgataggcccctttactgaggtggataaaaagagctggggaaaggtagtttgggaaaaattaatgattatgccttaaatgcccattagatacccatgtggaataaaaagcaaaagtcaaatatgggtatggaattcaattgtcctttctaaataggaaatataactttgagatgatatatcagcataaagctaaggtaatgggaatggtataatctcatctggaacagaattataagagaaaagaaataaaagattgagcactgaagtacacaacctattgagtatagagcaggtcagtatctgttcggagatggtgacagccaaaggagagagggaaaactgggaaggggagtggcatgcagccaagaaatggcttaccaggaaggaaggagctaacaactggggtgaattctgttaggaggttgattgaggttagtgagggttaattggatttggcaagatggacagtattattaatagttaacttgtcaagaataacatcagaaaatatatcaaaggactggagatttattacagtggcttcaacagtatattgaatgtgaagatacaaagaccatgagttaagacaattgattgatatcttttaatgaatgaacagcagaaacaaaagcattttgtgtcatcagaaaagtgggttcaacaaattattttcttttatatgggaaataagaagcattgtctttgctgaaagaaatgatgcttttgaaaaaggggactatcaaaaattgtaaaactcatgagaaggtgaaaataattggattccggggaacagatatagaaatttcccattgaaagtaacagggatgcttcttccattttagtatgaggaaaagatgaaaagctgggtagaaatatagggtaggtgtggtgatgtaaatattacaaaattcatcatactttctagaacagagtgtaagtggaattgcaatacaaccaaccccatgcctctcataggcataaggtgttagaagggtatgcagagcatattgctaaggtgtgaaatcttctaacctcctgtggagaggcatgaacacacatggcagaagatattaatagcagcatggagaatgaaactacagagcaaggagcatgccaagaaatctaacttatcagtaaaaaacacataaaaagagacagattgtatcacttggaacggtgtgatcaaaacaaggaactgaccattgtacattaaattttctaataataagtatatgttaattgaaaaaagtttaacataaaaaagaaatttaaacaagaaaaggtacaactctaaagtaaatcttattctgagacacaaaaaccagatgctacagaatagtgggaaatctgtatgtcactggggttcccaaagcataaagccatgctacagtaaaaccattgtacttaattcagattgagtctatactagaaaaaaaacaaaacccttcttataacatccctttcccagaggaaaaatgctgaggatgagggttgaactggttaggaaatgacagatgtcttatcatgtggaaaggacagcatcctttaacatgtagtcagtaggctttctggctattttattatctaatgttaacctgtctttaagaaattgtccatttttggttactgtaagaaaatcagcttctgtatctgaaatttggaggattcaaatttggaacttattattcagcttcaaagttgcctgcagcaactatcagaaaagctcagattgtagtgctatagatccctatgaaatatggcagagcatgtctcattttagaagttagatcaccttacaactgtcagtctggaagaaaataggttttgttttgttttgttttctgaaaatatgtagtctttttgccagagcaatctcctcttttttagccacttcacactgggctttctaacataagtgctaatatcagtggcttaatatttttagagttaaacattttaatttatatagttttaaattatgtttatatattagaaaaatggtaagcatactgctaggcatgcatctttagactcatgttatttgcttccgagtttcctaagctatctagctctctagggaaatcaacatcctaagggttagattgtgggcgatgcttggatccaaagagtcttattcacgaagttgcaattgaattttgactcaagtagaactaaatagttctgcctaaccacttttggctttctgcccagacatggaaataaaaactcagaagtaagtaaagtggaaatgtgagaaaagagaaactattcaagactattttgaagattaaatgtagaatcattcaatgctaattatttagaattaagaagtgacatgggaccataaaactattaatcaaaccattaaaaagagatgaggctattctcagtaaattacttttcaaataatttttataataaaatctgtttcataagccctaagtaaaaaaatcaatactttatgaatgtatatatcaatatttagatttttttacaaataattaatttgacattatcagaaatatttagaaaatacaaaatcaagtaacgatttgcctaggtgacataggtcctaaaagaggactaatcataaaacccgtggaattgggattttaaattaaaaaaaaaaaaattctaggttacagctaccaaaaatgaaccagaataaattgaggctagaagatttatagccagataagacattttaaacaatttcttcaaattctaagttggccattaatataaacctttgagtattgccatatgtgtgaggcagagaggaaatacttaaatgcgtatatgagttatttaacaaagctatctagtaagaggtaagaaaatctaacatttatggagcacttgcagtatactagatggggttctaagtgctttataaatattagttcattaaacactcataacagctgcatgaggtaagtactattactagctcccttttgcaaatgaagaaacgaagggacagagtaatagagaatttgtccaacattaaggagacagtgcaacagattaaaatacaatctaggtctactgagtaatatttatcagcttttttttttttttttttatgaagtgtcgctcttgttgcccaggctggagtgcaatggcacaatctcagctgactgcaacctctgcctcccgggttcaaacaattctcttgcctcagcctcccgagtagctggattacaggcgtttgccatcatgcctggctaatttttgtagttttggtagagacggggtttcaccatgttggccaggctggtctctaactcctgccctcaggtgatccgcctgcctcggcctcccaaagtgctgggataggcctgaactactgtgcctggccagcttctttgtttttaaaaggagaaaattttaaaggggggataatactgtttgaatgtttttcctttctgaatctcatattaaaagctaattcccaatattggaggtgaggccaggtgggaggtgactggattatgggggtggatccctcatgaatggtttggccccatccacttggtgttaagtgaattctcactctcagtagttcatgcaaaatctaattgcttaaaagcctgggacttcttctcactcctgttcccactctcaccatgtgacatgctggctccccttcaccttctgccatgactgtaagttctctgaggccagaagcagatgctggcaccatgcttcctgcacactctgcagaatcatgagccaattaacctcttttctttataaatgacccagcttcaggtatttttatagcaacacaagcacaaactaatacaatctttatccattcattcaaaaatactctcatttgaaagaatacagaaaaagaatgaaagatatatattaaaaaagagagaatatgtcaaatagtttacttcgggaaaagaagaaaataaagaaagaaggaaggaagaaaaatggagggagggagagagggaaggaagggagggagggagggaaagaagaaaagcgaaagaaagaagaaagaaagaaaggaagaaaggaaggaagaaagagaaagagagaaaagaaaaagaaagaaagaaaaagaaagaaagaaaggaagaaagaaaggaagaaagaaaaagaaagaaaaagaaagggagggagggagggacaggtaactgattataatgatggatgccagagagtttaatgaagagatcagagtataaaattccaaggcataaaagcttcatgaaggacatggtatttgatcagtcctgaaagaggaaaaacagttaaatagagatatgtgcaccagagatcatccagagagtatggaatttgatgatttcatatgacatattagagaaaaacagagagaaagaaagatcttaaatctggtttggaattccttcagaggtgacatagcattttggagactagtgctttctggtattggctgctagactagaaaaagagagaaaaaaaaagaaagaaaaaagcttcatgtagtaggtaggaaagaaaccacacatcagcattccagtaaacatggctgcccttattcaccatgttagactttagtagtaaactctttttattattattattattatactttaagttttagtgtacatgtgcacaatgtgcaggtttgttacatacgtatacatgtgccatgtcggtgtgctgcacccattaactcgtcatttagcattaggtatatctcccaatgctatccctccccactccccccaccccacaacagtccccggtatgtgatgttccccttcctgtgtccatgtgttctcattgttcaattccaacctatgagtaagaacatgcggtgtttggttttttgtccttgcgatagtttgctgagaatgatggtttccagcttcatccatgtccctacaaaggacatgaattcatcattttttatggctgcatagtattccatggagtatatgtgccacattttcttaatccagtctatcattcttggacatttgggttggttccaagtctttgctgttgtgaatagtgccacaataaacatatgtgtgcatgtgtctttatagcagcatgatttataatcctttgggtatatacccagtaatgggatggctgggtcaaatggtatttctagttctagatccctgaggaatcgccacactgacttccacaatggttgaactagtttacattcccaccaacagtgtaaaagtgttcctgtttctccacatgctctccagcacctgttgtttcctgactttttaatgattgccattctaactggtgtgagatgaggattgactaaactgtaagacctagtatagcaaatgaaagaatataattattacctttctagatgaaaggagtacagatactttgtagagaaagataatctctgtaaaattttgaagatgagaatgcatagattgggaaaaatgtcaaggatgtttggattgtaagagcacagacttttaaagataaatgaagaagcaagaagaattagggtgagggatgggccacttaccaaggacaaatttcccagttttcagatatcagaggtagtaacctctttgaagacactgaaaaacacctacattctttctctctgtgtacaataagtcacagattcttagccttgtttatttagaatgtaaagatcaattccaggaaaattatttctaaaatagacacagcatatatgtgaatattatatcaagccatagtaagataatcactccaggtttgaaaccaagcaaacctgttaatcacagctgtatcacttagcattgtgaccttaagagatttagtctctctgagctgtctccatgagtgaaatggagaaccatttacataataattttcttgtgatgattaagtgaagtgatatgtgaaaatcacttatgcttgagggttaaatgataggccttcatagaaaacagctatcacttgttttaaggcttctcaggaagacgtttttctccctttctttcttgggaagcttcagtctattttgataagacagttcatagattgtaagtactggttgtttctttctcctacgactgcactataaacagagtgggttatgaatagggttactactgaataaacaagagtctctatataaatagccagaacttcagcctgtttctgaaaattttgtcagaaaattaatttttaatttactgcttaattcacatagagcaatttttatttggaaggtgtatgagactaaagctctttaacttctaccaataataacacagatgtattgcttggcctcacaagtgaatgaataagccaaccaatcaatcaacagttataatggagactgataatatttcatgcaactgatagtagtctttcacttcttttgtaaatatgttggtagcactaatcatgccaagaaatcgtgtcttacctatccaggccagtatgttttcatatctagataagatatttatagattcttaatgtcatccttcatatggatttctaatactatgcttaaaattggttagatttattcgggaaataattgttttctctttatggtgtgtagttggcttattccctctttcattgagtaatatttaaacattgcacaaagaacaaataaatttgcgcctcacccaaaattcatagaatcatagttctggaaataattttaagatgtaatacaattattgactgtgaaagctcatcttttagacttcagtttaaatctaagaaaaaaagcaaagcaactactttgtggtgtatcttgttaatatcctgtactaatctacaagcatatgtggtcaaaagtgttaatatgagggagaaaacgttgaaatagactcaacggctactcttataattgtgacatataattcaaaccctatcaccactacatgttcactatattatgtgtgaaataagcatcaaaatggtatcttcactaaacactactgtgaaagttgtatgatcaatgatcaataagatgtctcctagttatagattagagaaagtacaattaagttactgacagctcaaatttgctcagtggtctttattagccctctaactggacaagtcccataggcaaaccttaactaatttcacactgacagataaatggatccattcatgcctcacccagtacaggagatcttgccaagttcccaatataacttataaatactggctataattttttatttctacaccactctttgttctatcattcaacttctgtaccatttcatatctctagtaaatgttttaaagcaatgatgaaagtaaaaagaaaatgcattatattgaagtgagatgaaaatttattattgaaattagtacttcagggaccaaaaaacagacagaaaatttatgaccatagtaaaaattcaatctcaataatgattacctttactcaaatattttcttccacagaaactactttaaacaaaccatgcaggtcatcatttggaactcagcttccctttgattaggtatacattcgtgataatcaatactcatattaaagtgtattagaaatgttatttttcatttcaataacagctcttcagtcctcagtggcacttattttcattatattctgtccatttcaccacaagaaattaatttaaaacttatgtaacagaaatccatttttacagtgacctacttagagaaatatcatctgacctgcacgttgtgaacatgtaccctaaaacttaaagtataataataataaaattaaaaaaataaataaataaataaagtatagaagacctctttcagttgtcactttgtaaatatttgcaggtacaagacatgaatggtaaagcaaatgtatttaagattttgtcacccaagcagttgttttgtaagttttgttgagaataatcaatagttgggataaagtttaatcaatacataccctgtgagatattaccacaacttggtctcatactttttttttttttttttttttttgagacacagggtattgctctgtcacccagtctggactgcagcagcaggaacacgactcattgcagcctttgcctcctgggctcaagtgatcctcccaactcagcctctgaagaagctgggaccataggtgtatgccaccctaatttttgtatttgcttgtagagacagtgttttgtcatgttgcccaggctggtattgaactcctgagctcaaatgatcctctcgcctcgaccttccaaagtgctaaaattacaggtgtgagccaaaacgcctgaccctggactcacctttagcttaacaaaaagtcacgcacctgaagtatagcttagattcactttacgaattatgattccctttgttaacattgggaatgcaatttaatacacaagccatgcattgagaaaataatctttctaaaaaaaagaaggtataatttctcacataaagtgagtattgtgcttatgtgcttaataggatggacagcacacatggcacatagatatttgcggatactttttaacctcctgaatcaaaacttccatccaatgaagcaaaattaagctaaacctctgcacatgcaattataatgtttcttcctggtatttatgactctaagtaagtgagatatcagaaattgcattaatcttgagttctagaaatgctacaaaaccttattagaatttttttattcagaaccagcctgaccaacatggccaaactctgtctctactaaaaatccaaaaattagccaagcatggtggcacatgcctgtagtcccagatacttggaagactgaggcaggagaatcccttgaactctggaggaggtggttgcagtgagccaagatcacaccactgcagtccaggctgggcaagaagagcataacttcatctcaaaaaaaaaaacaatttttttttttgtaaaattcgcatgaaatacataagctatttggatgttattcccctgttagtagatctatagagtatcactaagctagggctaaggtacttattctaattatgcacaccttcccagaacacaggttcccttcctggggctaagcctggtttggtcacaagatggtgacattaggctgttagataaactttaaccagaaatggaagatttttagaggtcttctatatctttaatgaaacatgaaaaagtgaccacattcttgtccagtgtcaattattaattaataatttaattattttagacttcaggttgaatctaagggggaaaaaaagcaactttgtggtatgtcaagttaacactttggaacaatcaacaagcacatgtgtccaaagagttactataatggaggaaatgttcaaatagatccaaaatctactctaatataactgtgacacaacattataacacccttattgtatattcactttatcctgtgtgaaataagcatcaaaattgtacttataccaaatggtacttcagacgttgtatgactagagccagggaaaatggcggagaggaggcaggactaacttgcagctcccacatggaccaacagagcagcatgtggagacccacactgtgaacttttgctccaagaactaccacaggaacataccaggaaagccaagagaatccacagaccctttgaaagaggtggactgcagctgcaggctccatgggatagctgaggaattgtgagttggcttgctttctcagctgggaggcttgtagtctggggcaagttcttagctgttaccagcttcctggaaataaacttggtgatgttgggtgggacatgaggggagtgagaccagctgtttgggctgtgggctgcatgggaacaaggtaaggcctggggctgccggctcttcccccacttccctggtgagctatgtgatgcagcagagaaagccataatccccctgggaatataactccattggcctgggaaccacatccccatcctccacagcagccacagcaagacctgccaaagtctgagctcagaaaagcctaacagtgcccccatctgatggtctttctgtacctaccctggtagcccaggacaaagtacataatctcttgggagccgtatggctctgttgactgcctgatcctccctatacaatcgcaactgatgtgctcttgaaagcaccacctcctggctggaggccaaccaacacaaaaccagcacacttaacaaaaatgcaaccaaggaccctcacagagtctacttcactcccctgctacctataatggagtaggtgctggtatccacagctgagagacctgaagatgggttacatgacaggactttttgaagacactccccagtatcagcccagagcctggtagctccactgggtggctagagctagaggagaaataacaataattgaagtttgactctcaggcagccccatccctagaggaaagggaagaacaccacatcaaggaaacatcctgtgggagaaaagaatctgaacaacagcctgagtcacacatcttccctctgacatagtctacccaaatgagaagagaccagaaaaataattctgataacatggcaaaataaggttctttaacatcccaaaaagatcacactagattatcagcaatggatccaaaccaagactaaatctctgaattgccagaaaaagatttcagaagattgattattaaggcaatcaaggaagcactagagaaaggtgaagttcaacttaaagaaatccaaaataatgatacaggatatgaatggaaaaatctccagtgaatagacggcataaataaaaaacaatcacaacttctggaaatcaatgacatacttagggaaatgcaaaatgcactggaaagtctcagcaatggaattgaacaaatagaagaaaaaactttagaacttgaagacaaggctttcaaattaatccaatccaactaagaaaaagaaaaaaaaaatttaaaaaacgagcaaagcctccaagaagtttggaattatattaaatgaacaaacataaaaacaattggtgctcccaaggaagaagagaaatataggagtttggaaaacacatttgagggaataattgcagaaaacttccccagctttcttagagatctagacattcaaatacaagaagctcaaagaacacctgggaaattaatcacaaaaagataatctcctaggcacatagtcatcaggttatctaatgtcaagatgaaggaaaggatcttaagaaatgtgtggaaaaacaaacaaacaaaaacaccaggtaatctataaaggaaaacgtatcagattaacagatttctcaggagaaatcctacaagctagaagaaattgaggtcctatcattaacctgcttgaacaaaacacttctcagtcaagaattttttatccagcaaaactaagtttcataaatgaagggaaaatacagtctttttcagacaaacaaatgctgagagaatttaccactaccaagccagcactacaagaactgctaaaaggagatctaaatattgaaacaaattctcaaaatacaacaaaatagaatctccttaaagcataaatttcaaatgacctataaaacaacaacacaatgaaataaaccaaggtattcaggcaaaagatagtataatgaatataatagtaccttacatctcaatactaacattgaatgtaaatggccgaaatgctgcacttaaaagatacagaatggcagagtgcataaaaactcaccaaccaagtatctgctgtcttcaagagactcacctgacacaggactaatatacttaaaataaaggggtggaaacagatatttcatgaaaatggacaccaaaggcaagcaggagtagctattcttatatcagagaagatgaactttaaagcaacagcagttaaaaaagacagagggactttatgtaatgataaaagaactagtccaacagaaaaaaaaattcacaattctacatatacatgcacctaacactgcagatcccaaatttgttaaatataaaacagttactactaaaccaaagaaatgagatagacagcaacacagcaatagtggaggacttcaatattccactgacagcactagacaggtcatgaagacagaaagtcaacaaagaaacaatagacttaaattatatcctagaacaaatggacttaacagatctttaaagaacattctacccatcaactgcagaatattcattctattcatcagcacatggaacattctccaagagagacaatatgataggccacagtacaattctcaacaaatttaagaaaatcaaaattatatcaagtactctctcaaaccatattggaataaaattgaaaatcaactctaaaatgaaccctcaaaaccatgcaaatacatggaaattaaacaacctgcttctgaatgatcattgagacaacaatgaaatgaaaatggaaattaaaaaattttttgaactgaatgacaatagtgacatgacctatcaaaacctctgggatacagcaaaagtggtgccaagtggaaagttcacagcattaaatgcctacatcaaaaagtctgaaagggtacaaatagacaatctaaggtaacatgtcaaggaagtagagaaacaagaacaaaccacacccaaacacaggagaagaaaataaataacgaaatcagagcagaactaagtgaaattgaaacaaaaaacatacaatacaatagataaatgaaacaaaaagttaattctttaaaaagataaataaaaatgatagatcattagtgagattaactaaaaagagaagcaagatccaaaaaagctcaattagaaataaaacaggagatagtagaactgataccacagacatacaaaagagcattctaggctattatgaacaactttatgcacataaaatagaaaaccaagagtagatggataaattcctggaaatatacaaccctcctagattaaacaaggaaaaaaatataaactctgaacagacaaataacaagcagtgagattgacagggtaattaaaaagttaccaacaacaaaaaaaagtccaggaccagacagattcatggctgaattatattagacattcaagcaaaaattggtaccaatcctattgacactattccacaagacagagaaggagaaaatcttccctaagtgattccatgaagccagtatcattctaatactaaaaccaaaaggggacataacaaaaaaagaatactacagaccaatacacagacccggatgaacatatatgcatcagacccttatgaacacgatctaggacagttgtatatttccaggaatgtatccatctcctcttggttttctagtttactatgaacaaagttgttcacagtagcctagagttctcttttgtatgtctgtggtatcagttgtaatatctcctgttgcatttctaattgagcttgtttggatcttcttgcttctcttcttggttaatctcactaatgttctatcatttttatttatctttttaaagaactagctttttgtttcatttatctattgtactgtgtgttttttgtttcaatttaatttagttctgctcagatctttgttatttcttttcttcagctgtgttacagaccctgatgaacatatatgaaaaaatcttcaacaaaatactgtctaacagaatttgacagcatatcaaaaagataatccaccatgatcgagtaggtttcatagcagggatgcaggtatggtttaatatccacgagtcaataaatgtggtacaccacataaacagaattaaaaataaaaatcacatgattatctcaatagatgcagtaaaagcttttgaacaaaatccagcatccttttatggttaaaacactcatcaaaaacaccaaagaaggggcataccttaaggtaataaaagccatctatgacaaacccacagccaacagggtaaagttaaaagcattccccctgagaattggaacaagtcaaggatgtttactcttaacacttctcttcaagtagcagaagtcctagccagagcagtcaaacgagagaaagaaataaaggacatccaattgataatgatgaagtcagattgttgctgtttggtgatgacatgatcctatacctagaaaatcctaaagactcatgcaaaaagctcctagaactggtaaatgaattaagaaaagtttcaggatacaaaaataatgtgcacaaatcagtagctctgctatacactaatagtgaccaagctgaaaatcaaatcaggaactcaacccctttataatagttgcaaaaacaaacaaaaaaaaaactcaggaatatatttaaccaagaagaagaaaaacctctacaaggaaaactacaaaacactgctgaaatacatcatagacaacataaacaaatggaaacatatcccatgctcatagatggagtcaatcaatattgtaaaaatggccatactgccaaaagcaatctacaaattcaatgcagttcttaacaaaataccaccatcattcttcacaaaactagaaaaaaaatcctaaaattcatatggaaccaaaagagagcctgcatagccaaagcaagactaagcaaaaagaacaaattctggaggcatcacattacctgacttcaaattatattataaggccatagtcaccaaaacagcatggtactggtataaaaaataggcacatagaccaaaggaacaaaatagataacccagaaataaagccaaatacagccaactgatctttgacaaagcaaacagaaatgtaaagtgggaaaaagatacccagttcaacaaattgtactgggataactggcaagccacaggtagaagaatgaaactggatcctcatttctcacccttatacaaaactcacctcaagatggatcaaagacttaaatctaaaacctgaaaccataaaatttctagaagataacattggaaaagtccttctagaaaatggcttagacaaagacttcatgaccaagaatcaaaaagcaaacacaacaaaaacaaagataaatagatggaacttaattaaagtaaaaaggttctgcacagtaaaagaaataatcagtagagtaaacagacaacccactgagtgggggaaaatcttcacaatctatacatctgataaaggactaatatccagaatctacaaggaacttaaacaaatcagcaagaaaaaaaaatcccatcaaaaagtgggctaaggacagtaatagataattctcaaaagaagatattccaaatggccaataaacagatgaaaaaaattcaacatcacgaattatcagggaactgcaaatcaaaatcacaatgtgataccacctcacttctacaagaatggccataatcaaaaaatcaataaataatagatgttggcatggatgtggtgaaaagggagcacttttacattgttggtgggagtgcaaactagtacaaccactacggaaaacagtgtggagattccttacagaactaaaagtacatctatcatttgaaacagcaatcccactcctgggtatctacccataggaaaagaaggcattatacaaaaaagatacctgcgaaggtatgtttatagcagcacaattcataattgcaaaaatagggaaccagcccaaatgcccatccgtcaatgtagggataaagaaaatgtggtatacataaaccatggaatactagtcagccacaaaaatgaatgaaataatggcatttgcaacagcatggatggaattggaaaccattattctaagttcaataactcgggaatggaaaaccaaacattgtattttctcactcataagtgggagctaagctatgaggatgcaaaggcacaagaatgatacaatggactttggggacttgggggaaagggtgtgagggtgaggaataaacactacacattgggttcagtgtatactgatcaggtgatgggtgcaccaaaatattaaaaatcaccactaaataacatattcatgtaaccaaacatcacttgttccccaaaaacctattgaattttttttaaataggccaaaacagaaaacaagtagttgtatgactaaatgtgttataattatgtttggcctaggggaaaaaatcattttatatcagataatatctttagctatgtgcttttggaccattcagccttcaaagtctaaagatatgttcatctatgaaagaatagagttgtcttagtcatctttatgtccccctgagttctcaagtatcatgtgtttatgacattgaacaataaaccattaatcaatctcagtgttctaatatcagcaatatataatgtgatacaatttcaaaatacaggttgtagacaaagacttttgattttaagcaagaatttgctttctgtctgtctctactggatttgcattaaatgtccataatggactgtttcctttggatcagaacacaatggctgagtgtttttgatgatacactgaggattgccatgaagagaacactgaaataattttatgttatcaataaggaaaacttttacaactaaatttggtctatgaaaaaggttcttgtatattagatacctttaacatgaacacagtttaaaacatatttactggttatttttcatctttgttttcaaaagtttaaatcctgcattcaaactcttaataatttcttttcactttccctcttgaactttgccaaaaggccttatcattattttaaaatctctctcttttttttgctgttataacatccaaaataatttggtatttctaatccaactcatcatcaattatgtgaaaatttcaaaagtagagaagaaagcaaacaaaaaacaaaaagaagtgaatgcttccagtgtattcactgtaccattatttaccaataaattcacctcaccaaggtcacaataaatctctggataggctgagaaaatacttttaatactttgcatccatttctttaaaattatcccttatgttgcaaaaatattttaaaatctggctaagtttccaatatgttcacaatacatttgggctatagtttattttataggtagtgccatcataagcatttgaaacaattatgcgaaatatttaatcatttatttccttaaagttatcattcaaagaaaacattcaaattctcaacaagaagtaaatgcatagataaattcaggttataaatcaagatgcaaaagaaggaaagatggggcatatactcattcacataattcagctgctaaagcttttcatcatataagaaatgttgattcagggactccaactttttttatactaaatcaagtaatgtacatctttaactacaatacggagaaactataaaattaagagcaagtttattactaagatgctaaagttaaaaaaagacttgccagttagcatccccttttctaatgtgtggagtaaacccataaaagggaaggccccaggtaatggcatttgcttaatggctctctgagcatttataatatacatttgtttctaatttttgatacttgacttttgtaaatgtagtcattttgtttgtttgtttttattttttattagttatagtataatagggagcatattgggctacaaaaagaaagttttcagagtaaagcaaaattggatttgcattaaaatgtcatgttatcactgaaaacagaatcaagttagttaattttttgaactttagtttcttcatctatagaatggaatcaataatacagacagtttcagtgttgtgaaacagtttatggaatgatatataaggtccatggccaacagacagaagacaatgaatggtaacaatttaacagtcatgtgtcataaagctacattcccaaaagctctctagcttcttgttttcaacatgggattgctcatctctcagtagctaatctgtgaaattcctgaattctatttgtaatttgtgagcaaatggtgtagcctgtttaaatgaaaggcttcactgctggtaaacagccaggctctaattttattttttcaaaaaggtgatgattggagaagaaggtggagcaagatagcagtatagaaccctacaaagattgtcaaccctgcaggaacactgaattgaagaactttccatgaaacaccttcataaggactaaaaatcaggtgactgatcacagtacttggtattaacactatattaatgaatggggcactgaagagcacaggaaagacagccttgaatggcttacacaacccctccctcataccctggtagtggcagcagagcacaaagagagaatctgtgcactttggggagggagaacacaatgattatgagactttgcattggaagtcactacttccttgttatggcagaaagcaaaaagtgacagaacacatcctgcaacctatggagtaagcctttagaccagcacaggctagagagaaataactcaacccagtggtcaaaacctgagttctggctagccccaccactgtgggctaaagcactccagggtccttaatgaacttgaaaggcagtctgggccagaaggactgtaattcctgagtaagccttggtgatgtgctgggcttggagccagtggatctggagtgcaggtgacatagtgagaagccagctggcgtggtcaagggagtgcttctgccactcctcccccaaccgcaggcagtgcagcttgcagctctgggagagatcccttccttccacttgagtagaagtgaggaaggagtaaaaaggacttcatcttgcaacttggatacaagttcagccacagtagaatagggcagcagacagaatcctgaggccctagctctcagacaacatttttagatacacctgggccagaagggaacctgctgccttgaagggaagaacccagtcctggtggaattcatgacctccttactaaagatcccttggaccttgagtaagcatcaactgtagccagacattactcatcgtgggcttttgatgagaatgagactcaggtgtaacccagggtattaacagatatggtggctatggggagagactcttcctgctcaaggacgggaaagggaagtataaaggggagtttgtcttgcagcttggataccagcttgaccacagaggggtggagcatcaagcaggctcctggggtccctgattccaggcgttggctcagaggagagaagttctaaacctgccctgggctagagtggagctaactgccctgaaggaagagactcagtccaggcagtgttcagcacaagctgacagaagagcccatgggccttgagtgaagatgggtggtatccaggcagtacataccacatggggagaaactcctgcttgagaaaagaagagggaagagcgggaagaactttgtcttgtggctggggtgtcagctcagccacagtagaatagagcaccaagtagattcctaaggttctcgaatccaggctgtggctcctggacagcatttctagacctgccctgggctgtggaacatgagaggcaacatcgaggggaaggacacaatcctggctggattcactccttgctaactgaagagccctgggccttaagggaatatcagtagtagccaggcattagtaatcaatggtcttgggtgagatccagtgatatgttcatttcagttatgacccagtgcagtcttggtattggtggctacagtgatgcttatgtcactcctctgctgagctccaggcagatcaacatggacagagaaactccatttgtttaggggaatgtaagggaagagaacaagagtctttgcctagtaatccagggaattatcttagattttacccaagaccactacagcagtacctccacaagtcttcagagtcacagcattactgggcttggggtaccccctaatgcagatatagctgcaatgaccaaagacttagataataacacccaattaatcccctttgagtacttggaagagtccccaagaatgacaggcacaaataagcccagtctgcaataactacaataaatgactcttcagtggtgctgggaaaactgcatatccatatacacataattgaaaccagacccccatctctagctatatgcaaaaatcaattcaaaatgtattaaaacttaagtctatgaactcacactgtgaaactgaagagagtacgttgggaaaactctgctggacattcatctgaacaaagatttcttgagtaatatgctgcaagcacagtcaaccaaataaaaaatagataaatgggatcacatcgagttaaaaagcttctgcacatcaaagaaaacaatcaacaatggaaagcgacaacccacaaaatgaaagaaaatattttcagattatccatatgaccagggattaataaccggaatataattgaagctcaaacaaatctatagaaaaaaaaaatctaataatctgaataaaaaatgggcaaaatatctgaatagacatttctcaaaagatgacatacaaatagcaaacagacatataaaaaggtgcttaacatcactgatcatcatagaaatgcctatcaaaactacaatgagaaatcatctcaccccagttaaaatggcttatatcaaaattacaggcaataacaaatgatggcaaaggatgtggagaaaagggaacccccatatcctgttggtgggaacgtaaattagtacaaccactatggagaacagtttgacagtttcttaaaagctaaacatagagctccctatgatgcagcaatcctgctgctatgtttatatgaaaaagaaaatgtattagtccgtttttatgctgctgataaagacatacttgaaactgggtaatttataaagaaaaagaggtttaatggattcacacgtggctggggaggcctcacaatcatggtggaaggcaaaaggcacgtcttgcgtgggggcagacaagaaagaatgagagccaagtgaaaggtgaaaccccttataaaaccatcatatcttgtgagacttattcactaccacgagaacactatggaggaaaccgcccccacgattcaattatctcccaccaggtccctatcacaacacgtgggaattatgggagatacaattcaagatgagacttgggtgaggacacagccaaaccatatcagaaaggaaaccagtacactgaagagatatctgcactccatattcactgcagcactaatcacaacagccaagatttgaaagcaacctaagtgtccatcaatagatgaatggataaagaaaatgtggtacatatgcacaatacagtaattcagccataaaatagaataagattctatcatttgcaacatagatagaactgcaggacattatgttaagtgaaataagccaggcacagaaagacaaacttcacatgttgttactcatatgtaggagctaaaattagaacaattgaacccaaggagatagggggtagaataatggttgtcagaggctaggaagggtagtggtggtggggcaggtaattggggatgattactgggtaaaaaatgtagttagaaggaacaacagctagtatttgatagcctgacatggtgactacactagataataatttattttacattttatatatactttatattgctgcaaattacacatcttgtttagagttgaaacagacaaaacctagacattatattctctatgaaatctgaagagtcttactaataatttataaaaggacaatggtaaaatacaaagactgaagtacaaaagtacaatagtaaaatacaaaagaccgaagtcaggaagcttttcacaaatgcttgcaaagctcaaactccctttcattaccaattctacaaacttggagttgattgcatttcagggcacattgcaaagtacatcttttcaatgtgcttttccttaattagtacaaacatttggtccctgagaaaggtggaagtataggcttgcttttgtttttgttaatgttttctgtttttttattcactatttgcacccagaggcccatgtgaatgacacatttttattaaaatcaagaataaatattatgtaaattatgtccccaaacagcagctatggagtctaattattttaaggcagctttagcaggattcattttagttctctaaccaaaacaaagcagaaagaatatttcatatgctaatagatttctgcttcccttcttagcatttggaaactatgtaccaatcatctttgcatcccaacaaccaggagagtgcatgtttcatatgagtgttcatttaagtgctctcagtgatataggacaattactgagacaattagtgacatattttaattgattgaaagtacacattgaaacattcacatgactattcatgtatatgatttgtatatatagacacctatctctgaaatatcttttcaaaatttcttcccatgaatacaattagtactccagttctaccaatttgccagtcagtttgttttagtctatgtcaggttttctcaacattagcactattgacttggggccagataatttctgtgggagttgtcctgtgagtttcagaatgtttagcaccatccatgacttccacccctagatgccagtaacaccctacctgctacaagctgaatgcttttatccccctcccccaaattcgtatagtaaacagtaatccacgatgtaatggcatgtggaggtacaaacttctggaggtgattatgaggtcatgaaaatggaactgtcatgaatggattagtgcctttacaagaggagcttggagctagctacctttttccaagatgtgagaatacgagacgttggtagtctgcaatccagaagagagcacttagcacaacccgacaattctggcaacctaatctcagactctcagactcaagaactgtgataaataaattgcagttttttataagccaccaagactatgataattcttcttagcagccaaactgactaaaggagaaaattggtgggacattcattgtgtgatgtgtgctctcgtaaaaagaaatggaagagtttgctttctttctttctgctcttcactatgtgaaaatatagggagaagagggctctctgcaaaccaggaatcagacacacaccagataccagataggctggccctttgatcttggacttcccagcctctagaactgtgagaaataaatgttttttgtttataccacacagtcgaaggtaatttgttatagcagcgtaaagtgactaagacactatcccaagatgtaataactagatatctctccagacattttcaactgtcccttgcaggggggtggattttgcccccatgtgagaatcacagtcctatgtgggaaggggtgttttcatatatgttggaacatatagaataatgctaaaacatctttgtccttgacctcaatttctcccccttggcctacctttcacttgattttaaatattgtttattttgaaatgcaaattttcctatcattgttttggttataattatcaaagttcctctcatttctctccctattggcattgctgccaggattaatttcaaagaccttaccattgcagaaagcctcttcatgatctgtatctaatctatctctccaatctcattacttgctattcccacaggtaacccaagctcctcatgtacagcaaactacaattctttccttcattcttcatttctctaatttctaattggtttatgagcctcaattcaattttcttcagctcattgcctccagaaagttttggaatacattctccatgcacacctccctcagaccattattacactaaacacagtgtgatggttaattgtacatgtcaacttggctgggccacagggcccaggtatttcattctctttctgtggagaattatgcatgatacacaatgcatattttttccaagtctatttcttccctggagttcaagatgctgtgtgtatgtgtgtctatgtgtgtgtgcacatgtataattctttatcatgaggactactataatatcgcacgttacaagtgattaaaacatagtctaagagtgattgctatagtcaccctactgatctatcaaacactaggttctatttcttccacctaaatgtacatattggtacccactggattgtacattttaaaacagctagaagataatgatttgaatgttctcagtgtaaagaaacgatacatatttaaggtgatgaatttcacaactaccctgatttgatcatatgaatatgtcaaattatcacgtgtatcccaccaaatgtacaacttttttgtattaataaaaaataaattaaactaatggttgcacttcctgtttttttaaataattacagaaattatcattagtatcacctttaaaaaaatattgtcaatgtttatttaatattttcacagcaaacttatatcatgacctatctctattcccaaaagatattgggtgcttttggtaaagaaagcctcatttgtacagatcttttatggtgctacatttttttttaaacctgaacaaatcatacttactgtttggggtcaaaagtataattaaaaacatggcattctatggaatgttgaagcaaaacgggctttcctttggttaagcaatgaaacatgttaactttgatttctattccttagttagagactgatttctgtaacttggtttatgcatattattttgcatagtttaccgatcctccttcttcaagcattatctagctcttgctgttagtgtgacaggatacagtttctatacttgcagatggagtaggattgttgaatatctacatttgtgcacagaaaattgcttcactacatgcatgggtgctaggggaattatttttaactgaaacagtcatgcttatgaaaaagaaaattcagagcttttacaaatatcccacagatactgaggagactatttagtatattagcttttgttaagtgaatgaaaaccaaggatttcatggtaaaaattagaaagattattaaggattttaacctttctagagacaggatttccatgagtataaatacaggatatccaagaagttttacacatgtatgcagcctttctgattttgttataaatgagggacacaaaaaaactcctttgataatgcaaaaaagctttgattatctctccagcatgatgtactaaactaatacaagtattatttagcgagcacttattatatgctgggcaatgtgttaagtcctttaatctaactaaatcctatcaacatatttatgtagcattattattctttgttcacatatttggaatttgagattccacatgactgaatgactgtaaaagatcactctgctagtaagcagacacaatagagttcccacgctgattttcctgtattcagagttttttgcaccctatactgtctttcacaagttagcatttattgagtgactactaggtgcaggccactttgctgagtgctttacgcacattgcttcatgcatcctcacgatagctctgagacacagacattatttttccacttttacatataaagagaaagccacacagctaggctgaccaaaggaaccagagtcagttagagatgagtgttatccccaaatcatcacgctttgtactatatctatacttcctatcattaagggagcaatagattctctagtttgtgattaaatagctctacaacaattttctcaatcaattacgctcacatccattaagtcaaatgaaaaaattaacatgtggtcaataagacattcatggagatagcaaaatatgttcttaatgtgacaaaaatccaactgctaagctacacagttaaaatcaattaatattataatttaattatattcgtagaaaacaacgtagaaataaaacattttaagtgtaattttattcaagtttaattaatgtgagaggcaataaaaatctttctatgtctaaacgattgaagcatgccataccttactaagctgttagtactgtcaggatcttgtgccaaaactgtaccaacgacggtcccaatcttggcattttcgtagacttccatgaggtaggaaggcatggaaaatagtggtggttcatctacatccccaacaatgatcttcagcatagtagcatctttaaaaggacccaagtgagaaaagcgaaaatcaagatgtgtatttgctccttctatgttgagggtatatgacttctttttctcatagttcagtggctgtggggaaaaaaaataagattatgacttttataaaaaaagtcatattatgactttcattacttttcaaatatgcattattttttcctttttagaataaaataattgagagagagataagtcattctagctttgttctaaaacgaactatgaagattattttaataataacatctaaggcataaatggaacctcagcattttgtatttagtgcaataatatgtatttggtgttatggacatcaataggaggaatacaaactccgattcaggaatgtgtgaggactgctaggtaatgttttcaagaggaagtgctttttcagataagaactaaacatttggaaagtgtttagcatgattgatataaaaggctgtgtgaaactaagatgaacggatgtagttttaaaagttaaaagctcccatggtgaggtgagtgaaggtgattcggagaccagtcttccattttaaactggatgaagtatccactgatgctggtcttcctgttaaagatctgtgagaaacagcagaatagagaattttcatttctatttatgccactgattttgtacaagcctgcttcaatctcaaagtgtctttttttggcaggaacagaatggtcattccctgcagagaaattgaggcattgtcctttacattaagggtcaatatcatagtcaattcaggttgctataacagaataccatacactgggtggcttaagccaacatcaacgttcctttcagagctggtgtctggtaggcatcctctttctggtttacagacggcctcttacttgctgtatcctcacacaacagagaaaccatctctcccttgtctcttcttataaagacacaaatcccattcatgaaggtttcgctctaattacctaattatgtaccaaagacctcacctccaaataccatcatatcacactggggattagatttcaacatatgaattttgagggaagaaacatcccttcagttcatagcaaccaagcaaaagctaactagaaagaggatccttatcaggatcctgtaaacagaatgatcagtactataatacttataataagttccccaatttttctgaattgccttggaaaattggccttcccaggggttggagattacacaaaaggcaaaatatcatttcatttccaaaccatatattaagaacctagaaaactagggtcacagggacattgatgaggataagccactacaatattttaccagtttccaaaaaaatatgtatctttatatcttaaaaaattcaaattatcagaagttgatcatatatacaatacacatgcatttatatatgacacaaacattatgaatttcagattatatatttttcaaggagttgcttctgaagtttatgacctatcacactagaaataaattgccaaaataactaatacctatcttgtttgaggagttgcatactcttttttttttttgagacggagtctctctctgtcacccaggctggagtgcagtggtgagatctcggctcactgcaagctccgtctcccgggttcaagccattctcctgcctcagcctcccgagtagctggaactacaggcgcctgccgccacgcccggctaattttttgtatttttagtagagacgcggtttcaccgtgttagccaggatggtctcgatctcctgacctcgtgatccacccacctaggcctcccaaagtgctgggattgcaggcgtaagccaccatgcccggccgaggagttgcatactcttaattggatccacacattaaactttttctttccttgaatccttcctcctttacattaacaagtgagaatttgcctatgactaatttatcaataagccccatcaaaatttaaataactcgtcctagaaatggtacatacttgctgcctatcagcaactgggtggacaaaaatggtccctcttggcttataagagctggacagtcagaatcgtgcatcctgctcatggaaatacgaatacctggaaagtttactgttagttttagatcaatgtctataatttttggagttaacttgctgcatgtggaaggcttgatgatgtctaaggttcttctcactgaatatgggtatttaagaccttagaactaaaaatcagagttacatacttttctaggaatgcttaacatttctttctcacaataacactggattttaaaacaatcacctccacttatttattatttttggctttcacatcttttggacttttcaatgaaatttgtggagggatttgggccacctcccgtcctatctgatattattatcaagctctgcatccaagatgacacacatctcttgttccatttcttagcaggtcccctggcaagttagatgccatttgcctcaatactaacctacctactgctacggtgcaggctgtttctgtggacatatggtttcaggttgacgatcatctaatatatattttactactccagggtgggggtaaacattttgagggacttctttgccagaactgacggatggatggaaaccatgtggagccatgaaaaaaatgagtagattattttaggttgggacaggaatttagaagcagttgaattaacgcaactggaaatattttaacaacctcatttgtgaagaaaagctggtgaggctgaattgccggtacagggaaactgtgagaaaattatactcatttatttatgcctggatattttagagttatatatataatagaaattattgtattatttggttttacccaaaaaaaatggtatttatagtattagtattatagtgattatttttctattactgtaactctgggaaaactactcaagtacccatcttccacaccttttaaatagttgagtaaactattaaagttgtcttccacgctttcttagttaaaaaaaaaaatcccaggtgaggcacggtgcctcatgcttgtaatcccagcactttgggaggccgaggtgggcggatcacgaggtcaggaggtcgaccatcgtggctaacacggtgacaccctgtctttactaaaaatacaaaaattagccgggtgtggttgtgcacgcctgtagtcccagctactcgggaggctgaggcaggagaatcgcttgaacccaggaggtggaggttgcagtgagccgagatcatgccaccgcactccagcctgggtgacagagtcagacaaaaaacaaaacaaaacaaaacaaaaaacaaaccatatcactgatgctcatacttaatgagtgctattttcagtgttgccaaattcaatcatttaaactactggatgcccagttacatttaaatttaggataaactgtagggtttttagtatattaattgtcatttatcacaagaaacatagttgtagaaaaatttattggttatttaaaattagaatgtaattagatgtcctgtactttatttgacaatgctaattagcatgcattcatattccaacattcaccatggtgatgatggtggttggtatcaaactcacttggtagggaagagagaaactaccagcaagtataacatgggtatgtattcacaactcctgtcctttttcaaaagttagtttaactcatatgaaattgctgatatcaaaaatgtatgatgacatatacaaaagatcatttcatatggttcagtctagcataattatttgtctatccctcaactatctgagcattcctggaatcatcccatttgcaatgtgttttgttttactggaatggtgcttagaattgtcctgtgggtgctgagaaatgaagctgcttaatgttgcttaatatttgtattggcttattattttctgttaatcctactatattcgtttcctagggatgacataacaaattgccacaaacaggttgggttgtaacaacagaaattaccttgaagttctgaagtcactaagtcagaaatgtggcagaaccacaccctctctgggaactctagacaatccattcctcacttttttcagtttttgtggctgccctagcctgccccagaagaaagatacccctacatgattggacactcaatttatattgtaattcaaccacttgcaggatgaaactctaggtttaatgtccagaaatcataattttgcagttataggtgatgaagatttcttccaggggaaacatagaagactttgggtactttatgcaaagtacccgtaggggcagtggcaagcagagctacagactcagagaggaaagtattgagccttacaagaatcagctcaaaatggattaaagacaatgtaagacctaaaacgataaatctactagaagaagaaattgaggggaaaccttcatgacattgttctaggctgagattacttgtctataactaaaaaaaataggcaaagtaagcaaaaatagacaagtgggaatgatcaaactaaagagcttcttcatagcaaagaaatcaagtaatagaatgaagagataatacatgatttgaagaaaatatttgaaaattgtacatcggataagggccaatatccaaaataatgaaggaactcaaactactcaaaaaaaaaatacaaatcactctattcaaaaaatgggcaaatcacttaatagatatttctcaaaaaatgacatacaactgagcaacatatatatgaaaaattcctcaatatctctaaatatcagaaaagtgccaaattaaaaccacagtgaaatatcatctcatgccttttacagtggctatcatcaaaaacatgaacgataacaagtattggcaaggatgtggagaaaaggaaacacaggactgtggttttgtaaattagtacagccattttggaaaaaagtatgaaggttcctcaaaaaactgaaagtagaattcccataggatccagcaatcccctgactgggtatatagccaaaggaactgacatcagtatcccaaagacatggctgcacccttatattaattgcagcattactcacattagacaagatatggaaaaaaacaaagtattcatccacgaataaaaggattttaaaaaattgtggtgtagatacacagtggaatactatttagtctgttacttaaaaaaagattctgtcatttgtaacaacatgtgtgaacgtagagaacattatgtttagtgaaataagccaggcacagacagacaaataccatatgatcttagttacatatggaatctaaagtcaaactcatttaagtagaaagtagaatggttgttaccagaggctgggaatagagaggtgagtaggaaaaggggagacattggttaatgggtacaatgttacagttaggtaggaggaatcagttctggtgttccatatacagcacagtgactacacttaataataatgcattgtaccattcaaaatatctaaaagagagaattttaaatgttctcaccacatgtaaatgataaatatttgaagtaacagacatgtaccaatcacattgtacatcataaatatatataattattttctgtcaattaaatattaaataaaacttaggaaaaaagaaacctaatggaattttccatgctgggttttaaacatatttggaacttgtgacttttttatttcttccattttccccctgttggaatgtcagtgtttataactgttatcttatgcctctcctaccattgtattttagataaggataatttgttttctaatttcacaggtccacagatgaagattttcatgctaggattcaaactatctagagtttcacccacacctgattaagataatgagatttagattgagatgatgagtttagaaatgttgacctgatgataaacagataagattttggacttagaattgattttgtaatagattgatattttagggatgttgggatggggtaaacactactgtacacatgggaaggacatggctttcgtggagacaggctatagaggcctgacggcaaccctgcaacaaatatgaatatggcaaatcatgcaattaacttatgtagtaaactataagaagaggtgataatcctcgattatttaggtaggtgttaaatttaatgacaagggtccttataagagtggccaagggagatttggcagagaaaatgtgatgcggtcatatgaccacagaggcagagagaggagtgatgtagccatgagctgaggaacaactggagccttcagaagctggaattggtgaggaatggacaggtccttagagtttaccaaggaaagaggaagtgcagtcccaccaactcctgattccagacttctggcctccaggactgtgagacagcacactggtttctcgagttcctcagtttatggtcatttgtaagagcattcctaggaaacgaatgtaaatttgtctgctttatgtagaaacatagtagaaattttctttcttttcagtgtgttgaaagctttaaatagtattgcagttatgtgctcttccaggtttgacagaattccttagtgaattattgggtctgatatatttagggaaaattcacaagcttctcattttcttattcagaaatcagtttatgtgtgttttctgtttctttgaagttgcttttagcaaccttccctcgaaatccttcatattaaatttatttgtgtagagttaagaaaatattgttataatgttttcaagctgcttattttctatgtctttcatgtatcttaataagattagtttaggttttttttttaaactttccttccaaaaaatcaggtttgaatatatatttttgtttactattctttattccttttcttattttattctccattattagttacatatttaattcatctaatattattctttttagtcgatgtctttgatatgtttagaattacaagtatactttcagaagcacttaatttgtatcccataatttccatatatgttctttctcattatagtttttttcctagaaattctgcaatttgtttgcctttttttttctgtgatttgagaattcctgaagaagaaggttgtggttgttgcagttaatacattttcagtttaaggtcattatttgttttctgatgtttttcactaacttttagttgtatttggaaaggagcattttatttgtactattttaactttgagtcctttaatgagatagtcttgaagactaatacgtaatatttagtcagttttactaaatattctataggcgcttgaattaaatgatatagccccagaatgcagagaatgatttattaaatctatcaacctccttattaattacattatttgattattcatattttaaaatactttatctatcacagactgaaatttgtgagctataaccctctacaattctgtttatagacatatttctttgtatatattgtgatttcttctttgtgaatgttggtcaataacatgcaacagagatacatactcacagtgaatggctcactttaggattgtaaagtgtttttctgttccttctttttatgatttcagtttggatcccatcactgtgggtgctgaaatcatatctcttactttcctttttatgtatgtggatttttattatgatcttatttttttttgttttagatacatctggtttccttgagtgaagttctatttttgtttattttttttctagtgaccacctccattcttataagtttagataatattgtgttatcaccatacaataaacagcaattaaaataaaatagactgtttccatcttctcccatttcacttaaatatttgtaacttttaatttttgtttacttttgtactcttagtaatgcttatagatctaatatttgacttattagctcggacttatattttttcattcttagttattactaataaattttttttaaacttacaatcctatgttcttaggaaaagaggtattgtttctacagtttttaaggcacatgtttacattctgataaactactctgatcctgatgttaatcacagtcagtgttcctgcctgtcattacccattagtacccacaagtatttcttggtaagatacattacttcccaataaaatatccttcaatccaccccccccaaagaaatataattatttattgtttctaaatacagaattttacattgatcccaattaaaggtgctaactaatatttaggtagattattccaactggtcagaagtttttttagtttcattttatttttaatgacacaataattatacatatttacggggtatgggataaaatgtaaactattgacatatgcatacaacgtgtaataatcaaactaaggtaattagcatattgtaatgttcaaagttttttggttataatttccatacttgaaggacaatatgggtggatataaatcctttggctgaatttattttcttgagtatccaaagtccacacatgtttaaaaataatttcccatgcaaatatttcactgaccccttcccatctttgaaaagttggttctttttaatttctaaactcataacaattaaggcaaacctatatcattaacagttggtatgggctgacatcttgtattataacaatatatcatgtctacccagttttccctaagagaaaaaatattatctaattcatttcatagtcatgtatctaaaataattcctagcacatggaatttgattaatagctctttctccatctcaaatacagctgttttcagagtacagaaaggtgctattacatggtttagatttgatggataaaaaatttaatattatttttgaaatataatacttaacaccgacctatgccctaaacaattaacatatattaatttatttaaccttcacaacacctgtgtgagatataattgttcccatctacaaatgaggaaactaaggcataggacagttaagaaactccttatggacaacagtctgtaagtgatgtacttgggatttaaactcaggcagaggaagtgtataagctgtgtccttaagcactatgttatcctggtggaaatctaaatagcaaataagtagtgtaatataatatttcattttgatgataaagataaacaatttttttagtggaatataataaattcaccattaaaagataccttcatcatcatcttttcaagtatttattattaagttaaaaatgagctgatacattcactaagcttaactactagaactctgagtacttttgtaatttctttaattctcagatgcataagctaagaaactaaaatgctattgataaaattgtttatcttctcagcccttgctagaagtgtttattctggcataattttttacttccccaggcaattgggcttctcttacttttctttagctactgctctatatcctaatttaacagcttactgtcaatgagttgacactgattttcattttaaattttagtttcttaatttcatcctataactcctaattacttttacatatcattgctctttctaacttgtaaagtagtactttctcctctaatattaatccatttcatattactatagttagttatcattttcccatcaatcgtttcccagccagatttacatattcaggactttttaattgtttctcattaatcacttctattattccttaaatcaccctattatattcttctctggaactatataaccattataaatacaaggatattgaaaatgctgtttagccaagttgccgtatgagtcaattattcttagagtttagagaggttctaaaattctattctcctaactaataagagaagagactcttcatgacctcttctttgtctgattcctatgcttcaccagcatccagattttagttccaagattgggtagatagggtcgatatcaacattttcatacataaaattgtcatcttaatcattaaataaaatggcctagaccaggaatagtgactgacatcattattaattttttgttttctggaaaagtatttaacttatattatggtattttgtcaaaacacaggaaaattgtatgaatttaagcagcgtttctccagctaggcttttgtattataatatgctttgtggcccttgtcagaggtctggcctggatgatggacagtctgtggaaaccggagtatatgcataagctttctcatcatatatttctctatacagaagaaagtaattcttattcattgtgtataattctaaggacactgatacaaataaatattacatgtttgctttctgtcatttgaacactggacaaataagtgcaaagatctttcatttcaaatagcttaagtatacattatattatacagaaagtatgcttattattatttatatataattatacacaagctcatatgtgtgtatatgtatatctatgtgttttgtgcatatgtgtgcacgtgtatgtgtatatatgacataaataaaataattaaaaatacccaatacatacacaaacttaccaacagcccatgcatatatatagcttaattcatcaagatgtttcgtcagatcattagtttccaaatactgcataaactgtattttaggaatatatgtgtcaaaacaatcaattagctttcaatgaagtttcaaacgatttattactccaggctcatcattatgcctatagatgaacagcatgaaaaataatttacccaatagcgtttccgtgtcaaagtcatccaaaatatagtaatagatattactgaattgaaacttggaattcctctatcagctgtggctgaaaagaataacttttcagactttagaaccttataagaatataaaacagaaacttagttgagttttttttgataatgaaattcctaaggaatgttcatattttgtaagcagtccattagaattagaaatctactgtttcttatttatagtttgtgatcatgtgtttgcctgtgtgtgattattcacaatgggttgggatgacttatttattactctttgtggttcaaagtctaaaaatgttaaaatctgttagtaaacaacattcgatccttattgtgttactaaatgcaagtcaaaggaatgacaatgtaatcctcaataaacacaatccactaaaagaccagaaatatagtatgtagaataaatctagtatggttgtagcggaacatatttcatgtttttatcttataatttacttaaactttaaaaaacaaatttataactttcagtgtttactcttaagacccatctcaaatcatgtgttaaataaaagggtttgataatattttacccatggtggggtatggaaatcttaaaaatacacagtacttggttatgaaagtgttttatgtctcctataggcagggatacacttgtagtacacatagatacacactcaggaaaattatcagtacattcacagtaaattaatttttgaaaagtcttatcctatcagaagctacaactttaagaggaaaataaaactgataggttttccacattcagaagttatagaaatgcatattttgataagtgaaaccaaaaagataatccaaaagatatttatgactgaaatgtacctgaacatgttgtactacaaatacgatatttaacgtaaacttaaaaaaagtcttctcttgaagaagcaggaagaggaagttgattgccaagaaacatgaagacagtatatacattgtgttgtaatatacacacggtatttcattcttagtttgcttccagttaaatcaaataacgtgaaataaagatggcagcaaaatcaaaatcatcacatggattggtctggaggtataattaaaaactggtgcaaaaataggaagaaaagaaggcaaggaaaaagaagtattgaggtagtattagatagtagttattattgaggtagtagtaattattagacagacatagcttagagcacaattttcacctcgtttcatgttttccataatcaccctgtaaagtgcttaaacaagaaaactgacacttcaaagagttgagataatgtcatagatctcctaaatgacaagatcaagatttatatttcattttacagtaaggttatatcttcaagcatcctttgttgactcgaaggacaagtttaaaattttttggcttaagttaatttgcattgtatttacagttgaattagttagaagggaatgacaacacaacagtatttgctgaaaatcagaaggccaaatagaatcagaaacctaaagaaaacataatatttggatccacttctgtaaagtgtgcaaataggagccatataagaagagactttgagaaaggctgctaaggagaagcacatctctagctacaagaggtttatgtcagaggaaagagagtacatccaattgcattcatccttatcttttttcccctttccacccagccaggcttcattaaacaatgaatgaaagttatcaaagtgtatttacaatgtaccacaccatgcaccagtgaattcaacttggcaattttctgatgaaggaatgatacagacaggaacgttgcagacagtcctgctggcggatttatagagcagtgctgatttctatctgtgaggagattagctgttctgcccagctggctaaagtgaactgccttagagattaaataaggaataggtttttaagaactgttttatcttttttctgccatctcaatgagtatctcttgaaggttaaaatccactcaggtatacaggtttttgaaattgcaattatttatgccctaaagcatacagcaattaaataactctgagattgataatcctaatcagaagtatcaaaaaattacgtgaatgcaacatgtacatacctcagaggaaatctagactacattaaaaaatatgttcaagggaggccagatgcagtggctcacacctgtaatcccagcagtttgggaggcggaagctggcagatcgtttgggctcaggagttagagaccagccagggcaacatggtgaggccccgtttctactaaaaatacaaaaaaaaaaaaaaaaaaagaaaaaaagaaaaagaaaaagaaaaaagaaaaaatagccaggcttggtggtgctcacctgtggtcccagctaccagggagactgaagtggaaaaatcacttgggcactagggaccgaggcggcagtgagtcaagatcgcaccactgcactccagcctgggtgacagagcaagactctatctccaaaaaaaaaaaattcaaggaaaaaagtgaaagacaatttgaacttattaaatgtcaagaatatttttagtacatcatcacttaccatttacagaattgaaacgattctgatcttgaaaatatgcattgtgtgtatatgcaccaaatagaatgaaccattaatattaaattaattaaatatgtgcacacacattaacatatataattttacctttgtttttcagacctctaattaattgtagccatgtaaggtggtgagatatgtgcaccgtccttaattctacaactgatagtcatacttcagattacgtgtgtaatcaaaccatccactgccactttcactttttgtcaatatgaagttgttttccattttataaaaacaataggacttaatacacaggaacgccaccactgcacccatacacatcctcactacatcattgcaaacttacccgcagtcatttgcttctatcttctgtcctatggtaacctcagagatggaggcatactatcttaggttgtttccttgcacttgtgattcaggattcttttgaggttcatctccacccataatgaatctttttaaattacttatcctctcttcagtatccctagactacatcagtatccttgatgtcttgtctgtattgagctttttgtccctgtgcatagaaacactcttgtctcccaacttaaaattaaaacatttatttcattgtgttcttggtttatttgctttataatctttctccaccacgtaggtactaaccttctccaagaagacagtgtttttctatttttttcctcccatatttttgcttcccattctctctccacctcatcacaattagtttctctctccattgtagcaaagaataatcacatatcttccatctgaatatataacatgagtaagtgttcagactctgatgacagacaccccaattcagttttctgtcaactttctgcttgggcactatttttatcgcgttgtgattcagtttctttagctataaagcggggataataacactctctttcccaaaatgtcacagtaagaattaaaaggacaattatgggtatattaattcaataaagacattgcaatgtgcttaaaatctgtcttgatacagaggaaatactctaacaaatattagttgctgctactatttttttcttcttaaaggcattttattttatttttttattttcaacttttattttaagttcagtggcacatgtgcaggatatgcaggtttgttacataggtaaacatgtgccatggtggtctgccgcacagattaacccatcacctaggtattaagcccagcatcccttagctatacttcctgaccctctcccttctcccaccccctactcctataggcccgtgtgtgttgttaaccctatgtgtccatgtattctcatcatttagctcccacttataagtcagagcacgtcgtatttggttttctgttcccgcattagtttgcctaaataatggccttcaactctgtctatgtccctacaaaggacacgaatgtagttcctttttattgctgcatagtattgcgtggtgtatatgcaccacattatctttacctagtctatcattgatgaacatttaggttgattccatgtctttactattgtgaatagtcctgcaataaacatagacatgcatgtgtctttataacagaatgaatgatattcctttgggtatatacccagtaatgggattgctggatcaaatggtagttctgcctctaggtctttgaggaattgccacactgtcttccagaacggttgaactaatttacacttctaccagcagtgtaaaagtgttcctttttctccacaacctcgttagcatctgttgtatttgactttttaataaaagccattctgactggtgtgagatggtatcacattgtggtttagatttgcatttctctaatgatcagtgatgttgagctttttttcatatgtttgttgactgcataaatgtcttcttttgggaagtgtctgtctgttcatgtcctttgcccactttttaatgaggttttttttttcttgcaaatacatttaagatacttatagatgctggatattagagctttgtcagatgcatagattacaaaaatcttctcccattctgtatgttgtctgtttaacctgttgatagtttcttttactgtgaagaagctatttagtttaattattagattggtacaaaagtaattgtgattttgcaactaaaataaatgccaaaacctgcaattacttttgcatcaacctaacagaacttctttgtcagttttagcttttgttgcaattgctttagggctcttcgtcatgatatctttgcctgtgcctatgtcctgaaaggtaatacgtaggtttttcttctaggatttttatagttttgggttttacatttaagtctttaatgcatgttgaattgatttttgtatgtagtataaggaagggtgtcagtttcaattttctgcatatggttagccagttgtcccagcacaatttattaaatagggaatcctttctccattgcttgtttttgtcaggtttgtcaaagatcagatagtggtaagtatgcagtcttatgtgtgggttttgtattgttttccattggtctgtgtgtcttttttttttgtaccagtaccatgttgttttggttactgtagcactgtagtatagtttgaagtcagatagcataatgcctccagatttctttttgcttaggattgccttggctcttcaggttttttggtttcatataaattttaaatcatttttttctaattctctgaagaatgttaatgatagtttcatggaaatagcactgaatctattgattgctttgggcagtatggccaatttcacgatattgattcttcctatccatgagcatggaatttttttcgtttgtttctgtcatctctgatttctttgagcagtggtttgtagttcttcttgaataggtcctttgcttcccttgttaaccatatcgctaggtattttactctttttgtggtgattgtgaatgagagttcattcatgatttgttttaggcttgcctattgttggtgtataggaatgctggtgatttttgcatattgatgttgtatcctgagactttgctgaagttgcttatcagcttaagtagcttttgggctcagatgaggaagtttccgagatatagggttatgtcatctgcaaagaaaatttgatttcctctcttcctatctgaataccctttattttttttctcttgcctgattgccctggccagaagctttataagcgaaggagaaataaaatcctttccagacaaataaatgctgagggaattcattaccaccatatctgccttacaagagcttctgaaggaagtattaaatatggaaagaaaaacttgttatcggcctaaaaaacacactgaaatacacagaccagtgactctatgaagcaaccatataaacaactgtgcaaaataaccagctagcatcataatgactggatcaaatccactcataacaatactaacattaaatgtaaataggctaaaccccccaataaaaagacacagagtggcaagctggagaaagagccaagagccattggtatgctgttttcaaaagacccatctcacgtgcaaagacacttatgggctcataaagggatgaagaaaaatttaccaagcaaatggaaaacaggaaaaagcaggggttgcaatcctagtttctgacagaacagactttaagccaaaaaagatcgaaaaagacaaaaaaagagcattacataatggtaaagggttcaattcaacaagaagtaactacactaaatgtatatggactcaatacaggagtacccagattcatacagcaagctcttagaaaccttcaaagagacttagactcccacacaataatagtgggagactttaaaacctcactgacattatgagacagatcatcaagacagaaaagtaataaagatatttaggacctgaactcagctctggctctagaagatatctatttagtagattctgatagttatctatagaactctccaccccaaaacaacagaatatacattctcctcgttgccacatgacacttactctaaagttgatcaaatacaacctgctaatgataatcacccagtcaatcctgtacttcctttagccgaatccaatcaatgtttataatccaaaattgttttaaatttctagaacagttcactttttgatgactagctacctcctgaacagcgtcccttgggaatattcaatgccaacattctctcctattatttgaagatttcctccaagattatatttcctccgttttcatgcttgtttcttaaacaatcagttgtcagattaatcttttagaaaaaattaatccagtttacctgaattattttgagtaaagaagtcacccataaaatgaaaagcaggcaatcctcttctcacctttgtatccacatcctcatccattaattactctaatatttattgaatgccaactctgtgtcagaaaaaaatgctagatgttgggaatgcagtgataagttaacacacagccttggcatcatgttgcttaattcagcaatcagaaatcttgacatcaaattagacctagtcacttttttcttacatctcttcaatggctttccatttggcaaaattcagcaaggccttgtgtgctcttgtgcccactgactgcattcctcattccctctactctggattcagccacattattttgatcccttaaatgtgccatgtttcactcacctcaggcacttggtacattttctgtcttcctgaaatagtcatccttacagtctatatctaatttactcctaggcttctttcaattctctctttaactattgctgaataccagaaaggattaaatattctagatttttcccctgtagcactatataactcttcttcatagtaaacatattattgatctaggaatttatgtgatatttgattaatgtctgtccacgtccatagattagaagctgtgtgcatgtaggggctgagtctgcctttgctccagacttatccttcttattctttgcatagctcatgtggaacatagcaactgacacattgaaggaactcaaaataaatacatttgttaaataaatatgcaaattgtctcttttcattatccccttgacctaggtttgacaatttgagaaaaaaaatttacaatgagaaaatactttaggtgaagacattgatattttatatgtaccagtggtgattattgttctctaagtgtttaaaaccaagttattcttagaacttccccatggtagtattcaacagacaagttaattttcaattttaaatcaatataaaattataattactagaagaagaattaatgagatttcatacaatccaaatagaaaagtatatgtatacaagtagctagacagatggatagatagatagatagatagatagacagacagacagatagatagatagatagacaacaggctcacatcaacatctacagtaggcacattagaataaaatatctcagcctgttatctaaatagttctactgtagaatcacctggagtacattttaaaatggcaaatatctcagcccccttcgtcatcctctctggctataacagaatcaccacagctttattaggatgatgctttgattctttgcacttcactgaaattacttttatttaattcttgactattaacattgggacatttcaggaagattagagcagagacaaaatgaacaaagatggagagaaacattgttagtgtagtctacatcagatcttcccaccgcagcaaaacatattttctgaagaaaagatctaaacagttgacaaacaacaattaaaatgtaattatatcgcaaagtgacaatattttatcattttaatggcctgacagcgtggattattcatgcctctgccaaatttccattcaggaaaagatgagtgagttgcctgaatcacaaaaagtatgttctttttaccttctttaaagaaaggattccttctctggtctctttgtcagtggagattgagaatattcccatgccatcaccatttatgatggagtaggtcatgtcagcatttgagccagtgtcagcatcatttgccttgattttcccaacagctgaaccaacttgagctgactcaggaacatatagctgatagtgttctggaagacatttcatattaaacatatttaaatacaatgttcatgaaataatcttacaagaaaaaataaatatttagagcacatattcaaatgaagactatattaggtaatgcatcaaatggacttttttagattttaaaagtagactattttgtaattaaatactagatttatataaactttaaaaggtacgtaaaatactttgcatgaaaataatttctatatttgaatatgaaatattttattagctctaaacccttaagctacagacaattagaagagaggtaaagttttcattctgattttgaaccaaaactgaattagtcaagtattagtgtaatcccaatttattcttccacccatcgtaaatgtgaagttcaaatataaaaatgtggaaacaaaaagtatggaaatatggaattcaacagaaaaacaagataaaatgccatagcctgtttgtgaatatagataattatttttatcaagaatagtgagatatacagtcatgtccgagaacgtgaatgtagttacatatttctttagcataaattccctatcagcttctaaaaaggatttgaggtggcttcataataaagttttaaataacaaagttattaaaatttttaaaaatcgattacagagttgaagcatgagaaagtaaatagctatagaaaattaaacagcatttgtgaattagcattaattttgacacctaatattttgggtgaagacagtgatattttatatacacaagtggtgattattgttctctaagtgttaaaaccaatttattcttagaactcccctatgatagtattcaacagacaagttaatattcaattttaaatcaatatacaattgtaattactagaagaagaattaatgagatttcacacaatccaaatagaaaagtatatgtacacaagtagctcattagacagatggatagatagacagatagatagattagatagatagctaacaattttaaagcactgttaattttatactctcattgtctaataggtacaaagatcatttttccaaagtttgtcctgatattaaatgtcgaatggaaccgtttctatagtgcttatattaagaagcataatgaacatgtttttaataattattttattgacaagttaaaaaagcttattagagcaatttattatagaaaattcaaaacattataaataacagaagcccaggaatcttgaattaaaatgtaatttgataaaataatttctaccaagattaaattaatagtgattcaatgctatacaaggacatagactatatagataagtgaatgcacaatctctagaaaaataatttcagtgagacaatcatttgtcattagtgatatgatactgaaaacaaaagtctaatctagtgaatgttgaaaatatcattttttattattgtgataagaacacttaatatgagatccatccgataaacaaatttctacacaacacagccttgctattcatagacacagtatttttcagcagatctctaggacttattcattttgcataatgacaattttatatttgttgattagcaactcctcactcaccttccctagtccctggtaacaaccactccattctttgattgtatgaattttactattttagatacctcatctgcttgaaatatgcagtactatatttgcccttcagtgactggttgatttaattcagtctactgtcctcagtagtcatccatgttgttgcgtattgcaagatctctttttttaaggctaaatactattccattgtttgataaaccacatttttctctacattctctgtctatggacatttagattgtttccatgtcttagctattgtgaataatgctgcaataaacataggaatgctaatatttatttgtaatcctgatttcgattttttaaataaatactcagaagtgtggtcattaggtcatatagtaattttacttttaatttttgaggaatctttatactatattctgtagacgctacacaagttcacatttctaccaacagtttgcaagggttcaaatgtcttcacatcctcaacaatacttttctgtcattggcttttttcataaatagccatcctgagaggtatgaggtgttatcatactgtagttttgatttgcatttccatgatgactggtgacattgagcatctttatacgtacctattgtccatttgtatgtgttctttagagaaacagctattcaggtcctaggcccattttttaatcaggttattgatcatttttttccttccttcttctccttctccctctcctcctccctttctttcccacttctgtctccccctccccttctacttcacccactccccctcccgttcttcctcctccttctcctccttcacccactccccctccccttctacctccttcttcctcctccttctcttcctcttcctcctcctccttcttcttcttcttcttcttcttcttcttcttcttcttcttcttcttcttctttccttttattattgagttgtaggagttttattttggaaataagccttttagcagacagggcttgcaaatatttcattccacttcacaggctgcttttcactctgtagattgtttcctttgttgtgttaaaaatttacaacttgatatagtcccatttgtctgtttttgttattattgcctgggatttgcaggtcatatcagattaatcattatcaagactaacgtcataaagctttacccctatttttttcttttaagagttgtgcagtttcagattttatgtttaacttgttaatccagtttgaattagtgtttgtgtatgatatacaaaaagaagccattttcattcttctgtatatagataatgagttttcaatgcatttttttgtttgtttgttttgttttgttttgttttttgacacggaatctcactctggctggagtggaatggtgcatcttggctcactgcaagctctgcctcctggcttcacaggattcttctgcctcaacctcctgagtagctgtgattacaggcccgcaccaccacacacagctaattttttgtatttttagtagagacagggtttcactatgttggccagactggtcttgaactcctgacctcgtgatccacctgtctctgccttccaaagtgctgggattacaggcatgagccacttcgcccggcctgtttttaaagagactatccttttctcattgtgtattcttagcaaccttgttgaagatgattttactacctgtgtctggatttatttagaggctctactctgttccactggcctacatatctgtctgtatgccattaccatactattttaattactgcagcattttaaaatattttgaaatcagcaagtgtgttgcctccagctttgttcttctttttcaacattgttttgcttcttcagggcctttgtctttccacatatattttagaattgttctttgctctccctgtaaaaaaatgtcatttggattttgatagggattttactgtacttgtagagttaaaatgtagtatagacattttatgagagtgcaactgataacattatatacataaaagcttaatgcttttccaataagatcaggaacaaagcaaggatgcccactcttaccacttcttttcaaaatagtactggaagacatagccagagcaattaggcatttaaaaaaaataaaagggaactaaatcagaatgaaataagtaaaactgtccttgtttgtagataacataatattacatatataaaaaaacaggctccacaaaaaacaaaaattgttataactaataaacaaattcggtaaagttgcagacataaaatcaacaaaaaaattagttgcatctatacacactaataaaaattatttgaaaaagttagaaaaataatcccatttataatagcattgaaatgaataaaatctgtataaataaactaaggaagtgaaagtctcatgcactgaaaattataaaacatggatgaaaaatgtaaaaagacaaaaggaagtgaaggacttatacaccgtaaactagaaaacatggatgaaaaatgtaaaaagacaaataaatggaaagacattcagtgttcatggtttaaaatatttatttgaacctggtacggtggctcgagacctgttcgagactagcctgaccaacatggtgaaatcccatccctaccaaaaatacaaaaattagctgggtgtggtggcacacgcctgtaatcccagctacttgggagactgaggcaggagaatcgcttgaacctgggaggcagaggttgcagtgagccgacgttgtgccactgcactcagcctgggcgacagagcgagactccatctcaaaaataaaaaaatcatttgataaacttctaaagacaaaaatgtataattttaaatgtgcatgtatagatactaagggttgacacacgtgttcatgtatgtgtttgtgtttagtcaatgttcaacaaatatttttctcagctctctttcataagcattggagaatacacctggaataaactcacagcaaagtaagaaagacattagcttttagtctaactaaactaaatgtccgaataaattgtatgttcaaccaacatatcttttcctgtgtaaaacaccctcttcttttaaacaaacaatcccttgaccttaaccatatggttttatcaagatctaccattactaaaagatctatcttccttgattctgtgaattggcatgggaaaagcatgagacccaaatgttataggatccctccttcgttctcacagttgattggtgaagggtaggcagtttttcaaacatctccaaaaagagtatatttctcaaaaatgttgaactggaactagaaaataactttcatctctctttggtggcacagctatgaaatactaagaagaggcttttgtcaatggtcgtgtttccaaaattgatgttgaaaggccaaatttgagggcataaaatcagcatcaaagagaagccatgtgatttgcactggccttgaaaatatcatgatgttcctgaaaagtcacatctataatgggacactgttttgctcaacaaaatgtatagacatattacaaaataaattggtacaaattctctaaaatattttgagacagagactagaaggagtcaatttttttggatgctgtggtctccaaggtccaactaaaccagaattaaccactattacataagccttcaaaaacctgtcaagtagttaatactaggatggtaacactagaaaaccaaagatgtcttagttaacagagataaataaatacattatagaattactatgatgatagcgttataaagaaggttgttttcacaaagcggattgcaaaaaactgttcaaatgggtcacaaaagactcacggcccagaaaacatttaggctgggtcttaaaatatgaaacagattcctggtacaggcagattatgtttatagaaaaaaaacctgataattcttgacacattttaagaattgcaagaatagtaacttccccattcactatgtcccattaaacaaaggagtgcattaagattaatattttgtacactctccattgagttgagaattataatttgtaaattaagagtcaacttttagtagacagccttcaaggcggccacattttacccatgcatcctgctgatcatgtccttgagtaatcatttcctcttgaatgttggctagatatagtggctcacttatgatggagttcagcaaaagtaatcggacatctcttacaagactaggttacaaaaagactgtggcttctatcatgggaacactttctcactccctcttgtatcactctctggggcaagctatctgttatgtttcgttgcagcccatagagcaagtgagtgatgcctgccaaaagccatgtgagtaagctggaagcagaaaccagctccacctccactgaggtaagcctttgggcaagacctcagcccctgctgacttctacactggaatctcataagcatgaaccaaaggcactcatctaaaccatagctagattcctgacctacagaaattgtgaaataataaatattagttgttttaatatgccaattggaatgctttgcaacacaggcatagataagctatacacacttttgcagtagttgccagtgatttgctaattcaaatgcattcttttattgttcttgtcatcctggggcactgtgagttatgttgaggaaaactgaaaaccaaaataaacaaacaaacaaaacatgattctattgcacccttattgctgattatttctcctcctatgattttatactttgatatatttctaacagaaaaaaaaacaaataaaaaatgtcatgaaacacacacgtatgctgtcaaatcttaatgttttggtgtatttgcttcagttctcatttgataaagtaacatactattgaaggcataggtgatgcttctaagtgagccatttgctataatcaaattctcagctcatcttcccagaaccatgatcatccccttatataacttaaaaatattaatgtaatgtgtttccacaaatacatattcaaatagtatggttatttagattttatgtttatattcatctttttttgtattttttattcaaaatcataatttgagatgtaactaagatgtcgcatatagttctagtttgttaattagaatgtagtgtttattttaataatatgctacaagttatctaaccttatatttttctaatttagaaatagtcaaatgaattttactttacatatctccttattcacatgcaggaaaatttacttaggctacagctataaaaaaggccctctctagagttttagaacacagaccttccctggttgtatcactactttgctaatatctcagtttcattacagacttatctttcacttttttcttaaaagagagtattgtccgtaacttagtacctcatttctattccttatatacacactctagaaaggtacatttgtccctgtggtttcaacatcaacatataaacttatggctcccaaatgaatagtcacttctactatatcctgagtttctgttaaaatattcaaaggatggtcatctccaactttacgctgggcatttacaatcttgcatctttttttaaaaaaggaaattgaaactatttggaaaatttaaaatgtagaacaatgaaaaaagaataaattgtttaaagtttacaacaaaagaaggacataggaaactgaatgaaccaaatatgaaggttaaacttcatgtaacactccccatttgctgatacaaactatattgaaaacaaaacaaataaaaaataagaaatgaaaaaactaaatgataattgtatttttaaaatatcaatttgataacaaaattaaattatctcctcacttccctaaaattgtttatgtccatgaaacttacaactgttaaataattatgtttagtattaaaaattactcaagttggctgtagcaaaggacatcccacaatgaagagatgtgttatctttagtaaattccagctatttaagccacatagaaacagtaatggtaatataacttttagaatctggttgtccaacttcacagaattactaaaatttgcaaataaaatgtcaaatttgtatttataacaaagggttatttataactatgcactaatatgtgactattaatgaaaaattggaatagacaaaatagaaaaaaggcaatttgttgttttatcactaaaataatttttttaaaaatcatatgactcaattgataatgtttattgctttgtgattgtagtgatatcatatttagtattctaccataaaagataataactttaaactttcaaatataatttccatatatgtgtgtgtatatatatttacatacacaaatatatgtacacacagtgttatataatagacgcaacatattcatagatgtcctaagattatataatctaaaagacatggatcatgaatctagttgatataatgaagaaattgatgtaaacaatatctgttatataatggattatgtgtctttttataaaaattcaagtcatttaacatgtattttcaaaatgcaagaatttatttttcaagtatttactaagtaaaacagatgttatgctgctttacacgtagctctgcttttatgaatataaaaatattcatatttattatgctggcccagtacacttacagtatatattttggtcatcatatacataagtgagaaaagaacacccccagttattaatagtcatcagctctgtgacgatatttcatctgatttgtgtagcagtaaagagtgactaaaaaaacacagagccggccaggcgtggtggctcacgcctataatcccagcactttgggaggccgaggcgggcagatcacgagatcaagagatcgagaccatcctggctaacacggtgaaaccccatctctactaaaaatacaaaaaattagccgggcatggtggtggaagatgcctgtagctgaggcaggagaatggcgtgaacccgggaggcagagcttgcagtgagccgagatcgcaccactgcactccagcctgggcgacagagcgagactgtgtctcaataaaaacaagacaaaaacaaaaacaaaaccaaaacagaacctcaatagaaagaaatccaattcccataatgttctccatgttttcagggtgggagagacagtgagcactggagcacctatttagccatgcaacaggggagctctttaactgtaaaggtcactttgctatggatgaagctggaaaccatcattctcagcaaactattgcaaggacagaaaaccaaacagtgcatgttctcactcataggtgggaattaaactatgagaacacttggacacaggaagggaaacatcacacaccggggcctgtcgtgggtgggggaggggggagggatagcactaggagatatacctaatgtaaatgacgagttaatgggtgcagcaaaccaacatgcacatgtatacatatgtaacaaacctgcacgttgtgcacatctaccctagaacttaaaagtataataattaaaaataaaaataaaaataaataagcctctagagtttttcagctggtaccagcttttaatgtcttaaattaacttatatctactgagccagctgttctctataacactaaagtcgatgcttagggtcactaagggttgtctctcctcactcctctaaattaaattattttttcatactagatacctaattattttaacagtaaaatatcaataatttatacacttgaatttatttttctgtcctttttcttgaaaaaaagaaatatagttttcatgaaggtctgtccattcttggcaattattagatactttcatgaaaaaaatagaaagtacatggggagaaattttttccttgaatgaaatatctaccacactaatatgtactataggatatgtagtattttaatgccttacattatttttaaggtggaatccttttcttatctggaaaaattaaatgtattggtagcacttatgatttaaatgcctaaaaaaacaaagatgggacttacattagaaaaatggcagattacaaagctccaagcctgtacacatttgaatatttcccagagtttttataagtttagctcagctagttttaagttgcttttcgatgtttccatgagggaacaagtgacttaaaactaggtgaaataaacttataaaagctcttggaaatattcaaacgtgtacagaaagcaagaaaatcctcaactaaggaaaaaataaattcaagcattaagcatctgtggtgtttcaacttgctcttgccccattcccttcccagggcaaggagatcttggtctgcaggaggttacaagccagttccaagatctgttctctctagaaaaagatcaacaaaattgattggctaagaaagagaaagaggactctcaaataattacaatcagaaataaagtagaaacactaccctgattttacagaaataaaaggattttacaaggaagtcctgcaaacaaataccaactaactggagaatgtataaataatgaatatattcttttaaatatgacttaccatgacaaaattaggaagaaatgaaaattctgaatagacatactactgataaggagagtcaataagccatcaaaaacttcccaagaaagaaaagccctgcaacagatggctgtactggtttaattctactaaccatttaaaggagaattaacacaaattctcaaaatcttgcaaaaagtaaaaaaagagggaaattacctaatttattttataagaccagcattctcctgaaaccaaaaatagacagacactaaaataatagaaaattaaaaaccaatattccttatgaatattaatacaaaaattattaacaaaatactagtaaactgatttcagcataatatcaaaggaatgtacaccatgagcaattgggattttttttcctggaatacaagcttagttcaacatatgaaaatcaattaattttcatttccattaacagaataaagaaaaaaatcacaaggtcatgtcaattctacagaaaaagcaattgacaaaattcaattccattttatgatttaaaaaaacataaaatagaactataaataaaagaaacttcctcaacataatagaagccatatgttaaaaccccacaactaatatcactaaaatggtgaaagactaaatgcatttactgtaagaccaggaacaaaagaggatgcctacttttgaacttttattcaacataatactggaaatcctagccagagtaataaggcaagaaaaagaaattaaaagcatccaaattgggaaggaagtaatacaattatctctgttcacagatgacatgatcttatacatagaaagccatagggagtacacaaatacagacacacccccacatacaaacacacacaaacttttagaactaataaagtaattcagcaaagttacaagataatgaataattgcaaaagaaaataaagcaattccgttcttaataccataaaaatgataaaatatttaggaataaatctaacaaaaaatgtgtgcactgacaatgacaaaatattgtggaaataaattaaagacataaataaatgcaaactattataagttaacactgcaaaacacacacacacacacacaatccaatcttttaaataggcaaagaactggaatagacatctctccaaaaaagataaaaaattaaaattaaaaaaaaagaagacaatgactagtgttggtgaggatgtggagaaattagaactcttgtgccctgttagtggagcagtgaaatggtatagccattgtggagaacagtatggaggcctctaaaaaaattaaacatggcagggcgtggtggctcatgcctgtaatcctagcattttgggtggccaaggcaggtggatcacctgcagtcaggagttcaagatcagcctggccaacatgataaaaccctatctctactaaaagtacaaaaaattagctgggcatggtggagggcacctgtaatcccagctaatcaggaggctgaggcagaagaatcccttgaatccaggaggcggagggtgcagtgagccaagatcgcaccattgcactccagcctggtgaagaagagcgaaactccatctcaaaaaaaaaaataaataaataaacataaaattaccatatgatctagcaattccgcttctggatatatacttaaaagcactgaaagtggggtgttacacccatattcacagccaccttactcatgatagccaaaaggtagaatcactccaaacatgcagcaacagaggaactgataaaatgcagtatacacattaaataaaatattaattatcattacaaaataagttaaaatttgatacatcttacagcctggatgaaccttgaaacattatgtttaccaaagttagccaggcacagaaagacaaatattgcatgattccacttatataaagtacctagaacagtaaaattcatagagatagaaagttgaataaccagagactcaggagagggaaaatgggaaagtacccattaaacaatgggtacaaagttttacttttgcaagacgaaaagacttctgtatttcaatagtaccattggttgcacaacaatatgaatatacgtagtgttatttaaatgcacacattagagttgttaaaaggataaatattattgtatatattttttaactacaaaaaataaaatcaaaatgagaacaactagtaattgagctgtttttcagaatagaaaaatgaagaagagacacaacaaatgctgggaatttatgatgaaaatctgaccaaaatcacaaaaagtgatattactaccaaaatatataattatcttcaaaatgctagttttgcttggattttcagtgtgtgaggcttagattttctgagatatgaggtagggcaatgtgcatttttcaattttaggcaccaaattgtttatagtatcaataaaatatatataaatatataaattataaatacataaataaaatatatataaattatgttctaactcattagaattttttttactttttaatttcttcaagtagtactagaataatttattctggttttaagactacataatttttcacagcttaggaatacagatctcactgtgtaacagctttgtatctggatgcaccatagttttgtatgccacatgtgatcttttcacataatttcttagactgcatcataatatactactgattatggaaaatacacttaaggaaggaagacatggtgggaataataaaagggcatttgtctcactgaggcttgtcccttttaatatactttcttttcctccaggacagcactgattctagttgctttttaaaagaccttgtgtctttactacagtaattttgtcatttacttgaataagtcattccctatgattaccccaaggccctatcttacaaaagctgtaataaatttaatcattacatttgttagaactatttactattttatagtatttacttgagaaagtgagatgcttctcagggaaaactgactgacatgtgagaggttagaaactatgatgtctgacttacagagtttgcctgtctttcctgataaaattaaccagacagtttttataatctccactttaaatgtttatgcaaatacagtttatgctgagaatgctaatttcaaattaaaacacacacacacacacacacacacacacacacacacacacacacacaaagtattctgagattttcctgcatttaagagacttaagctgaatattgattattaagcattgtggttggctctacgtgcaatgttttttaaaacataaataaagtaaatttaagtactactgccatttgaatgccataaataaaaagggcaattttcctctatcagaatctttactgttctaagaaatatctttaaaatcgtttaacccaatacattctgtttctatgtgtcaacatgcactataggaaagctgattattctatagaaagttttttttttctctcaagtattatagtggaacactttctttgttttctctcactcttaatcataaataacacataaatgcttgaagaaagactattagaaattttaattgaaattcagtccactttttaagtattctttgaaggtgtgcaaattgatttgtaatgcctaactataagaatcaaattatttccaagaaatatatgcttattaccataaacatacctacctaaacaaaatattatgtaaaggaaaaggaattattctgtaactttattatagtacacaaccacatagattaaaaacaaaccgtaatacaattgaaatgtcatgactagtacgtttctaaacagagagctccatataatttcaaaatattcaattctaaaatcagaagaatgtaatactattatttatttatagctgttactttgttagaaagaatatgatctacaggtgtatgtgtcttattataataaatacataataattttcaattatctttataaactaaatatcatgatgtaagataaaaatattgtgtttctatgaaggctaaatgaaaataaaataataatattactcatttaaagttaatttaataatttcatctttattttagagttcatcctttcaatttagccacatagaatacaaattgatagagaatacatctaattatcttccataatctttctatttaaacttaagtggaatgatctttcaaatctggatatgatggaggggtatatctaactctgtcatataaaacaactctaaaagatgcatagtatatagaaaatgactgttttaaggcattgaaggcaattaatgtagggaactcaggatggagtatgattcttgagagaaagaaaccataacaaaacaaattttatatgcacatatactgagggtatttaaaaatatgtagtgctggttgaaagagtccaagcaaaaattgtgtagcttttggagacaggttggagttcagagctggcacaggggctgagaaattgaggacaaaagcacagagaagaagaaacctcaggtaagtgaggaaaaaaacaaatgcaatttttcttgtggtaattgtagacacatccactactttgacacttgtagaggctctgagaaaccaacagaaagtgcatctggaaggcaaaggcgctaggcagagatttcagcagccatgagttactggagagtcagaaattggtaaacacttgagaccagtggagagtaagtaaagaaagatccggattccaggaataagagctacttcccggaagtaaggagagcaataaaataagctagtgctaacagaatccaactgatttaagtaatccacactgtatatgtctgcaagaaataacttgcccctctttgaaagattgcacaatcatgaacctctgcaactcctttatgtaatgttcaatcagtaattcaaagtcatgattaaaaatgagcattggctaaaactaagaaggaaaaaatgtaaaaaatgacccaggcatgattatgatattagaattctacaaaaagttttgaaataagtatggttaatatgtttatggttaatatgtttaaataaagaaaagggtggggaatttcaacagataccaataatctttatctactaaaccaaataaaaattttagaacaaaaatgtcaatgctgaagtgtgtacttaatatatttaatagatgggtttaattgctgaacaaacagcagaagaaaggattggtgtactagaatataggttaatataaaatatccaggttaaagaagactgtagaagactgtagaataataattattatacagcaaagacagtaatagatgaatgttatataactgaaagacctagctgacatactttgtagaactaatagaaaagaagtgagaaaatgaggtcgaagaaatacttgaaaaaattctaaccaagagtttctcaaaactaataaaagatagcttaaaaaatctttacaaccattagtcagatttttaaaaagtaaatacctaggtgcattgtaggttaaatttttgaaaacaaaatataacaaagaatatcttaatagaagaaaggtccaataaactacagtaaactattgtacagtaaaggaattctacagttgatttttcaatgaacaaaatggtaaacagcaaattatattaataattattgaaatggagaaaatccttcaaactaaaattctattctgattggaaataccttctgcaaataaaggcaaaattgtaaatttatatagaaaagctgagaaaattcattggcagttttctgtcactaaaaatgggaaaataatattttaagaaatttacaattccctttagaaaacaataattctagaaggaaacacagaaattcaaggagaaataaatagtaccaggaagggtaaattattactgtcttaaaaaataatgatttgctatttaacacaacagcaacaatgacaatttcatataggactgaatatataagatgacaaaaatagaaaaaacaacaacaaagggttaatgacattaaacagttttaaagtcattctattttcaagcaatgaaattataatttaaggtagagtgaaataaataataatatctacagtattttttaaatagaaaaaagtataaaaatgtaaaatttttaaaaagtgaatggaggacaaaatgaatgaaattaaataattcaaagaatatgagagaggggaaaaaaggagaagaaaagattagccaaatagcaaatgatatacctaaatgaaactatatcagtaattaagatacttataagtgtagtaaatcaacaaaagcaagagaaattataatgtcattttaaactaaacaacaacaaaaatattagctaagtggtcacaagaaacatttataaattaagaataaaaaattaagaacaataaagtttgaaagtacaattatagaaaacattataccacacaaaccataaccaaaaagaaatgaagaaaaaaaagaaacctctggaatagctataggagacaaattagactttaaggtatggagtattattagaactatagacatatatttcacaataaaacaattttaatcaagagaaagatatcaaagccttcgatctgtgtgcatccaatagcatggtttaaaactgcatctaagaaaaattaaacagaggaaaaaagagaaatggaaacatctagtatcatcttggaagactttaacatctctctcaataacagacgagcaaaaattctataaggatatagaaaattggaatggtacaaggaataaacttgaatgaaatttacatatgtagaatactaaacatgcagctgcagaatttatcttatttcaaagtgagtaggaacagttatcaaaatcaaatatatactgtcattttaaagaaatgctcaaaacgtttcaaaatatatgcctacaactataataaaatgacccagatatcattttcaaaagacactagaaagacctcaattctttgataattaaaaaaaatcctgcatattttgatgggtcaagggagaagctttgttttctttttcttttaatttgtttcaaacaaaattttaatgatgaaaatattatataaattcatatttgtacccataacaatgaaaataataaaaacaacagctccccccccaaaaaaaatcaatgccaatatcttcagcaatattttctttctcattaactttagaaattacccaaaccagttaaacaattgtgatgtttactaactttatgggaaatactgccatctattgaatttttagagcttgatcctccaatattacatggcactaaaccaactgcagtcacaagtgagtttacgttcttggcaatttactatcatttaagttctggagaaagttatgttagattaagctaacataatgatagcaaatttccaaaaactgaagctcacttgtggctgcagttggtgcaatgtaatattggaggatcaagccctaaaggttgattcattgtgattatttggcatgtgttatgcttctttctgttactagatgacttatcttacaagagcaatcctcaatacaacaatataattccttccatttaggatatagaaggtttgttttgtaaactttcatgtaaggtattgaattttatatgcatatggtttgtgcagaataaataaatgtcagtgactttttaacctatccaagaataagttatgcaacaaccataacccagaataaagtttttaaaaactagaataggaaatggcagaataaaatagattacctttaatgaaagaacacacactagggaattttatatctttagatggatgattttctctagaaggagaagtacacatcgtttgtgtactttgagtagaatttcaagccatagatgggctgatttgttttctttcactatgagtccttttgttttgctttgttttgtttgagtggctccttttccaacaccatgtagcccagaggtaggcatcaatttgaattaaatagtagctacccttgtagttgggcatgcattatccagtctctatgctcctttttcacattcctgatactgacaagcagcctgtttcctccaagacatttatctgacttgtatcctaagctactgagtttgtaactctctagagtagagacattgtaaagcaaattactagctctaatttactacctctctaacacttactcaaagcctatttacttcaagataaagggataactaattaccatgcaatataactagcctactcactttctcaagcatggtagattaagcatggaggaaaaaacactttgagagaatatttttgcaaaatttgtagttagggatgtttattcaagtgtcaattgtaagaaatataactgtctcagacaggtgatgagagaaagaagtagaaagggcaactgtaaaaacctcacattaagagaaacaattcaactactggatccatttgatgacaggatatgaactttatagaatttgagctgtgtatagacttgcgcatgtcatggtattttgtgaatacaagtccttatattatttcttttctccaagcagtttacaatacttccccactaggtacatagctgtttaataagctgcaatttatggataaattaaagagcactttactacaagctacttttgtcatggtgacaccaaactgttgcaaaagcagaattgttttgttcaaatggagtgcgaaataaagtatcttttaagaaaccccaagtgtaaacttctgattgtgtagtgcctccttttcaaaactctaagaacaccttgaaatgcagcaggatttacatctgtcagtcattctgccagaatgttactgactgaagaaacatagaattcattagacacaatgagttaactcagagagtatacacttattctgttttgtcaggtaaagtgattattttcactgtacactgatgcttcaacaatgacactattattgatcaacataataaaattaggaacaaatatctctttattatatatctatattcatctatatgaataatattccttatatccatcacaattaaaattttctgtacatctgcaaagtcaatcttaataaacctgtaattttaataattattttaggaagaaatggagaaaaagagagagtgggagatgctatatttactacaaactagcatttactgaatcctatgatttacaacctgagttttctgtctattaaggctacaatatgaatgtacatctttaaaatagtggtggtagaatctatttgaaaacaagataggcaagttggtatcctaaattataataaagagtatattctgttgagtctgaattatcgcttattatctttatcttcaacttcaattgtaccaatctatgaaataataacatttacctcatgtatatgcacattgttgaactaagtgataacattgatacaaaagttcatcctaatctgcaaaatggtttaaaatttaattatattttatggctcaataaaatatggacttacctatgatatatactttcttcatagagcaaacgccacatgaatgcaccaggtaacattatcttatctctggcatcaacattttaaaatgatttttatttaactatgactatgatttgcatgtatttaataataatcttttaataatgatggtttgacagagtatttaaattcaactaatttactcactaagaatcatttatcaaatgctgggccctcactgggctgaacacctaagttcgcaaaacaattaagcgtcttcctagaggatctcataagtggaaggggatctatgtacctgcagaaattagtataacatgaacaagcacgcaaaagtgctgtgcaaggggatctatgtacctgcagaaattagtataacatgaacaagcatgcaaaagtgctgtgcaagagggaaaattagtataacacgaacaagcatgcaaaagtgctgtgcaagagggaaaaaagagtgagtaattctgcaacaggaattaattgcaaaactgttctaattctgcaacaggaacttcagagaaacttgtagcagggattttaacaaagggccgtgaataaggaaaaattttagttgaagtaaggacgtacaaagtgttattatattttaggaggaggcagtattccacagtgtctaggcctgaggtgtactgcaaatgctattaagagacaagagataaagttgagaaaggcatttcgcgctgatttgagaagagcctgtatgacgtaccaaaggatctaatttatgacagtttttagacatcatttgtaagaggaacataagagacaactcctctgtaggatatttgtgattattagtgactgtcgtataaaatgttatctatagtatcttccatttttaaaaactcaaatatattataattatatcctttacattcagaacatgtcataaacaccatctccctccaaacccacaggattcatatttctcctctccccccaaaattgcctactgaattatgctttctgttttcaagtcttatattttactctgagacctcatcttatcatattaacttcaacttgcttttggatgatgcgtgtgtgtgtgtgtgtgtgtgtgtgtgtgtgtgtgtgcatacatgcatgcatttgtatacagcatttattcataacatgaagaatttttttaaaaaattcagtcacagaatgtatggaataatgttgcatgaaaagaatgttcacatcaaaataccttttcaacatctccatgaatactttaagaatatacagatacttcgccaaaggcaagatgccattttttagtaccaccacatcatttttaatatttaacttgatgccaaatgaaactccaactctgaacacattcccaattatttcctaggttcagaagacaatagctggagtgatttcatgagtcttacatgaagaagggtgatcatatagtacaaaaacagaacaattccacttaagaaaacagtaacataacactgttcaagtatttcattttactttacataaagagataatgataaattcaaatcatggaaaacaaatacgtactttgaggaaagcgtggtgggttgtcattgacatcggttaaggtgatgttgactgttgtagatcctgaaagccctccaacttgcccagccatgtctttggcttgaatgactacggagtaatgttctctggcttctctgtccatgttatgtaaggccgttctaataactcctgtaatagatatattttaataaacagtatgagctatataataagcaagtatcaacaaacatacacatacatattttaagaaatgtcttttaaaatagcatatttttgggataaagtcacacgtctgagaaaaacaatatcttaccaatgcatgaatactgtctctttgaaaaatttacttatcccatgccccaaacatcctattaagtaaattaagatgtctatctctctgcattccttaaagtagatggtccctcggccggatgcggtggctcacgcctgtaatcccagcactttgggaggccaaggcgggtggatcacaaggtcaggagtttgagaccagcttgaccagtatggtgaaaccccgtctctactaaaaattaaaaaaaaaaaaattggctgggcgtggtggcgcatgcctgtaatcccagctactcatgaggctaggcaggagaatcgcttgaacccagaagacggaggttgcagtgagcggagatcacgccactgcactccagcctgggcgacagagtgagactccaactaaaaaaataataataataataagtacatggtccctcaagggtagtcctgccaccctattcctagtgctagtgtgctgaacattttacaatttgagctcctcagaagtttcaactaaggtggtcatattgatttaagcagaggctaattttcatctttatagaacaatttacatagcttcctggcagagttatcaatgtttaatgatggaaaacatttgaggagtttggacacttaaacagagattataggcaggaggcatattaacacgtatcaaagactaagaaactcactatttttgttagaaaacaactttaaggagaactagatctaagtatttaggcaaaataaagaaactgataaggtttattctataaatcatctgtaaaaaatcacattttttatcttagtagtgcaaagagggacgtttaacatttttgcatgatgaacccttggattgaataaagaaatgaaaaatattaaatacccatctgtgattacgcatacataaacacccacctctacatacataaatttaatagctctgttaatagagtcttacgttttaaagttaaaaacgcatattctggaggataaagtttactcagggtatattaactatgccataacatagaatattgtcctcatgtccatgagatagattataaacatgtgtataaatatctgtatatctatgtgtatatatgtatttatatgtccatctatatatgcatataattataaaatataaacatatttgatccttcaaacataagtcattttttcataaatgtattttcattaaaaatatttgaagcatgtcatctttaataaatacaccaatgactttcaatcaaactcgcacttgattagttacagtacaattcttaagaagttgtcaattataactgttacctataggctttaccaaatacttttacagacaatatcttaatttatgagaaggagttatatatttatgttaaaaatagcctttaaaagcagaaaggagtattcaatgacttgttttgtcatattttgaatataaaaaagtaaatcactattttcttttttttctgaattgattggctaagtaataatgactttgagaggagagcctcaggtatcagaaaagaagatcccataactttcacatattgtgaacatataattgagggaattcagaaaaattttcctgaagctaaatagaaatgaaaattattcttatcaaaataaattataataatattataataaatgattcatctaactcatgcatatgaaaaagcctcaagcacccttattaaaaaaacaatgttttatcttacgataattacattagtaggaattgaattgatacagaaatgaacaagcaaagaacttatgaaagaaatttatattttctaccacttgaaaaaagtaaagctgtctttcctaaggagaattaattataaataggacttgtctttggtggggagaaatatgagattattatcaaagataaaggtttacaataaaatcattagtgagttttgcaaaatagatatgtaaaggtaaaactaagtattatgaagtgaatgacacatatctacaaccacttccaggatgaaatgggaagaaatttgccagccaaatttgctcatggatagaaaagaccatatccaaaacggacacatacttctctgaaaggattgtctcgggattaatttaaaatcacaactcttggctgggcgcggcggctcaggcctataatcccagcactttgagaggcctaggcaggcagatcacgaggtcagaagattcagaccatcctggctaacatggtgaaaccccgtctctactaaaaatacaaaaaattagctgggcgtggtggcacgagcctgtagtcccagctactcaggaggctgagacaagagaattgcttgaacttaggaggtggaggttgcagtgagccaagattgcgccactacactccagcccggtgacagagggagactccatctcaaaaaagaaaaaaaaaaaaaatcataacgctctcttcaggatggcccagctgcatgtgcttagctatgacccctcctagagacatatagataatcagaaagtgttacagccaaattgccatagcaacatgatttcagtaaaagatgatcactttctaacctggaacccagacgcattttctgggatcacttaaagtacaactgatacacagtaacttcttatttctccttttaaatagactatatttagagcaattttaggtcctttcactgtaaaattgagcagaaagtacaaagaattcccatataccctttacttcctccatgagcacagcctccccactaacagtattccataccagaatggtacatttgatactattgatgagcctacattgacacatcattactctccgaagtccagattttacaacagggttcacacttggtgttgtatatggtatgggttttgacaactatggcaacattaaactacttcatagtatcaaaaagaatagtttcactgctctaaaaattgtctcttctctatccctcccctccctcaacccctggcaaccacgaatctttttactgtctccatagttttgcctatttcaaatgttatgcaattggaatcatacagttagcctttcagattgatttcttttacttagtcatatgcatttaagatttcttcatgtcttttcacagtgtggtagctcatttccttttaactctgactaatattccattatctgcatggaccacaatttatttatttactcacttactgaagggcatctacttgcttccaagtttcagtgattagaaagaaaactgcataaacatctacatatgggtttttgtataaacacaaattttcaactcatttgggtaaacacaaataagtgtggtttctggattgtataatgaatttatctgaaattgtgaacagtgttgaaataagttaggggaaaatggcaaacatttatatcttaccaatattgtgataaaaaatttttaaattaaattcaagagtaattcacagcctacgttccattctcacaatgcttagcataatagctgtcttttttttaaccgaataaaatatatattatgagtaaacacacgcctacatcctcaccacacagatacatacattgattcccccccacccaaattttatgcacgaagctacatttgaacatagtgaaaacatcaagcagaatgatcgttttaattaaaaaaattggttaaatgtgaagctatacaggcaaaatgatcatatgcaatgattttctcaggaaattttcagattaccttgtcctagcttaactattgcaatgctccttttcattttaaacagtgtggcagtttggatgatcaattattttgtcattctaacttttagaatattgttattggttttcaaacttgtgtttacaattatcctgaagtttcctcaatgatcaaattgctcatatttcagtccccagaaattttgatttagtaatctgaagtgggactggcttacacacatctccaacagactattgcgttaatctcttcaggctgccagaacaaaataccataggctgggtggttttaaaaacagagatttatttctcacacttccagaagctagaaagtccaagatcgaggtaccagatgattttattcctggtgaggtgtctcttcctggtttgcagatggccaccgtcttaccatgtcctcacatgggctttcttctttgcaagcactgagaggaggatggggaatctccttttttaaatttttttgagccactattttcatcatgaaatgacctaatctaagcctaactacattccaaaggcctcatctccaaataccatcatatttggggttaggaattcaacttatgaactctagggaggtcggacacaaatattcagtttgatttgtgtgcaagtggttcaagaccatatgttgctgaataggcaacaattaaaaaggcaaagtcctgccattatgtttccatgcatttcttcacattttatcttcatcatgtcatgccaacaaatgtatatgtatagggatcaaataggcacataatatacaaaatgatgtgcatttttctcaattgtaaaaggtaagccaatggataaagatagaataaactatatagacatagtccaagtaagaaagtatgttttatttgtttggttggccatttctgtcatgtatccatgtatccagtatttgcaaaataatttacccttgtctttgataaaatcttactaagggaacactgtgtagcctttccatttagtacatttttaaagccaaaaatacagagcagcaaaattaatttccataaattactgcattgtgcatttgtttaaaaataaaatgcttctcttttcaatacatcctaggtaaatggttacggcatattctaaatgtttgttggaaaggcttcactggcaatgtttacttcaaaaattttaacttgaattgttgcctcttattctcttgtgatgctgggttgaatcaacaagatgtgattacctgtgtatcattttgttttgtttcttattacttccctggtaaacaattgtaggtgcccgattgcctgcaaattacctctgactactgttttccaatcaccttgatatgtaggggcttgtaattgggaattactctctgctgtacacaagttcataacattgaaaatgcatctgtgattataaacattacttgttgagcttgagtcactagcctaccatatgtttatgcctcctgactaataatattcatatagcagtagatcctccaaaatgttttcttgcatttttacccactaaaaagaatccaagatgaaaatgttgtacacattttgtttattagataataccacagaagactgcaaaataaaaatgcctaacgggctagaacaaataaacaagcctgcacatttaaattcttacaaaaacctccaaggtagacacacatatttatgagagaaagtggtaaggttccttctatgtctaaactacacatgtgtacttctgcttatttttctttcttttttttttttgagacagagcctcactctgtcacccagactggagtgcagaggtgcgatatctgctcactgcaacctctgcctctcgggttcaagtgattcccctgcgttcgcttcctgagtagctgggactacaggcatgcaccaccatgcccagctattttttgtacttttagtagaattggggtttcaccatgttggccaggctggtcttgaacacctggcctcaaatgatccacccactttggcctcccgaagtgctgggattacaggcacgagccaccgtgcctggcctacttttggttctttttcttaatttgttcagtttttcatttattcatttaacatctattattttacagaaaatgggtaggactcccagtgtttctccaatgggacatgtggaccacttaataactaaatcatgtaaagtgctcattatcgtgcaaatctactcacatcttcgacctactgaattagaatccagggcagtgggtcccaggcataagttttgtgacaagttgccccagagattcttgtgaatgtacaaatttgaaatatctatctatttacccacatatggtacctggccttaaggttctcatatttcattggaggatctgcttatgcaaattaatatgagtactaagagatttcgatatatgtaaaagtttcattaaccattttctaaatgaaggcactaaacatcttggcagcagtaagtcttctcttcaactgcctgattatggtgatttaggtacctataaaattctttatgttatctacacaatttatatttaagtattttaatatttagtatattatatgctatatatattacacattctgaattttcccaaacgattttatgaagataatgcatcttccataaattcttgtctgtatagaaaacaaaaataatcagacatttaacggatgcatatccatcagcagcataatccagaaatctgttttcttcattcatcattggcaattcgaagtgtgctgaatgtgtttctactctgtataaaatgtgggatataaacacatataagatacaacttacgaagttgaaatgctatgattagaatgttcaatgatatggaaacagatatgcaaatctgtacagtaatacagaaaacattttaataaacacaaaacacagacttcagagaccatagtgatcacaatggaagcatatgaatgaagagtacctgtgggggaaggccatgtttgtaggctgtgaattgcatggagaaagcagggtattcatggaaagggcacttgacatgaacccaggcttggggtctggaatatgcatggcaatattggacagtgcacaaatttagcttcagtggaaagtgttagtgagacaatggcagagattaggtactcagtgattaaaatacaccttacatttaaaggttaattttaatttttacaaacattcaatattttgtttctcaagtggctgaaagtttaaataattctactgctgcccttgtggaaagtcaagattgaccaaacttccctatttgtcagtcactgttacggctgcggtttagccagggtatggttgtctctatctctactggtaaatttagcacatttgtgactccaagcttccagtgggtgatggattaaaacctcagattttattttacttataaagaaaaatatatatgaaattatattagacactggcatcttaaaatttcttctaaaacacaagctacttagctgcaagcttgatggattaaaacctcagattttattttacttataaagaaaaatatataagaaattatatgagacactggcatcttaaaatttctcctaaaacacaagctacttagctgcaagctatgactcatggaattagcaatcataaattcatagaggtagacatttttatgctttagtaggaagattcaatacttctctatatgttttttctcttcctaccatgaaaattgatggtgaagtagtttatttctgctgaggagaaaaggaaggataattcacatgttttctgtagagaatgtgaattaagaattccttaagggaattcctttagggtatatacgtcgtgtatttatttccacacactctattagaatgtgaaaagaaaagctcgaaatgtcaataactcctctcagatcacaagattaccaatctggaaaatttgaaatcatacccgggatttcctgacacaaaaatcttcatgccacagtggcattagctcaaggaatttagcccttgtaacttgcagagtttataggacagagttggtgtattttgagagggagagatagagagaaaagagaaataaagaggaggagaataaggaggaaatgaagaagcagaatgagagaggggggacatgatcataaaagtggtcactatctaagaatttgaaaatatacatcaggcagatgtagttattttaatacatcactaaagatgtttcaaacttagaatgcttttttttatttttgcttgcattttatttctgttattagtattcaatgtgatctgtgttttcaaaagctctgtctttcttgctgatatatttaataatcatactgataaaatcatagggctgcccagggattctgcaaagggctactcttctccagattgccaaaccttcagcacaactactccattcagcaaaatggaatttactaacaaatttagataatttactaagagcataacagatgctccttgacttacgatggagttgcatcataataaacccattacagagctgaaaaatggtaagatgaactatcatgggtaagagactatctaaatatggcaaaaaagaaaattaaactgtagactttcacaataggtttacctgtgagtaaatatcattagatagcacaggaaagtatcacttttctgcttaaagaggtgtaatttgccactccctcttgatatgaaactcattgcacatagtcagaagccctgtggtttagcctaaacaagaacccaggttttttttttttttttggatgtagaaattgatgtttctggatcataaggcagttctatttcttaatattgtgttgaattcctatgccgtttcattcccaccaacagtatggctctccaacctcatcaacacctgtcttgttttttgatgatagccatcctagctagtatgaggtgatatctccttgtggtttggatttatattcttctgatgactagtgttgttgattatctttttatatacctgttgtccacatccaatagaattataatcgggatctcatagagatacctgcactcctatgttcactgctgcatgaacctcaaagacattatgtaatgtaaaataagccagtaacagaacaaatactgcatgatcttacttatatgaggaatctgaaaatgtcaaactcacagtgtcaagaatagaataaatggtggttttccaggggctgagtgagagggaaatgagttgttgctgtttaatgtgtataaagatttagatgtgcaagatgaataagttctaaaggctgtacaacactgtgcctacagttaatgatactgtatcggacacttaaaaattgtttaaaaggtagttctcattaagtgccattaccacaattaaaaaacaaaataaaataaaacagtaaataatgcagccagtaactatatattgaatgggacattattttttgtgctcttagtcacatccttctgctttccagagttgatggagcatatagaattctgttgccatgtgtgcattcatgaaatcattcacacatttgtcttaataattgttgtttctggatgaaaaaataagaaagaaacagctatgggatcctgcttcaaatatttctctactgttggccaacagaccctcaaatagactttgaaaggatgtctgtaccttggcaatgtgatttcagaagcagcctctcctggccaggttagattctaacagcattggaatcaaaggtccgcattgtagggaatttccttcaagagatggcagaaacatggtaagtaaactcgggttactgaaagttctgatgccaactgctcaggatacagtcttttgtataacagaaaaaagagtgagaactggaaaaataaggtccatcttgtttcaagtggccattagcccttaggatcttctctctgtagagaaccaactatcaatgctactatcgctaccatttagagaaaatgatcttggcttgagggattaacgaagcctcctataaattctttgacaatagtcccatcagtcatctgggtctatttgccttctccttaaatttgtgctggcctgtgactgctttaatcaaggcagtacaatgaaagtgacattagcagtttttgctctgttcttgaggggtttagaagctgctgccttgatctctttagcctgtgagctttctggtaagtgatctagctagattgttaatgacaccatgtagagaggctctgcaatcacatggagaaagtgaggcatccagctgggcctagtctcctagctgttcctactaaggcactaggcatctcactgcacccatccttgaacttccctggacccatccttgaacctccacacaagttgatatgtcagatggatgctttacccagtattccaaaccaacgtcatacggattaagaaattgcctagacaatccctgctaaatttcctggcttccaaaattcttgttttgaaagctctccatagtagtttgatttaccccaaaggaaaaccagttatgtttggttttctagatcaattgctaagaccattaaatcatactatatattgtgtacctaccatgtcctcttgccttcctctctttctgcctctcttcctctcactgtctctctccagaaatggagtgcatgacatatagagaaacaaacataactcacaaatggaatatttcagctatggtccattgtaagcatatttcatgagttcaggtatatgttgtatttagaggataagcaagtgaaggaaaatgaacctgacctccaaataattgctgtttagtcaacacatagaacacgacttcctgtaattaatgaatagttataaagaattttagcatcaggaaacttacactctatggggagtattgagattatctatgctatttatgggatactattaatcaagaaaattagaaagataactaaaaacatttaaatatcctatacaagttatatttcatttctagatttagttaagtatgatttcccaaaatagcttattcatgtggcttataaaaaatttgtgtgctcaaattgcaaacccatatgagaaatattatcatatagacatatgatgcttatttattcattggcatatttttatcttattctgcttttttttggtttttgctttgatggtttaaatgagttcaaaagatgagatgctttatgtagatttttttagtcacagttactattagagaaagggtatttaatatgaatgtcacaaaaacacttggaatacgtgttgttgagacaactatatttagagtcatataattttaaatatattaaaacactactatataagtatatacatatatcaatgaccatctagttccattagtaatgatataattgacaacataggtccataagtaactgaacattgatgatttctcctgcattaccaatttagttattgtgacatctggtttcctaatttataaaaaatgatttatttctcttttatatcatgatttaatttataatgcattatgtcacactccattattattattattattattattattattattattattattgagatggagtttcactcttgttcccccagctagagtgcagtggcgccatcttggctcactgcaaactctgtctgctgggtgcaagtgattctcctgtctcagtctcccgagtagttgggattgcgggcgtgcaccaccatgcccagctaattttgtatttttagtagagactgggctttgccatgttggccaggctggtcttgaactcctgatctcaggtgatctgcctgcctcagcctcccaaagtgctgggattacaggtgtgagccaccaccctggctgccatactcattaatctaaaaagacatggccactttccagcaagttggctgtcatgttaggcatgctatatgtatatacaatatatgaatattattaaagcatgcctacatatcatatacatgttatttatgtcacatgtagcaaatatgcagcactgaagtaaacacatatatctgattcctaaaattattaagatttcagagatatgtatatgcttttttcctttagcatatagttttaagtagagtccagaattgggccaaagtagccagaactttatacaccctccttcattctgtcactggatgagtgctgtcctggaaatggtgccacttcaggaaaggttgagatagttctgaaggagctgacagctggaagtgtgctgctgaatgcactccccatgctggagagcaagtttttccctaaaggaagctcaggaccacacgtctctatgtctaccagacagcaaacctgctttgttccccttaatctctagtacaagcccttccgatgttgattaaggttgcatgctacactgaaaatactaaggatagaggttaagcaagtgtgagatcatgaagagtggccttggattcctttatcctgagagctgtaaacagttattcattccttcaattggtagctatagaatgccctcttgaatccaggcactgttctaggtggagaaaattgctgcccttgtaacggtggcattctaggaagggcagattagtgaaaaaaaaaaaaagataattaaatcatacataataataccatatatagcagattagttgtggttaatgctcttattttctgtggttctcatgttgccacatccaacaggtaattgctgtcctcataccaccctcagtaatactggccccaggcaattatgcctatccttctgagagattatttccttgtctttctcaattctactgccttgttttgtattgccattacattaatttcttattttcatgcaaatttaattcttgtttttgacaaattatttgttttttttttccccactagaacaaaagctctacaagaccaaggatctttgtttactgtgttttcattgctgtgccctcattgcctaaaacaatctgcaaatcatattgtcctcaaataccacaaactgagtgattacaaaaaaaaagcaaaaaagtattgttgcactgttctggaatctagaagtctgaaatcaaggtgttggcagggttgctttcttcttggggcagtatgggattgctcggtcccaagcctctctccctggcttatcattggctgttttcctactcacgtggacttttccccatatgttcaaatcatctttcctttgtgtgtatctctatgttcaaatttccttttttcataaggcaccaatcataatggattatggcccactgagacagccagatgggagggggtccctggcaaaactccaactggcctgtgcactggggtagagccacagaagttcaccccatttgcagcagggaggagaagcctggcccctccttttcctgggtggaacttgggattcaaacaacgaggcagaaagcactctagcaaggactcaggccttgaagagagtcccttttccccccttttcttccttttcactcaataaagccttgtgttactcacccttaaaagcatctgccagcctaaactttcaaggctgtgggacaaggacctgtctttagctgaactaaggaaaagccctgtaacaccacagcatgtcactttaacttgatgatttctgtaaaacccataactccaaagaaggtcacattctgagttactgggggctagggcttcaatatacgactttttcatggggagaggacaccactcaagcgacaacactaaagcaaaataacaaatagcaccaagaaaaaaataaaaacatattgactgtgtaaatttgttctttgagcccatattaaagatattagttaagcaaaatcacaagtgttgacttgaccaaaaagggcctgaagtcactcaagaagagcacacaagatgtgaaaaacagatgtgcgaaagaacacaacgccagagaaaacatggagatggagaaagacttttgtgtgggttccctaaggatagaggttaaccaagtgtgagatcatgaagagtggccttggattcctttatcctgagcactataaacagttattcattccttcaattgggatagaggttaagcaagtgtgagatcatgaagagtggccttggattcctttattctgagaactataaacagttattaattccttcagttggtagctatagagtgccctcttgaatccaggcactattctaggtggagaaaattgctgccctcacaacactgacattctaggaaaggcagattagtgaaaaaaaaaaagataattaaatcatacctaataataccatatatagcagattagttgttgttaattgctgaggaaaattaaacatttagtttgggcttatggttttaactaggactataatagtgatatgctggaattagctagttctgggtcacaagtgctgattattatgctttcaaaaatttcgagagctggctcatagatataattataattaaacattaaattatataaacttaaaagttccctttcactttaaaaagtaataaatattgaaaactcactactttcaaattgtgttactatattttaccattatctataattttgatgttatttatgtctactttatctgtatggtgtaaatattatagaacaatgtgttcatcttttctcaactccatgttcaatcgtgtcaccttggtaacttgaaaatcagtggcagtggatgtattgatctggtgattgtctagacttgagaaagtaaaggagaaaacaactaaagcagtttaaaccccaaagtaaccattacattgcaaggaacacaaaacattgaagaaatagtatcctaaataataaaaatgatttttagcttagcaaaatgcagctcatattgatgaacaagtgaaattgagacgaacatcatttatctacacatttacgtaagtaaaaatattagccaatacctaagccagaacaaaacttacttgccaatgaactgagcaacttctttgctgaatcagatagtaatcaagcatttatttgcaataaaatattatcagtattcaacagattgcaacaactgattggttatggatgcaagagttcagtaaaaatcaatgtaaatattctgtaaaaatcaattgactatgtggaatttccaatcaagagtaatatatattctataattgcttgtaaattgtgtgctacatatcttttatatctgtaaaatttatataaacatacacttatatacatgcatacatatttctggttgttaaatatttactggcatgccactgactgctagcaataaacaggcttacttaaaagaagtgatagagaggtctaggcaaaaaagaatcatatgcacaaatgccctaatgtgggtgctttctaggctatttcaggtacattcatgggaccagaatatctaaggtaaaagtaacagaaagaaccagtgatgatatcagaatgatgatgatgggccaggtaattaagagcaggcacatcactatcatgctgttagctttgtttgtaagtaagatgggaagccattggcaagttttgagcagaggagtgatgatatggtttggtgctgtctccacccaaatctcattttgaactgtagctcccataattcccacgtgttgtgggagggacctggtgggagatacttgaatcatggtggtggtttctcccatactgttcttatgtagtgactaagtctcacgagatctgatagttttataaggggtttcctctttcgcttgattctcattctctcttgtctgttgccaggtaagacatgccttttgcctgccaccatgattgtgggggctcctcagccacgtgaaactgtgagtccattaagtctcttattctttataaattgcacagtcttgggtatgtctttgccagcagtgtgaaaacagactaatacaagtgacatgattttatatattttaacatgattgttttgaaagttgctttgggaataaattgtgtggaacaatgatagaattaaggagataggttaaaagagaaatgaaataaagttagttaaaatagaagtgaggagatgtggtgaagtcctggatatatgttgacggtagggtttcctgatgtcatagtcatgtggtgtgaaaggaaaacaggaatgaaggatgatccaaagtgtttgacctagaatacagaaaactgtgagatgaactgtttgtggggaggtggttggaaatcaggagttcaattttggatctactctgagattatgtctcagagactcaagcagacatattcagctggcataacatacactggtttttagaggagcaagctaaaatagtaatataaatatgaccagcataaagatactacttaaagcccttaaccttatgaaattagcatagaaatgagtatgtatagaaagaggctcaaatactggatactgacacataagattgagagaaaaggtaaaagcaaaagatgcccactgatcattcagaaagaaaaaaaaaaaactaagagggtgtggcattctagaaaccaaccagtatttcaagggatagaaattgttcccttgcgataaatgctgttgctaagtaaagtatgatatggcctgagcagtgtgaggaatggagtcagagacatcataatgagaactgtggcagtctgccctaaatttaatagtggatatgaaatgaagaaaatgttacgttaagtgaatttttaagcataagaagactggttggaagtagaggatgaggaaaagggagtgattctaatgacactcaggtatttggcttaagtatctgagtcagtggggaaacctctacaagatgagaagtatcaggtaaagatcagtgaagagagtgttaatttgggatattttgactttcatgtgcttaagagaggtatctatgtgaaagtctgatggaaagttgaacacctgacactctacagaaaggtctgggctggtgagtcaagacaataatgataactatgaacaaaaaagatgaaaatgaactcattcttgcccaacataatgaagaaagggccacttattacagttaatggtctaaattgctccctcttgaatcttcattccctgaatcatatactaaaaaattaccaatcaggctgcaagagttatctttttaaagaggcaagtgagataaaagtcaatctatctaatcttaatgaatataaaacaatcaaagactggatatttcgactgcatatattactttgtctgtttatataaatatgtctattggttgaacaaattagctgaattactcctttaggttatcaaggtatacttcaaatttaatcagatagcacaataagaggttgactatataaatttttttcaaccaaatttgaaagacttttcacactatatagggatcatttacatataattagaaaaatagacaacatatcacaaaagtgaagaaaaaaatttgtagaagaaaattaatttaaaagagtaggaggacatagattttttatttttatttatttatttatttttttgaaacagagtctcactccatcgtacaggctggagtgcaacagtgcgatcttggctcactgcaacctccacctcccgggttcaagcaattctcctgcctcagcctcccaagtagctgggattacaggtgcccttcaccatgaccggctaatttgtttttttaatttttagtagagacagggtttctccatgttagccagcctggtcttgaactcctcacctcaggtgatccaccagcctcggcctcccaaagtgctgggaatacaggtgtgagccactgtgcctggccaggatgtagattttttaaattttttattcagttattgatttaagatatccatccttatcccccttggctactcattcattagttatcaatgtggcccttcctttgttaatctatatcctatgtgaactaatatctgatatataaaacatttgctatggtagctttgtattcttaatatttcaacatttcctgaagttacaaatggaataatgggtttagcaaggatccattggggtgtgtgtgtgtgtgtgtgttgttttggttttgctgctaagaaggcttgtattttgtcaggtggtccatgatactagagtttggaagtggctactatctaattctcaggccaaggccttgcttcgcccactcactagtcattcaatatttttctatcttatttcttagtagggggatctagcaggaagtaatagaagtaggcacctaaggcagcctataaagtaagtaaagcaaaggctgcattaaagaaagtaacataatgcagactgaatagaatgaacgggtcccctagatgtatttggaaatttgcaaagagttatttaaaatttgaagaatgagctctattagaaaacaggggaagaacccgacaggattatagagcaagacctgaactagaaagggaattaacatggcaaataatggctaaggaagaagggctaaatgaggcattgatttagttatatagagactgtttttctcttaaaataaaaccagaaattgtatcacttttgttgatttagcacctttcactgcttattttaatgctcttcaatcttagggttccagagaacctataaatgtcttttcactgactcaagcaccatttatcaaagttattgcatgatctcaccaagcaggagtttaggcatcttcctctgtgctatttccctttcagagataattctaaagggaattaactaaagagagagcaccacatttgagtacaagtcgatcataagcctgaaatatttcacgcatatgaataattgagaagatgtaacaaatgcaaatttttacatattctcagttaaaatggaagcagtggcacaatataagtgaaacataatgcttttccattttgatcccttgttttggcatttgagaatcaagctgactctcgatttgtcaattttttctttgatcatgtattaaactgtagcaatgtatttacttaagtcctacgtttaagaaatatatttttatttcttaatctttctattaaggtatctttggcaaggtcacttaaccaaacagttggcaaattctgaagcgattttcaagttacaggcttggtcaagaagctttactatattccacaaaaaaaaatacttaaaactttattgaaagacttatgaagtctgttaaaaatcctaaaattaatttataaaaattaaagacaagataataatgtaattttgaactacgggaagatattaaccatcacccaataactacatttaaaatcactgaaaggtagtatcacatcttatcctatcattggcatttatatgtgtaatgaactatttaaaaatatctatttcctttattatttggaaggatttctgtctcttttacttggcaattccactttttttggtcattaattgcatgttttagccatttttttctaggttatatctgtagactaatttcataaatgatttatttcggtcatacagtatagttgagggtttagagtagtagagccaattgtctgcaatgaaaccttggttccaccatttccttacataattttcctccactctatatgaaaacacctaataattcatatttatatgatcaatgtgacattacattagtcagtttatgaaaacattttccagcagtgtataccacatggtaaaagcccagtataattatcatctgctttaaaaaaataaagagtactttctgttttttaattttgttcagaaatggacatattttctccaaagcagacatataagtctgaaacttcacaattcctgaaccgttctctgatttgtattccttcctcgcccccagtcagtgaattcagaatggtgagctatttgttttgttcaccctagcgttagcaatatcattatttgtattaatagttctagaaatgtgtcttttttgtttacaattccaactggatgcatttataaccacatttttcacaggttgactactccacactttcttacccaaatgtacagttattttgccttaattctttccgggtttcttctggctgatgattctaaagttttcatgtcattgttatttccaaacacagggctatctctttttttcttgaatattttcctaaaatcctaactatattatcaaacccttattacctgttatcatgagtgtcacccatttatctctaaggtatgcgcataattatgaataccttccatgtaccaggtaatatgttaaagtgctttttgcaaatatttcatttaattatcctgtgatccatattatgagttacaaacacctgggattatagaacacttaaaagcttactcatgttctatctttcctctttaactgggcactgtggttcaggtgaagaaactggttttatttgtgccccctctgtgttctacaggtgcttcctcttccactgaagcatcaccccatgctcttgtttgtatactccaactagctgctgttttgcatcagctggctgcaaagatcgttttcagactcttggaggaggtcactaattagaaaatacagtgtggtggtgtgagtagtggccaacgtagtgtgctcattcacactgcattaactggccttcagcgtgcttatttagtcccttgtcgtattcagagaaaatgtttgaaaattcctatacatactgatttctgtgatgcttctttcttctctagtggatttactacgtagtgtcttcaacttttacacttcattcttgctatggaacggaatttaataatgatacagatatcagcataatctgtacctgtccacaaatattaaatacagcttatttctcccaattgcattttgcatgctaaaaggacaaaattccaacaaattagaaatcaccaaaataattcacttacttcatttaatgaagtcattaattcagtgaacgttgattgcattatcaagtgttaagtgctcagaatacaaataagtacagaaaacagttcccaaatggatattctcaccgatggcatggtgttacatttttatattatataactatattaattcaaaagaaattattacaaacatttctttataaaattattttgaccatgaggcatagtggggtggggagggaaggggaagtgtctctcctacttcatgtttaaattacttttctggctaccgaaacttgtttttgatttgttttcatttttttttaattgagacagggtctctctctctcacccaggctggagtgcagtggtgcaatctcagctcactgcaacctctgcctcccaggctcaagcgatcctcccacctcagcctccaagaaagctaggaccacaggtgcgcactaccatacccacctaattttttagtattttcagtagagaaggggtttcatcatgttgcccaggctggcctcgaactcctgagctcaagggatccacccctctcagtcttccaaagtgctaggattacaagtattagccaccattcctggccactgccaaaccttgtaggccctggtagaaatggttgagaagattctgggtgtaatgatatcactttagtaacttcttacttgtactttggaaacattggccatctaatatccaactaatgggaatttgctagtgatcaaattcaagagaaatcccttttccccaaaataagcttgtggtggcatgtagaaattgaattgaaaacctatttttgtctcatctaatattacatgaagctatgtttgcagaattgttttaactgtgtgaaagaaaatgcttgtaaataattatattttgatgaataacaacgttgttatttactaaagtcagatgatgctttcttttctttttatttccccaccagataactaggttgtattgaaaatatttaatgattaaaaacatgagctctacagagtgatagggtccaaatcctcttctcactggattaactctatggcgttatggaaattacttccctacgactcaatttcttcctttagaaaaatgtgggtcatgagttctcatttggtcgtaaggctattataaagattaaataatgtagtatatgcaaagcacataaaaaactgcctagagaagcacaagtaacatcataagcaaaagttagcatttttcttattgttttatgttatcatgtgcccagatgactaaataatataatcagcttagcaagaaatattctcccaaagaatgtatttggataggctgggtgcagtggctcatgcatgtaatcccagcactttgggagcctgagggtgggtggatcacctgaggttgggagttcgagaccaccttgaccaaaatggagaaactctgtctctactaaaaatacaaaattagcctggcgtggtggcacatgcctgtaatcccagctacttgggaggctgaggcaggagaattgcttgaacccgggaggcggaggttgcaatgagcagagatcacaccattgcactccagcctgggcagtaagagctaaactgcatctcaaaaaaaaaaaaaaagaaagaaaaaaaagaatgtatttggtgggtgctcataatttttatagtggtttaaagcttaccaaatttcctaacataaccttattttcaattcaaaatactcctgtgaggtgatataacacaatgtttacacattattactaatttactcatgagaacaaagacaaagaaaatcaaatactaatctagaatagctaataagtgcttagtgattttcctctgtctattgatgctagttttgctttttcaatagaaagaatatgtataccatgttccttacatggattagaaaatccatctaatcacagttgcctgtaggagtactttatatcttactactgggaacctttttgacatagatacatcagatatgcttactgatgtttgattactatggagtgcttcaattacattaaacaaaatgtacatacaaaaatacatatggaaactctaaaagtcatcttctcatagtttaattatcatgccaaaattgttaccatttttaccagaaccattctggcagatcagaagtgagagatggttgttttgtaaacccttgatgacaaagtcatctttggtagttgcactggatggttggaaacatgtagcaatttgtagggaaaaatgattaataagtgattgaggtaagtgactacactgtattttgaccaaaacaaacaaacaaacaaacaaagagtataaattcttagaatgcagactatatgttatttctctacatatcatctatctacctactcatctgactaggtatccatttatatattttactttctttagttacaaactgtttctaaacataattttgaaaggagagttcaatgatatgtttaacaagtttaacatggttgttcaggatcatattatccaaagtaactgcactgccatgtaagcatcattggatgtgttttggcagaagaaaaaggagacattcctgttaatttttcttcaacatgtatatttattataggttatggcagtcaagaaaatgttgttgaaagtaaagaaaaatttcgtcttagtaaagtgccgatgaattgtgaaatactacccataaaccactatttgctgaaatagacttggctcaatcaatgattttcagttattaagttaaaaagccctcccctgatatttatatagtctaattaagttaggacaataaatgatacagaaaaaggactataaactaaatttgcaagtatacctagttttggaatttaatacatattaattacacttctttttattattttattttttcaattgacacaaaattgtatgtattaatcatgtacagtatgatgttttgaaggatatatgcaaagtggtatggctacctctacataattaacatatatattacaccacatagttatcctgttttaatggttaaaaaaaacatgcatcaaaacgttttttccaaccaaaaatacatgacatagttttattcaaataatcttgtggctaaaatgttgtactttattttcaattgtttgtaaatattcagttcatataatctattttgagtgtaaaaaataatgtgtttaaggtttaacttttgattgtttaccttttaaaattttgactcttaatttttatatatactgctacctctaatctccaacatttattatcaatataaattaaatccaaagtattttcatttataaagataaaaaatatttatataattttttgatatcactatggtcactaaaaataaataactgtactctatacattctttatgtcttccatattccatcagaattttctcatgctatgttcacagtttcttacaagttagcaaaaaaaaaatgcctttggatgttaagaatgaaaataaaacaagctgaaatcaggataagatatattctttgtcacatctctaatcctgttggcattttgcaacagttttcttttgtaacttatttacataacaatggatttaccttttataagtggtttgattcttctctttaagcgagaaatgacagaatactgtctcctctcaagcaaaactgagagaaaaaaattgaatccaaactatctgtgcctttcctctaatgcagttttactcctcagggaaaaattaaactagtgcttttggaaatctatatatcgcaggtagatttctgtttttttgttttcctttttctttctctttctttctttctttctttttctttctttctttcttccttccttttttccttctttctttcttctgatttttaatttataaattataattgcatatatttattgcacagagtatgttgttttgaattatgcatacactgtggaatggttaaattgaagtaattaatatatgcatttacctcaccaggtggattgtttagaattggacactctaatatcacggctgccatgccaactcgactctctatttaatatcacacatttccttgttctggtccctacactactgattcctatttctacttctaattgcaccttttatttcgcagcagttacgcctgacaaatattctatctttggccaaaagctatttaagctctcctgaactctcctttaaactagccaatgattttgggctttatgtttgtctctgcatttcccagttttagcaagaatcctgctaagtcaatttcgctcgaatcctctgtcgtcaatacctaatcacccttactgtctcactgggttcctcgtcaccaatcaccagtcaatgtctgcttatcccggcctgcctgtagcaagaaacttcaccttctcttgatgtctcctattagtaattttccatccagtgacctcttgcttttcctcacccaactccttggatataaattcccaattttctttgtggtattcagacttgaccctaatctcactcctaagctgcacccaaaacccaatgcaatggtttctacatctatcatgacgatcctgaataaaatctgtgtaccatgctttaataagtgtcataaatattttctatcatcgccttctaacattctctataattctttttgtattatctttctattatttattgcccatcttctcttcacaacttctgacagctagaatgtaagccaggtgtttgtgaatattggtttgtttcgtttgttaacaaaacccaaataccttatatgaatgcttattcatattaatacataacaagtcgacagtaaacatttgttaaatgaaagaataactgaataaaatacaagatgatcattaatgttgcatacagcctaatagaagtaccatattttctctaaaatttctagaattacgacagtgagactataactatcaaagtcagacctcaatcctcaccagaggatattaaacagacattttaaaatctgcactttcttaaggctttcctgccgtaagtgcataccatctaatagaaccacaactcctaatgttatgcagtaaatatggattattcgttagttttctcctcttttcccatgttatgtggaaagaaattccacctcatcctatcttccataaatattgaagtcaaggtggtagttagatgaagagcaaatgtttctttaatgtgtttaagtctttactaagttttttttttcttttttttttaatgagctgcataagttaaaacagttcctggatgagcatgaggtggtatcagcaagtggaacagtaggaggttcctgccttccccccccgcgccccacataaaaaaattatccagccatccatgaatgaaaactatttctggatagctcaggagttcagttaaaaagctgcagcaacacagtaaagaaaaaagactaattatattaaaaggataggataaggagttccattttgcccgcatcatcccatcacacagctcaatgcaaagagggatttcccagcccacgagtttccttttcaataacaaggggagcagtcaacaattagtttcttcagactttttgggcaatattcaaaggacctgctttcatcccacccctcccagatcgctgggaagttttttgttgctgtttttttttttttttttttttttttttgtttgttttttcttttttgagacagtctcactctgtctcccaggctggagtgcagtggcgcgatctcggctcactgcaagctccgcctcctgggctcacgccattctcctggctcagcttccctagcagctgggactacaggcacccgccaccatgcctggctaattttttgtatttttagtagagacggggtttcaccgtgttagccaggatggtctctatctcctaatctcgtgatctgcctgcctcggcctcccaaatactgggattacaggcgtgagccaccgcgcccggcctgatggctgggaagtttaacatagtaaggaagtgcgaagatggctagaaacaaagaggaagagtagaggttattagtagcagccactgggtggatgccctaacagcctgctctacagaacacccaagcaatctttgctattaaagacatcaagagccatagctgtcccaaacattctagaaagggaagtacccctgcatcttttgagaaaaggaactgatgctccatcactatgggacaaagcgactacacccttgtccctcccacaaccacttgcatgctgggatctcagaggcacagtctctccatgagcaactgcacctaaaatactggtgccacttcttcagagagcacacaagtgctataaacatcagagccactgccacaacaaatagccctgtgctccagccatttgctccacagacacatgccccttgcgtgctacagccgtgactgcaacaggcatgctgacatatcacatcctattgcaatctttccataatgctgcatatcagcattgcaatcaaattgtacaatgccaaggacaaaggtataattttgaaagcagcaagagaaaagcaattcatcacatacaagggaattaccataaggctatcaatgtcgttctcaacagaaatcttgcaagccaggagaaagtgagataatatatgcaaaatactgaaagagaaaatctaccattcaacatactatacccagagaaattatcttttaaatggagagaaataaagactctttgagacaaacagaaattgaggtagtttatcactactagatctgtcttatgagaaatgcttcaggtagttcttcaagttgtaactaaaacataaacatatgaaataatatgaaaacaaacattttactggtgtggctaaatatacagtcatatgcagactaatgtagcactgtaataggggtccataatttcctttaaaaactaatcattaaaatataaaaatctattaatagatacacaatatagaaagcatcaaattctgattacaagggtattatatgtgggtgaggagtaagtgtaatgatttggtatacgattgaaattaagttttcatcaacttaaaatagaagatattttatgtaagactcaagctaatcacaaagataaaacctataatcaattcaaaaacagataaagagaaaagaatcaaagtaagccactataagaaatcatcaaatagcaaaggaatacggcaagacaataagaaaacagaaataaccagaaatatgtggaaactaaacagcattcttttgaacaactattcggttaaaatgaagtcaaaatgaaatttagagaatatttccagacaaacaaagataaaatcaaactgtatcgaaacttttgggatacagcaaaagcagtcccaagaagacagtttaaagcagttaaagcccatattagaaaagatgaaatatttcaaataaacagtataacattaagcctcaagaaactagagagagtaaaacgaaaccaactaagcctaaagttggcagaataaaaaaaatataaggattataactaaatcagctggagagaaaaaatagaccaaatcatcagaactaaattagttttgtgaaagataatattgacaaacccttagctggaatgagaaaaaaagaaagatggctcaaataaataaaatcagtaataaaaaaggagatgctacaatggatgcctcagaaatgaaggggatcaaaaagcatcctttttatggttattgtgcacaattataggccagcaaactggataatccagaagaaatgaaaaaatttctagaaatacatacaacttaccgaatctaaatttttcaaaaaaaaaaaaaaagccagaattgatcaataacaaatgaggaaattgaatttttaaaaagcccaacaaacaaaagctcaggaccaggtatcttcatggttatattccaccaaacatttaaagaaggattaatatcaatcattcttaaacttgtccaaaaataacagaagaaataggaacacctctaaactcattccataaggcctgaatcaccctgataccaaaatcacacaaaggcactgcttgaaatgaaaatgattggtcaatattcttgaagaacatagatgcaaacgtctttaataaaatgctataaaaagtaatttaacagcacattaaaagggtcatacaccatgaccacgtgagatttatcaattggtttgcaagaatcgtttaacatatgtaatacaacaaattaacaaaatgaaaaagaactatatgatcatctcaatagatgcagaaaatggatttgacaaaatttagcatttattaatcagtaaaattctctcaacaaaataggtatagaaagaagctttctcaacacaattatggtcatatatgaaaagcccacagctaaaatcataatttatggaaaaaattgaaatctttctaagatccagtatagagctaggatatccactctcattatttcttttcaacttagtacttgaagtcctagccagtacaattcaacaagaaaaaaataaaataaaataaaaggtacccaaattggaaagaaaaattagctttatttgaagaaaatacctttattttcaggtcctctgcatatatgtagaggtactaaacaacaacaacaacaaaaaaacctgttggaaataataaatctagtaaatttgcaggatcccaaatcagtacatcaaaataatttgtgttgctatacaaaaacaatgaattatttgaaaaagaaatggaagagacaatattcacaaaaacaaaaagaataaaatactttggaataaacttgaagaggcaaaatatttgtacactgaaaattaaaaacattgatgaaggaaattaaatagatagataaatggaaagacagcatatacccacggattagaagaatcaacactgctgcaatgtccatgcaacccaaagtggtctacagattcaatgtaatccccatcaaaatcccaatgactttctttatggaaatagaaaaaaaaatcctaaaattcatctgaaactgccaataccctaatatccaaagcaatcttgagtaagaagaacaaaggtggaactaacatgctctctgatttcaaaatatatttcaaagctacagtaatcaaaacaccataatacttaaacaaaaacagatatacaaaccaatggaactgaatagagagctaataaagaaattcagtgatctacggctatctgatctttaaaaaggatgcaaagaaaatacagggaaattataatctctttgaaaaatagtgttgggaaaactggacattccatgcagaataatttaaatggacccttattctcactatttacaaacgtctacccaaaatggattaaagatttaaaggtgagacctgaaactgtaacagtactagaaaaaaaagatagggggaaggcttcttgctatttgtccaggcaataatttttttggataattaccccaaagacacaggcaacaaaagcaaaataggtaaatatagttccatcaaattaacaatttgctgcaaataaaacaataaagagaatgaaatgacaacttagggaatgtgagaaaatatctgcaaactatatatctgataaaaggttaatatccaaaatatatacagaactcacacctaaatagcaaaaaaacaacaaagatataaacaaatatataattagctgaattaaaaacaagtaaagatttgcagacatttctcaaaagaagagaaattgctaccagattaatataaaggtacttaatttcattaatcatcagaaaaatgaaaatcaagaccacaaagagatattactttagccctcttagaatggccagtcactgtcacaaaataaatgataattattggcgaggtgatggagaaagtgaaacccttgtacactattggtgggaatgtaaattggcacagaaattatgaaaaacaatatgaaggtttctcagacatgtaaaaatagaactgccgtatgatccagcagtttcagttctggataaatccaatggaaatgaaatcaatattttgagaagataactatagtcccatgttcattgtagcgtaattcacaatcgctaagataaagaaaccatctaaatatctattgatagatcaataaagaaaacgtggtttatttatgcaatgaagtgttattcaccctttaaaagaaggaaatctgccacttccaataacgtggatgtacttagaggacagtatgctaggtgaaataagctagatgcagaaagacaagtactgcataattccacatacatgtggaatctaaaaatgtcaagctcacacattcagagtagaatgacggttactagtggctgttcacaggtaggttgggagtgatatgggaagatgttggtcaagggctacaaagtcttagttatgcaaaataaattagttctggagatctaatgtgcaacaatgtgactatagctaaaatgttggatactcaaaatttgataagatgatagatcttcagtgttatcaacacacacaaacacaaacacaaaaggtaactttcacatgatgaataagttagtttgatcgtgataaatatttcacaatgtatacatacatcaaattatcaagtttataccttaaatatatccagtttttaatttttcaatatacctctttaataaagttaagggaaaacatacatagtgcctctccttctcacttcactgatgaggaacaattaactagttatattccctatttgggtctaaatttaattttgagcaagagatttttagctgtggcttttggaaaagaggataaattaagcaaaccacttacttagaacccaactgaattgaccaaattaatgttgtaataagagaaaaatctactcagcattgtagctgagtagaagttatccaagcagcataagcttccagtagtttatcaaggaagctagaaaaacaaataatagaaaagttcctagggctaaagtgtgaattacttcctaatactgtggtctgtgtcgcaagaagcatatagatcccatcatggtttgatttcaccccgccaaaaaaaaatgagtaagggattaatatatgaaagcaatgtgttcaaaacctgtttcttgtggtgtgtatctaagtcattctgaagcacccatgtctgaaagcctagagctagcaaagcaacagtgaatggaatgtagataattctgggaacagttgttccttccccttgtacagtggagctctttctgacaatgtgggtcatagctagaaagaagttttgatataattatactaagaaagttgtgacagactagttacttaaatgcatattctccatatatggatcctaaaaaaaaattgaacaggatgtttgttttctgtgctggggcttggtatgacccgtgaagcatctgcacctctctcaggctgctgaacctctgaaatggtaatgccaggttacatcaaagcaggttgcaacttctgatgtgggcaaagaatcccaaaagatttcagatggataatgtgcaaccccaaggagaagacatcagcacatctgagacaagctcaggctcgccaaccatactggctaaaggtgcattccctgaaaagagaatgcccaggtttttccagggactttcacttaatcctatgtgattgtgattaaattcctttttctccttgtctttcacctttctgctctgcaaaataagagaatagcaatgccttcatagtattatggagaagatgaaatgagatgatacatcaaaaatgcttagaatagaggttgcatgtggtaactactcaataaatgttatccaatactgctgttgctttcaaagctgtaactaatgggttttatgaagacaaaaaatggagtaggagatatgtagttgattcagtttgaatattatgtgcagttataggaaaagacatttaataaaaggtagtatttatcagagaatgaggggaaggaatgagccatatgcttatgtaaagaaagccttccaggcagtagtgaaagtcaaagcaaactgcaaagctagagggaactagtggagtccaagaaccttaggagcgaatgtggctggagtggaatggatgggaggtaaagtaacgggagagcagagaggtagagagggctaaataacggatagtctgtaggctctggctattgacttccattctgcatgaagcattgggtggttcgtggtagtggaggtagaagaggtcttatcctgtataggctaagctgttttgtaaagagtagtgatttatttcttgcttatatcatatatttttgagctttggtcagctgcaatttcactttctgtgtcatttcattctggaatcagtgctgaataagcacgtcctaaggcagaaaggaaacacaagaaagatggataaaatttgctgggaagtgactcatgcgactgccattaacatctcattaccctagaagccataatgccaacgctatcgatgaggtgagaaagtgaactttctcctgaaaatcttaaagtagcaggtatacagatacatttactttataaaaaggaagaagtagatgaatagaaataatatcatctattaacattactgtgattgtgaacattttacaaagatccttctgttgttgttttgcgaagaatacaatatatggaagcaagaaaagaataaatagaagaaaacgacaaatgatgacatggagatcttcaatgtgaggccatcatgtctctacctaagacagcagaaatagaggtgaaaataaagtaattagattcaggatgtataatatgttgaaggaaaagttgagaaggtttattggtgaactggttgtaaagtgaggagagaaataaaaatgtcaggaatggcttgtttgtttatctttattttttgacctgagcaattacagcacttaccgagatgggtaagactgggatgcagataaacacacagcctacgtgagaaaaaagtgcatttaaaaaaaatacaacattcatcaataaacttaaattattattattactatttttgagatggagtctctctcactctgtcacccaggctggagtgcagtggtgtgatctcggctcactgcaacctccacctcctgggttcaagagattctcctgcctcagcctcctgagtagctgggactacaggcacgtaccaccatgcccagctaatttttgtatttttagcagagatggggtttcaccatattggctaggctggtctcaaactcctgacctcgtcgtgatccacctgccttgacctcccaaagtgctgggattataggtgtgagccaccacgcccggccttaaattaatttaataaaaaattagaagtaagatactacagaatcaacactgaaaaatctaaatggaataaaggatgtatgaaaaatactgaagttttcttctggagaatagtaaagaaagcaggaatgagagagcaatgctaatacaggggatggatttcagtatcttataaatgacaacaaagtattaaaaaataaaatacaacatgcaatggtcaaagatagaagaagggatagaagagaaaaagatggatgaggataaggtggagaaggaaactttctcactgaaaaataatgaccgttcagattttaaaatgctgttaattggaagggagaaccataatggaaggaaatagcactgaaacacattgttgcatttttttaaattgcaaagttaatcatagattttagcatatttaaaactcaccagtctgggaaagaactatgagttcataagataaagatgcaggagttatggtctttactgacttaaggttaaaaaaataaaagtagacatccctaacgtaagggcaagaaatgcaaaattttggatcccttctggtattagaaaataatgtaatttaaagatgcctattgtaaggccgggtgcagtgactcacgcctacaatcccagcactttggtaggccgaagcaggcggatcacgaggtcaagagattgagaccatcctggccaacatgatgaaaccccgtctctactaaaaataacaacaaaaaaaaaattagctgagcatggtggcacagaactgtagtcccagctactcaggaggctgaggcaggagaatcacttgaacccgggaggtagaggttgcagtgagccaagatcatgccattgtactccagcccaggtgacagagcgagactccatcaaaaaaaaaaaaaaaaaaaaaaaaaaaaaaaagatgcctattgtagtggactctggaggctagcaacaagcacatagagacatagaggcaatttaaaagcagtaatgtcatctctgctccctgtggagcttacacaggaaccacatccagtagaatcagagggtcattgtgtctgaaaacctagatcagctctgccctgcagcaaattgatcacttcatactcaccctgcgtttgtattctcttttattcattatgcatacaccctagaggagactgaaggtggaatagaggaggtgtccaccaattattttgaaaaccctactttcatttgtcagtaggagaaaaattgagaaaatcaatagagaaacaattcatattagatagtttaggtctgtcttggtaatcaaaaatatttgaaatccaaaaatacttgaaaatagagctatgtaggcagaaaaaaaataaaaatgtgatttgttttcaagacaattgaaggcagaactgtcaaacttaccattgaggtgaagtcttagattctacaaccatatcgaagcatatttcagccttggactttcagttaatgtttcagttataaagagaagcaggctgggtgcaatggctcagacctgtaatcccagaactttgggaggctgaggcagatggatcactttaggtcggtagttcgagaccagcctggccaacatgttgaaaaaccgtctctactaaaaatacaaaacttagcctgatgtggtggcgcccagctttaatcccagctacttgagaggctgaggcaggagaatcacaggatcccaaaaggcggaggctacagtgagccgagatcatgccactgcactccagcctgggcaacagagcacaatttggtctcaataaataaataaataaaataataataataaagggaggcagtcagattagatgatctagaatgtctcctaagtagttgcatatcagtgatcaatttttatgttttgttttattgttttcaaattcaacttttgaaacaaatatcagggtctgcctaattaattctatctcttttttttgtcttttacctcttagctattctattgatgttcacagcttttttgtacatgaaatctctttgtctttgatgctgaattatttataatcaggtgttgatttccattcagtcattttaacaatgaatcaaaaaagcttagcttcgaaccaatattataatacttttatttttatgaccccaaatatcctctttctcactcttactcttcacacagtacattaaattttgtatatggagaggttttttttttcatgcagagttagacaaaaatgacatttatatatttatttaatgtaatgaagctatttgctttattttgtgactctggttgtatattcttgataggctccatatttcccttcctctcccaggaaggatagttttatggcagaagctatttctcatccatccctgctaatttctgtaactcacaattttcttaagatatttcaggtaaggaggaaagaaatcgacatggtagaggaatctaaaaatcaattgctcaggcctaaccattttagaaatccatgtaataataaagattaatattaaaccagcttctcacaaatcttgagatatccatacagaaatgcctgtgctctttaatatatttgcaattgtagaacagaaatagtctttgaatgccaataaactcaatagtatttgtttgtcccttaagtgaaggaactagtctaacatgagatgtcatcttacatactcccctttaaacataagaagcaaaatatatacaagttaaagatatgtgttcagcttcagtccagtctctatcattctgagatctcaatatttggcttcatgtgggttaaatatttggaagattttttctacctttgcatctatttaagaaatatccaaaaatatttactgatatgtaaatatttcctgttcttatttacagcttttaaccaattgacttatgtctttgaattctagctgaggtaaaaggcatcaaaacaagtggttttcccttcacaactactaatacctgcaatagacactttaaaaaggaataaaatggtcaatatatcaaggtaaaatattgggtttcaatgcccacagttcttctaaaattctcatcaaaaaggtctcatcataaaaaataggcttttgaaaaaatggtattttattacattatatattatatgataaagtccaacattaaatggctaccttttttttcctaaaacttccagggttcttatatatatgtatttgttatttcacctaactttttttctacagaatgggtcaaggaattttagaatttttatgctttcttgtggacatattgagtaatggtggatgactgtgagtcaatactgttttctcatctcatcaaactatatgtcaaagacacacatgcttgaatgattgacaactggtactgacttatggctcaaattttaaaaaattttactttttgcaattggaatttttgctattaactccattgccatatataacaatatactaatataattttcaatacttactgtacacacatatgcaatatgatatgtatgatatgaagcaatgtgaaaaatgaaggaacacaaaagctgcctcttgatggtgggagcaaaagcatcataaaatgtttaattaaggttgctttctatgtagtacactttggaagaaatccctctttcccaaaacattgggcttaaaatttcctatctccataaaagaaaaatacagatacaatagacagataaagcactaatattagaaatataaataaccacaacagtcacttttgttaactaataattttggtcaaaacatttttaaattcgtattgtagattcacagctttctgtacaaattgatagggctcaataaataagacaaattgaaaagcaaaagctaatattaataataggaaccaaatttcctccctacattgtctgagctaatggagataaagagaaaataaagaggacactcacacttggaaaaatctgttggatttccacaacaagcaagcgaagcatattttctcatgccaatccctgtacaggtgtattttgtgacatgacattgagtaccatataccatactgccatgaaagagataataggggtcctagtcacaaggatctttcattcaattaggggaaaattaaacgtatttccacatcttttctaagaagccttatatgggagtaatcacaaatgtactagggaagaataatgacagaattagctcttttcagatggttttacacaaactatataaattacaatgcattaaattctcatttcaagacaaaatatattttaattttgttccagttctagtatagaacttatcttaaaattatcatattaaaatggttgaacttatgataattattactatcaatatgctttatgctaaaagtagacaaaaaagagtacatttagtaagctaaaaatacatgagcatattatatgtcaactgctttgttttaatatatttttctagcatacctaataatagtttagtaaattagcctcagtctacaatcaaagacgatgtgtgtgttatttctcaaacaagttattatggactcataggttcaagttttttaggaaatcactctttatgtaaccactgttttacatgatctcttcagtatgtgcttcctaaatgtgtctgagaagaataaataaaataaatttaaaaatttcagaaaatattgtagaaataaaattgctagaaaaaaatctctggatttaaaaaaatgtgttcaacagaattgcttgtcaaagacatttcttcataggtagttcaatacgtagttctgaaacattattaaagatatcataacataaacctggccttccagatcttcaagatcagccaataactggttagaggtcagcataccctatcagtatcaaaagcataacaactcaaattctgtcaaagaagacgttaagggagacagataaaagtttaatcagagacagtatttcatctaaaagacatcccaaactggaaattatttggtaatctcattgaaactataagataaaattttccttgcttccctaattcaccatgaaaaggcccttgagaacactcagaaactaagctaaaagtattaacctgcatttctgttttcatttgaagggataaatgtctatgataagcaggtatagtaaaaacaataattatcagtctaaataatcattttttgaaaactagaatttaactgcaaaaacttaagaatcagaaatagggttcactctcagtcttactttttattagctctgtgaatttacttaacctctcagaatagcagtttcctcatttagaaaataaaagaaaaatataccatatatacatattaacacttgtaagtttctttgcaaggatacaaaacatatccaggcttaagtaaatgattaacgattcatagctattaatgctattcatgttactactaacattttatgtaatttttatacagttaagtagaacagcctttttaatatttacactttatcattaatgttattacttaaatttttttctttttaatataattattatattcacatgtttaaactaaatgattaaaatgtgatattctttagaagtcatatttttctgggaatttttatgttattaggtgtgtctaatttattattattttttactattgctatgacagacctagtgctatgagagaaattagcaagaggataacatagcaaaataggaggatttagctcagcatgatggttttaaaaagctaaggaagtcactaggagaaatcagaggttaccttctcgatttcaaaggaaaaacagacatttgccaggccaaaaaataatggggaaggagtcagctagtagaactgctatattctattgatatgtgcagacatgatatttatgaggaatattagagcaaaaagagttttttttaaaaaaaagaatttaagaatgtggatacatcatcctgaaaagtaggtaagaagactaatcacaaaaatcaatgctgcaaaacagttggcctatattctgaaagtgttggggttgggtggtgaggaggtgacgattggcgtttataaagaaaaaatgaaacaactgaactctgaattctcaaaacaccagtctggaggaattgtggagtacagattgcagaaccctgagaccacaagaaacagaactaggcatgatgctaagagaggcatcagaaacggcaaacagggggcaaactatgcctataattaagattataaataaacgttttctttaaatttagaaaaatgatgcattcatttacaaggacagctcttagatattgaaatggcttcatattggagggtaaaaaaatctttgcaggtttagctggtttactgaattacctcgacttggcttctaaccagaaactgacctactattaaccccttgatttatttgcatatgctttgtgggaaaacacattttttttttcagcttctgaataaaacctcagacatctcttagttttttagataccaatatattaggttgttgcgaaagtaatggcggtttttgcctttacttttaaatggcaaaaaccgccattacatttacaccaacttaataatacttcttccttgcttagggattaaaagttctgaaccagggtagtcattgcatagcaacaatcgagtctagaatagcagaccctgagcttgagtcttttttttctctctctaatccctagttagcggctatttcagaaccattcagaataagacctagaagaaggggaggatttgctaaaagctgcacagtcaaacatggccgagttcactgtaatcacgggttggtaccctctctgtggttgatgtatccttgctgaatctttctcaggtaccatttttgtggattctgacattccccactagtgacctgtgactgcattcaccttcacctagacaatgtccagcccattggtggcaccttacttagaacttcttgatcatcttttacatcaaagaaatctggcacttctctcactgaaggttcttttaaacttccaggcagtcccctagagaaagatccccccaggccatctcattttgctggtggtagaacacatacatcttgttgcaagtcaagcctgggctttctgtctcttccaccatagcctgtgctgtgtagcctctcctatcaactcctaggatccttaagctccagtgagcaaggtacattcttgtgatggcctgcacttggctcaaggtaaacgggagaattccatgcctttgcctgagaagggactagaggaagtgagtgagtgatgggcactatgctgccacttctcaccaataaggccctctttatcacattttcaagcataatctcttgtagaagaggctggagtgtgacttgttaatgtttccctaactagagctgagtcatttattttgcccataatgtgtataaatctcatacttctcatcacagggaagtacaacaaggcattattattttgtttagtccccagcctttctttagcagcctctgcagaaactttgagggagaaggatgggactcacgtacagccctgtaacagagaattttaaaaatagaatgggtgcattttggtcttgggtttaattattgcatgtttgatggagttatgatgataagagcaagaagaggtgatagcacttctataatactcttttccttgttttgtattacataactaaaaagtgaaaatcctgtctacaccagtatatttgaaactacaatatgttatatgccaatatatgaaatctgattatatgcatgcatacatgtataaatgcatatgtgaactggaagaggtccttgactccctttgcaggatgtgtcacagacgtgtggctcatctgtttagccgctgtgcattcaaaccccttacaggagagggagcacgcagacaggcgggtttaagagctggggaaagtgctattgggctccggccccatggtagtgtcaaggggtggtgcctacgactcctgaagctccagtgggcatgctactgtgctcttttagctttgctgctcactgatggcttaagtgataaccagctcagtgccctcttggtacccaggttcttgtctggtgtccaggaagaatcagatcacacagacaaactgaaggatggtaaaggcgggggattttattcccggagggaggtagctctcagcagaatgaatgggagctggaaaggagatggactaggaagatcatcttcccctggagtttgaccatctcacagccattctcccctccaaccatcccctgctgaattactctcgacattcagacactcctctgccatgctgctcttctgcttctgtgctcatctgttcaaccatgcgtctgctcatggagcctggggtttggagtttatatgggtacaggataggggggtgtggcaggcccaaaagcaacatttaggcacaaaagctggaatgccagttcgcacttagcgctgcagttttctaggcttgagagtggggcctttgccagggaactgccctcttttacccagtatttcccttcctctgtagcatatgtgtctagatttcaatatatattgatacatgtatatgtatatgcataccacatcctgcatatgtgtctatgtatatgtacatgtatctatatacacacattccatgatgataagatataaatattatctactcaagaagaattgcatttgaaatcatcttttaatatcaacctttgcatttaataattatatgcatttgtgcattatagacattagagttgttagagttgttgcattagtgaatatatatatattcactaatgtatcagtaatatatatatatttaaaataaggaagagagtttctatctaaactatcttaagattgattttatttaatatttgtggaataaatgtattgttttgtttattaatatatttggaaatatttaaatcctgttgtcatatttgtcaatgttttctttctctcatatttagtaaactaactctgcgtatcatctacatacaggcaatggcatttggatatgtcacactaattaagtgctacattggatgtctcctcttaagttttcctcctgaatatttgatataagcctttcaaactgcagggaaaagtgacaacaaaccccagagctacactctgtgattgagagaatcagttatcccggtgtctctggaagcaaaatcaattcatgtgttctgtcatccttagaaagcactctctaacaggctgtcagcaataaattttacaggatttccccaaagtcaattgcttcttctatttgggattaagatgaaagcaaattgattctgcccatacacagaggaagcacgagagaagagatacttttagtctactcacttctttttttttttttttttttttttactgacagacttctcttgccacactaatgtaaggtccttagtaattgaaattctggctgtgaaatatactcaggcataaccaacttgaatgcaatttcccttagagttaccttccatgcaagtaggcaggaaatttacttctgagtaacttatttctgaacacattaaaaaataatcataaggcaactcttttcagtattttaactggaatgactgccaggatatcatattcaatttgattttaccatatcttctaaagtctagtgataataataattcgtgttttttctttaatcaaatttaaaacattcagaatcaacatttaacttttttaaatcatttttttcttaaaatgtaattttgtaatttttgtagtagatagagatggcatattaaaattaaaactaccataggtggattatgctggcatttaatcaagtgttattgagtctgactctagaaaaagtgtcagtttagaaatacattttcttatttcgtttggacagcttagaaatgtagatgagtttaagaaaattattccagctgaactagaattagaacttgttaaaggtctataaatatataaaatgtcaggtgggagtgaccaaaagttgcacttttggtgcaaacaagcaaacaaagaaaaatagaaactgatgacatattgtaaaaaccactaggtttctgttgacaaatatttatacaggtttctgatctcaattttgatgtttatacatagagtaacaattgaaatgtatgtttgtgaagtactaaagggtgcccagtgctaggttaaattccaagcagaacattatatgtctagattgaaatgccaatttactctctccctctctctctctgtctttctctttctgtgtgtgtttgtgtgtgtgtcggtgggagaaaaccatttatttatacaactacctactagcaagttgggataaaattgaaatataaacaacatggtatgggaatgaagaagcaggcaattaactatattgtgaggtttggtgaaaataatattagtcttaggtcttacaggatatgtaacatattaaaaatcaaggttaggacagtgctaatcatttcttgtaacatttataaaatctaatcagaatctagttaattaaacttgtactctcttgtgtcatcaattacagtttgctaccaaatttgttcaaagcttttgtgtatacatataagattttcacttgggagggaatgtgatagaacaaagaagaataaaaacttgtgattaaaaataatcatttaacattcaaagttttaaaatcaattaatctgtattatgtgaagataaaaatataaaagtttttcagtaacattaactctccaataaaacttcaaaaaataaatcacacaatccaaattcggtagaaccaacgacttcaaatgtctcaatataaagcagtataaggaattcatatatccttagaaaagaagggttttagatattatttgaaatacagtttgaaatttatagaaatatttatcaatttgtttttaataaataggtttatacagttgctgttactaataatccatggtctctgaagtaatttaaagtttcatttttttaattgtaaaattgaaaacacttgatctaaaaatacacacttttagttttgctgaattagatttaaatgtattttccaattgaaaagcaaaatatcattaatttctataaaacatcttctctttacaagaactaggctctaaaacaacctgaaaatccataacttattctcctcactctaggaagcacatgtttcttggactaggtgaggaatagtaatttcccctgcaggactttggttctcttcattcttaacagaaagtctgcagtttgcctttaggaactgtgtgccagcggctaagattttgaacatgagggcctccttcaatggacaactcttagtcctggcataagagggccaccccaggataaattacactggaggaaattgacgatgctttgtatctagaatttaatctctctgatcactaaaacaattcttatattcaaaattgatgctgatattacaaagatttctaaattaatatatgattaatctcatatatcaaagttatctctttattattgctttatgcaattttcttgtacatttttaaaatttagcagctatatttgcatttttatatagatattatcctttttatatgtaacataagagctaaaaagacaatgatctttccttcaaagaattatagcatgtctatctcatgtcaacacataaaaattatttttaattaaaactcatggtttgttaaaatgatgacttactgcaacatggactcttgagcaaagcaggttaaaaaactgcattggattgcaatctgtgtgcctctagacaagttttccaaaaagatctagtttcccaaactctaaaaggagaataacagtattctatttccaatacttcagagtacttatttacataaagtattcaaagtgtgtgtgaaactgtttgagacatctgaggcacccatggtaattgttgttaatacttttaattttataactgcctataataaaaagtaccaagcacgagtaaactgattttatctagcacacttatttgatacttttaaacttctttttttctttttttttttaaattataaattttagggtacatgtgcacaacttgcaggtttgttacatatatatacatgcgccatgttggtgtgctgcacccattaactcatcatttaacattaggtatatctcctaatgctatccctccccacttcgcccaccccacaacaggccctggtgtgtgatgttctccttcctgtgtccatgtgttctcatttattcacaagagcaaagacttggaaccaacccaaatgtccaacaatgatagactggattaagaaaatgtggcacatatacaccatggaatactatgcagccataaaaaatgatgagttcatgtcctttgtagggacatggatgaagctggaaaccatcattctcagcaaactatcacaaggacaaaaacccaaacactgaatgttctcactcataggtgggaattgaacaatgatacttttaaacttctaaaatatttataaaatatattaacctctgtattttagaaagtcgtttatatttataagtcaaatcaattgtccttctacattctataattaaataataactgccaccaccatcaagagaagtaattgtggaaaaaatgaaaacacaagtgcctttctcaatgctttgttaaattacgttcaattaaaatgattctgaacatttatggcatggctttggattaatgtcaaatgattatcaaagcaaatgactatcaaaatagttaaattactatatgtggatctcatattaaacaaatagtaaataagaaaatctaaaacacttgggagtttgatcagtatgagatgtgtctgtatctgcagtaccaattctaaatttttaaacactgttgaaagtattaaatatgagagtgccaaattattatggtttgaaagtttgtgtccctccaagatttacattgaaatttaatctctaatacaatagtattaagaggcggggccattaggagatgattagatgatgagtgctgcacccttatgagcgggattagtgccctcataaaagtgtcttcacatagcttttacctcattggcccttctgccttctgccatgtgaggatgcagtaacaaggccccatcttggaagcagagtacttgagcactcaccatatacttcacctgctgccaccttgatcttggacctcctagcctccaaaatggtgataaaataattttcttaaataaattacccagtctcaggtattttgttatagcagcacaaatgcactacgacaaatatgatactagttctttagcaaatttataaattatcaagctgttgatgctgttgaagtgatgttaaaagaatttgagaatcttataacaaaatcacaagctaaaatgtttcaattttaccctttatcctgtcaacatggataaaaataaaccccagttttcaaatttctaagcatttaagccattctcttcacaagaatacgtgtatgttcaactgtttcagtttctataagtcgttttaaaatgcaactaaaataatttttgcctcattatgaacattttttcattttttgcagtgaaacactgagaatgaataataaatatgttgaataggcaacatacgtgaacgttcaactctttcagtttctataagtagttttaaaatgtaactaaaacaactttttgcctcattatgaacatttctcattttttacagtgaaacactgagagtgaataataaagatgctgaataggcaacatacgtgaacctgccaaagaattaccacaatcagtaattgtatatttccctaaggagagattaacgcatactcagtcacgcctgctgaaagatgccatcaattctgtcataagaagctaaaattctcaaagccaatgtatattatttacagtttcttttacttggttgtgcttaaatgtgtaataaattgcatatacatttcgggctgtactataagctcatttgtcttcaattttcttttctgacttcctcaaatatgaagttaaatgcttaaagaatcgtagggaaaattatcaagtttagttaaaccaagaaggcagagtctgtagaagtttctgtgttttggtttatttatttttaaaatcactgaggcacttgcatcagtgtaagtgtatgtgtgtgtgttgtataatacatagctagcactttgatttcagctgtgtgagaggctaagcagaggcctcaatgtagccacctggacttctgaccttcagcactgtgaggcaagagatgggattgtttcaagcctgaaagtgtgtggtaatttgttaagcaacaatagaaaactaatactaatacaataacggtgaaaaaaaaagagaaaattgagaataaaaaactcattttcagtgggaagacaaaaaccaaccaaccaatcaaagaaagaaaaaaacaaaagacaaagataaaacagtagatcttgtgacaagcatatcgattacaccactatccattaggctttgaaaaaaaaaagttacatttacatagctaattatattagcacttattttctgatccctttaattttcttttactttttgagtttccaaataaacatcccaaaacatattagagccaattattttaagtttataataagactggagtttttggacaaattttatttcttaaggcacttttgtaaaaaataaataccagtgatagtatttacccatctaatactagtgatagtaatgtactggtgataatcttggtgtgcttgtaaatcaaaaagaaatacaatatgttaaatatataaatgatacttgatagaacataatatttttcttttaaaataaaataatatttaactttcttctctttttcacatattgccttttaacaaaactagggagagggtatatgcaaacaaagataattagtaaagtaagatttcgaagcaaattctaatactactagttattttgtgaaactctcatattataaaataaaataaaaaatacagtgtaatatccagaatgacctgttctttctcttttaaaaagtggaacaaggttttgaggacaaggatcttatcaaagttaatgccatattttggagatgagaaaaactctacagggaaaaatgaaacctttctaagagcctgacccatatacactcaagctcagatagaacagtgagcaatgaatttaccctccgctgtctatccttaaatttggggaatcacataatgtttggtcacccatttagaagtgctggggttagactgcaggtttgtcagaagccataactcagaggggaagatacaataagtcagcctttttcatttacttcacctcaggagaacaaaataattcataacgagcatgtctcagctcagactgaaattcaactgtgttaacatgaccgtgcccatagggtgaactaatggcaatgcgtgggttctgctaaaacacagccaccatgtggcttacctttttcactgattttttttttacattttttaaagatgacttttttttttttaaacagcgtatatgtacaaaggttttaaatccctaacaaagatatatattcttttaaaaatcggtcattttacttgcgtcccatttttgagatgctgatgttgcatctttagaatttctcttgatattccggcatttattttaggccaacatgttcttcatacgaataggggtgctgatgaaatgcacgaaatattttgagggcataagaaacaagaaaaattgggtcatctactctcagagtgtttttctcactgtgcataaagaaggtaaatataaccatacaaaaattcttgctgtgactttatgcttcaataccatagatatgtagtttatcacctgaaaagtacgtaattgtacagtttatattatctctgcattttagttccagtagcttgggatgtcttgtcctgtttgataaaataattaaaatgtcttttttctaactatctagtctgtctttactatgcaattaataacaatctgatgagccacaaaccacatatgtgcagcactacatctggcctatttttctgtatctgtgcagtaattatgagcttttcttttactcatgacttgtatagtgtgtgaaattaaggcaaaaatgtgcagactaaaacaatgtatgactgaatttaaaattatagcactctgtaccaattctttcatttccataacaaataaaatactacgtacgtgcgaataataagtaggtaggcctagcttataatttaagctaagctgttataatttaagaaacaatacaaagtgaacaaaggtgactgaataaattggttagaaaagtttaggagaataaatatgcccgcttaaagttcctgttttgttgtaagagatgagaaaacgtcacattaaactctgagaaactggaaattacacaaaagtactcatttaacaacgttcttttttccccaaatatttacatattacaataatgcaactatgcattaaagataataaaattaatgctttcaaaaatgtttcccttcacattgctaatggacatttgtggaaccttccaaataacgacagaattttatcacaggaaaatgctttaatgagaaaaaaaatgttctatccccctgcaaaattctatttttaaagttttatcatgtatttttgcaataatttccaatatataaaacctatactaatactaactgctatttgtacatttatatgaacctgtttattccttctgttttcaagttttgtaataatgatcaaatcttcttaaatatatggaaattcattgagagtgatttgagtttgagtgtctgtatacatacatctatatttttagcttgctagagaagacctgaaggcaattttaagttaatactcttctaagtcagaattttccaagtgaaagttggagaaaccaaatcctgagagataatctctgaaggaatgaaaatgagaccgttttgccatgattcctgggttcagtaaggaaaatggaaactaccacatctcctgctggatgatttcactttgtattactattttaggcactgaaaatcctgcacacactacttaactctaattctcaacttatttgactagtgtacatatttttcatttaaataaatttattaatattcacacgcaatatttttaaaaatgatatccggtgttatatgatggaattatttctttggggaaaagattatatttatccttgcataagatacacttaaaagacttttttttttaatttagatattccagtaccataagttacacatgtagtttaggaaattgttaagaggaaaaaagtttaaatagaaaaaatattttataagaagatgacgggtttatataacagtagagtacattattaaaatagtactgtgcaaaaatgtctataaactgcattaatccctgtgaactaaattggattcagcaacactaaattattaatcatgttaatctaattataatataacatgaaatcttcaaaaatgtagtgacaattagtttaaatttctatttgacattcactcatagtagccctttcaacaatcagagaaatttgttccagagaaaataatattcatggacactcaacatatccttaattaatgctccatgatcaaatggtcctatgggaaaaattaatgtgaaactcaagataaatttctagcaaaatttagaagcactctataaactcatcacccctgtaatttgtgattattgcatttgtgattcatatgattcatatactgacatagaaagctgatgaaatatgtatattaagcaaaattgagataaattatgggttcgctaaatcaaaattcaatctcagtaaaaaacaaacaaacaaaagcctgactgtaaggacaaaaaatattgtgaaataccaaaacctggtataaataaatcaactacataaattatattaacaacccaaatatatatgcaaagacgttaaaatatttagttaaatataaattcaaatgagtctcccctataatttggccatcaaaaatcctggtgccagttcaggttgcattggaataagctaacatttattcaatgtattctatgcatgagataaaattctatgcccctcactgcattaaatcagttgttattcaaaatacacttacggggttggtatcatgatctccattttagagctcttaaaactaaggcataaagaatctctttaattttcctgcaggtcaaggaccatgtcagttttatttacatctctgtatatccacttgtagaataaggactgacgtagagttgcggacttcatgaatatatttgaaataatacatggcttgaggaaatctaacataagcaagatgacttccacacatagacagcaattatgataagtaataattggtagatttttccagtacaattgtcaacataattataaaaataatttttaaaaaccgcagaggaatatctgttgaaaatgtttagaaaaaaattatattacattatttcattatggtgattactatatatttaacattatgaagtgtgaaatactacattataaaattaaataaacgatgtcaaaactaaatgaaagatttattagactcatttgacctaatgttagatgcctgtttattttctggaggaaaattattttctgtataagtaaaagaataattgggaataagttgtaaaataaccagatgcatttgtactttattgtctaaaatgttttaatattaaaattatcaatctatatctacatagatactccatgctcagtgttaatttttgtatgtggaaaactgaaagacaactggtagttaaagaaatgctgcttcttatcagtaaatttcattcgtgttggttagacagtattagcttatatgaatagatctgagaatagattccttgctatcaattaagagattataagttttcattaaaaagagtaaatttctttgatcttaaaaatgttgaaggttattaaatatgtatgtaagttatagatggatagagagaatggatcagggtattaacataaaaaagggcattcttctggaaatgaaaatcatttctcatggaaatgggtaattgggtaagagaagtgtgaggaagttgacctacgagagaagtgtgttgttacaatgggaagaatagttaatattgtggtgaaagtttaagaacatttaaatttaagttcttaataacacagaactttagatttttaatactgagcaatgagatattgtaacacagaatatgtgacacagaaagcactgatttaatatttttcattgtattgctatgcaggaagagaaaaagactgtattcaagtagatcttaggctagtgagaaaagttaagtagaatgtaacaatgacatttagcaggactagaacaagacacaagtattattcatcagtattttacagaaaataaaatgtattttttttgacacagggtcttgctctgtcacccaggctggagtgcagtggtataaacatagctccctacagcctcagcctctggggttcaagtgatcctccttcctcagcctcctgactggctgaaaccacagtcatgtccccacgcctgtatgatttttattattattattattattattattattattattattattattattttctctagagacggggtctcatcaggtatcccaggctggtcttgaagccctgggctcaagcaatcctcctgctttggccttccatagttttgggattacaggcatacgccaccacacctggcaaataatgtaaattttgataatccattgtaaaagataaaatgatgaaaatgataaaacatctcctgatgtccatcctgggggaatagataaaatattacaccacgagccaatgaagaacacgtgactaaaaaaggatttcccgaggaaattatggccattgaatctggacaggttgaacttgtggtataggtaaaaattttaagatagttgttttataagtagacagaaacagcactatgtctatccttcaaatatcaatttcactcagctaacctcccaaaagacaactgatttttggcaaagtgttcttcatccaaagagaactaggatatttcagtgtcacagaagtaatagtaagggtcagggaagagattcaagaagtgagtgcacaaactgggaaatagaattgagattaataacttatacaagctattatattataattaataaaaaagttacctgtggccttgtctaagtttctgttggataatggagaaaagatatataaagaggacaaatgtatcaaaggaaaaattaattcagcatcaaataaatcattcagctttaaattatggtgagaatttggcacttaaacgtatttggtgttttttaagtgttgaaataatctcaataaagtttttaattcaattacaatttcttaatttattatgcttgccaaacatattaacatatgtgtttgttattaaatatgttatttataaattagcaattaaaatttcagctaagaaaattattttattcaccaaaactaaatttataaatgacaaaaataaatactatgatgtatatctttatgttgactcaatattacatgatattttatctgtaaaaaactgatcaaaatatactttattatgtaaaattgcagttgaacaaattcgtggtggcatacttcatagtcaatattaacttttatgtggtagtaaataaatataatacttaatcagttaattattaaaatagattatatattgttttctccttaaaactataaaaacatatttaagcaatttaaaatataattaatttcatgagacttataatcacaatgaatatatatgttatatatatatatatatacacacacacacacacacacacatacacacacataaactgatttgctaatcatgagctacaaaaccacaggagtaacattcaaagtagttaaacaggctacataaatattataactgattatatatatattatttgccaatttaaacagataaaattacacaaatgtttattctatcaaaatgtttaggtatctttctactcaaatattctgctttacaaagttttatatattttcatatcttcataatgatgaaatattttaccaatatattaagatgcagtctgatgattttctaaccttctgatataccaatgaagtatcaccaggtatcatctgatataccaaatggcatcaaacaaatgccatttaccatttattttctatgctagagggatattttagttgtatttcttactctctagccatgtggcctgcccgataaaaaataagtttagacatattttcagatatttagtttaaccaataataatagaactaataaaaaaactataaaaaactccttaattttctctcaaaatcatagtcagtatacatatttacgtgggataatgacaaagcctttttcactgtaaaataaaaattcacatatttgagatgggacaaatctgaaataattgcttgggcagttacaaattaaacagcattctatgcaattacattttattttaactattcattttgaatgagacaatattaagctattctctgtgagtctgtgagtgtttggtatttgaatgctcttgtgaaagtattcatttgaacatatatttttatattattttcactcaaacttctaaagtggcataaagtcctcattaatagtctattagtttctatgactcttattagcattaaaaaacaaataagatgataataaacatccgcttatattaaaagtttctctgttttagggcactatgatcaaaagacctgttataggaatttaaaatgtaaatgctatgcatttaattaagaagagataactgtctatcaagcatggctgcagagacttatcaagtcagtatcatataaaataataaaaaatgtatcagtttcgcttcattttgaataaaataagtgagagtcaaaagagctcagtgtggtttaaaagatgtgtgaatgagtttttattttagtaattgaaaatagtcttgtaatgaatgatgtttcttaattaattgtgaaaaataagaaatgaaggtgacttcaaggtgcattgtcatgatgttccctgactggatgacatctcagccatgaaacattcatactagtgcaagcatgtatatccttgtgttaacacttcatccacagaaacaagtactttatccatataactggtttcaaagcaggccattgttctgtactatattataattcttgagattatattaaaataaggaataaaatattatacataaatctaaatctgaaatatggttcttttcccacttagtcagctttccatgatacttcaacttcaacacacactctgtgtctatgtggacattcataccataaagtaactaaatattcagagcataatgattacttccaacttgatttgtacaatctcacttatatatataatatatattatataatatatcatacattatatataatatcatatatcatatatatcataataatacaatataatataatatatgatgtaatataattatatataatatatgtttaactatatgatatatattatatataaaatattatattatatattattctattaaatattatataatatatatattttttgagatggagtttcattcttcttgcccaggctggagtgcagtggggtgatctcggctcactacaacctccgcttcccaggttcaagtgattctcctgcctcagccgcctgagtagctgggattacaggcacatgccaccacatctggctaatttgtattcttagcagagacggggtttctccatgttggtcagattggtctcaaactcctgacctcaggtgatcctcccgtctcggcctcccaaagtgctgggattacaggcgtgagccactgcacccaacctctcattgatactaatgttcactttgcctgagaaagaagagaggcaacatttgttactggaaaatttagtatctcattaatagatctatctttatatctgtttatccattagacaagagcaaagaggttccaggataacaagaagggcaaggaaatacccagcaatgactttactcatgtattcattactcagtaactatttcctctgtgcatcgtacatactatatgcaaggctttttacaattatatcaaatacaatggttaacacaacagaaacaaagaaaacaacaaaaacagaatcaaattttatgttatagatcttaacatctagtggggatgtgagtgaagactcatgagtttgcatttctaacaagttccaaagcgatgctgatactaccagttcagggtcccagaactgaaaagtgaacctgaacacatctggaagtcccatttgacatgaggtctttagaatgagtgggaatgaactaggaaaaagaggtgtagattgccctacagatctgggaaacaatactcatagagaaaattttgtgcatagaactagcaggaaaggaaaaaataaggcttatattggtaactctatgaagataatgtctttcagtaaaagttgctaaacagttttttttcagataaacatggaaacgattcaatggcataaggtaaatgaagagtaaaataaattgtggttttcatatgaaaattctaagcaacagaaaattctgttagtgaaaagagaaaagtacattcaaaaacagcgtatctgcatagattttaaataacacaaatactggttataaatgacggcaaataatggaagccaaaattttgtgttactgcactgaggcaaagattaggaaatgaaggggctcctgtgccatgcaggacaaatgtaacgtttatctctaaggattggagaatattgaagaattgtttaagtagctgtataacatgatcgatttatattaaaaagctcattctagctttgtgtgaatatgaaggctatggctgcgggtggaaatggcaatactttttaaaagcttccagagattattatatcctttgaagtctatcccaggacctctgctcaccaggtaagatgaattcaggagaccaagctgaacgacaagatcaactggggaacactgcagcacttctggagcaaaatgacaaatgaccattaatgtattattaatgggaataaagaagagttgacagactcaaaatgcattgcagaaattacaccatttttgatgatgctagactaaatataaggaagtgaaataaaaggaaaagtctagaagaatgtctagtttattttgtggctaaaccaaatgtataagtgatgaaaaagaaaattttaaaaataggaaatgatgagtatctagttattagttcagtttagtgcatgtcatgagtttcagtatttgtatatatgtatgtagagataagtagtaagcacttagacaccacctgaaatttattagaggtttataggtaagaaataaaaatttgtttaagaaattacgttattcaagtaatttatcaaactgagaagagggtaaagttcagggacagggactgagcagtcaattaaggagaaaactgatgagaatttatgtgctctcaggtcaccaccttctgtgcttttgtttcatccaatctaagattatttaaatagaatttgctcttccagttaaagtagaaggtaattaagaaaaaataacacaatacattgtaatgcataaaagtattgttttccatatatttcacataaatataccattgatagtcaacttgcttaattagttaaaagatgctttttcatttgctaatactttactagaattctaattatctacatttgatattaagttaattgtgtttttcatatctgactcctctgtggttctgtttagagttccaaatatggataaaattcacctgatgagaattgctgaatcttgtattcttagtattaggttacatcattttgacatgggaatttgtcaaataggatttttaaaaccgaatcaatttaattctaagtaactcaatatctagatttaccttggctggatatgatggataaactggatcatgaaaaagaaaacaaatacaatctaggaaagagagtaaaggcagaaaagtcatgtgtacaatggagaaacctaattttgaaaattaaatgcaaagacctagaaatggctattcatctagcccaattcataaggcaggccaaaagcattactcgagatgccctttatgcacaatgcacctgattcctttgtatcacaagatagtcaccaccagtgatgcaacaagaaatactggcatgtaggaacaattcctaggtattcacagtcaatgcaaatacagatgatacattattatttcatggtataaactgagctaccctccatccccaaaagctaaacaatatgttgtttttgaaaatattacgaagcattaaatactggtaaaatctcagtgattggagctgtgttcacaaagccactgtagaatccaattccacagctgcatcctgatacagaacaaacaatatttaggctgatttctttgtgagaatatcagcatcccctagttataagaggccaaaggcagagtttgctgcacaggcactactgattagctgagtgaggtccagcaagtattctcacttttttatgttccagtttactcatcaataaaatacaaattataatctgctaacatttacagaacttctgtgagaactgacttaaagcacttagaaaaggacttagtaaattaacaataacagttttatgagtggaattggattacttcataaatcttatcctgatgatgactttgtgactaaaaagtttaagaataaattataactcattttctctgaaataaactgatttgttcacacaactttttatctatgtaattcctgtaaatattctaatcctcacaaatgttaaggaaggaccaaacaacttagtaaaattttctccactggtctatggtattaatatcctaacagctttttaaaaaaatttatgaaaaaatcagctccataggaatagtgatgtcagtgaaaaagaacaatataataacaacagtataagtattatctgtcagggagaggagaagctgtaagaaatattctgtcaataactgctttaaaaaataaaaatacaattttattgtgatagaaatattgtcaataataatatttgatgatagtgtttgttttccatctcttggtcagaaatattttaagtgtcagattttgaaacttaaatcctattattatagacaataataaagacctctcaatccagttattttcagaaatgaccttttcttaagacacatattcatttataattaaatcagaaatgtctttaggtgatgctcacctgcattcaatcaaggacaagaaaatatttatttcatttaagataaaacaatggtttgtgacattagtgaattactttttttctgatttgagacattgaggaaatgagagataatccagggagagctgtctttacaccatgctttattctgtttttgttgttgagaaacttattagactgccaggaattactaggaattgtcaggttaaatatcatcagaaactaaactattgactaaggattaagagtttataggtttagaaaatatttaaaaatcacaataaccatttaaaacagataatttacatgtttgtaagctatttattttagcaaataaagttatattttattaataagtcttgataatgatagtttggaaatgttatagttctagactatatccagactttatctgattttaagctttcttaacttaggcctaaactaaggtaaaccttcaaaaataaaaaataaaatctttaaagtaaactaacgtaaagcataaatttggaaagaattataaatcatcagatatatttagtggttgtttctttagacattaaatccaactatctctataaaatgttttactagaatattcttttaattaaatcaagtaacttcaaccagctttctgtattttatattttcattctttgaatttcaaaagcatatcatatttttgtaattggaatgtttaaaatggattgataatgcaccctgcaacatactctttacaattataaacacatttaattctcataataaagctgtgaaagggctgctattattgtctcctttttacagggaaaactgactcattgacaggttagtaagtttcaggctaagttgacctagcctgaaagtgtgaattcagacgagggtccaagcagtcttacttcacaactattatataaaccacatctttatttttttaatcacatctttaaagaaataagtcacctaaacaaatcaaatttaacacaatcctcacaaactgaatagaaaattgagataaacaagataatttttctagattactaccttcttttatttttttgtcccaggtagcaatagaaaaaacaatgataacctcctacatttatgtgttagtgaatttggtgaggaataaggaccaaacttaatggataaaaaacaagaaatgtttttcactagaatatgcaaatgagagttcagtaaattagaagttgactttgcaaaatgaaagacctgtattaaaactttttgtcacttaaggattcaataaaaaatttgcaaaaatttattgtgaaaccaaagaaatttaaaaagggaaataacaaagaaaaagagaaaacctattggcatttctccacaatttatctaaatgtttagcttctgcaataaaatattttgtctcactttctttcttttttaaaataatgtttaggaattttttctaacaatttttccttcggatggaggttattatttgtacctgcttgtcttaatattaactatatgcatcactagtctattgactcttaaatacaataaatctaatggtaagtagtcaattgacatcacagactttatacatacaacagggcataaaaagggtataagatgtgtcaactattaatatgcattaaatatagttaaatatttgataattcagtatagacatatgcatataaataaaactttattgttgatttgaaaagtctagaaagcttccaaataatattttataatctgttggtagcaaaaacttaaatttggaaggattcttagctttttaacacaccggtttatcgttacacaaatctagaccattgacattcaagagaaagcaaaaatccaatccagaaaattgaaggatggcaataaaacaatacaagagataaaagaagaaacggtcatttatcacgggaaattcagcccccaatatttcatgtgggtccttttctattttccctaagtgtcagcctgtctgagaaataaagggaaagagtacaaaagagagaaattttaaaactgggtgtctgggggagacatcacatgtcggcaggttccgtgacgcccctgagccgtaaaaccagcaagtttttattagtgattttcaaaaggggagggagtgtacgaatagggtgtgggtcacagagatcacatgcttcacaaggtaataaaatatcacaaggcaaatggaggcagggcaagatcgcaggactggggcgaaattaaaattgctaatgaagttttgggcatgcattgtcattgataatttttatcaggagactgggtttgagagcagacaaccggtatgaccaaaatttatcaggcaggaatttcctagtcctaataagcctgggagcgctactggagaccggggcttatttcatcccttaacgacaaacgtaaaagacagatgtccccaatggagccatttcagaggcctccccttaggaacgcattctctttctcagggatgttccttgctgagaaaaagaattcagcaatatttttcctatttgcttttgaaagaagagaaatatggctctgttccgcctggcccacaggcagccagactttaaggttatctcccttgttccctgaacatcactcttatcctgttcttttttcaaggtgcccagatttcatattgtttaaacaatttgtgcatttaacacaatcatcacagggtcctgaggcgacattcatcctcagcttacgaagatgacaggattaagagattaaagacaggcataggaaatcacaagagtattgattggggaagtgataagtgtccatgaaatcttcacaatttatgttcagagattgaagtaaagacaggtgtgagaaattataaaagtattaatttggggaactaataaacgtccatgaaatcttcacaatttatgttcttctgacatggcttcagcctgtccctccattcggggtccctgacttcctgcaacaatcattaaaaaaaaaaagtaaacaaaagcagtgatctgatagagctgaaaaactcacttcaataatttcataacacaatcacaagtactaaaagcaacatggaccaggatgaggaaagaatctcagtgcttgaagactggtctctgaaataacacagtcagacaaaaaataaagaataaaaaataaagataaaacaaaacctatgagaaatatgggattacataaccctatcaaatctacgactcattggcatccctgaaagagcagagaaagcaagcaactttaaaacttttttgagaatattattcataaaaattaccccaacttcgctaaagaggtaatcattcaaattgaacaaatgcagagaatccctgtgagatactatataagatgactgttcctattatgggtagttagacaggcaggagcagggcaggagaggactcttccccaaatctaggaatgtcagcaatggtttggcaattatcacattgcctctctaaaaagtcataaattggcagccagcaccagggagaggccatttcctgatgatccacagctgttaatattaacgtgttaattgaattcaggtgccagggagtagcaaaaagggcttccaataaaatctcaggtaatggtctcatgagcccaggcgtgcacattaagagaaaaaatggcagggtatgaccttctgtcagcaatccaccgggaaagtgaggagtatctcagatgaacatacatacaacttcttaaacacactgtgcatgctcacttcccaagggcaagaagcacactgtgcatgcaggcagcccaccctaagggaaaaatcacaagaaaggggccagcctatagagtcctaggatccaggttaaacaccacacttgttatttaagctgctcactgagtctcttccaagcatactttcctttctttcttgttctaaagccttttaaaataaacttccactcctgctctaaaacttcccttggtctctttttctcccttatgcccttcagtcaaaataaaaaatctgaggaggcaagaattgaggttgctttagacacgtatggatttgctgccggtaatttgaatatttgccactggtaacattcccaagacacagagtcatcagattctccaaggccaaaatgaaagaaaaaatgttaaatgcagctattgggaagagtaaggtcatctacaaaggggactgcatcaggctaacagtgtaactttcagcagaaaccatacaagccagaagcgattggggatgtgttttcagtattcttaaagaaaagaaattccacccaagaatttcatatccagccaaactaagcctcataagctaggaagaaataagatccatttcaaagaagcaaatgctaacggaattcattaccaccagaactgccttaaagaagatccttaaaggagtactaaatacagaaatttaataaaagactattactggtcgccacaaaaacacatttaagtacatagtccattgatactataaagcaaccaaacaatcaagtctgtataacaaacagctaacaacacaacggcagtatcaaagccacacatgccaatattaacgttgaagataaacagggtaaatgccccaattaaaaggaacagagtggcaagttgaatgaagaagcaagtccaaagtgtatcctgtcttcaagagaccaatgtcacatgcaatgacaaccgtaaactaaaaaaaaaaggagacagaaaaatctaccaagcaaatgagaaacagaaggcaggtgttagcaaagatatttgagacctaattactcatatttgagacctaaaaactaacaaagatatttgataactaatttcagacaaaacatactgtaaagcaacaatgatcaaaagacaagaagggcattacaccatggtaaagggttcaatttgacaagcagacctaacttctcttagtgtgtgtaaatcaaattaaatatatatgttatatatataaaacacaggagaaccaagattcataaagaaagttcttagagacctacaaagacttaatagtggagacttcaacacatcactgacagtaatagacagatcatcgaggcagaaaattaacaaagatatttgagatctaaagataatagttgaccaaatgtgactaatggacatcagtagaatgctccaccccaaaaccacagaatatatattcttctcatctgcagatagcacatgctctatattgatcacacaatcaaacataaaacaatcctcagcaaatcaaaaaaaaaaaacactgaaatcacagcaaacacactctcggacaacagtgcaatagaagtataaataaatactagaaaaatcacttaaaaccatgcaattacatggaaattaatcaacttacacctacctaaaggacatttaggtaaacaatacaattaagatggtaattcagaaattatttgaaactgatgagaagatacaacatacccaaatcactgggacacaggtaaagcagtgttaagagggaagattatagctcttaatgcctacatcaaagagctagaaagatctcaaattaacaatctactgtcacacttagagaaaccagagaaaaaagatcaaaccaatcacagagctggcagaagacaaaaaaatcaccaaactcacagaaataccaaataccttcctagactactatgaacacttccatgcacacaacctgtaaaacctagaaaaaaaatgataaattcctggaaacctacaacctcccaagactcgaccaggaagaaattaaatccctgaccagatgaattatgagttctgaaattgattcagtaataaaaagcctaccaatcagaaaatgtccaggaccagatggattcacagcgagtttctaccaaatgtataaagagttgttaccattcctactgaaagtattccaaaaaattcaggaggagggactcttccctaactcatttcatgaggtttgcataattctgatatcaaaaccagacagagacacaatggaaaaagaaaacatgagaccaatatccttgatgaacataaatgtaaaaatcctcaacaaaatactaacaaaccaacttcagcagcacttcaaaaagctaatctgccacaatcaagtaggctttacctctggaatgcaaatttggttcaacatatcaatacaaatcaataaatgtgattcatcacataaacagaactaaaagcaaaaaaccacatgatcatctcaatagatgcagaaaagtcttttgatacacttcaacaccccttcatgttgaaaattctcaacaaactaggcattgaaggaacatacttcaaaataatagaagccatctatgaaaaatccacagccaacatcatatggaataggcaaaagctaaaaaaattccccttgaaaaccaggacaagacaagcatgcctgctcttgccactcctattcaacatagtactggaagtcctaaccagtgcaatcaggaaagagaaagaaataaaagacatccaaatgagactagaggaagtccaattatctctctttgcagatgatatgattctatacctaaaaatccctaaagactccaccaaaaggctcctagaactgatatatgacttcggtaaagtttcaatgtataaaaatcagtagcatttctatatatcaattatgttgaagctgagagccaaatgaataatgcaatcccatttctagcagccacaagtagaataaaatatctaataatacagctaagtgtagaggcggaagatctctacaaagagaactataaaatactgctgaaagaaatcagagatgacacaaacaaatggaaaaacattccatactcatggataggaataattgatattgttaaaatggccatactgctcaaagccatttacagattcaatattatttctaccaaactaccaatgtcatttttcacagcattagagaaaactattttaaaattcatatggagccaaaaaagcccaaataaccaaagcaatcctaattaaaaagagcaaagccagaggtatcccattatccaacttcaaactatactaaaaggataaagtaaccaaaactgtatggtaatgttacaaaaacagatacatagaccaatggaaaagaatagagagctgcacatgtaccgccatctgatctttgacaaatttgacaaaaacaagccatgtggaaaggattccctatacaataaatggtgttgtgataactgcctagccatatgcagaagattgaaactggattacttccttacaccatataaaaaaatcaactcaagatgaattaaatacttaaatgtaaaacctaaaactttaaaaaccctggaagaaaacttggaaaataccatttttgacataggatctggcaaagatttcatgattaatatgccaaaatcaattgcaacaaaaacaaaaattggcaagtgggactaattaaactaaagaacatctgcacagcaaaacaaaataaacagagtaaacatacaacttatataatttgataaatatttgcaaactgtgcatctaataaatgtataatagccagaatccataaataagtaagaagcaaaaaacacacaaaccctattacaaagagggcaaaggatgtgaacagatacttttcgaaagaggacatacatgtggccaacaagcatatgaaaaaaatactcaaaatcactcatcattagagaaatgcaaatcaaaaccataatgaggcaccatctcacaccagacagaataaaaaaattacaaagtctaaaaatatgctggtgaggttgcagagaaaagggaatgcttacacgcactgctgctgggaatgtgaattagtttggccattgcggaaagcaatttggtgatttttcaaagaacttaataaggaattaccattcaaccaaacaatcccattatttggtacatacccaaaggaatataaattattctactataaagacacattcatgtatatgttcatcatagcactatttataatagcgatgacgtggaatcaacctaaatgtccatcaatggcagactaaaaaaagaaaatatggtacatatacgccatggaacactatgccaccttaaaaagaacaagatcatgttctttgcagcaacacggatagaactggaggccattatcctaagcaaactaatgaatgaacagaaaaccaaatactgcattttctcacttataagtggaagcttaacatggggtacacacgaacacatgacttaagagcgcaaggtgggagtagacagaggatcaaaaactacctatcaggtactatgctgattgcctaaatgacgaaataatctgtacaccaagccctcatgacatgcaatttacccatataaaaaacctgaacatttacccttgagcctaaaacaaaagtaaaaataaaaataaagtccttttagttgaatagttttattacagatgcagtcctctttatttattatttattttaataactaaaaactactttcttatattgtggcagtgtctcaaaaacaacctaaagattggctgcttttccaacattatgacatcttttaccttgtcaatagctgaaatgccaaccaggaaaataccttaataaataactgagtaataaggtaaacaaatgtaagaaccaaaatgaccccttgatgttgagtagccctacaaacccagtctagctgggctgttacctgagagagagagataatcttctcttatttaatctgcaatttttttcacttactgtgctgcatcatataaatatttaccctaacctgttatagaatattcacctttacctcaattatttgtcatatcataaaaaaaatctctgtggtcatcatttctaatgatcatgtagtctattatataaacatgtgataaattattttgctacttccccttgtttaaagatttaggctgttttttaagtctttgctcttatactcaataccacagaaagtatctttggtcataaattttctttaagtttctgagtagttctttaagattgagtcctagaagaggtgtaaaagaacttaggacacttgatacatatgaccatttggaagctattatttctcaactccaaatctctctttatttaagcctttatttatactttgattcctgaagctaagacttagactttgtaaaccatatttcttctttgacagctgctccctcttcaattctgccaacaggcacactagagggggaaaggaacactggaggagggaaaagtcttcgctgcttcttgtttcttattctcatcagcatcatttatcatcttgactgcactactttcctcctgtttccctttctgtttttgtttttgtcctttggcactctcagaaccagctcattgtactccttaaagacatcagcccctgtaaggtagcactggtccttagaggtcaaagtcaccctccatgaggtccttcttttttgcttctaagacaccaccttcagctgaatggtaccccatccttttcccattgctgagtcacagagtgggctgagtcctctctcttctaagcttttatgttctattaactccagtcaatttttgttgttgtttcccagctccaggaagcagagggcagagagtgtaactggtctctctttcactctttgtgagttactcaatgtcttttggttgttgttggtcttttcaattctctaaaatgtctttgacagactccttatcttactttctctctgttaaaataaatgatgggataatatttgcccaaaaagcaaggcattgattgatactatcaaattcctttatatatgcaggacatgaagtgttagtttcatccagccatcttaagcagtatcagctaactaaattgataaatgaaaggatcgtaattatataggtgaagaaatgcatcactgttgctttgaagtgacttttactactacgggagttaattatcttttatacatgtattattcatcatatcttccaatactttactgctttgaaagttctttccttttttatagatttgaacaatatgcacatattatctccatttttacagaacatatatatatattcaatatataaaatgttcaaagttcaacatataactctatctatctatctatctatctagactttaaattttctgaaatttgtgttctgcaagtgatcaacagacctctgtgcaaataggaaacaaagcctaatctgacattgttgcttaaaggaatttctcatggtttcttagcaattctgtttcatattttatgtaattaaaaaccatactgtagtattttaatagtttttgccatattctatttttctaatatatgctgtgtttcttagacagttgattactattgtcatccatatggcctcttctgcagcttcatagatacccatgctggtttaatcctgataactgtttaaatttttctcctgcatattatgtgtttgtgattgtggtcttgctaggatggggattaaataaaagagggtagtgtttgactctggctaatggactttaagatgttagattgttttaaaattccacttttcaaccttacttgttttgtgattttaaagggatcatttaaagtctctgattttgggtttatttaagagtaatctgataatgggcatttattacaagcagaatgggtggtagttattaaaattatttgatatgtttggaaactttgaattcatctggcttcatctttgatgatcctcaactttgcacttgaaacatcatctgtaagagctttccaatacacactcattacaattttacttaggcacattctttaatcttcctctgagataattcctctctatatatattgttcacacgtgtcccctgtttcactgtttctcaaaccactatgcagatttcttaggcagtgcctgcatcgccaggaaacttgaatgcctgtaggtcaactagactctctagagaactaggaactggcacataatgaatgagtgaggaaagattattgagctgctctaatcctcagagttgttttatatctttgtcatcctttccttttatatcaacttctccgtgcccccagttcatttgattttcctttctatagtttctaattgtttgtttttcatgacattttcccatccagctgagaaatctctcatatttttagcaaaaaatcatagacaaatgtctactatttttactttaaccatgggagaatttaggcaggaatataagctgcatttcacacaaatatctattaatcattttcaaaatcctataaatatatgatcttatttaaaaatcatagcatttaatttatacatttttctaccaaatatatatgaattaaaattgtatttaatatttaatattaggaattaacatacacaccaacatgccaattaaaagagaaagaattgagggaaaaagaaaatgtcactaataaaatatcatttttaataaaataagtttaacttagccatataactaaatttatatgtataatatatattaaaatatatgtacagaaataataaaatacagaatagcaatatgtaaactatagctttttttcagatacaaagagattttttaatttaatttttagagtcttctacattttttagattttcttcaataaaactacatgtttaaaaacaatgttaatttttaaaattgaaaaccctgtaatttggaattggatatatttttactctgagaaataaaaagtgaatgaaagagagaggcagaaagaaagaatattgccttaaagaataaataatatttattgatttcccacaattgaagtttcgagaggtagatcctattttattataaagctcaaaaatgtgtcgtcaagtatcttttatctttccattccttattacagcttttttgtagacctgacacttctcaggttgtaatatggctgtaaaaattttccagagtcacatacttttttattcatgttcaaaaggaaggaatattgtagggataaattaaagattctgactgaatggcttacgtgacatgtcctaacctgaaacaactgatgggattcgttaagatcatgtgctccataactgaatcttgcactttaacctacttctgtggaaccaaagagaaatcaaggccctctcagaagcagatatttatactacgatacaaatacaaatgtcaagtagggaaaatgaaatatctctatgaattacaatagctgtagccaaacaatcagaaacctcagtgacttagcatgttaaatgcttttaaatatatttgtagcacagtccagtgctggtcaggtgactctactagacacctttcctctactagacaccttccctccagggaccacaattgtctttattttatgactacacaatctgggacacattggttccaaagtcactctgtacaggttattattcctgttgttctcatttccagcccttttctgccttggtgcgttattaggaacaacttcctttctgactgtctcccaccctttccctcatgggaggtgctgtcagaagactgatgtgtgggaaaatattagttgccaggattttttccccatctctttgtgctttgggtggcatcctcaggatggccacatttcctccacagatatagacgcatccaggcagcatgccctggttggatccagttttcaattccctgactcatgagctccttctgccttggttactccagctctctcttacatcattgtcccatttggctttggtgctattacatcacctgtgtaaacaatgtttgatgttaagttccatctttttgaagagagagagtctcagaacggacactgacaaatcgaccaatggaagcaggagaggtggctggaggatcacacaggatatttttaagttccagtctcagaaataatatatagactttcttccacactccatttgaattatagccccaaactgactgcaaaggagaatgggaaattttacatgtgccagaaagaagaaagtggtttggtgagcataaagtattgtatgctatatctaataaattcctagaagtgtgggtagtcaactgacaggatacttgtaatatgaataaattaattaattcatactaatatgtatttgatattattgttagttctgatataatgcaaaatatatacaaattcttaaaaaccagcacgcaataaaacatttcaaagtaaaaatcataggacttatgggaaaaatagagtcaaggacatgacactaaaaaactttgtactatgataaataagacaaactttaagaacttagtaaaaagagtttccaagtgttaaatgatttaaaaattcaccaatattgcaataaatatggtaccttaccttgcaaaaacctgaagtttttatgtgatagtaggttttggaagagttacagcttgtgaattgttaagtaatggaaggaaagttgttcaaaatttgatggaaagttggaacaccagatatggatgttggtggctcattacacatgcaatgagatagccagcgtagatgtttaaaatgcctatttatgtgcgcgcacctacaaatacatacattttgtgtattcagtgggatgcagttgtctgtgttcacctagtgtttcttatggatgaaattgtgtgtaaacgaatgtagaattttgtggcaaatgtgttttgtgttccgcaactgtggaacacattgtgttttcagaacaagatttacagctgaactcattgtacttcaagttcattaaatcactacttttcacaatgtcacagtaaaacatgggacttgtaattgcaactagaaatataacaaaatatcttcccaaccaaaaaaaaataaaaaattattatatgctagtattgagaatttgtgaaggaaactgtgttggaatttaataacattacaacacgggaatagtttcaaaatggctgactaagacatctagcactaacctcctccacaaagaaaaaccaacatgacaagtggatgatcactttaagtagagtatctaagaagtaacactggaattcagcaaagaagtgacaggaagcacctgagacactgaaagaaagggaagcaaagcaactaatttggctgtgatcagctgggagcctggaaaggctccccactgtgtggagcagttccagacgtggagaggtccttgatgccggcatgctgtgagactggcttggggagctacctgaagagagtgtgatggcattgctccgggagggagtgatgctccacttggtcccacacacctgctaagagataagaagttgcatcccagagccattttgaaagaccagcctccatcagaatgcatcctgttctgaggccaaatagcccctgcatctcagtcactggagttcactgacattcctccccttgcacacttgtcttacattcacacagaggactacagtggcatgacatcagttacacccactggaatggcagggtccccagcactctagtatacacagcgtcctgtatcttggggaatgggccatgcagcaaacttcgttggcataggacaagggagccatagcacatgctccccagagcctgaaaccctcctgcctgggactgctaccactgaaagcaagcctacctccaccagcagtggcagggctccagtgcagtttcacatgccttagagactagacgtccctgttggtgccactgctgcagccactgccgccatctccagagcatgaagcgtgtactctccacagcctcagagctgatacttgtggcttccgccacagaaagaagacccaatcctccagaagcaaggtcacaacacattcacacattccctgataacaggctctatctgtccacaccactgctgatggtgggcctggggtctacccaaccctacctgccacagctgatacccatgaacagtaccaagaggcctgaggacaatcccacccagcttggcaccacttgtgcagtaccaaaacatactgcccaagggcctgggaatcaccgtgccccatccaccactgctggcacctgtacactctttctgagggcctgaggatggccctacccagcttacagcagccaccattaacaccacagcatgctgcttaggagcctaagggttttcccaccaccattactgccatcactcatgccatacacactacccaaaacccaaagatccacctacccaaccagcccaccactgtcacaggcacaaagaaggaagtggcctagaggttcaagaactggctcacttggactggctaatgctactgactacatacactgcctgggagcctagtgacagtcatgcttatcctatcattggaatcactggggctgagggactgacccatctagaatcctcttccccagcaaaacctcactatagccttacaattaaacctaagctactgaggaaatcacagacatcattgctgttctttacagctgaagaaggcatatgaagactatactacttaatgcacccataatcaaatttaaagtgccctgctcagccaacagcataaatacatctttataaaaaagtcttcctctaagaaagcaaatcccaaaatggaagaagtgactgttacaccatatgcacaaataacaatataagaactcaagaaaaataaaaaagcaaggaaatatgtttcatccaaaggatcccagtgatttttcagcaacagatttcaataaaaaaagtatgaaatgccagaaaaaagaattcaaaataatgatattaaagaagttccatgaaaacaaaaagacacagacaaaataatacaaataaattgaaaacttattcatgtcctacgtgagaaattcaacaaagtgatagatatcataaaaaagaatcaaatagaaatcccagaaatgaagaatttaatacatgaaacaaaaaataaatttaagagcttcaacaatagactagattaagtagaataaagaattttagaatttaaagacagtttttgaaataacccagtcagataaaaagtttttaaaagaatacacaaaatctatgtcacatatagaacatcataaagcaataaaatatttaaatttgggatgttccaaaggcaaagagatacaaagggcatagaaaacctatataacaaaataataactgaaaacctcctaagtctagcaagatttagatatccagaagtagtaaacttagagattctcaaatggatacattcaaaaggtgtttttcatggcacattatagtcaaaatgtcaaatgcaaatacaaatagaaaattctaaaaacaaagagcagggtgtcttgttatatgtaagagaactctcagcagattggcactggatttctcagaataaatcttacaggccaggagagtataggatgatatattcaaagggctaaaagaaaattaaaaaaaaattggcaatcaagattactatacacagcaaagttttgctatatgaatgaagaagaaatagtctttcccagacaagcaaaaactgaaggaatttataactattagatcatccctacaagaaatgtttaagggtgtcctacacctggaaacaaaaggcttatatctatcattgtgaaatacatgaaagtataaaactcactgatagagttttaaacatacaaatgaggaagagaaagaactccaatgttaccactacaaaaaaaccaccaaaccaaaatgatacacaataagaaagaatgaaagaaacaaaagatatgcaaaacaaacataaaatacttaaaacatttacatgaataagtcctcaaatatcaataataaacctgaatataaataaattagactttttacttaaaatatttagactgtctgaatagttttttaagtgatctatgatatgctgcctacaagaaattcacttcacctgtagacacatatagactgaaagtaaaggaatggataaagattttccatacaaatggaaacccaaggtgatcagaagtagttatacttagataaaaacaggctataagtcaaacacagtaaaaagagaaaaagaaggtcattataaaattatgaagggatcaaatatatatatgtgtgtatatattatatatgtgtgtgtgtatatatatatatacatatatataaaccacagtgtaataaaactactagctggtaacaagaggaattctggaaattatacaaatgcatggaaatcaatcaacttggtcctgaatgaccagtaggtcaatgagaaaattaagaagaataattttaatcctatttttgaaacaaatgaaaatgaaaaaacaacacaccaaaacctattggatacagcaaaagtagtgctgagaggaaagtttatatcaataaatacctatatcaaaaaatagaaagattttaaataatctaataatccacttcaagaaactagaaaatcaagaactaaaaacaccccaaacttaatataaggatagaaataataaagaccagagaagaatgaaatgtaatagagacaaaataacacaaagtcaaccaaatgaaaaatttgtcttttaaaaagataaagtcagtaaaccactagctaaacaacaacagaaaacacccaaattaataaattcagaaacataaaaggatacattacaaccgataccacagaaatacaaaaaaaatcagagacaacatgaacaatatatgctaacaaaatagaaaaactagagaaaatagataaatttctggacacatacaacctaccaagattaattcaagaagaaatagaaaaccagaacaggccaagaacaattaacaagattgaatcagcaataaaaaagcctcaaaagagagaaaatcccaggacctaaaggtttcactgctgacttctaccacatgtataaaacaacatcaaaattcctcaaattattctcaaaaattgaagagtagagaattcttcctaacacattatatgaggccagcattattctgatatcaaaactagaaaatgacacaataacaacaaaagctacaggttaatatccctaatgaacataaatgcaaaaatcttcaataaaatattaacaaattgaatctaacagtgcattagaaagacaatatatcatgataaagtggaaggcatgccaaggatgcaagcaccgattgtttaacatatgcaaatcaataaatataatacatcacaataacagaaggaaggacaaaaacagagagtcacataagaggaatttgataaaattaacattcctaacattcctacaggtgtagaaaaaaacacatcttataggtcatatatgacaaacccacagctaacattatactgaatggagaaaactgaaagcctttcttctaagaactggaaaaagacaagatgcccactttcacaactcctattcaacatagtactaaatgacctagccatagacatcagaaaataggaagaaataaaaggcagacaagttggaaaggaggaagtcaaagtgtctttctttgctgataaggtaatcttatatttagaaacacttgaagattcttctaagaaacacttaggccagattaaaaaaattaatttgcatgatacaaactcaacatacaaataaacagtagtttctaaacactaataatgagctagctaaaaaagaaattaaaaagctagtctcatttacaatagctataaaaatacctaggaataaatttaaccaaagaggtgaaggacttctaaaataaaaaccacaaagcactaataaaatacattatagtagacacacaaattaaatgacatcccacgctcttggaaagaaaaaaatccatattgttgaaatgaccatattactaaaatcaatcttgattgaatgcaattcctatcaaaataccattgccattttttacagaaacagaaaaaaaaatctatcctcatattcatatggaaccatataagaggccaaacagataaagcaatcttgagccaaaagaacaaagctggaggcattatattacctgacttcagaatatattacaaggctaacagtaaccaaaataacaaggtattggtataaaaacaggcacgtagaccaatggaacagaatagagaacccagaaataaaaccacttatttacagccatataattttttaagaaaggtaccaagaacactgatagagggaaaggaaactgtcttcaataaatggtgctaggaaacttaatatccatatgcagaagaatgaaactagactgctttctctcaccatgtacaaatatcaactcaaaatgtactaaagacttacacttaggacccaaaactgcaaaactactataatgaaacataggtgaaacattttaggacattggcctaggccaaaattttatggctaagacctcaacagcacatgaaacaaaatcaaaaatagacaaatgtgactatattaaactaaaatgcttctgctcagcagaataaataatcaacagaataaagagacaacctgtttaataggataaaatatttgcaaattatttatctaacaaatgactaatagtcataatatgtaagaaactcaaataattcagcggaaaaaaacaaatgatctaattaaaaagtgaaaaaggagaaaaatatacatttctaataaaacgatatgcaaatggccaacaggtataagaataatactagatatcactaatcatcagggaaatacaaatcaaaatgataatcagataacatcataccccagttagaatggctattattaaaatggaaaaaaattatagattttgttgaggatgcagagaatagggaactcttatatactcttagttgggatgtaaatgagtagattcattatgtacaacaacatggaaatttcccagaaaaaaaaaacttaaaaataaaactactatactatccagtaatctcactactaggtatacatttccaaaagaaaggaaatcagtatatcaaaggtataactacacctctatatctattgcagcaaataacttcacaatagcaaagctatggaatcaacctaagtggctatcaatcgattaatgcataaagaaaataaggcttatatacacaatggaatactattttgccataaaataataaaatcctttttttttttgcagccacatggatgaaactggaggttattatgttacataaaataaaccaggcacagaaatacacatattgcacgtgctcacttatatgtgggatctaaaaaaagctgatcttgtaattgtagagagtagcatgatagttatcagaggcttggttaattatagtcttactactcctcaatcttcacttttagaattaataaaatatagtccataattttacatttaaaacaataacattagaaattatgtgaaagaattaaatcaacttatttttttgaagagtttaaaaaattcaattattacaaccatctaaaacatctgaagtgcatctttcttggacatttctaattgggaaacatttcattatttctacatgattagtaacctgctccactcttcatatatccattctggaaaattcttggtgcctgactttggcatcttattttaatcttttccaaattgtactcataatttgtctacaaactaaggcattgtaaatgctttaaaaatcatgagaggaaggccaagcatggtggctcatgcctgtaatcccaacactttgggaggccaaggcaggtggatcacttctggtcaggagtttgagaccagcctggccaacatggtggaactctgtctctactaaagatacaaaaattagctcagcatagggtgcctgcctgtaatcccagctactcgggaggctgaggcaagagaatcgcttgaacctgagagctggaggttgcagtgagccaagatcaggccactgcattccagcctgggcgacaaagtgagactctgtctgaaaaaaaaaaaaaaaaaagattatgacaggaggcctctagataatattaaggggacttgaagataaaatctgggtcaagttccatctcacattatatttaattcatctcagtgagaccattatcatctacttacctcttttgtacatttgatatccacaattatgtgtgtgcacgtatatacacaaaaaacagacgcacaaacagaaactcagcctccacaaataaaaatgctttccaaaaacatcaataggtctaatttcgtcaatagtgtatgtatctttaatttttttatatatgtataaaggcaaatctaattttttaggctttctcaaactgcttgtttctccacaactctctactattttaaactctgttttgagcattggttactgaaaaatagataaaagagccaatctatagggttcaaaatttctattaagggacctgaatgttttaaaaagagtattaatgataaaatgttaactaataggattgccttcatatgctcacatattgtgaaattatggagcctccctctgtttcagagactccctctgccaagacaataagaaaagcaatttggacatgtcttaaatcacacttacgaagctttaattaaggctaactataaagtttagtcaataataacagatatttaatatttttgagttcatgtacatattcaccagttttaaaatcttattactatattgtccaatacacagattctcaagttaattcagaattaaactctgtgtgtgtgtgtgtgtgtgtgtgtgtctgtgtgtgtttatttttttgttcctattgtctcctggagtttccagcactttgtaaaagataaaaattaactgtttattgaatgttagtgatgatttgttgaataaatgaacaacaaggacaactgtgcatggtggatcacagctgagactgcgccactgtactccagcctgggcaacagagtgagactctgtctcaaaaaaaaaaaaaagataaggttagatggcttaggttccatttcaataaagatttctagaaaatgttaagatgaaagcagacgtttccatagctggagaacagtgtacagcagtacctaggatagtccctgaaacagagggagggtccataattagtgtggactgaactcagagctttgccctctatcccacttgattgcctgtgggatcacacgagttttttctggtgcaggactgtgtgcaccaagtgcatgcctgtatgtgtgaaaggggggatgggaaatagaattatcattccagatctctgtgtgtgtgcatagaaaataatgcagtaatttgctggaaggatacactcatatttttttccacattgaccttctgtctccaaactggtgatttgtttattgaacaagtacacattaaggtcataaattgtggttatgttgtttctttgctacaaaggataatttttaaaatatcactgcagtgttaaatctaaggatgcagggctcttgaatattaagtatcaacttgctacccagaaagggaccaaatgaatgattagtaatctgcttatacagcagaaatagctagtctactttatgtaaaatttagaaggcattaagagcctaaaaatgcattagaggttttttttcgcttgacatacaatcagtaataacaaatagtcataaaatcacaattattgtttcaaagttcgctgacaatgacacacaacccttgtcctttacaaagttttctacattgcaatcagcatcctggggggctgtaatcaggaatgggttagtgctgtgtgagttgacatttcctataacttcaactctaaagatccaatcagaatttattgcaagcactatgtatagcaacctttgactgttacagcaaccagaagttaaatttctttatgtgtgtgaggagagtgattaacttcaggagcgagttcatcatcagtatcagcaatcaaaactggaatgcagcctcacacctaaaaatcaaaataaggttgatggtactgctctattatcaaataagatgatctattttgctggtaacaatttcatgaatttaattaaaactatcagcgtaagcatagggttttttcatctctctcaagttttcatctaaaaaaattctccaggtaattttttaaaaaactttaaaacttatatcttgattgatggttaaaatatattcatgataaacctagaaagaactgtgtaggtatactttattggcaaagatatgctatagagaatatgggtatattatgtaaccaacataagatttagtggaaaagaagactgaacatttatatgcagtctgcaccaaatatatgtgtgtgtgtgtgtgtgtgtgtgtgtgtgtgtgtgcgtattttttaagacagagtcttgctctgctgcccaggctggagtgcagtggcttgatctctatcaggagttcaagaccagcctggtcaacatggtgaaaccctgtctctactaaaaatacaaaaattagccgggtgtggtggcacaacctgtagtcccagctactcaggaggctgaggcaggagaatggcgtggccctgcgaggcggagtttgcagtgagccgagattgatccactgcactccagcttgagtgacagagcgagactccatcttaaaaaaaaaaaaagagcccagctgatgtttttgaatttttagtagagacgaggtttcaccatgttagccaggatggtcttgatctcctgacctcgtgatcctcccgcctcggcctcccaaagtgctgggattacaagcgtgagccaccgcacccagccaaaaatatttttcagttgaatcctgttttgaatatgatttatcatctatgatgagagtacgggaaccaccaagttgttctccataggactgaatgcatttatcatttataaatggggcttatgataagctcaaacacatttttcctattctactggagaaatatgataggcatagttcatttgaataactgtgagtgctagtttggaagttttgtttaatgttctaagaaggggagatattgttgtctgcaatataaccatttgttttattccattaaccaaacaatactcaacagaaagtcttgcacataagatgcaaacaacaaatactagctcaatgaatgaaacagttgaaatgaatcttatgagtgagtttgcttctacaagagctataaaaatagtagaagctccagctgaaatgagtaatttaatgcttgtattaagaaaaacagaaaatatctagagaagtggaaaatatcttgttctgtgttctaaaaatatgacctatctcccacatacatcccaatattttgcaattgctgcaggtgattctctgacttttcaaatatgaaacaaaattaagtcatacgggctatttggaatgagaataattagctatacatcaatctcagttgcatatttaatatagctcatataaatagaactacataaaactgatgcattatttaaattgtgtattgaaaatatattcattttgactgtaggcatattggttattgtaagtggtttatatttgaatacgtaatgtatgatttaaagaatttcattttaaaactcagggtactagtaaaactgcaaaatgtagattattttatgcaaagtttacacataaactctgactatactttctcacaataatataaaaaatcatcagaaaaaaagtttaacaaagtggcatgattgaatactcctgataaaaggctctagactttccataaaggaagaaaatatgagaaggaaagtttaatatttctggaataagtgaataaaaaacactttgttagggtcacaagaagaaaaattgaaagcctttcatcttaatgacacctatgccattaagagtggccaatgacagccttaggtgtatcccatgaattttcagaaagagcaaatagagttgattcctctaagtgttcatagtgcctgcccagggatccacctctatcctcttcagatgaacatgggctttgtctaggaaggcagtttatagtcttgcctgctccgggtctcttattcaggtatactttactgaaattcacatggaatctttctctgtcactggcaagtgaggctacttttaaatactgtaaatgctgcagcttctcaacctcagataaattctatctataactgtttatatgcacctatcttagcaaattcaggttccattaaatcattttacaaagatctgcatcatatggcaattagaaagtatagcctgtatacaagaataggtcacattctggataataagattatcttagtgaaaggattaatgttctcccctgattttaagatatggaagtttttttaaataaatgatttctttcatctatttttatgaaagcattatcattttatgagcttgcacattgagatcaaaggcttgctattgttttgtgtatggaccatatgttacaatttaataaatacatagaattataaaatctataaaactaggccttggaatccaagcatcaggagagaggtggttctcaatattatatatggatcttgactatatcaaaagctaatttggctcaataaaaatataaaatatctccaaacatttgataatgatctctaaaacagctatgtgttttaattataaaataaaactttaaaatcacaataagttaaaaattataagtagatagaatgttgtaaaataggaatcaatgtaataaaaaatataaataggcatgatttctactcttaaaaatggaatagtttaggtatctgtatgtgaattaaaaataaaaataatatgtatacataaatgacacctttgaaaagggagagaaaagatgtggaagagagagagaaagaaagagatattcaatatttctgtgtcttggagagattgggataggtgattacaccatttaaacttcaggaatgatcaccatctcaggtttgattcaaagtttgagtagcaactgcaggccctcagcataagatataatgataatttcttgcataagtatttcttaggatgtttgtggcagtctgtttctcttccctacaggttcccaaacataattgagtccccatcctttacagtaacagaatagagcactagcttaaccctaatcagcatttcttctgtcctgaactattatatgagttatattccatcatgatccttgtgtacatttctaattctaaaatacttaagtaatcagaatttttatgtaataggttaattcagtgtctattcaatacacatacaagcacaggcatactcactgattatatgcacatcattaatctcttattacactcatattttgcattaggttatatatcctcatccatattgtcttattcaatgttcccaaataacctgcaattgatctatgaaaggctagttagagtttccaaactatatttcaaaaaatatgtagtcaggatccagggagtgtacagaatccaacttcagtgttcaactatacaacacagctcatattctaagatacaactttatacctgttatggactgaatgtttgtttccccaaaaattttataagttaaatccctaatccccaatttgttagtatttgtagatggggcctttgagaggtaattagttcataagggtaagccctcacgaatgggatcagttctcttataagaagatgaagacacatgagagagatgatgtctctctttctccatgtgtgtgtgtgtgtgtgtgtgtgtgtgtctgtgtgtgtgtgtgtgtgtgtgtttctatctcttcatctctctctctgccatgtgaggacatagcaagaaagtagtcatctataaatcaggaggagattcctcatcacaatagtgcaataatcttggacttcccagtcttcagaactgtgagaaatgtttgttgtttaagccacccagtctatgatatcattaatagcagcccaaactgggggtggttgatgagatattacttattaggtacagtgtacgctattaaggtgacagttgcactgaaaaccaagacttcaccgctaggaaatatacctatgtaacaaaagtgtacttgtaccccttaaatgtatacaaacttaagaatacattcaattaatttgagatatttatgaattattacaatttttttctagaaatacttatgccctcttttgtctttcgtctttcgaaagagtaagatacaattatatttttgtaaagtagcaatcatcttatactccataaaaattaatttgcttctgagtgaatacaattctgtacaacttatactacaaaccagggttcctaaccaaactttatttgtttaataagagtatctgtgctgtattcacatgaaccaaacaacatcaatgtgttcaacagcacatatctaaacaactgaaataccgtatctagacatttctacaaataaaaaagtatagtaaaatcataacgttacaatcttatgcgaccaccattgtattatggtgcattgtcgactgaaacatagttgtgtagcgcatgactgtgtgtgtatatgcctgtgtgtctctctgtgtatacaaacagtgtttggggagatagagagatttcatttttgtttaagttatttaaatggttattaccttttcctttaatttctggggttttcatgcacagtttctatacagagaaggattgtgagcagaaagcactctcttttaatgtgtgcatttgctcttgcttaggatgactgcttcacaaactaagaatgacagtctcctgtgggtcttttgcaagcacaggtatgctgatagcaaatccatactgccaatcaatttcagtggactcccaggcttgtacatgtatttgtatctaaacattcccagtagaaagggctttcatttatctcccaggaaaagtctatgggccttgtttccatcatagtttctttaaaatccatacttgtgtaactctttagttactatctgattcagagaaaaaaattaggaaatagaaattttgttagaaaagtgcaaaaaatttaagtaaacaaagtgtggaaacaaagtgaggaaacaaagtgagaaaaaaagaaaaaaaaatgagcaaaaaaataagcatcgatcaagaaatcccaaaaagacaaatagtaattgtggtcagtaaaattattgtaaatgataaaaaaaaattaactaaggatacagatacagaaaaagataaaaatatggctaaaatatcaaattttaaatcttgtatatttgggaaaatctctagttagcaaagtgggaaatttatgtgttttaaaaaatgactgaggtttaatcagatagctctgtgaaggacaacttctcttggaggaaaaaaaatccctgctgtatatatctcctgaaaaaggataaaatatcctgtttgtgtcagtgtgtcagtgaacaaaagtaaggcaaagaagattcatatttctctgcatagtaatatttgagtttctgtgaacattctggaagacagtgaaaagatagaaacaaacaaaaaaatatggcccaaagagtgagggagatgagacccttatgaaataaaaacaggagatttagtctcctaagacacagagttatgaggaatttggaggtatttaatttgtttcaagttgacccctttggtcatagatcacaattatctcccatattccctcaaaatttagaaaaagtctggttcccccgaagtcctgtattaacagtgtttgggggcaatgaaggcatattggctctattgtccagcaagaataaagagaagatagtaccgcttagagataaaattgatttatgactgggcaagcaggggacaagtttcttctcagctctcctttctgaggagagcaaagatcacctggtggccatcaagcagaccagacagagacaaaactctttatctgaggaatttagaaataatgagacttccctattatctaaaaccagcatctggtaccaggcttctttcccagaaaagtataagtaactaaaatttctatacatctacggaatgcatgcatgttgaaacgtattgtgcaagtcttgctcacatcaaggcaccaaaatgtctacaaatataatcatttatcatgacctaagtggctaatatggtccaaattacccttaagctcctgctttaaggattacaaatacccctaaggaaaaatccaccacggtgcactcagtcctgtgttgccgaagctccccgctacactcttctgcagtgttctttctttctttctctctcttttttttttttttttttgagatggagtctccctctgtcccccaggctggagtgcaatggtacaatctcagctcactgcaacccccgcctccagggttcaagcgattctcctgcctcagcctcctgagtagctgggactacaggtgcgtgccaccacacctggctaattttatgtattttagtagagaggtggtttcaccatgttgcccaggctggtcttgaactcctgagctcaggcaatcagcccaccttggcctcccaaagtgctaggattacaggtatgaggcaccacgccctgctgcagcattctttctaactaacaaaacgtccctttcagccgggcgtggtggctcacacctgtaatcccagcactttgggagtccaagacaggttgatcagctgaggtcaggagttcaagaccagcctggccaacatagtaaaaccccgtctctactaaaaatacaaaaattagctgggtctgtagtggcgtgcacctgtaatcccaggcactcaggaggctgactcacgagaatcacttgaacccgggaggtggagtttcagtgtgttgggaacaggctcccaaatctggccataagcaggccccaaaactggccataaacaaaatctctgcagcactgtgacatgctcatgattgctatggcacccacactgaaggttgttggtttaccggaatgagagcaaggaacacctggcccacccagggcagaaaaccacttaaggcattcctgaaccacaaacaatagcatgagcgatctgtgccttaaggacatgttcctgctgcagataactagccagagcccatccctttgtttcctgttttagttaatctataatttatagaaacaatgctcatcactggcttgctgtcaataaatatgtgcgtaaaactctgttcatggctctcagctctgaaggctgtcagccccgattcctactccgcactccatatttctctgtgtgtgtgtgtctttaattcctctagctccgctggggtagggtctccacgactgagctggtctcggcaagtggtgcctatacatggggctcaaacctgggtcgaagggttgccagagtgacggttggagaacatggaactaagctggaggacacctgagtactcttaagcaatccctgtggtgagtaagaaggggagcttggaagcatcagggtaacaatgtgcaagtgtgggctctggttcattccactttggaaccttttcacaatgatgatgaggaggaaggagagtataactaagtaacagaagaggtgacagagcaggtttgtttgccagctaaagctaaagcggcaaaggagggagaggtttgtccctacccttctgcaccccctcattattttgaagaaaaagggtggcctgaccctccagatctttcttttgtggaggacacagggcaaaaagtagttgccccagtgactgttcaagcagtgcctcgagtgactgctctcagttctattcagccaggaatttagcaagctagaagagagggtgatatagaggcttggcagttccccattaggacacacacaccccctgccccccctgccccccgccgatcaacagggaaatattatagctacatttgagccttttccttttaaaatacttaaaggatttaaacaagctattaatcaatatggactaggttctccttttgtaatgggactgttaaagaatgttgctgtctccagtcagatgatgccagcaggggctataggattacttctaggtagatctagtttaaatgtaaaaggagtgcaagtacaaacaggagtcattgattcagattacaatggggaaattcaaattattatatctacttctgttccctggaaagcagagccaggagagggtatagcacagctcctgattgtgtcatatgtggaaatcagaaaagtgaaattaaacgaacaggaggatctggaggcacaaataaacaaggcaaagcagcttattgggtgaatcaaattactgataaatgtcctacctgtgaaataactattcagggaaagaaatataaaggtttggtagatacaggagcagacatttcaatcatttctctttagcactggctgtccacatggccagtttaacctgctcattttaacatagttggagtttgtaaagctcctgaagtatatcaaagtagttatattttgctctgtgaatggcctgatggacaacctgggactattcaaccagttataacttttgtacctataaatttatggggaaaagatttattacaacaatggggagcacaagttctaattccagagcaattatacagccctcaaggtcaacatatgatacgtgaagaggggtatgtccctggtatgggacgaggaaaaaaattgcaagatttgaaggaattgcgtcaagcagaaagacaaagttcccgccaaagtttaggatattatttttgatggcagccattgttaagcctccagaacctataccttaaaatggttaacagataagccaatttggatagaacattggtcactaagtaaagagaaactggaggctttagaggacttagttactgaacaattagaaaaaggtcacatagctccaacattttccccctggaattctctagtctttgttattaagaaaaaatcaggtaaatggagaatgttgacagatcttagagccattaattcagttatacaatctataggggcattacagccaggattgccttctcctgttataagcccaaaaaattggcctttaatagacatagatttaaaagactgtttctttactattcccttagctgagcaggactgtgaacggtttgcatttacaattcctgcagtaaacaacctgcagcctgctaagcgttttcactggaaagtgttgccacaagtcatgttaaacagtctaacaatttgccagacttatgtacggcaagcagctgaacttactcgtaaaaaattttcacagtgttaccttattacgtggatgatatactttgtgctgcccccacttgagaaatattactccaacgttatgatcacttgcaaaatttgatttctcacactggtttaattatagctctggacaaaattcagactactactccttactcctacttggggaccttagcaaataacactacaattgtgccacagaaagtaaccatatgtagggatcaattgaaaacattaaatgacttccaaaaattactaggggatattaattggatacgacctgccctaggcattcctacctatgccatgagtaatccatttgctatccttagaggagatcctagtctcagttgccctcaacaattaacaaaggaggctgagacagtgttacagctaattgagaagcaagtgcataagactcaaatagataaaatagatccagagaatactctagatttgctaattttttcaactcagcattcacctactggtgttattgttcaagagcaggatcttgtagagtggctttttcttccacatactaattcatggactttgactccttatttggatcaaatcactactgtgataggaaatgggagaactcggattgttaaattacatggatatgatcctggaaaaattattgtccctctcatgaaggcacaaatacagcaagcttttatagtcttacttggcaaacccatttagctgactttgtgggtattcttgataaccattttcctaaaatgaaactgtttcaatttttgaaattaactaattgggttctccctaaaataactaaatttataccaattgaaggtgctgaaaatgtcttcacagatgggtctagtaatggtaaagcttcttattctggctcaaaatgtaaagttttccagacgccctatactttagctccaaaagtggagctcgtagctgtaattgaggtattgactgcttttgatatgcatattaatgtgatttctgattcttcatatgtggttcattccacacaattaactgaaaatgctcagttacgatttcatacagatgagcaactgataactttgtttacccaattgcaaacagcagttaggagtagaatgtacccttttacatcactcatattagggctcatacacctcttccaggacttttgactgcagggaatcaaatggctgatcgcctagttgctactgcaatatctaatgccagacactttcgcaatttaacccatgttaatgcctctggtctcaaacgcagatacagcattacctggaaaaaagctaaagctattatccagcattgcccaacttgccacatggtgcattcctcatcttttacaggaggagttaatccttgaggattggaacctaattctctttggcaaatggacatcacacatgttccctgatttgggagactagcttatgtacatgtatgtgtggacaccttttctcactttgtctgggctacatgccaatcaggacagtcttctgcctgtgttaaatgtcaccttttgcagtgttttgcagtgatgggcattccagcttctattaaaacagacaatgccccaggctatactagccaaattccagctacatttttatctatatggaatattaaacacattactggtatcccatataattctcaaggacaagccatagtggaaagaatgaatctctccctgaaaccacagtcacaaaagcaaaagaggggaaatagggactacgggactccacatatacaactgaatctagcattattgactttaaattttttgagcctgcctaaaggccagatgctatcagcagctaaaaagcatctacagaaaccagctgtaaagacagaagcagagcaactggtttggtggagagatccgataacaaaaggttgggaaataggtaaaataataacttggggtagagactatgcttgtgtttctccaggactgaatcaacagccaatttgggcaccatcgagacatctaaagccgtactatgagccagctacccaggaagaggttttgggaggatcccaaagacccatcattggcagcattgctcaagttcatgctgaggaggaccccaactgtcacgagcaacacccgttgaacacagccacctacctggggacagatcaagaagctgtcgcagatggtggaagaaaacctgaggaaagcaggacaaccagtcacaatgagtaacttaatgatagctatgatagtggtgatcaccattgcctagagtattcctttaacaagggctgacacagagaacaattatacttattgggcatatttaccttttccaccacttctacggcctgtaacttggctggaccccccagtggaggtatacactaatgatagctcttggatgttcagtcctacagatgatagaggcccatctcacccacaggaggaaggaactgttatgaatatttctttaggatttgaacatctgcctatctgtttgggaaaggccactagttgcctacaccttcactatcaatcttggctggcaataatgcctggatgtaatcactctatgacacagttacacttgctttctggtcttagtatttaccataataaatctgctcctataactgaggcataccacatcaaaaacctatttgtaaacaggattggacctggtcagaaaaaataaatgtgcttgtttgggaagattgcattgcagaacaggcagaggtgctgcacaataattcccatggaatcattactgaatagtcccctaaggggatgtttagcttgaattgcccttctccatctgcatgccatggccacactacgttcagctggtctgaataaaatagtcagatggtagaaatggttaagaagtgtggcaagagttcctattatctggaaacatggcggtatagtggcacctcaacctcaaatgatatggcccactctaggagctaaacataaggatttgtggaaactattaatggctcttagtaagatcaaaatttgggaaataatgaaaaagcatctagaaggacactctacaaacttgcctttggatattgcaaaattaaaagaacaaatatttaaagcatcccaggcacacctgatcttactgtcaggaactggagtgcttgaaggagctgcagatggattagtagctattaacccatttaaatggataaaaacacctggaggctctgtgatttcaatgatgactgtgcttttaatttgtgttgtttgtctttatatactctgcagatgtggatcgtgattcctgtgagaagtagctcatggagataaagctgcctttgcttttatcatcttgcaaaaaaaaagggggggacatgttgggaacaggcccccaaatctggccataaacaggccccaaaactggccataaacaaaatctctgcagcactgtgacatactcctgatggctatgatgcccatgctgaagattgttggtttaccagaatcaggacaaggaacacctggcccactcagggcagaaaaccgcttaaggcgttcctgaaccacaaacaatagcatgagcgatctgtgccttaagaacatgttcctgctgcagataactagccagagcccatccctttgtttcccattttagttaatctataatctatagaaacagtgcttatcactggcttgctgtcagtaaatatgtgggtaaaactctgttcgcagctctcagctctgaaggctgtcagccccctgattcccactccccactgtatatttcagtgtgtgtgtgtctttaattcctctagcaccactgggttagggactccatgaccgagctggtctcagcatcagcgagacaagatggtgccactgcactccagcccgggcaacagaactagactctgttaaataaataaataaataaataaataaataactttcctttcaaacctgtactgttggtaaattcctcttattacccatgaaccaatcacttgccatggcagtggctctgatacctcacctggcacttacccctcaactggcacttaccactcacctggcacttaccactcacctggcacttacttcggaaatatgtggaggaaagggtttggggaactttcttctgatactgcataggatgggagcttgagacatttatttgtattttaaagaaaaggcttggcccagcacggtggctcatgcttataatcccagcacattgggaggccaatgtgtgtggatcacctgaggtcaagagttcgaggccaacctgatcaacatggtgaaacccatctctactaaaaatacaaaaattagctgtgttcagtggcagacgcctgtaatcccagctactcaggaggctgaggctggagaatcacttgaaactgggaggcagaggctgcagtgagccgagattttgccattgtattccagcctgggcaacaagagtgaaactctttcaaaaaacaacaacaaaaaaagaaagtaaagaaggaaggaaggaagacagaatgacagaaagagagaaagagagagagaaaaaggagagaaagagagaaagaaagaaaaagaaaagaaagaaaagaaaaggaaaaaaaagaaaagaaaagaaaagaaaaaaagaaaagaaagaaaaggcatatcccaaaatgttgggagagttaggcacataagaccaaagcaaaaagaaaatgaaattgagattttaacaataatagaaaaaacataaaccttaaaaccataagtttggctgggctcagtggctcatgcctgtaattccagcactttgggaggccgaggtgggtggatcacctgaggtcaggagttcaagaccagcctggccaacattgtgaaaccctgtctctactaaaaaatacaaaatttgccaggcatggtggcaggcacctgtaatcccagctacacaggaggctgaggcaggagaattgtttgaacccaagaggcagaagttgaagtgagtcaaggtcatgccacagcactccagcctgggtgacagagtaagactccgtctcaaaaaacaaaaataaaacactcataagttaatgattcttctcttattcagacattcagcctttctaaattcaatatatggaagatgggaatatttttgagaaataaaataagacaattaaaaaaccatgagcattaatattagaaatggtattattttgaataactgccttcccaaagtcagattttatttctatataaacaaatattgtcttctatgtgtcacacaatgcactaaccattatggaagatacaaaaatgagtaatgcaaggtctcagtgagcttgcattccagagatttattttttagttatgtacatgtaaaacatgttgttttcgtttctcagaaataatttactttgtaaacttgtaaactgagaattattttatttatcatgtttccaaaaatatttagttttctaagagctctgaaatactactgttttggcaatcatttggaaaaatcctaaactagaatattacaaaattgatagaagtagcaaaataaaaactgtttacagaagatcagagacgtgacaaatgttatgtaaaatacaaatattactaatatttatttaaaaataataatccacaagtcatttcttctacaaaacttttaaaaacttagttttgtagttaaagttagataatgtaggccttcaataaagataatgagacataatttgaagtccaataatatgatgccttcagtttggttcttcatacaaggctatcataaccaaacagcatagtactaacataaaaatagacacatagatcaaagaaatataatacagaactcagaaatgaagccacatacctaaggccaactgatcttttaaaaaaccaacaaaaacaaacactgaggaaagaacaccctattcaacaaattgttctgggaaaattggattgtcatatgcagaagaatgaaactggacacctatttctcattatatataaaaattatctaaaggtggattaagagttaatatctgaatctataaaaatactagaagaaaacctgggacaaactcatctagacattggctcaggcaaataattcctgattaaaacctcaaaaggaaatgcaacaaaaacaaaaatagacaagtaagactatattaaaataaaagcttctgcacagcaaatgcaacaaatcaaccaagtgaacaactttcagaatgggagaaaatacttgcaaactatgcatctgacaagagactaatatccagaatctacaacgaatgcatacaactcataaactacaacaacaacaacaacaacaacaacaaacaaataaccctatttcaaagtgggcaaaagacataacagacatttctcaaaaggaggcatacgaagggctgccaagcatgtaaaagacatttctcaaaaggagacacaaatggctatcaagcatttgaaaaaaatgctcaacatcactattcatcagagaaaggtaaattaaaaccacaatggaataacagcttacacaagtcagaatgactgttagtataaagtaaaaaaaaaaaaaaaaaagcaaatgttggaaacaccgcagagaaaagggaatgtttatacactgttgataggaatgtaaattagcacaacctctgagaaacagcatggagaattctcaaaaaaactcaaaatagaactaccatttgattcagcaaacccactactactactacccaaagaaaatgaaatcattgtatcaaaagcatatctatacccatatgtttatttagaactattcacaatagcaaatatacagtaagtatccaccaatggatgactggataaacaaaatgtgctacatatacactgtggaatattactcagcaattaaaaagaatgaaatcatgtcttttgcaggaacatagacggaactggaagccattatcttaagtaaaataatgcaaagataaagtcaaatcctacatattttctcttataagtgaaagctaaataatgtgtacacatggacatagagtggggaataataagtattggagactctgaagggtgggcaggaatgaggaacgggaaattacttattgggtacaaagtacattttctgggtgtttattataccaaaagcccaaatttcaccactatatatccatgtaacaaaactctacttgtatccctcaaatttatagaaataaaagaaaatacagataattaaaaacttgctactgtgtgtaaagcactcagggaggcctggtgtggaaagcaacagtaacatctatggtattgaagcccttatagagctctcagagtagagaagaaatgccatatgaacaaaagggctactgctatgttttaggaggaatgtaaaaatgttactcaaagatcagagattagttctaagagtccagggaatcaaccactgaagtgtaaatttgtgtgggaagggcatgccaggaagatcaatagactaagtgaaaaaataacatagaagcagtgcttggttgaaatatagaagtaagtatgagcttaaaatttatatatatatatatatacacacacacacacatatttatatatatgtatgtattctacatatatgtatatataataggaaaattatatatgtgtattttctatatatatgtgtatatatagtggtaaaaattgtggaacattaataatattctagtgctttctagatttcattgtacatatctaagatactgggttagggaagaatctagggaatcaatgggattgcagtacatttaatcctgtggcagtaggataaatgacctcagaataaatttaaagtaatgaaagaaaaatcaaattgcttggtaattatataacatgaattatgtttaatcaggtttaaagactaaagaacacaatcgcaatgtttcctgttatctattgatttaatatttgacaataaattaactagtattaatagctaatatatttgccacgctattggctaaacaataattcccagtattttttttttctcaatagttactattgagatgcaggaggcatagagcgaggtcacaaaaaaaagaagattaagtaaatttatcttttattaggaagaaatagtataagatatgctacaattgaccaacattgattcttatctttttgatatgtaaaggtataactaccattttatagcgaattagatgatttttttactctcctggtagcagctggtcaattttttgacaaacagttgatatttttgaagaagtacattcaattggtttccttactctgtttgcttaacagctttttgtaagtttaatttacataccataaaatttacttaagtgtacaattcaacctaattccatcttaattgtttcatctagggctacaacgaatagtttgactagaatagaacactgatctataattgcattttgttagaactatatgcagaggaattaaatttgatagatattattctgttgatgtcaaaaggacactatgatcttgccacggagtaggagagttatctgatatctatagtgtctgtaaagtactttggtactttgttttggaaatacaattatctaataaatatgcattctcagtggagtatcagagaaaaatgcatttagtttcattttgattcccccaaatagcaaacctaatataccttttgatatttcatttaaatcagtgtgaaaaatgtccttttgcagtttgatattgcactgaaactgtaaagtggttactcatggagagagagcagtgtgctctctctggttcatagatttcaggttgaaagtaatgaaagtattctcaggaagccagctcaacacctgcctgggcagtgcactgtactatgaaggtgattcatatgtctgcaaagtgcatttcacaaaggtcccaggtatcagttagtgcagggcatgcatctgaatataaaaataacataatcggagtgacttcattgaggtccttttcttcagcaatttccatgtaaccttctctttgtgtgcttgttgtcacatgatcacaaatacatgtttaaatccagaagatgataaagctgattgagggagcattggcacctttataaagatttccaaattttcctaaaatacctcagtggcctcactggccagagcagtgttgatagatacagggaagttggaaaaatctagatttttaactgcatatgttgctaccctgagtaaaatcagagttatgatatgacaggcaaaatgagaaattgatattaaatagacaaccactaatgtctactagaatttaataactctctatttcttaaatgctatctacagctgattttttttcttgtgttgttgtcctcacacaatctgctgcagttcaggaactacttggaattcttccctaaagtagacaaagtgagatttttttttttttttcagtaaatggaacctattaattttttttccaagaggaacaaattacttagctttgatgatgactacctaaccatttttgtctgtttgtctgttgtctgagaatataaaataattatttttaaatgtttctacagtaagttctcaatgtccttaataggttctttaaaatggtgattgcaagagaagggacatacagcaggtcctcaaattatgtcatttccattacttcatttccttataacattgacggaaacaatatatattgtcattatactttattttgcttaaaaattacagtttccaagaatctatgaatgataagtgaggacatactgcaaaattgtttgtgcaagcaattattattgttattattattatcaataggaatgggttataaaaagataaattgacaaagcatattctattgtgaaatcttctttatcttctgcagatattgtaaaccacaatttaaatattttattgtcttagcttttaatagatataaaatattgactttggaaagtgaaaactattgtcaaatagattttcatatgaaatgatacaaaatgaaatttaaaatctataggacttccaaagatgctttatatagtttctttaagcatatagagaaatcattcctagacttaatatttttcctcactgagcaaaaatgaaatgaaataaatttggggaggtaatagagaaccaaaaaatgttgatgaatttaactactttatgcagactgaagaaataatgttgaaaaaccttgttttcaattatatcctacgaaattcattgaggtctttaactgagttcatttttatagctgattgaattctgttacaatatgttgagaaaaggtcatcttgaagaatcacagttattgtccgtcaagagctctgcattagtggctgttgtttcagacagagcatggcagtttacctcatctagagacactattctgagtcaagactgtcaattccgaagataaaaggttggttattttattgtctaacttttatctccttacagattatcattcacaattttccaatggtatatttctcttatttatcatgtttgtaaaagatttctagaaaatgtttggaaagaatttaatcgcatataagttcataatgtatcttatctttttaaaataaatttatataactttttgactaaaaagttctttcaaacaaaataatcattttttactacttcagataagactatttcaaattctcataatcattcaaaatgtagtaattttggaaattcttgtcgatctctttttttttttttttttgagatggagtttctcactctgccacttaggctggagtgcagttacacgatcttggctcactgcaacctctgcctcctgggttcaagcgattctctctggctcagcatcctgagtagctgggattacaggcatgcactactacacctgactaatttttgtatttttcagcagagacaggatttcaccatgttggccaggctagtcttgaactcctgacctgacgtgatccgtccacctgggtctcccaaagtgctaggattacaggcttgagtcaccgctcccagcctcttgtcaatcttaaagaaggagacaagataacttgagtcctatatttttccaaggactggactaagagcattgccctcattttcccatgggatttaggcattaccattctaagtttatacacatggaaacagaagcaaaaaacttaattaattcgatcaatttattaagcaactaagtagtattctagaatttgaacacaaagcatcctcaacttcttttgcaataaaccttactatttcagaaaaaatatttataatttacgctatatttatattatattaattaaactataacgtgactccaaatagtatattaatctttggtagaaaggccaagtaagcagtttcttcatgatatttataataacgccatgtcaaaataaataataatctgactgtgtctttgaaactgatagtcattattaggtgtagggaattttacttgatgctaagtgttcttagcatctgagatagtgttctatctcatctaagtgagatagatgttattaatgcaaaagaatctgactgacaaaatatttgaagttcaatgtctactcctttttaatatcatgtaacacaaaaaattaaaataccgaaatacattaggagtgttgattaaaaaaatgtggtatgctctttgtatataaataaagatagcctgtctgatcttactatttttatgtacctgacaattaaatgtagaatgtatcaatgtaaatgttttcagccgctatattttataaataaatattcttacattaagatatgtaaagactgtatgaaaaatgatacatgagtttaaaacataaacacgcaaatatgaaaattaaaaaatggcttagtagtatttactgggcatgtgaaaaaaacccactatgagaatcatttatacaaatgtatgatctccattactgactgtcaatgatttatacatttcatgttaattatggtcaaaagagctgatattgactactataaacaattgtaagggaggtttaactacgattttgtaaaacagtatactcctgtatttttcgtgacatcaggttttaatttaggttttcaggcttcctgaattggtcatcaggaagattcagtatacttgtatgaaatagacacaggcatgacttaaattagatgcactaacaaaaataatattaagtagttcataagttgttaactatgaaacagcaatcagagaatcatcaaatggccatgaaagtaatgagcattaagagattttcatgtccagttaaaaactacactggtcttccattccgtaaggaaatggaaagtttccattctgtttctaaggccctggaatgatacctggtagatttctggttctgtctccaacctatgttatgggaactagttcttttgtgtaggaatttgatcactcagcttttgtagtcaccacctgacaaaaattttatggtttctgaaaaggcatagaaaacttgaaatattgatttatttttaactcagtttacactataataactgaagtaagagtgagatttgagttgtgctaataaacaaccatcatcccagatttctcttgaatttcattttctgataactcaaaatgactttctcactcagtggccttcctcaaaatgcattgcttaggtttagctgtttccttagatagtaaaatgttttctttaataactgtaaaaaatgttttcttcctatgaatctagccagaaatagcatatgtattttatattttatcatcgtaggcccctgtaccttttaaatggtagttaatgttaaaccatcattttttagtgcacatttgtcctttgttggtacacactgaacacaaatcataaaattaccttaacgaaagtcattaaaaacaatacatttttttcacaagatgtttcaccatactgataagatttcagtgtaaaaaaattcagatattattaatttaattctgtatcacatagtaactcaacagccacacaattcattttctggatacagctactcagagatggtttacaaaataggaagccaaggtctctggaagagcacaatggttaataaaatgcatctttcatggaaacaaggcaatcgaaacactgattttagtcataagcactcacaagtccacattttgaggggtcagaagttatgttttattatgattggtcttcaatgaaaataactggaaacatgctgaggtgcagtcatactaattaggggaatggaattaagtgatactattaatatacaccattataagtgactactatttccatgcttcttatataacatgccatccaacttaactgattctttgattttcagtatgtttgtattttattccattcacttttctgcacaatttcaactaaattcattagttctgaggatgtttaacagcatcataattgggtttttaagcacaaattgccaaatttgttgtttgtgaagactaatgaacattttattttataccctacttagcactttctactgataactgtctaactctctaagatacttgcatatttaaaagatctttaaaaacacttttgttccttaatgacctagtaggacagatatccataggttcccatgatgcattagccagtataatactgatattaacacacatcaaagtggaggcatgtactttattcaatatattaaagctctgaagaaaggaacaaagaaatgcaagagcaaagaaaattttgtagagtagcatttgaatagcagcctatttacacttgagataaacttatttttgttgtttaataaggtactcacttaaactataatatatgtacataaatgaatgcacattgtatttacatattatgttactgatatatttgcttcccccaaatcacaaactacagcagtccaacactattagagcattggtctcagtgacctaatttatccatccaagtgcatacacatacatgtatttactcacacaacatatgcaaacattcacattcagacacatgaacacacaaaattgatgtttgttaaccaattgtatgcataaaaagtgtaaaataacttttttaaacaattttatacaggctgtttatatcacagcgatattctattagataattgtaactatttataaataaatgtttggctttgtatggcatcgttaatggactaatgtcatatatttgtgtgcatgtgtctttatgcatgtatgcctttgtgacatgtgcatgcatgtgtgttagtatatttctaaaaaaggcagttgaaacagcattcctgttactttcctctagggagatgtgtattttaaggtaggaatttatatttattttatatttgaagcaaatattattattgggaaaatagaacaaaatgtgaaatatcaccattaaagaatggcgagcttttcaactaattctaagctcttctaatgaataataatgtgtaatcataaatatgtacatttttgtgccaccacttagattactagattaataagcatgttttcctaaatattaagtgataccttggaaccaacagaacctgcaggtctcatactcattttaagttgcattatgttatttattttattatatcccaatatctatttttcactttaactacatattacaatctattctacaattataatgcatataaggatatttatatatattcatgtgtatgttcttcatttctatatctatatatgttctacgttgttttctttttaaggtaaaagaaagagagaaagaaagaaaagagagagagagaaagaaagaaagagttaagcaagagaaagaaagaaagaaagaaagaaagaaagaaagaaagaaagaaagaaagaaagaaggaaagagttaagcaagtatgtctgagatccattcatgccagtgtatttccatgttggagcactccaggaaaagaaagaaggcaagtgacccaatcaaatcctcttgtaaacatgataatgacaaaactcttggtaaacaatctagtggtattagctagagagaaagtgcttatctataccatgtttttagttggatgtgcctcacataacacattggtaaataaatctataatctgtagacttatggaacaaggttccctgaaaaatgggttatatgctatataattatagaagtataaagagatatttatgattaaaaaatagctcctttttgtattagttatgtggctatgccatttacttggagatgccagatgttgatctgattcagaatgcatcttgcgctcaagaaggatgtatggtgctgctggaacatcctagatctctctctacttcatccatctcataaatatgtacatccttaaaattttagaaaaacttgagatttgttactgaacacttgtctaaattaaaaatgagttttacttaaccaaatttttagcaacaaattgattgtcaatggggacatgtgatttttttatggtttttggattccgctgctgtagcaaatcctgtaatacattattaagcagccttcattaccattttggcctgatatgacaggatataactgatgtgatataatgtcatatgatatgattgacatgatatgattgacataatatgttttggccagtaaaaaataaaaggagagcagaatttatattttttcctgaaaaaatatttatgtctttgacattattttaattcttttttggtaacacaatatttgagggctgaataatttactcattagaaaaaattgccaacccaagaaatagaaatcccccagtacaatacaattttatatatatgtgtgtatgtatacctaacaatttatgtgacaagcaaaatcaatgtaggaaaatttcaaagagctatttaccctcttcagctaagaattaaaactaatatacaagcggagcaaataatatatttgaaaatctcactcaatgtttgtaatatgccatatttgttttaaacacagattatttatttaagtattacagaaatactgaaggataagtaacattttcttgcacgggtataaataatgggttatcaacataatagggaaagcataatatatgtacattaatttattttcaattatttcattacattgttttagaaaaagtgaggatatgtttaaaatatgttaaaatcacatcatctaatggaaaagagcatatggaaataaaaaccattgctttgcaacttactgtagcaaacgcttgcatgcgagttatgtgtaaatgcactaacctgttttagggtcgacggagaagtagggttgtccttggagaatgctgtaaaccacccgagcgctgtttccataggtagggtcatctgcatcagtagctgtcacctgtagaacagaggtacctgtgcattcaggaaaacaaattttagtgtgtgatggcatttagcatatgattaatttgaacacagaaaatgggtatgctgaaatagctatggagatcagtactggttgtgtcctagtaaatttaattaaatttatgtataaaacatattacttgctttctttccctgtcatcgactgtaatgaaagagagtctaaaatataatattggtcccaaaccttttaacatggctctttatgtgttggtaacattgtgaatgatggtctcttttgattttcattaaaaaagcaataaaatataaccaagatttggttggcttgcactcatatatcaaattgctactaattttgcagttaaatcagagttatgataaagctgtgtatagcatgtttcatgactgttctgaaaactggaggtggaatgatttgtgattaagttgggaaggtgggtgagttgatattaaattatcaatgacatcacaacactccattcaagtcattttctgtcttacacattctttttatttattacctgcataattaatgagtcacataactggtctcctttttttgtccatttgtttttgtttgtttgtttctgagacatgagatggagtcttgctctgtcattcagcctggagtgcagtggtgcgatcttggctcactgcaacttctgcctcccagattcaagcaattctcctgcctcagcttcctgagtagctaggactacaggcaccctccaccatgcccagataatttttgtatttttagtagaaacagggtttcgccatgttggccaggttggtcttgaactcctgatctctggtgatccgccccgctcagcctcccaaagtgctggaattaaaggtgtgagccactgcgcacagccaactggtctactaagttcaaatctcattcctttagtgtcttatacacagtgccaacatcgcactggattttttaaaatgaaaatggattgtaaattcatttataacatttaaaatactatattttgaggtaataaaattattgaatctagtatgatcgtgtctttgtgcttactttttaaaacacgatttgcataattagatacacctatataatatttcaattgtttctaaatgaaaacttaatctaagtataacatgacaaccatatattaagggatatacagcttcattgcagaattagtgggtaagaatgctcatctaagaattcacatctattcataaaatgtacctgatgaatcatctaatggtgcatacttgatattttattccacatcactagaaaaattctacctactaatttgggttatctatcaagtaaaaatgtttttacaatcaattgatcttgtatggaattttgtattcattttggtatttgaatatggaagcactgacaattaatagttttttattttagtaattatgtcaatgactcaggacctaatgtccgttcaactagaaaatttgtacttctaggcccgggcatggtggctcatgcctgtaatcacagcactttgggaggctgaggctaggggatcacctgaggtcaggagtttgagaccagcctggcaaacatggtgaatttttttttgttaacacacacaaaatttttttttggtaaccctgtctctactaaaaatacaaaaattagctgggcatggcagcacatgcctgtaatcccagctacttgggaggctgaggcaggagaattgcttgaacctgggaggtggaggctgcagtgagccgagattgtgccattgcactccagcctgggcaacaagagcgaaactctgtctcaaaaaaaaaaagaaagaaaatttgtacttccatgttgaacttcagacacaattttagggaaagtttattctgtgtcttcaagggatcctagaaaatagaatatgccaagctcacctaacaatccttattagcatatcataaatatgtataatatattaaggattctggcccctaaatagtattttaacaatgagactctaagaagaaatatgacttgcaattatccatcctcagaggatgagagctgtgttatgtctaaaagagatttcaaattacagaccaatcaaatagtatggtgacagtaactttgctgtttagaatgctgagaaactgggtcactcatacactgtggatagaaatgtgattgtttggcaatttcttataaaactaaacacacatctacccaataaattgaatagggcattttattttttatttttattttattattattattttttgagacagagttttgctcatgttgccctggctggagtacaatggcgccatctcggctcactgcaacctccacctcccgagttcaggcaattctcctgtctcagcctcctgcatagctgggattacaggtacctgccaccacacccagctaattttttctatttatagtagagatggggtttcaccatgttggccaggctgtgaactcctgacctcaggtgatttgcccgcctcagcctcctaagtgctgggattacaggtgtgagccaccgcgcccagccatagcattttaacaaataaataaaaactgatgttcacagaaaaacctgcttacaaatattcatagtggcattgttcatgatagccccacactggaaaccatcctgatgtccttcaatgagagacttgttaaatgaactggtacattcatactatgaaatattactcaacaataaaaatgaatagactatgggtacatgcaacaacttgtatgaatcttcagggaatcaactaaatgaaaattaagtaaatcccaaaaggttgtatgctatgattccatttatatagcgtttttgaaatgaaaaaatttagaaatgaataacaagttattattttctagagatttagggagacagactagagcaaggaagtttggtatagcagggaagcataagggatccttatatattggagctgttcaatattttgattatggtaattgatgcataaataggcacagctgataaaattctgtagaactgagcacactcgtacacacagacatacacacacacacacacacacacacacacaaatttatacaagtaaatctagggaaacctaacgacaatcagtagctcgtaccatttcaataacctggttatgatattgctttatggttttgcatgatgttaccattgtgaaaaaaaaaagatttgcaaaatgttaccattacatgcaaatctacaatggtctcaaaattacaagtattagagacaaagatgcgttcttgcctctgtgctactccattcttagagaggtagtttgggtttgtgtgtcctgtgagttttctcaatataccgctaacctttctggcttgattaaatcagttcccaccacaaactgtcctgagctggtcacatatagactatctcttccactataaagtataattatttattaacatagcatattaaggccttttttttttttttttgagacggagtctccttctgtcacctaggctggagtgcagtggcactatctgggctcactgcaagctccgcctcctgggttcatgccattctcctgcctcagcctcctgagtagctgggactacaggcgcccgccaccacgcctggctaaatttttgtatttttagtagagacagggtttcaccatgttagccaggatagtctcgatctcctgacctcgtgatccacccacctcggcctcccaaagtgctgggattacaggcgtgagccaccgcacccggcccatattagggactttttatgtgatggcacaacacttgatccataaccgatattcaagcctccaacttattcagagaataccactaggtaggcatctacgactaaaagttggttttgaagacattttcactggtacctcactgaaaaaactaaaataaaacaaagtctgttgttaggtacccagattagactttaaatgtgcagcaagcttaaaatatggttaaaaatgatataaaattatttcaattaaagctttctttgaaggccaggcacagtggctcacgcctgtaatcccagcaatttgggaggccgaggcgggtggatcacctgaggttggtgatttgagaccagcctgaccaacatggagaaatctcatctctactaaaaatacaaaattatctggacgtggtggtgcatgcctgtaatcccagctacttgggaggctgaggcaggagaatcacttgaacccgggaggcagagattgcggtgagctgagatcacaccactgaactccgacttgggcaacaacaatgaaactccgtctcaacaacaacaacaacaaaaatctttctttgatctgataagaggagtgttaacagttctaggcacatagagattactgggattcgggaaagggaaaactacagaaaacagtagaataaggaccattaaaaaactaggctataaactcctcaggttttgaaattagctctggccctgaaatagcaatttaagcctaaatagtttttaatgtccaaatagcagtccctgggcaaccatttcatggaaaaagctcagaagcacaaacagtgcaagatcattcttcttttgctgtaataggctaaattgccacatgaaaggaggagagttgctctgtttagcttggggtgtctataaaagtccagccttgttaagtgagagttgagatacacgaaggcagtgacaagttaaataaggaaaaacaaggaaaagagatgaaaaaggaagaagggtagcatggtgatactgagtaagtgattgtttaaagtaacaaaggaaacttagtagagcagacaaaaatatatatatagtaactctctgccctgatccaaaagaatggtcattaacagctacatacatttctgcacaggaagtctcacacaattgtctttgtgtgtgaagcaaagagcaacaaatcgcctcgtgtactatgtgtactgtacttcggtagtgcctgaaggcatcagggtaccactttgagtacacagattgctggttgaagggagcacacacacacatgaatagcagagcccaactaaatgccagcccatcagagaacagaacaggagtggacataaatagcagggatggaaaagaaatctcttgccctactgttcaaggatcttttactaggtaggactggaaagaaagcttaaggctgaaagaaaaatatattcgtatcttaaattcttgtttatttgaaatctagatggaaaaattataagacttggtattttcagtaattctttatattagacaaaagtgtgtgcttttattaatgctataggctaaatgctcatatgcccctcaaattcatatgttgaaatcctaacttctaatgtgacagtatttgagggtagggtttttgcaaataccgtgtgagagcagatccctctttattaagagattagtaactttattaagaaggccacaaagagcttcctcattccttctgccatatgatgacacagcaagaagatggccttctgtgaaccaggaagtgtgccatcatcatggaatcttcttgcaccttgattttggacctcccatctttcagaactgtgacaaataaatgttgtttaagccacctagactatggctttctgttatgtgagcccaaataaactaagacaatcaattaatcaataaacaaaaagtaaatgaataagtaaactaatcaaggtatatgttatgggttaaatcatatcctcccaaattgatatgttgaagtcctaatccccagtacctcagaatgtgaccttctttagaaatagtactttttaaatgaaactagttaagagaagatcatgccagagtagtgcgggcctctaatctacattgactggcatccttataaaaatgaaaaatgtggagaaaggtacatatacacaggcataacatcatgtgaagatgaatgtaaatatcagggcgatgtggctacaagccaaaaacaccaaagatggtcagcgaaccactagatgctatgggagagctgtgaaacaggtcacttctctgttcagagagaacaaactggtgacaccttgttctcagacttctagcttccagactgtaagataatacatttctgttgtgtcagccacccagcctgtggcacttttgtagggcaactctagcaaatgaatatggtgtgctagagtttcagtgggaaaaatggacatttattctcataatttatagttgctttttaatctgggcaaaactatgaagttaaaagtcaagaaaaaaaatatctgtaattgtgtattatgtttgcaaccagatacatcataagagagataaaataaaaagttattgttacaagtagattacagtaaataaagatgaatatctgatatttttgaacatcaggcacttctaatgatctgcctgctgacatttttaaagttagttaatgcattatattgggcactttaataaagaattttatcactcgttaaaagttcaagtgaaacggattatcagtatttatatctctatgtctgagcaattcctttatttacactgtgtgcccaaattttatgcatagtagaaaagaaaaaaaattattaccctctacgtgctagacttcaaaatgaaaatatatattgtctaaaattccattattccaccagaatattaaaataggaatctaattttctctgggaattattatatagatttgatgaatagatattaaaccaacagttcccctccctagataattggtttcccaattaaagaaaaatctttcaaaagtgctttagaagcattcttaaattttgaaactgtttcccttaaaagttataatcacaaaaatattgtatttcaagtttcattgctttttggtatacaatattttcatggtaaatatttcctatggaacacagttagctgttcccatgctgaggattagtttctctcagctgatgttttatacaaatctgagaaagatttaagtacatgagaatgccttcaagatatcttttctacaataaaacttaaatcttattttctttaggtattgccctgtgtcattctcattcttttcgtttgttttttggtactactgctttataaacagcacgtattttgcatagacacatatcaatgagaggcagaaagagtagacttcctggtaagtttctaaagacgaatttgaaatatttaataaggcatttttataccaagcaaatactctctgagactgcaaattgttatgcatgacttgtcagggttaacagctctgttaaaatctcaagagattcaatgttgaataagaactttgagtaaaaataagctggagatttacgaaggctcagagtacttctctgaaggaatctcttagggcttaattctcagaagattttcccaggaaacatgaaaaagaaatagtcgtcaagatacaacttaaatttcattctatacaggagaactgtaatttcaccaacagaccaataacactgcattgtagtcattgtgtaatttaataaagttttgagtattaactcaagtcactgaattgaaaagaaaaaaatatttctgcaagtacacatatgaaacatctgggctgagtaccaaaacaaaattcactattttgtgtactaactataaaaccacagcaattgttaatttctgtgcactttcaataggatcttatttatggcactaactaatgtgaaatttcacattcacatgtacaatttatattctgttccataaatggaaaaaataatagggaaataataggtattaagtgccaatgatgtggaaaccctctgttataagccattgaatttaataaaataattaagttaacaataatctattgagaaaatgacatttaatactgttttacccatagagaagttgaagttcaaaaaagttgtatagttgacaattggagacggcagaattcaagtccagccctatctattttgatatgtagcagtctttctcatatacactattacttgacccagtcaagatctgctgaatcttgtttaatagttacaatattttctgcctttttgttttgtgtggtccttgctggtgtacaatgacagtccagatgcatctacttgggcagaagaagctttctatcacatttcccatagtgaaaggccgaggcggtaagtccattttgtcaaataagagtatgttgcagaatacttagaagggagtaatatccaggaactaacaacactgttgtgctcctctgcagccctgtagaatgctcataattctcttcatagttgtacagagtaaatggctctagtgaaaattgactggactgatcgtatgcccactagtcttatgtatcttacaagtatatttgcatattatctcaaattgatttcctaccctgtcctgctctgctctgcttgcagaaacttaatacctgtcattgacattgatttgctttccttatcaacagaataaggggaagttatagatggaaactgaaaaacaagaataagtcaatctctctgtctctgcctttctgtctctctctccctgcctttctgtctctctctccctcccaccttctttctgctttggatgatgtctctggctaagactgcagtacttcagtggttccagctccctttcagctgccccctaccatggtccattctataagatccaggttctgtgcttaggtaatactactactctcagccttaagggagccatactgctgcagtgattgtttcacagggtactatttgacttttcagtccctccatttttgtaacttgttctcaattttctctatttgtctaactgccagttgatttgtttttctgctagaactttgattgacacagaaggtattaacagatttctccccaatgctcctttatccattttgaaagtaatgactacacactaccaaacataaaggttaggttctatatttgatgctaatattgttagtacaagttgaatatctcttatgcttgggaccaacatttcagatttcagattcttttcagtttcaagaatttgcatatacataatgagatactttggggatgggacccaagtttaaatacgaaattcatttaaatttcatatgcatcttatttctatggactgaaagtaagttatgtttttaataattttgtgaatgaaacaatatttgtgtacattaaaccatcagaaagcagtatctcagccacctatgtggacaatctgtggttgtttggcatcaccactatttctgactctgaatttatattgctactgctaaacaatcattttcacacagaagtattaaatggtaaaaaaaaaaaagcatgcaattaatgcagtgaaaaagtaatgcatttgtagtagctaagtagaagaacagcatcaccagaatacatatattagccattaaacaataaactaaaatgttactgtctactatatattttttaggagagaataaacatcagaagcaattgagggaacaggaagtggttcctgtggagatgaggaggctttctgctggatggctacttaaaatttttctctagagtcacttgccttattagcagtggtttacatctttgattttatagatggacaagattttttattctgttacaaatgcacactactctagtcctacaatgaacctatcacacattttcatcatataggcacttctcttcagtgttaaaaaatgtcatcttcggccaggcgcagcggcttacacctgtaatcccagcactttgggaggccgagacgggtggatcacgaggtcagaagatcgagaccatactggctaacatggtgaaaccctgtctctactaaaaatacaaaaaaaattagccaggtgtggtggcgggcgcctgtagccccagctactcgggaggctgaggcaggagaatggcatgaacctgggaggcagagcttgtagtgagccgagagagccccactgcactccagcctgggtgacagagtgagactccatctcaacaacaacaacaaatgtcatcttcagcatcatgtgagcattcagacagttttggactttggagcattttgaatttcagattttggaattagagatactcaatctgttgcagattcttattttaaaatgagaatctggatgcctttgcattcaaaaacttgaattactcagcatattagaacctgacaaatacatatatacagagagagaatgtttaagaactcaaataatcgtcgaagtattctatcaattatctctctaatgtgtgacatgttttagaaatggtttcttgagataagcttccattttacttaatgaagttgaaagtaatggtgtcaccatcaagaattaatgcatgagtctgcatggtggctcacacttgcaatcccagcacgctgggaggctgaggctggtggattgcttaaaatcagtagtttaagaccagcctgggcaacatggcaaaaccctgtttctacaaaacacacaaaaattagccagacctggtagtacacacctgtagttctagctactcaggaggctgaggtaggataatcaattgaccatcagaggacaaggctgcagtgagccctgatcgtgccattgcactccagcctgggtaacagagtgagaccttgtctcaaaaaataaaaaaaaaaattaatgcattttttaaaactatgagaaaggcctagtgccttcccataatttaaaaaaattatagcctcatacctataatcacagaactgtgggaggccaagttgagctcaggagtttgagcccagatattcaagaccagcctgggcaacatagagatacctagtttctacaaaaaaaaaagtttttaaaataaaaaattatacagatgttgtggcacacacctgtagtcccagttaatcagaaggctgaggcaggagggtcttgagcccaggagttcaaggctgcagcaggctatgatcatgccactgcactccagtccacatgacagagtgagagcagcgggctatgattatgccactgcactccagtctacgtgacagagtgagaccttgtctcaaaaaaataaataaataaataaaataaattgtgacacagctatgtcatcaaaatcaagcatttcttgtttagcctttatagtaattaagcccataaggtaactttatgaaggactccttaatcctgaacacccatgggaatatctactttcttaaacagttatctctcttgtaaagtttaattgctcccacctaagatttaatttgtttcaccagggtgaaacagcttgggacacaatattgttttcagaatgattagtatatttcatctcttatatctgttatcttcggcactagattctttccttttaactgttttttgtgtgagaagttaatatttgatccatgcatacttaaccttgtaaaacttgtttcttctcacctacaggctgtcaaactttaaatggtcacacaactggagcctctgatgatagctcccttttaccaggaaccctcagataggcctctgagggaaatctgagttccgttttcccaaaacagcatcccctgtcagcagggagtagctaatatcggtcatgatccctattctaacagcagttagatgcacctcttcagaggaggaaatgacacaggcaggaggcagagaaatcctaggcataccaggggtgggcatcccatgaaacctcatcttcaagccaaagacagttcaaagcctgaagaccaagctacaagtcaaattcacagaccagatagagaacctgtcttcctctttgtagtgctttcctttgattgagcttcacccttcacctattttacatatacctaccctttcctaattgtttttacactgttcccacctttgactggtgcctttgttttaacctttttccaaactcttgaatggatcagtacatacttctttatcctatgcctataaaagctgcagactcagccacacagagagatgacctgacttcaagagagacaacccaactctcccatctcttctccgctgagagctgtttggtcactcaataaaattctctgccttcactacccttcaactatcagtatgacctcattcttcttggatgtgggacaagagctcaagacccaccaaatgagggtgcccagaaagtctataacactggccctctgaccttgctgatggagggcagccgcctcgtatgacagaagcagcagcaggtccaagccagtcccagagccatgctagtcctggagtcatgggcaagagcagggtaaaaggctgactgagctgctaacacgcctctttccactggacagcagacagctaattagcatcctgtaacatcccctctggggcttgggtgtctcaggcaccactgcctgggcatcatcaaattcccctcagggtgacacatctgatcttactgcagcctcacacagaacttgctcatgtgttgatgctcaaagcagttggccagaccccacacttgcttgcttacatgctcactcctgccaggggctgagcgcagtgggctgagtaggtggggtgttccctgctgcaggtccggcaaatggggcaagaaaagtcctgtgtcacctttatgctgttcttgtttaatgaatgcaacaaaatttcacagtgttctctgcagttaatcattattctgtttgttcattttaatccttgtcttttatcttgttgctttatttccaaaaaaatgaaacaaaaaaaagcagctggttgattgaaagagaaatagcacattatcatttaaaaactgagttgatgttttcccctttcaattggaatgctacctcttagtaagtgtggctggaatgcattgatattctttccaagcttgttgagtacccttctatttccaaagcaggagtaactgcatcagaagaggggacttgtgatatttgtctattgataagaactgttttcttttattttgtttttgttcccctgtgatatggacgttttggtttactggaagttaatttctgcttaattcttgtgtcacaatattccttttttgagccatcctcagaaaaattcaccaaaggccttatggtagaataaaaatattttttctcggattgcacagattaaaaaaagactcttccttgttttgaaagcttcaatttaataagttgtccaggtgtcttgtatttacaaggactttcttggacaagataatgttctcctttaatgtttagggctatacatttgatctatttcccagtgctgcccaccccctgcccattaatccagtttcaatgtcttcagtgctctaggaatttttggaatctcttatccactgttggtaccctatcttattattgtggtttctttttgaaatatttatggtttctttttggtgtatggtctctgacatgtcaaggggtgatatatcagaaagatatatctaagtgtaagttatattgcaataacaaacaaaccctaaattttagagtctttaagcaataaaagttgatttctcactcacatactctgaaatgtggttgggctggtgtggctttgttgcaagctgtcctccctcggaggcaaatgctgctgagtcactaccctccataacacaggtgagtgtttgcaaagcatctaaccaggtaaataaaagtatagacagtagaatattattggctcactacattatataaatgtatatttaagacagaaagttaaacatggtggaacagagtccatgaaatgtcacttggttctttatgtcactaagttctttatgtcgctgtcaattggtctcagtggttgctttaatcacatggaatctgatcccagtgtatttttagttataaagcagtcgcaacataagtgctgctcttatatctctttgctgaaaagacaataggaaaccactcccattcaatctctttttgttcaatgtattgatgatattggattttttttttttttttttgagacggagtctcgctctgtcgcccaggctggaatgcagtggcgtgatctcggctcactgcaagctccgcctctgggttcacgccattctcctgcctcagcctcccaagtagctgggaccacaggcgcccaccaccacgcccggctaattgtttgtatttttagtagagatggggtttcaccatgttagccaggatggtctcaatctcctgacctcatgatcctcccgcctcggcctcccaaagtgctgggattacaaatgtgagccactgtgcccagccgatactggatattttaagttagagaagtcacacctatacttcgtaagaaaaataaatacaagtccagtgctatttctcttaaggaaggcaacctgaacattgtcttgcctgcctttctataactctatctctgttcattcaaagggctctaatatagtttcatgcatatatacatacactaaacaaaacactgtgcatttttaccccacccaataatttttcatggatatctacatgacaattatgtaaaagattatttttttgaaaattcaggtaatttaattggaggaaagaattaaaagaattttagaaataattggatgagacatttatgatttgagtatttatgacaactatgaaaattaagtgaacaatttaagttggtatctctgaataaagcacttgaaataatggaccagaacatttttattaagatacaacacaagaattcaaaatccactaataaagaacacttgaacgtaacaattaaaattttgttcagtgtgggcaacattgtaaaaccctgtctctaataaaaatacaacaattagccgggcatggtagcacacgcctttaggtgggaggctgaggagggaggatcacttgagcctcggagatcaaggctgcagtgagccataatcgtgctgccactgcactctagctagcctgggggactgtctcaaaaaaatataaaattatagacagcttcacaggtgggggagacatgacacagaagaatcactacggaataatattctagtaaattattgatcttgaaagataaataatgatatcttcttttgtaatatatattcttatataattaaagtaatagatgtttaatataatttctgtagctatcttacattccacgttgcttattgttgcatagttatatttttctagtttttttgtgtgtgtttgttttctatactacgtaataaattactacaaacgttgcatataacaaaagctatcacatttggttctatgtgtgggggtgcttttttcttggtatctacatggactgttgtgataaacttagagagtagcaccgcttttatgaaaggtcgcaacttccacaatattccatggtgtctctgtgtggcacagcaggagaagatttaaattggccatttagcttgtgcaggacaataatatccaaactggatttcaaagttttctccttgccagagtatgagtacaagaaaatttctctatatactaaaataggaagtgaaattggctgagagaaactcagaggatttcaagaagatgtgcaattatgacagagagaatgaattcatgatgatcaaggactgatcaatgaaaaccagtgagaacacagaagtctggtagaaagcagtagagacctgtgatggcactgccagtcctcttccacatgcggccttctctctgcgtgatgtgccctcaccttctaccttcacagtgttttttttctatatccaattgctgtgtctcccctctatacctgaccattgtgcattcactctctatctgatcatggtgaattttctctacacccaatcactgtgtagtcattctatacccaattgctgtatcttctcactatatctgatgctatactttctctctaaacctgatcattttgtcttctgtctatacctgaccattgcaccttccagctatacctgattgcaatgtttatatctgactgctgtgccattttcactctatgcctggtcactatgccttgaccataaacctggtcattttgtatgtgtgtgtttttttcagattacttggtgccttcactctatatctaatcactgggcctattccacatccctgacattgagctttctctctgtgcctgatcactgaacattcactgaacacctgactcctaggaaatggacaaaactatccaaaattatgcccccctaccaataaaattatccaaacagaattagaaatcaggttcaattaaaagtgagggggattatcacatatcctgattgtttaaataaaataaaatttcagtatatgtcctaatacagtaatttcagcatttgcttaaaatctttttcaacttataaaatgatacaaacaattttaatttatatgctttgattaaaagatagggacaacaacatcgactgattaatatttttagtgatacttgaatgatgacaagtatcaattttgagattttttgctttattctatttcctcagtaagaaagaaacaacataaattgttattattaggatctatatatgtgacattccagtcaatttatgtaatgaataagaatgattctaatgagaaaatcgattcatgaatggatatgataaatatagaaaaaatgtcacatttaagaatagctctgtctctgtgaaaatgtatataatttgggtttactcattctatacatattttatttattacctatttagttttagacactttgttaggtgcacatgatactgagatttttaaaatatatttttaagggactacggaccactataatatcaggtgatttcaaactaatttataagtaaaggtggaaggtgctaaaataataagccaaggttgctctaagatcaattgtagtaaatattttgctgtttattttctttaaaaaagacattctctactttaagagaagtgctacattccaaagccaaattatatacctcaatgatccattgatcactgcaataatttcacttattatattttttagaattacctacacaaaacctgcctctttaaactgccaagaatctctgactggtttgttttgtgtttcagttttctacattgaggcctatacatatgaaagtcattctttggctatcatattttttaaaacatgatgtaccaattaaatctgtatgaatgtggtacaatttatgcagaaaaatatgtatcttctagttaagtattttctcttgcaaattgaccagttttattagggaattccaagtctggcctacattcataaaaagtaagtggtaagagggtaaccatgtactctggggcctaccaatgggcagagggtgggaagagggagaggatcaggaaaaataactaatggttactaggctttatacctgaatgacgaaataatctatacaacaaaccccatgacacatgtttacctatgtgtcacataggtatatgcacatcctgttcatataccgttgaacttaaaatataagtttaaaaaaagtaaatggaaagactgaggaatcacttgaagagtaaaatgcaatctagtaaatcacatcaatcattgaataaaagttaaaaactatgttggtttattgggcctttctttaatttacaacaacgaagttaaagatatataaaataaataaaaagaatctttacccaatgaaacagatattggaacaattatgttccaaaaattaagagccaatatttctaagaaatctttcctctagacgtaattgtaggtggaaaaggttgtcatgtacttgttcaataaacatttagagaatatcttgcttcaagtgaggggatacaataacagaatgcagcaaaagtggaaaaacagaacttctgagactcctctctaaaacccttaatatttttgctcttatcctcttgaactactgccctaagaatgcacacaaagcaggtccctacctggaggatgagataccatggatcagagacaagccacccagctaagaccccagaaaaaccagctggtaaccagcatccaccactgcaggtgagggaggcacctgcgctgttcgagctcctagatgactacagcgcaatgtatgaccctagtggaagagcagcctggaccaccgaattatgagcaaataaagcaaatattgtgtgtggccactaaactgtgggtgggttggtttgtacaaaacacaagctaacttacacagaagaatagttatgcaaataaagaagaaaattatgaaacttgcaaaattttgtctactttctggtttgtcagttgtccaatgtgtctcttcatgaatactgcaatgttccatgtagaattagagtgctggctgtgctttattaaaatgataccattctgaacattatgccccagggtaatgatttttaaatggctactagaatcttggcagatgtccagggtgaacatcccaagatatttggcagaactaaatcagcgctccaacaagaagcacaataaagtcagcacagctggtgtctcttcttgttgctctgcagcaagaaacacagctgcaaatggaacagcctggggccttagagattggaggtgaaaaaaaaagacatgaagaagattagagatgtttcaatacatttccaagaaaaaggaactttgcagttaaacaatctcctttttgtagctgcaaaaataagtttgttatattgaacctacagtttattaaatgtatacttataattctgttaaaatataatatttattctctctcatacattaaaaagtactatttctataacctgttactacctgttaaatgcttttaaatggtatttaatgataggtatactaatacacagaagagttaaaaatttgtacattttcatacagaaatatttatttgaaaaagaaaatagtaaagtttatgttctgccaaattacattgtgatctgttatatgatctttttgaaacaacttctagatttaaaacatttaaaaaaaaatgactgcaatagaaacaaatttcagttaatacagttatagaaactcctgattctaggtgaaagcaagactgtaattgcagaaatttgagaatgtctccataaaaagagaacagataaaattattcttgttttaaataaaagagatacgatacacacaattaagacaaacacctttaccagctttttattgctaattttatgtctttgtattattgctaaatttcttagtgagttatgatgtgcttttcatgtgaaaagtgtaataccatttacaaatacatttttattcatcttaatttctaaaatcattcacttgacagctaactcaaaaaccaagtatcatttcatctcatggtcattttcatctttgtattgtgataaacacattaactcattatctcatattttaactgtcggttctgaagactatataaattaggcatgtaatgtaactatagagaaagaaattgaagaagtaattccattaaataattgatagaagttggtaaagatcaagactgacatgataatgtactgcatatcacaaaaaaaggaaaatttaaaatctcaaatttgcattgatcaaatatgtacatctattatggattaatccaggttacatttgcccgcaataatgttataatgccattctgttcacatatgtttactgttgaaattatttagataaatatgtatagtgtatgcgtatatatatacttatctatatgtatacatgtaaatatacatgtatatgtacatctatgtcatctatgtatatatgtatatatgtcatctatgtatatatgtatatatgtcatatatgtatatatacatgtatatatgtacatatatgtatgtatatatgtatacatatatacatatatacgtgtatatatacatacatatatgtacatatatacatgtgtatatacatgtctcacacacacacacacacacacacacacacacatatatgacagccagtaccttactaggaaccaaacacaattcaagtggtcttctaaatgcaggctatacaatacacaattttttttttaatgagagccatcatggctcccaagtagccacgccattactcttccttttatgggtgcaaataacttcattttattctacgactttcctcagtgttttcatactattgtgcacttcaagatgacaattaatatttaaacactgcaatttcttacctagccagatagaacatatttttgttttaaagttcacggcatgagcattctggcactatgaaagtctctctggacaggattataaatttaacaaatatattattcaatttgtgtttctactttgacatttttaattctttatattgcatgttccctagggcagtagttcttaactgacagcatttttgtcacccagaggacatttggcaatttctgaagacaccatcactttgtggttgtgggaggaacaccaccgcatttattaggtacaggccatgactgctactaaacatcctacaaggcacagggaagaccctcacaacaaagaattatccagtccaaagtgttaatagtggaaagattgaaaaactcgttcctagaagaatataattccctagataatgggtgaaattacattatatagatcaaaaagatacatgcaaatcttacattaagacatgctttagaaaccacttcagtttatttttgcatctttctgtactgagctatccaaaatgtctcagactttgtcggcagattattgcccaccgacaagaaatatacaaccacattatgcttttctcactggcaatatagcgcagtgcaattacttggagtggctccataatcattacttagcaagagatgcaagaaacaataatctgataaaatcttacacaccaaggaagtctctggtactgccttttctgtattcttgtgacatatttgcaaagctatatagaaaatctattatttgcatgatcttcctatttccccaaaacacacaaatgcacacgcatgggtacacacacacacacacacacggacacacatcccaagctggactatttttttttaatcattttatcctgtatgtcaaatgtccatttattttaccttttctaacagataaatcaccaagcattatttaagattcactgaggacgtcttctctcatccacaagcagggccccctgtccaagtctacggttcccctattggtgcttatcagacaccatattgaaattttctatttgtaagtctgcagtttgctcaaagatagtggtcttgtttcattaaccattttattactagccactatcacagctctcagcacataaagtgcatttactctctctctctctctctctctcactcaagaaagaattgaataaatataaggagagagattgttttaatgattcaaaactgaattaatgagtatatgataaaaaaagtaattttatcaggccccatacgttgataaaaattttgttgtcacctgcttacattattattagtcttcagttagcattagaaaccagtacatttttaagtgttagtgttataaaaatgatttttattacatatttagaaccacttattcctttcataccaaataaagccacaacctagtgtttagaagcaaaccttcaacaatgtgtgtgtgtctatttcctttagatatcttctgtgcatgtacatgcatattctgcaacacagctgtattctctaacaaaactaggctatcttagtatcacagaagggaagcctggatagtcattagataactaacagtatctacccaaagggaagaagcatgatcccatatatttgtaacaaacgctatatttctgtctatatgtatatagtccagtagggctggcagaacactaactgctatagatcagcagataccttgtctatcaaaactatgacaccatcctctaattgttccttgcctctgatctccctataatagcttacaataaagactgacaaactcttttttttaataaaagataacactgtaaatattttgggcattgtgggccagcgatatgaccttcttcccaaacatccagctctgccattgccgtgccaaaactaccacagacaatcttcaagtaaaggagtgtaactgtgtttcaataaaagcacaaaaacagagagcaggacagatttgttccccctgccattgtctgcagatctttgcctataatatcatcaactttttgtttctaaaatcagagttggccagacacagtggctcacacttctaatcccagcactttgggagacccagaagggcggatcatttgagaccaagagttcaagaccagcctggccaacatggcaagaccccgtctctactaaaattacaaactttagctgggcctggaggcacacgcctgtaatcccagctatttgggaggctgaggcatgagaattgcttgaacctgggaggcagaggttgaagtgagccgagatcatgccactgcactccagcctgggcggcagagtgagactcttgtctcaaaaaaaaaaaaaaaaaaaaaaaaaaaaaatcagagttaatgaaaatatcacccattcttatgaacacaatataaagtgagtttctccctccactttcatatcatcctctatgcattcatgttacaatatctattatatgttattaccatgaatgctatgtatttgttttcctatagtaatgagtgtatatatacacacacacaaacttactgataaaatataatttccaatattcagcttaaggtttcccataaaataactctttcaatagaatcttgcctgaaaccacagtagtacagagagttgaaacttactctgtcttgttctttttctctactactttcagatattaaatttttgtccctcaaccatactcatctcagtaagagaacttaagaatattaacttttcactattctcatctttcttcccaaaccccaaatgaggactttgacttgttcccaagtcctcaactcacagccttttctgcaaaaattactttatgccttatgattctcacatagattatgtggcatccttttacaatatctcaaaaatatccatttgtattaactcagtgtacacacacacacacacacacacacacacacacacacatctattccagagttcactgttgataacatttttcctctctgttattttccttgacttttagatctctgttctgatttatttcaactattttcaatttcaactgttgatcttccagatccttctccaaatatttattttgccctagctgatggatcatatttgtctaaacaatagatttggggcttcagtgttttctctgtaggccgtaaatgggactcaactttctaacagattcctctatttcatgtaataaatgtgagggtaacatattcatttttattcacacctaatttttaaaaatctgaatgtttttaaatttttctctttttattaggctttaaaactttaccaggattttcctatgtttgattcttattctatttactcttcctggaacttggaaagtctactaaacttgtaaagtcagtatattattcacttcaagaaaaattatgattgctcctttcccccatttcctctttatttttctctaaggacacatgttattcacatgataggtctaatgaatatgttctctaaatctcctttctttttcccacaatatccacaattttatgtttgtttctgtggctactagctacttcttccagtcagttatgattttaggtaccaggacaataattcaggtctaatcagttaccattcatgccttcaatccatatattgactttctttgttgttgttatttacttatttgtttaaagcaaaaggctttgagttacagaaatctgtttgtggcatccataaaagccctccaatgctcgtattggctactgtttagtatactgtcttcctgggtaatgcctgctctgcctgtttttctctctagtgctttaacccctgtggttatgacagtttcctttgtgctccttggggcccttacttaccttggaaatagctcaccaggagcactctcacaggtgggagcaccatagagctcgttgccttcctaaggcagaggagattaggtttgtgggtatcagttccttgatgtggcagagagaattctgtccttgagttcccatgcaaactctcacccaccagggttaaaaaatgctgaagcctttaattctccctcgactctccttggagatcaataagcccgacagtattctgggcctctcttaggctcctgcaggctggttcctgtgttctgctggggtccagagggaacgagtttggcaactgctttctcctctgagacttcagctaaggaagaagacctcactctcttccttacctgctcctacagcagctgcaggagctacctgcctagctcaagaagactaacatgggctggaatctggagttgagagaaaagatgctaccatcttccatttttaaaaaatatatatacatatatatacatatacacatatatatatttcaaattcacagactgatttgattagtgactaagtgactataagaacctcaatctaaaacaatactcatacatatgcagtaaaattaaatatattaaatctttactcaataaatgtgttacaaagcttagagtctcataaagatagtcgaaaagtattatcgtagaagaaccatttttaaactactttttaaaaaatcatcccatgaaatgaaaaataaacaaaaataaattcaaatagctacaccacagaaaccagtgagtggtgaaaaagccccagatcattagggtggctcaggtcctggatcatggttctgttggctgcagtgtaggctttgcattcagctaaacctggaaaaatgcctccttggctattttctaaatatgtgaatttgcaaaagtgacttaaatactttatgccagtttgcacatcttaaaaatgatattcaaaatacttcacggggctgtcatatatttttaaataaataaggtatataaatgcttaggaatatctgaaaagttgtattgattaatgtagcaacagctattaatggtattataatttggtcatacactgaaagcttaaaagacctggagacaaaaatttcagacattctagaatctttcttctctgcaaataatcaaattgaatgtgctggtatgttcttaacaatatacatgtagaattcacgtgatagaagagccatatcaattaagcaagtattccacgtgttttcaaatttatacatgtttctttccccttgagatccaactattacctacacttacatgattagaaatcaatttcaatgaatataattgctagacccaatagtctttaacactttatgccacaaaaaatactaaaatattttgaaacttcatatttatatcccctccagatatatatatataagtaaaaattggtattctaaagatgactttttgattttcttaatatgttaattgcataatcacaaaaatgatttttcttacccatatctgacatttcaggcacagtaacaatgtatggtccatctgtgaattttggagcgttgtcattgatgtcttgcactttgatgatgaactcggattcaggctcaagaggtttgtttgtacgtctatcaatagcttgagcatgaagcacatagtgggtcttctgctctctgtctaggctttttgttgagtggatatcacccgtggtatcgtcaatgataaatatagtcccagcaccctctccagtaaggatgtacttgacagatccatcacctttgtcagaattggagtgcagctgtgaaatacacatggaataatttagcatatatttatattccaacctcacattatgttctctgaaaactccctatctataattactttggctatgacttttcttccctttacagtgccctgtgtgttactactatcatttgcttttctgcagtttttttttttcacttggttaatcatatggatattgctatcatggtttgtctaagagatacagttattgatctaagaaaaaaacaataaataatatttattaaaacaaaaatagcccttataattttactaaatccacattccactaactgccataaagttgggaaaataaattcccagtagattattgttgccttccatacttgtgaaaataatatatttggttttaattatttgacattctatttcaactttatgactagaaaaaaaatatatggtaggacaaattgaggttcaaattaattattaaaattttcacaaaagaggcacatatttaagtcatagtcacagtcatgtgtttaataatttgaaaaaaaaatgaaatcacctctaatataaagggctttgatgtagaatattaaaaaatagagtatttttggccaggcacggtggttcacgcctgtaatcccagcactttgggaggccgaggtgggcagatcacgaggtcagcagatcgagaccatcctggctaacacggtgaaactccgtctctactaaaaaagtacaaaaaaaaactagccgggcgtggtggcgggcgcctgtagtcccagctactcggggggctgaggcaggaaaatggcgtgaacctgggaggcggagcttgcagtgagccgagatcgcgccactgcactccaggctgggagacagagcgagactccatctcaaaaaaaaaaaaaaaaaaaaagagtacttttttagggatagagtatttttttagttagggattataaaactttaactcaaaatttaaatagcagtaatatatttagttgataaataggctctcattttaattaattgaaatacagtaacaaatctacacttactaaaattaaaattatcaaatattatttgaatagatattagaaaagtaacaataaattacagaagaggtattcaataagaaaaatacctaaaatattgagataatacactttgttgccatttaaactgcatatagtttttgctaaagattctgctataacaccaaaattcacttaaatagttccaagagtgccagtgctatatttctagctagaaataacagcagtattttctcagttcacaaatatattttcaaggattgtttctccctagaggtctgaacagttatcctttatattaaacctttttgggcacataacctcaatgatttacctttttctcatttctgacacgtagaaacattgaaaaaacacaactttgttcacatagcatttcagttttcttgccatagtaacatgaacatttttgaggttttaaagtctctgaactctcagaagacatttggaaaacacaaaatacagaaaaagacaatgcaatatgagaaaaagattttttttctgggaaaattagggcaactgaaacataaatgatagtatgggaataatttcacttctttcttgaaagcatgtaaaaaattaccaggacaaaattttgacaggaatcacagagtaagattcaacagatgaaaccatttaaaaatgcttatttagatcttttataaaaatgagcaaaaatacacagctttcaaagattcacacttcattagtaaattggatactaaaagaagaatgcagaatgaattgggtgatacaattgtatgcttgtatgaaaatgtgtttatttatttatgtctcttagtatatcattttagtatctagaagaaaagattcatctttcatgaagcagacacccgcaaagtgtcaatagagaaacctatttcatattctctaacttcgcgtcaatccatgaccaaaatgtagcaaagtaaatcaacaaattcatttaccaaatgtttctaaaaccttttctagaatacttgtcattaaactaacaaaaggtgagatagtttggtaattattatgttgttatattatatataaattataaatctatatattgtacttataactgtataaaacatttttgcagaatgtgttatgtcttttaacaatttctaaaagtttaacaatgatgaaaattggcattcatcttcaggatatgtatatgtgtgtatacatatatatatacatgaaaaatatgtttagtgaaattaatttgatgtcacttagtttttttattactaacaaaatgtagcaatataaaattatactaagtgtacagttaggttcttattacagatacttaaggatatttaaagaagaataggcttaagtgtataagagaaatagtaaagttcttaacctacagcatctattaagcatctattaaatatatatactatacactatatagattctagtaattcagatataaaaataaaaatttcagtaattttagggctatcaattttaagacttgaatctgactccacatgtataacattattataattcatatatatactttttataattaataaacagtttttataatacctagttaacagcataaatgcttctgaagatatgactaatttgaacctagattgtaataagattagtaaattataattcagtaatatttatatttttggataaccttacaccaaatattatgaaacttacacaaaaatatcatgaaaatgtatttcgattacattgctttctaagaatatttagcatgagtttttaaataacgtagatgatcattttattaatgaaattttagtttcttggccagcttggttaaatcttgaaataagcagattcccatgtaacactaacgggaaaccattgtagtagttatttagtagactgactaatagtttatatgattatgatgataaccactgtgaaatagcaaagtggtttactctcaagattccctctcctccaccaaatctattctcaaatctcagttctgtttgcaatatacactttgcaacaggaatggggcctgagagaaaccttgagtattttgtcttgaattttttaataaaagggttttaagactctagagaagtattttattaatttttgtaagccaaaaaatgatgaatgaatgaaataggtgaataataagggtagttgcagacacagaaaacttgacaaatggagaaaaagctcttgaatagagataatcagttaggaatattatgatgatagaaatatgtcatctctgagtggggtcaccagtgagacatcaaatgaaagagattggaaaagagcatggaaattagaaatactccatatatagacatggtagtgactcagtaaccagttaaatgtaggttacaagcttagctaaccactatactactaagagagatgcccatgatttttttttacagtgaaataagtaaaaatatttggaagataaattagattttagtcatatacagtgaagcccccccccccccactttttttaaatcagtttagtcataccaagggcattgtagcagggtctgaatgtaacacctcatatatactcttagagccatgggattttgcaaagcaggctgtattttcatgctgaaagatagacattatattgtcctaaagcaagaagagatagtctttgggtatctcatcacataacaaagtaggctaaattaactgctctttagagaacggcaaaggaatgaggggtgaaaaaagtaaaaagaaaatgcagtcaccctagtgaagcaaaatgctagtaatctctagcattactttaataaattgtcactttcttagcattaagtagtaacctatggcacttagaaagccagcgtgactcacatgagttcactctagaaaactatttattcaccctggactacattaggatcaggacctgaaaatttatagctttcactctaatgcaaagttcatcaataaaataatattctattccttggggaagaataactttaaaaagttaagaagatgttggtggagctattcatttacaaagttcagtttaattatgttaaaaagataggtcattgacttaaaactgtaatattttgggatacataatttatatacttgtttataagtagaaaacatatttataatatttcagtggaagccaaaaataaaggcagaaatatagtaattccactatgattgatcattatctccaaaacttgcacaaaaatatgtgacacaatgtgaaagaaatgtgaaaacatggggaatacatgtcactgaggagtattatgtatccttcattccagaatgtattacattcttaaagtataggcaaatgaaacaaaaatcaatccaactgttaataagtaactgatgtgaaataaaacacattaagcagtaacagtctcttgctaactgataatatattagtctctgtgaaaaagggacatgtattaaccataatttttaattacacaccaataaatgtataaaaggttatgttaaagagttaaataaagttttatttttaaaaatttaatccatcaaggtggatgggagtcaggactggattgcagctataactcagacagacagagcaggatgtggaggctcacattgttaattttgccccagaatgactgcaggaatagcaggaatcctgagagtactcgcagaccctctgaaggaagcagattgctcctgcagggcccccaagatgccccaaatattgtaagtgcccaggctgtgaaacagggaaagggagatccgttgcccttgaatacacacccccactggggaaactgaaggtctagtttataggagaatattctgatcttacctggagcagtgtgaatttagaaagccaagcaaaatacaggggtagaggaagcagtgtccattcctgcttggactcaggggaggatgcaaatcctgtgtgtagactccacagacagtggaagcactaaagccctactttcttttgcaactgggaagcgggttagccggcggtaagtcctcagccctgcttgcccattgcctggaaacagactagatgctatgatggggccatggtaggagtgagaccagccctttggattgtgtgggagctgggagaagcctgtgactcccggctctcccccacttccttgacaacctgcagaactcagcagaggcagccattatcttcctaggtacataactccattgacctggaaatcttgccctcatcccccacagcagtggcagcaagacccacccaagaaaagtctgagttcagacacgcctggccctgcccccacccaatggtacttccctacccatcctggtaactgaagacaaagggcatatacttttgggagttctagggccccacctgccatgggttcctctccatactaacacagctgatgctctctggaaagcaccacctcctggcagaaggccaaccagcacacaaaaaagagcattaaaccaccaaagttaagaacactcacagtgtccatttcaccttcctgccacctccaccagaacaggtgctggtattcatggctgagagacccacagacggttcacatcacaggactttgtacagacaacacccagtattagcccagagcctggtagactttttgggtggctagacccagaagagaggcagcaatcactataccttggctctcaggaagccacatccataggaaaagggggaggacactatgtgaaggaaacaccccatgtgaaaaaagaatctaaccacagccttcagccctagaccttccctctgacataacctacccaaatgagaaggaaccagaaaaccaactctggtaatatgacagaacagggctctttaacacccccaaaaatcctactagcttaccagcaatggatgcaaaccaagaagaaatccctgatttgcctgaaaaggaattcaggaggttagttattaatctaatcatggaggccccaaataaaggtaagcccaatgcaaggaaataaataacaataaaaaaagatgcaagaagtgaagggagaaatagtcaatgaaatagattgcataaacaaaaacaataaaaacttcaggaaacattggacacagatagaaatgcaaaattttctggaaagtcttagcaataaaattcaacaagtagaagaaagaaattcagacaagttcttcaaattaacccaatccaacaaagacagaagaaagaataagaaaatatgaacaaagcctcagagtagtctgggattatattaaatgaccaaacctaagaataatcagtgttcttcaagaagaagagaaatctaaaagtttggaaaacatatctgggggaaaaaattgaggaaatattccctggccttgctagagacctagacacattgctatgtgttatgccaatgcataggtcatctaaagttacgacaaaggaaagaatcttaagtgctgtgagacaaaagctccaggtatcctacaaaggaaaacctatcagattgacagcagatttctcagcagaaaccatacaagctcgaaggaattggggctgtatcttcagcttcctcaaacaaaacaactatcagccaagaattttgtatccagtgaaactaagcatcatatatgaaagaaagatacagtttttttcagaaaaacaaatgctgagagaatttgtcactaccaagccaccactacaagaactgctaaaaggagctctaaatcttgaaacaaatccttgaaacgcatcaaaacggaacctttttaagcataaatctcacaggacctataaaacaaaatagaacttaaaaaccaaaaacaaaacaaacaaacaaaaaaacccccaaaaaaccaagatacacaggcaacattatgaatggaatggtacctcacatctcaacattaacattgaatgtaaattgcctaaatgctccacttaaaagatacagaactgcagaatggataagaattcaccaaccaagtatctgttgccttcaagagactcacctaacacataaagactcacataaactttaagtaaagtggtgaaaaaaagacatttcatgcaaatggacaccaaaaggaagcaggagtagctattcttatatcagaaaaagacaaactttaaaacaacagcagttaaaaagggcaaagagggacattatataatgataaaaggccttgtccaacaggaaaatatcacaatcttaaacatatatgtacctaacactggagatcccaaatttatgaaacaattactactagacctaagaaatgagacagacagtaacacaagaatagtgggggatttcaatatcccacagacagcactagacaggtcatcaagacagaaagccaacaaggaaactggatttaaactataccttggaacaaatggacttaacagataaatgcagaacattccatccaacggctgcaatatacacattctattcaatagcacatggaactttctccaagatagaccatatgataggccacaaaatgagcctcaataaatttaagaaaattgaagttatatcaagcactctctcagaccacagtggaataaaactggaaatcaacttcaaaaggaacctttgaacccatgcaaatacatggaaattaaataacctgctcctgaatcagccctgggtcaaaaacaaaaggatggaaattgaaaaattcttcaaactgaacaacgataatgacagaacctatcaaaacctctgggatacagcaaaggtggtgctaagaggaaatttcatagccctaaatgcctacatcaaaaagactgaaagagcacaaactgacaatctaaggtcatgccttaaggaactagaggaacaagaacaaaccaaacccaaacccagcagaagaaaggaaataaccaagatcatagcagaactaaatgaaataaaaacaaacaaaaaaaatacaaaaaataaaaaaataaaaaaaagaaataaaaagctggttcttcgaagaaataaataaaattgattgaccattagcaagattaaccaagaaaagaagagagaaaatccaaataacctcggtaagaaatgaaatgggagatattacaactgacaccagagaaacacaaaagttcattcaatgctattgtattagtcagtgttctctagagggacagaactaacagggtatgtatatatatatatatatatatatatatacacacacacacacacatacatagatatatacacatatatatacacacacacatatatatatatgccctgttagttttatattttatatatatattttatatataataaaatataggatatatataatataagatatatataatataagacatatacatatatctcctatataaatataaaggggagtttattaagtattaactcacatgatcacaacatcacacaataagctttctgcaagctgaggagcaaggagagccagtccaagtcccaaaactgaagaacttggagtccaatgtttgagggcaggaagcatccagcaagggagaaagatgtcgactgggagactaggccagtctccccttttcacgtttttctgcctgctttgtatttgctgacagctatttagacagtgtccaccagattaagggtggatctgccttccccagcctactgattcaaaggttaatctcttttggcaacaccctcaaagacacatccagggtcaatactttgtatccttcaatccaatcaagttgacactcagtgttaaccatcacaagtacaccccttgtcaagttgaacccacacacatctcctgagatcatgcataatcttcaaataaagacaataataaggtcataattacacctaacgtaatacaactgtcctctgtacaactggaaacacaccaacccccaacccaaacactatcacataaagttaacaatatttaagtgctgatacgaagtcaataaatcttatgtcatatgataaaggaaataaaataaagatattttcttcatacaagtgtatacatgtacaaatatttttagcaaaagaaggaggaaatactcatgacaattacagtccccattgctgcagatggtcacgtggtcgtagctggtattgatgactactttcttctactacctattctgtatttctttgccttcagcaaggacctcagcaggtcatgatattttcctggtggagtgacccaaacctttactcctgagaggggctgttgtagtttccattaaccttaatcacagggaatgataatactaagagacgcccaaatggatctcctgtatcccatgcatactgttctttacctctgttgtggagtagtggactgatttcatcttgatagtctgggtcaatcaccccagccaacactgtaactccctccttagcttgttggcttaaaggtaggagaagcctaaagtggcagtcttaacttatagttcaatggaattgttgctatgtctcctggtgtcagtattcctccctctggaactaaggcctctaggccagcagaatgtaatatcacagtaacaggaagcaaatattttgctagtggatcactaggggagatggtgtgtgttgccacttatgcttctattccttgattcccggatccatgaatcttcgctatgggagaaacagtacaatatagcggatgctgattcagagcatacccagccttctggataactttgcctcagccctgcaaagtattgttacctagttggtgttgtaattgtgacttcaaaaggccattccaccattctatcaatccagctacttcaggatgatgggaaacatggtaagaccagttaattccatgaggataagcccactgccacacttttttgttgtaaagtgagtgccttagttagaggcaatgctgtgtggaataccatgagggtggataaggcattccatgagtccatggatggtagtcttggcaaaagcattgtgtgcacgataggcaaacccatatgcagagtaagtgtctattccagtgaagaccaacctctgacctttccatgatggaggaggttcaatataatcaacctgtcatcaggtagctggctgatctccccgaggaatggtgccatattgagggctcagtgttggtctctgctgctggcaaactgggcactcagcagtggctgtagccaggtcagccttggtgagtggacgtccatgttgctgagcccatgtgtaacctccatccctgccaacatggccactttgttcatggacccatttggctatgtcaggggtggctggggaaagcggctgagtggtatccacagatcaggtcattctatccacttgattattaaaatcctcctcagttgagctcacctattggtgagcactctcatggagtacaaatgtcttcagtttttgaccactcagagaggtccacccacataactcttccccaaatttctttgtcaccaattttccgatcatgcttcttccaagtccctggccatccagacaaaccataggctacagcccaggaatcagtagataatcacacatctggccattactccttccatgcaaagtgcacaaccacgtgcactgtttgaagttctgcccattgggaagatttcccttcaccgttgtccttcagggatgtccttaaaaggggctgtagtggtgcagctgtccacttttgggtggtgcctgaatatcgtgcagaaccatctgtgaaccaggctcgagtcttctcttcctctgtcaactgatcatagggaacctcccatgaggccttcagtgcagactggggaagagaaggcagggtggcaggagtggagaccatgggcatttgagccactttctcatgtaacttacttgtaccttcaggacctgctagagcctgatcatatatataaccacttctatttgatgatagaacgctgctgtgtatgacccactttatggctagatgggtcagaaagcaaccagttaatgataggcagtacaggtcgcatggtgacttggtgacatgtagtcaaatgttcagtttccaccaaagtccagtaacaggccaagagctgcctctcaaaaggacagtaattatatgcagaagatggcagggcattgctccaaaatcatagaggcctccactgtgattcacctatggtggcctgcaaaaggctccaaacaacatccctgtctgccactgacacctcaagcaccgttggatctactgggtcatgtggcttaagtggcagagcagcttgcacagaagcctggatctgttgcagagccttctcctgttctgtatcccactcataattggcagactttcgggtcacccaataaatgggccagagtaacacactaaacgaggaatgtgttgcctccaaaacctaaatagccccactaagcattgcgcctctttcttcattgtaggaggtgccaaatgcagcaatttatccttcaccttagaagggatatcttgacaggccccacaccactggaaccctagaaattttactgaagtagaaggtccttgaattgtagttggatttattccccatcctctggcacgcaaatgtctcaccaataagtccactgtgtttgctctttcttgctcactggatctgatcagcacaatgtcaccaatgtaatggaccagtgtgatatcttgcagaagcgaaaagcgatcaaagtctctctgaataagattatgacacaaaaccagagagttgatatacctctgaggtaggacagcaaaggtatattgctggccttgccagctgaaggcaaattgcttctggtgggccttatggataggaatggagaaaaaggcatttgccaagtcaatggttgcatatcagttaccaggaaatgttttaatttgctcaagcaatgaaaccacatctggtacagcagctgcaattggagtcactgcttggttaagcttataataatccactctcattctccaagatccacctgttttctgcacaggccaaatggaagagttgaatggggatgtggtgggaatcaccacccttgcatctttcaactccttgatggtggcactaatgtctgcaatccctccagggatgcaatattttcttcgatttactatttttataggtagaggcagctctaaaggcttccatttggcctttcccaccataatacccctcaacctaccagtcagggaggtaatgtgggggttctgccagctactaagtatgtctatgccaattatgcattctggcactggggaaattaccacaggccgagtccagggacccactgggcccactgtaagtcagaccagagctaaaactccattaattacctgacccccataatcccctactttaactggaggaccacaatgatgtcttgtgtcccttggaatcaacgtcagctcagagccagtgtccagtagtccctgaaatgtctgatcattttcctttccccaatgcatggttaacctgataaaaggctggaggcctccttggggaaggaggggaaaaatattcactccataaattgtcggaaatgtagtgggggccctacattaggggtaccgttcttcaaggggacctcgcctctccttcactccaggggttctgggtctgtaaactggctcaagtctggaaatgaattgaggggccatgattctatttttataattcaaattagtattttgtccatttaacctagaagttttctgcttgtataaattaaataggaatgcagtaggcttcctatcaatttcacttctagggacacagtgattaattagccaatgccagagctctacgcgagtcacactattctgattgccactttgcgtctgctgtccattatggtagctacacccaccttgcctttgacagatgaatgctgccacttggctcctgccaccttgggatcaaattattcccattgtatttaaattttatagttgaataactgcagttcccaccattagatctgatacacagagaagagcaattgcagggctctttaaagatgcaggtgctgccgtcaaaaatctatttcacaaggctttggtcaagggtatatcttctggactctcccagctgggatgagtaggtctaaagtgactaatccactccacgatcccgatttccctagccctttggatctcttcctctacaaccaggaaagatcaggcatttccagcttgctcacggtggcccatcttttaatccatattttggctaacaatgcaaataaagcattagagacttttacaatgcccagagttgaacattaaaagcagagttcctacttagtgagcccagatcaataaattcagcctgatccgactctgtgttccttccaccattatcccacacccttaatatccatccccatgcctgtcctccagatttctgtttacataaattagagaactcaaacagttcttttcaagtgtggtgcatgtcctcatgtgtcacaatctcaacctcacctctagtggcctgccgggactttagttatagatttagaagcagagatgatgggggtggctcctgaggatgatcaacattatcttgcctggcaactacctcaggggaggccatcactgttgccgttgcctcaggcagcacagagtttatgttctcagccaaaggtagaaaggctgacagcagcatgggttggggagtggatgtcgccactactggggatggggaagctcttcattctggccaaaaaatattcaccagagtttacaaacccagcatccccaggtttattggggtcctcccacatgtccccattccaagtttcagggtccccttcttttccagtcaatgccctcaatttaacagtagatacctggcgaggtcgtgcatgcatctttcactgcaggtcagccactcacatgataagagcttatgtctgtttttccgcaatttcagctgtttctctacaggagataagaatctcactcagggcaatcttagcaaatttgaggctcagtatctgcttctgaagccaggagatagaatctctcagttcataattttctttcatcactttgtgcactgaacttaggagtaaccaaccagcttcattatgttccttggatctccacatatagtcaaaggtattatgtatagagtcactaaacttcttgcctcttctgagcagtaaatcaggcgtttcaaatgcatttattttgcataactctctaaagagtttctgcaaaggactatcagtgttctccatactattagaagtagagtccttagcatttctgggtctaatcatattaggcatctaactgcagaaacccaaaaaaaaactgcccaacaaaataaaagaggacacaaacaaatggaagaacattccatggtcacggataggaagaatcaatgtcatgaaaatggtcatactgcccaaggtaatttatagattcaatgccatccccatcaagctaccaatgactttcttcacagaattggaaaaaactactttaaagttcatatggaaccaaaaaagagcccacattgccaagagaatcctaagccaaaagaacaaagctggaggcatcatactacctgacttcaaactatactacaaggctacagtaaccaaaacagcatggtactggtaccaaaacagagatatagaccaatggaacagaacagagccctcagaaatcataccacacatctacaaccatctgatatttgacaaacctgagaaaaacaagcaatggggaaaggattccctatttaataaatggtgctgggaaaactgtctagccatatgtagaaagctgaaactggatcccttccttgcaccttacacaaaaattaattcaagatggaataaagacttacatgttagacctaaaaccataaaaaccctagaagaaaccctaggcaataccattcaggacatagggatgagcagggacttcatgtctaaaacaccaaaagcaatggcaacaaaagacaaaatagacaaatgggatctaattaaactaaagagcttctgcacagcaaaagaaactaccatcagagtgaacaggcaacctacagaatgggagaaaatttttgcaatctcctcatctgtcaaagggctaatatccataatctacaaaaaacttaaacaaatttacaagaaaaaaatcaaacaaccccatcaaaaagtgggcaaagtgtatgaacagacacttcaaaagaagacatttatgcagccaacagacacatgaaataatgctcatcatcactggccatcagagaaatgcaaatcaaaaccacaccagtggttttgataccactcacaccagttagaatggtgatcattaaaaagtcaggaaataacaggtgttggagaggatgtggagaaataggaatgcttttacactgtcggtgggagtgtaaactagttcaaccactgtggaagacattgtggcgattcctcaaggatgtagaactagaaataccacatgacccagtgatcccattactgggtatacacccaaaggattataaatcatgctaccataaagacacatgcacacgtatgtttgttgcagcactattcacaatagcaaagacttggaaccaacccaaatgtccatcaatgatagactggattaagaaaatgtggcacatatacaccatggaatactatgcaaccataaaaaaggatgagttcctgtcctttgtagggacatggatgaagctggaaaccgtcattctcagcaaactattgcaagaacagaaaaccaaacaccacatgttctcactcataggtgagaattgaacaatgagaacacttggacacaaggcagggaatatcacacaccagggcctgtcatggggtctggggatgggggagggatagcattaggagaaatacctaatgtaaatgatgagttaatgggtgcagcaaaccaacatggcacatgtatacatatgtgacaaacctgcacgttgtgcacatgtatcctaggacttaatgtacaagaaatgaaataatgctatagcagtgaatagaagattgttaatgggagcatggaccagggtggtatttgtgaaagaaataagaaattatccaatcagaaatatatcctgaaagtagcacaaacaaaggcttctcaaagagtagatatgaagtataagacaaatgagaagtcaagtacaaatgtttggtgtttggccatagttactgcataattgaagttgcaatcaactgaaatgtggaagaatccaggtacaggaagtttaaaagtgatcaagaactcaatttgaggcatgctaaatgtgatattttttgttgaaggtctcagcagatatatagagaagtcatttgtatatgcagcctgaagttcacaagaggcattttattggccttatgaacttagagaacattgacacaaagttggcatttggagcaacgaaattggatgaactgaacactaaaataagaataggtgagaagagaagaatttagtttagaagcctgtaatacctcaaagttaaaaagccagggagaccacaaaaatattgagaaagtgcaaccaggaaatagatggaaaacaaaagcatattagtgtcctggaacgaagtaaaaatatagcacatgaggctgggcacagtggctcacacctgtaatcccaacactttgggaggccaaggagggtggatcacctgaggtcaagaatttgagaccagcctgaccaacatgatgaaacctcgtctctactaaaaatacaaaaaaaaaaaaaaaaaaaaaaaattagctgggtgtggtggcagatgcctgtaatcccagctacttgggaggctgagacaggagaaatcgcttgaacccaggaggtggagcttgcagttagccaagatcgtgccactgtactctgcactccagcctgggcaacagagcgagactctgtctcaaaaaaaaaaaaaaaatacagtacatatatgcaaggagatttatatagcaataatcattgttgattatttgagagacaaaaaggaatgtaaagatctggctggagggtaaatacttaaggaaatatgaatgattattaaaataatagtataaatgtgttagctctgaagaactacccataatttgttggtaattgagaaaatcacattgtgtcaaaatacgatataatgtacaacgtaaggttgtattttgctaaaaattataaataataaaactccatatatgtggtattcatatttattaatataaacacatataaagttagggaagaatataaccaaggcatgagtcacttgagggaaggtagagaagaaaactatgctttaatgacttagttccctttatgcatctttcatagttttaattgattaagtaggattctatttcttcatatatatatatatatatatatatacacacacacatacacatatatgtatatatatctttataaccatatatgtgtgtgtgtatatagttattatcttttaaaaggttatgggttttatttgagccagttatgtgaaaaagtcagaatgttttaccactctttgtcagtatattaagagtcaacagaaaaacaaggtaaaatctcatttccatgcagtctcgaagctttgcttgattctcattctgcattgcataagaatttgactttccttgtgctcattcttgctaaattctgtccttaatttggctataattactaggccatttcatcaagttttctaggtatttccagttaatattttttcaaatgactgcttacagaagtctttcttaaattttttttggatttgtatccctgaccatctctcatgtctcccacataagccctgtcatttctatacctttattcagccatagttctggcctttatcaatatgttctcatgtgtattctcagctaaaatccaattcaatgtaactgaatggaagaaagaattaactgcatccccgctatgtatcaagtgatgtgctaaggtgaatcaaacaggggccattgtcctcaagaagtttttagctcagtgagcaagtaagagtgagatccacagaatagttgatattccaataaaggcattaagggaaactcactttcccttgagggaaaattttcccagaaaaaaagacaatctcaatctatagtcctgtttctttttttattttttttttaataaaaaagctaaaagttattcaaaaattatttgtttggggatttctcatcacattttttctcttaattatccaccttgtgaattaaaccatattatttgacagaaactgatctaacgtcacagaacatcttctggttattgaataacataattttataaagagggagaaatttaaaaacacaatgaagctaattcaatacactaaagaaccaaaatgcaaaactctgacctattgagtcctcgctctgggaattcaacgaatggggagaagctgtgggttgaggcaaactaaggaagacagttaaagagtgtctttttaaagttttcctgtgctagagaatggggttactcaacccagggttgagcccatataactctccacattgaaataaaaatcctgcaaagtctgctgctgtgcacaaattcttttcacagttaagttcattaaaaatggaaattttattcaaaaaacatttttttttttcttttgagacagagtctcgctctgccacccaggctggagtgcaatgacatgaactcggctcactgcaacctcggcctcccaggttcaagcaattctcctgcctcagcctcccgagtagctgggattacaggtgcccaccaccacacccggctatttttgtatatttagtagggacagggtttcaccatgttggtcagactggtctcaaactcctgacctcaggcgatctgcctgtcccagtctcccaaattgctgggatcacaggcgtcagccatcgtgcccgacccagaactttttcaatcgtaaagtccaaagtattcacttacgagtctgaactcattctgtatcttctcttgtatgtatcagagtaagaagctggcactttcttactcttctctcagtaacccaagattgaaattttatggttaatatcgatttttctttcatcatttctcctcactataagctttcaaagtgtttgtgattctttcttcttagaagtctcccaaatccaccccttctctccatcacagttaccactgggttcattcatacatcatactttcttacttagattgtcgtacttatcctgtaagtggtctcattacctctgttcctgttcatctctccatccagtccattcaccctgcttgtcaatgtgttatttctgaaattggagtttgatccttttctgcataaaatatttgagagcttccccacagtctcagaaggaaggcatcttgatctgatgcctgtctaggtttctcacagaatcatttggctcattcactctgaatttcagcaaactaaactgtataatctggctttaaaagtgccaacccatccacatctaatccccttcaaactagatagtttctatttatctgcccggattttagtggttttccatcctctgtgaagttgcttctgaacttctcattgtaataagctgccactccattctgatgccaaagaatgccttgtcattcaatacttccctattatactatcttttcttttaaaggtttcatctttccaacttcactctcattgaggggaggagccaaatttcattcattttcataactccagtaaccatgcacatctgatttttaataaatattattaaaaataaaatatgataattgaaaattttattattaatttcaataaggcatatcaaataagtaaacaaaaatttaaaaaacacaaaaatgtgtaaaaatattaaaataataccaggagaaaacttggctcagtggaattctaaagtcagtcaagagatcaatataaaaaatgtgtttttttgtaaatctcaatttaaacagacaacctactattaaaagcaaaaataataacattataagctgggttttataaggtcacaaataatacgtatgacaaacgtagaaaaaatggaagggataggtaattgtaattatattgtcataaaagcagagtagttgcgaataaggaggcttgaagggtaaaggaaaaattagtagaaaacgtcatgaaggaaataagcaaaggaaatagcctagcaaatataaagtatcagatgagaagtggtacaatatttactccaaatatacttcaatatattattttattaatggatattattagcatttgaataaataaagtgatgcataactgaaaaagtcatagagaaattaaaacagaataatgaaagtatttgaataaaccaagataaagcagaaagaaacattagaaaacaaaaacagaggggacacaattaaaataaaaacaatattgtagacatctaccaagtcttataaatcatcatattatatataattgtatggagacttcagtagaaatggtggaaaaacaacctccaaattatttcttccattaaagcaatgaaaatactgccaaaaattgtaataagtaactgtttccaaacttgggaaattgaccaaaatcttgcagcattccagggatgtatagaagaaaaatgtatatgagaaagaaatgtatataagaaagaaaaatgtatataagaaaaatgtctgaatcttcatatcttcaacaatgagctttgagttatgttaatttgctctattcccctccctccacctccactgcagccttgaaaaccaagatccacaaatcaaggtcaaaatcagcagcctggtagccactggagggaacagaattgagctggagttccttcaagctacatacccctaaaattctaattatgtgaactctgatggttcctcggaagaccccactctcaagtttgttgttatttgttctgactcagaatttacctaatgcaaatagcttttaccacagaggtttttcagaaacaatcagaggaaattcttgaatagcaaagctgcctgaaatggtgaataacaaaacaaacaatagaataactaaaaaagcttaaaaggaaaagctagggaattagagatttataaggaaatttcaaagctctgacatatttcagaaaatctagaagtcacatgcatttgtagattttgcaaatatctggagaagtaattaaagtttaaaagacatacaaagaacatagatctaacttctagttaaacttggggtctttgcaagcagaaatgtatgacaaaggtggagttgtaaactttccagctgagtgttgaaggtatacctcaacatatacaacgctgccccatagtaaatgttaatatatatattggttccagatatttaaaaatctctgtcaaatcattaactcactgataattaaggcaagctgagacttccacaagcaaatacaaccagaaataaagattttacaaaactattgcagaaaacttattaacaacaacaataacaacaaatggcagcaacaacaaacaccatagagaggggagaacctgatttccagatttgccacattataatatttataatagaagtataaagacaatatctcacaaaatagaaaaaatcaataacaaaataaacattataagacacaactaacatatctgaaaaagaaaagtataataatggaaattgaaaacttactagaagggcacaacaacagatttaaaagaaggcagaagaaagaaacagcaacattgacaagaggtcaattgagattattcagtctaataaagagaaaggaaaaagaatgacaaaaaaataaacagcatataagataccaccaagcctaagaacatatggataatgggagtcacagaaatagagagagaaaaggagacagaaagaacacttgaagatataaagccgcaaaactttctctatttgatagaaaccataaatctacattccagtagctcaatgaacctcaagtagcataaactaaaagggattcatattgatatacattgctatcaaactcctagaagacaaaacaaagccagaatcctgaaagtagcaagagaaaagaatcttgttacctgcaagacattgaacagctgatttctaataaaaaaccacagaagctaggagggagttggattatatattcaacatgctgaaagaaaactactatcaactaaagttcaatatctagcaaactagctgttaaaaatgatggagaaattacaatgttcctagataaacaactactgagaaattttttgctagtagatctgccctccagaaatactaaagacagttctataggctgaaaagttgtattccaacaccttataagcaaaagttaactggaagtaaatcaaaagcctaaatgtaatagataaaacaataaaactcttaaaatgaaacacaaatgtaaatctttacaacattagaataagcaatgttttgtaactatgatgtcaaaagcatggacaaataaaaatatagataaattatatacattaaaactgttgtgcttcaaaatgtgctaccaaaaaagtgaaagtacgactcacagagtgggagacagtatgtacaaattattatatctgataaggatctagtatctagaatttataagtagcacaactcaacaataaggcaaatagcctaattaaaaaggaatgcagaatttgagtacacacttctcaaaagaagatatgtaaacaataaataaagataatcaacatcattagtcattacagaaatgtaaatgaaaaccacaatgggttgccacttcacagtcattaggagagctaaagtttttaaaagacataagtagtggcaagggtaaggaaaaattaaaacattatatattgcagatagattgtaaagtggtgtagccattttgataagcatttgtcaatttctcaaaatattacacatatattttccctgaaattcactcataaagtatgtgaaattccaattaatataacaagggactttttaaagaaattaacaagctgattctaaaagatacatgaaaatggaaatgacctataattgtcaaacagtttgaaaaaaaaacataatcagcagattaacagtacttgatttcaggtctcacaagaaaattacattagtataaaatatagacattcagattaaagggacagattagtccaaaaatgtatccccacacatgtaactataacctgaattttaacatagttttctaatgtaatttaaaatttaatttaatgtgacaatataatttaacagaaacaaagagattattctatccccagaattctaatggcagtatgccagctaagaaaactattcagttgcaaatccatccaaactttccatgccaaaaaaaaaggaaaaaaagaaaaggaagaccaagacagactgcagaaaaaaaaagtccacagagtgtagtcatgaaaattattcctaggccttgagccctaatcaaggaacttctaatatttctctggctgaatttcagaattgctatgtactcttttgtgtctgccattttgctgtttttgaaaaggaatagctgtattcatttttctatgcttgtatcagcattgcattttgtattttggggggcaaataacatttctttgtagcttcacagaactacagatgaagagaaactatatacaaggacatgggcttaaatatctagaatttataaacagcacaactcaacaaaaaggcaattagtccagttaaaaatggacacatcaacacctgggcttgaaatagatcatgagattctggactttgagataacactataatgggatgatacttttggggtacttgggtgaagagaagtgtattttgtgagagaaacatgaatcactgaggtgtcagagggcagtctctggtaggcagctattggaattacctctaatgtgtactgtctcctgtcatttacacccttgtgtaatgtcgtctttttgagtttgggtgggacatagcgactccttgtaataagataaaagtgatggatgtcacttggaaatataggttataaaatgatattggcttctgtcatgcttactccctcttatcatctatcactctttgttgctctctatcttggagccctcactcagggcagaaagctgccatgcatgagaagccctaaggagaggctcacgtggcaagaaaactgatgactccagtccacagccaacatgaacctgaggcctgcccagagacacacaggtatcttggaaggagattttccacaaaattttgtcttgaaatgattgcaaccccagctaacaccttgatcacagccatgagagttcctgaaacagaggcactcagctaagccatgactgaattcctgactcacagaaactgtgagataaggaatgtttgttgttttaagccactgagtattggggaaataataaattcactagtgaggcgtttggatgtatctcaaaatagtatgctgaattaagtaagctgaactcaaaaaaacacatcgactttggctccatttgtatacatttataggccaaacgaaactaagctgtagttagagaaatcaaataggcagttgtcaggggcaggagtgtaccaattaactgcaatatattctttacttcatttgggacagtttataaagttttcaaatgtctccacattatatacttattaatgcaaaatgtacctctataaaatcaagatgaagaaatttacattcaaaaaaggattgtggtatttttatagcttactaatgaatgtgcaaattattttccattctatatgtttttgggaaccactgacagaatttttctctaagatgatcgaacactttttactctcctgtcgttaaaaaataattacttaatatcccaaacaaacttcagggcctgattgtcactctttttcctacccacagcccaaaatacttgttttgcatttacaatattaccacctcctcaaaaatatccatgtcttaatctacagaacttgtcaatatgttattttgcatggagaataggctttgctgatgtgagtaatttaaggagagttaatctggattatccagatatgcccaataaaatcccaagagttgttataagagaaaaggggaggcaggagagccagaagaaacctgtgaagacataagcaagtgtcagtgagagagagagaaagagttgaagatgttataatacttgctttaaagctggaaaatgggttacaagagaaggaattcaggcttctaaaagctgaaaaaaaacagaatctcctttagagtctccaaaagaaaagcagccctgtccacaccttgattccagaaattgtgacttccagaactgtcagatgataccattatgttgttttaattttgtcagatatcctgctaaaacattaatagttttagtaccactttgaagtattattatactcatatttttaaattaagaaactgaatcttattgttgtcaataaatttgcccaagatcacaaagctgctaagtaatagaatgtagatttgaaccacagtaatgtcagagcctgggctcttataatttagccaaacaacattattatgtatgcacaggcataatgactgataagtctaagtgtacaaaactgtaaatacatttttgcatcttctgcattggttatatactaaatgaccaaaattaagattaaacattatgtatatgtcccttcttaagtaaacatcaataattaagagctggtgaattattgtgtgatatttataagggtcttatatttatcttctgatattcatattcataatgtttctgatataattttatatagatattacctacatacataatcataggataaataaagggattcttatctctgtttcatattttagcagctatatagtgaacagttactaagaaccaactaactgcaaatactatttaggactataccatataaaaatacgtggaaatccaaagacaaatggaatatcattcagaacaagatcacatcagaagtctgaaaaggtaagtagagctcagtcccttgaatggcatgctttgtagtttaaagtttttatttaaaaaagatatatccatgcaattattttaatctaaaaatagagatgaaaagagagggatatagcagaagcaaaattgaactttagaaaggtaaaacaaattgtaatttgacttacaaggggcaagcatggagaaaacctcacagttcagaggagactaaagaaaagtgaatcctattcaggagcacattaaagagaaaataaataggcattttatttaagaaattagaaacattgattttaggacataaggaagtagttgagtcaaggaagtatcaagaatggcaatttgtttactatctgagagactgaggaggtggtatcttttataggctaaaggtaatatagaagacactaaaatgtaagtgagagtttaaaaatagaagatgatataaacataatgatagttggggaaaactgagttttgagctacctgtaaattcagtggatgtgtgcagttgacacataaatgagacatcagaaaataaaagacatgaactataaaacctaaaaggattcacatattgcagttaaagttaaaagaaaaacaggtgggaacaccaagaacacatttaaaaacttggaatcataaacatttatgaaaagagaagataaacacatacacctatgaaaaggaaagaatgggaaaaacaaagaagcaccttctggagaattctgagggactctactatttctctatatagctagatccagggtattaatcacttttggacatattactggtctttgagatttactccaaaataacatgggtttggtgcactgaagaggtgatgaaaaagctagcatagataaacacctacattttagagctcagaagctagggctcacaaattttggagcctgggcagaaatacctgggtggcagggtgacaactattatggactgaatatttgtgcccccttaaaatttatattaaggggggctgggcatagtggctcatgcctatagtcccaactgttcagaaggcagaggcaggaggataacttgagccctagtggtggaggctgaagtgagcataaccgtgccacagcactccagcctgggcaaaaaactgaaaccttgtcaaaaataaaataaaattaaaataaaataaaataaaataaataaataaatcatagtaaggggaaatactgatattaggtagaaatggagccctcatgaatgggataagcacgcttatgaaagggacctcagtctgggcgcagtggctcacgcctgtaatcccagcactttgggaggctgaggcgggcggatcacctcaggtcaggaattcgagaccagcctcaccaatatggtgaaaccccatctccactaaaaatacaaaaattagccgtgtggggtggtatgcacctatagtcccagctactagggaggctgagacaggagaattgaagtggagttgcaggaagcaaagatcacaccattgcactacagcctgagtgacagagcaagactctgtctcaaaaaaaaaaaaaaaaaaaaaaaaaaaaaaaaaaaaaaaaaggccaagactgccatgggagagtatacaagtgtaagttggcagtctacaattcagaaaaggacctacaacagaacccaacggaccacgcaataccctgatgttggactttcaacctccagaaccatgagaaataattatttctgttaataaaccacccagtctatggtactttgttataagagcccaaattgaccaagacaggaacccttcagagccaaagctgaagaagctggaagtcccagcaggggcagcagtgaatgggaaaagcaaatagccagtgggggcaatgcaccatactggaaaagcaggtggttttccatgacaagccatggtgaagatgaggatgcttggaatatttacgctactagctcgctaccaacattggagaaagagttgattgaaagtagtccagagacaggaacatgtcctttaccagctgtcttaggccattcttgcattgctataaagaaatacctgagacggggtaatttataggaaaagatatttaatcgctcctggttccacaggctgtacaggaagcatagaggaatctgcttctgtggatgcggaatctgttactgtggatgcggaatctgcttctgtggatgcatcaagaggtttacagttgttgcggaaggtgaggcaggagcagacacctcacagagtaaaagcaggagcgagagaaagacagtgggggggagatgccacacacttttaaatgaccagatttcaggagaactcactatcagtaaaacagcactaagccatgagggatctgccctgtgatccaaacaccacctaccaggcaccacttccatcattgaggattacaattcaacatgagatttagacggagacaaatatccaagctatatcagtagctgaggcagatgtacatcagcaatataagacaaataaggcctacaggaatactacacatgaaaattaaggctgtctttgcaataaaacagattagaaacacatgaaaacaaaggccatggtaagggagaatgaagttgagaactcataagctagagttcataaattttggagcatgggcaggaatatctggatgggaggatggcaattattatgataaggggaaacgaagtgagaaaccactgattttgatcaacaaaaatgcagatgtacaataaaactaaagaaaattatactgtacacaaaattatcagagaaataatggatgcaattaacaagatgctcaaacaataggaaaccatcaagaatgaggagaaatttgaaaaaaatactatcttggaataataaatattaaggggatcaaaattttagtgaatggattaaacagcagatttgacacaataaagaaaattagagtaaacttaaacattatggtcataattgttaggatctaaggaggacaaatgcacgttttcttttccacctactcaaaaggtttcttattttgggcagtcactacaacattatatttcagattttaagagatacattctttatgcaaggaggacaattggcaagagtgggaatacaggaagagattcaaagcattgataacggtctgtttaattctttatgcaaattatgtatttacaggcactcagtattgaagaaagaggaggaagaggatggaaagaaagagggatgaatgtagggaggaagtaaaagaggagaaaataaattcatacagggagcaatgatagtactatgatcaaattaaaatgggaggaaaaaaggcgtaatgacagtgtcatacattgacagtgggttgttttagaaaatgagtagatataaaaccattggattatattaacaaaagtaagcccatagacttctcttattcaaatgactgttatacacatttttttagttgagtggcaccatagtgaaataagactatataagtgggagctttggagtgtggtatctttgtaacactgaacaatgtaaatgttccataagttttggttttctcatttgaaaagtagaaataataagaactaatagtgaaagtagtaatagggataaaatgaaatgccagtaaatcactcatcattatgtccagtaacaaaaacaagtattttacaatgaaatattacacaacataatgcttgagtctcgtatgtttttatacaagtgttgagaaagaaaatgcaaatatatggctcacacctgtaatctcagcactttgggaagccgaggtggatggatcagttgaggtcaggagttcaagaccagcatgtccaacatggtaaaaccctgtctctactaaaaatacaaaaattagccaggcgtgatggcacatgcctgtaatcccagctatgcaggagcctgaggcacaagaattgcttgaacctgggaggcagaggttgcagtgagccgagatcgcatcattccactccagcctgggcaacaagagtgaaactctgtctcaaaaataaaagaaaaaagaaaatgcaaatacaaagcaaagacaagtttatatgtattcctgaattttgtttgcctctctctcctcaatgcatgttaacaacgacacaagataacagatggaaggcaatccagtttgggtaggttagcaattatacatagagctcagatggattgttatgccagtaaagcaaactgtctaaataacctgagacaaccaacagaagaaagattcacacagttggccggccacactgtgcttgtgaagaatcaggcactacgtttgaaaaagaattagggcctaaattgttggcattcttgcagatgaattagaacaaactagccttgagatgaaagttccgttcatccttgatcaaagaagaagtaggtaaagaattgccaaataaatatcttacagccttaagttgtcatggagattgatcttaagtttctccgatattttcaaagtaagctagttttatacctgaaatttttcagaatgcctgggtgcttttatgaagattatttgagaaaataattaaaattactaaaatgaatagaacttttgccagacagatcaggagaaacaaagaacataaattatgactattaggaatgggagagaagaaagatcattaaatttctataagtagtaaaaaggcaataagagaataatatgaatagctttatgctaataaattcaacaaatcagatgaatcaaattccttgaaaatcccaaattattaaattttaatcaagaagaaaaagataacctgaatagccctgtatttattacgaaatcaatttatagtttaaactttcccccacaaaaatctcaatagacacaaaacacctttgccaaacccaactccatttgttacaaaaactacaaagtagaaacaacacagaacataattaacctgaaaaagggcatctatgaaaaaactacattgaacctacatgattaaatatgggagactgaacttccctccccgcagccaatatctgaaacacaacaaagatatctgctttcacctcttgtatttcatattttgatggaagttttagccaagaaattaaaacgaaagatgaattaacagtgtctttatcagacaagaagaaacagaactacctgaattcacaaatactactgcctatgtaaaaattgtattcaatctacaaaaatactatatgaacttataaatgaccttagccagatgatggaatacataatcaagatgaaaaatgattttatctctgtatctctgtatcctagtaacaaataaacaaaattagaaagatagacctactacataaataatctctggttttcctctttaccagccttaaaacaagactcaggaaactgtcaccatgtgatatggactcttcttattgtgcaaagtcaaactaatgaacaattttggatggagacccaaaaaatacagtggacaccacaaaaccataataaaaaaaaatttaaggctttccctgttccttcatgaattggatagccaataggagcccatctcctcatgctgatatctcatccctggacaggagaatatgaggaaatttagcctagctctgcagcccctgtttcctttttctacatgtattatgctcagatacctcctccttgcactagatctgatgctggcttcgtttactggccaggaaggatattcaaaactctctttcacaaatgatgtctctgcacacacacaagatttcatccacctggctaggaataaaatacagtttgcattatataaaataagtttaataatatatgtgagaatactttaaaaatttttatattaatacatgaggtagatactatgccatttaatagagggaaaactgagactatggaaagatcaataatctgatcgaggtaggacaacaagttaatagcagacagagactcacattaaggattctacaatgtgtacatctataatattaattttatagaataatcactgaatataagttgaataatgtcccagattaactattgcaacactgtaaattggttttatcttttattttttctaatgaagaaacctaatagtggagacattaagaaaattgagttagtttattgttttaagtggagaataaattattgtaacaaatagacagtaaaatacaatcgaagctgaattctttctctcattagagagcagtggtaagcaatctattgttaccaaggcagatctgctatcctcaattcatggcttccatgtttggatgtaggactttctttgctgattttgctctgttccagccaagagggagaaaaagaaacagggacaaagtggaaggaattcagaattcgccacagtttttttcttaatgtcctgtaccaaagttgcacatcttacttacaccaacatcccagtgggtaaaatttggtcatggttatacacagctacatagaaggctgcatagggcttctttacagacaagtgtgtagaagatgttattactaaaatgttcaacagttggcgatgagactttgggtacgactagcagtctctcatcagggtcaaatagccaataacaagtggctcatatttgaacccatgttcatttggcctcaaaataagacatagactaacaagtttagtccattttatatgaataatatatgaattaatacatgcttccatataacaatgtgaattttaaaattatatatcatgctaagaattcaggcattcttggcaagtatgtaggaagggcctgttaatgtctttccttatgtaaccttcttagcttaatgtacccttcattagaaccttcttagaatagggcagtatctgtttattccatatagtgagctccatccacagaagagtgcataacttcaactgaagtcattcatgtctttatacagcacctccaccttcacaaatacagaaagtattcatcatttaactaaacacggttatggatacaaacttacctgctgtattagatcttgaacctaactgtataaatctaattgtctatgtatttccttgtcgataagagacagaaaagagtccttattatgccagtatctttcctgacaccatttttccattctttgtaaaatcagcatctcacttactttcacatgttaattttatgttttgattttatcaatacattgtatcctactgtcactttcttctacattattgttcacaaaatatttaaatatatctgtttagtctaaattaggaacaaaaaaggacaagaaaaaaaatattttggaaatcctttacactgcttctagacacttttgtttcccccttggttatctaatctcccagacagcagaacatcacagcctggttcatgttgattcttttttcatttctgcttcaaaaccttccctgagagcaaaatgattttccaataccagctgcaaattcactagagacaaaatgtatttatattttcctctagttttattatattttttccctcctttaacttttgtatatggccacaattttcagatttttaataatgcctccttactttcaagtcagattttctattggctttggacaaaggtttggtaatggaaactgttgtaacactaagaaaggagcctatacttcttagcaaagaataatgccacaggtgatcaaataaggcctgctgaagtggtttcctatagaataatatgaaattaaatacagcaagtcaaatatttaaaacgcctgtagaagcaaagaaaaactcacaaataaatgtgttattccaatgaatctaatatgcgtaaggccagatttatttccataaccaatttaaaactacaattaaaagtttgttcactaatatttttcacgatattaattatggctaaatataggcccatagtccaaaagtaaatcatgtatcattcattagcatacataaagtgaatattgttattgcaaagaaaaaaacagcaaattatttgcaatcatcaaagatgaatgcaattgtaagagtattgacatttttaattttctcaattcctgtatgaaataaaatcacatagaaaaaaaacactcatttaaaatttacatgtaagtacaaaaaaaaatgtaccactagccctacaaaagatattagaaaatggaaatatgtgtatgacctacaagtgtactccttgaaagattaattataatcataacaaaagagaaaacaacaaagagcaggtgtaagcagtattgaaatttcccaaaaccaggcactatgtaagagttaaaattattgaggaataagttctaactaatcttgtgggggtttttttattatataaaactatattttactgaaaccactttaacataagattttattactgagtaaagaatgattattaaatgatttggtattttcatatttttttctctctcaacgttagagtttctagcatacaaattaaacactcacaatagtctgagtccagagagaatttcaggtggaaatggaaaacacaataataatggagaagggaagattggtggcagtcccttgtcttgaatgaaaagtgagagaaaacattaagtttttgacatccataatttttggataatttctgctgtgtcaaaggcatccttaattaacatatatggatatcatatttctattatccagtaaatcaatttcccctttggctttataatcatttattttctggaaagaaaaatatatattctggccaaaaaatctattttcaatttaagtgttagactaacatgggatataatagggatatatggatgcaaaaataaaaaaaagcaaacacacctgtattaatttattttcacacttttatatagtactgccagagactgggtgatttataaaggaaagacgtttaatttactcatagttccacatgtctggggaggcctcaggagactcacaatcatggtggaaggcacctcttcacagggtggcaggagagagaatgagtgcaagcaggggaaatgccagacacttatgaaaccatcagatctcctgagacccactcattatcatgaggggagcatgggagaaaacagccccatgattcaactacctccacctggttccgcccttgacacgtggggattatggagattacaattcacagtgagatttgcatggggacacagagccaaaccatatcacacttttccacagagaggagtaaggcaaaagggattttcctgtgtggtgtagtgtggcttggtggattgtgatgtggagaaaagcaaattcaaatgtatgtaatgaaaagacgtatacttaaggaaaaattagtctacaatggagtcagggcagcacgatggtgattaggagcctaattttggtggcagaatatctgcatttacatgagcgcacttagacttatttatgctgtgatttggaaggagttgcttagactctgatttgtctcctgcactgtaaaatgagaatgatagcaatactccctaattcttaggtatgcttggccaaattccactgctcatgatgtaaatgtttcttcttgttttgataaaaactctgcatggagaagacattctaaatctttctacaacttaagacattactcagtatatcagaaaagctaatgaggactagatttttattttgtgtggcctacacaaagcaataatatatcaatatttgtggatataaagtatttgatttcaccaaatgtctctctacccttgggagaagtttaatactttgtgtagtctgagacttttaaatatgacatctgtttcacagatgtaaaatgtatttgaatgaaagttctttgctgctctaagctgcattaactttgtttctgcctaattaacatgaacaaatcctgataaagcctttttgctggtccatgtgtcacaattagaaattaatctgccgcactattatgtaacacgaggcaagatacagcagtggaaagaacatgaacttgagattgtgataggcttcttttcacatcccagttccaccaaatattaataaggtacaattagataagaagtctcttaacctctctgaaatgggttctgcagagagctgtggatgtggaaagaatggatcaaacagaataaaataatgaaggacatcaattaatatttataaaactcatatatttccattttaatatattacatttttctgctttcaaacatcaaaagtgagaaaaatgtgcctgacaggagtttaaataactgcatctcatagtcacctgagcatactagtgattgctgttatattctaaacttatttcaaccaggaattcctggatgataaagccaaacattccttctcccaaggaaacctctgtcaccacatggggacatatgtggtttgtagtttctaccctcttccctccctacattttctaaggaacaatttgtgtctttcgttggggcttgctatgaggtggagtctcatctccatgtgttatgattatcctgaaacattaatacaatgtctgacattgagtactaactattaattctcatttatattctataagacaagaaaacatttactataggaacatgggactcatacaaactcttcatgactagtagtggctactacacactttaaattatattaccaacattaaaatgccctgtattatttactgaatgcctactctgtacctgatacattcctctgccctttatatacaaaaatcccataggtagatattattttcttcattttatagatgagtaaaaacattttattttaaaattttgtacaaaaaagtaaattcatttcttcattccataattcatttaatacattttagttatatgccatgtgcaaaaaactggacaactttttgagcaaaattgtgcttttagaaatgtatagcctatgttttttaaatattacaatacagttaaatgaataaaaatatacacaaaaataagaagagggaaaaattcaaacagtttatgagtatgttcaaaacttgtagaacagatgataacttggaatcatctagaaaagttagattcttatgttctagaaaacaagaaatcctcttaccatgatctggcaaagtagctctttctgcaacttgaaatttttagttaacactatctttccgatattgggcatgttgagacatgaaaattagactcttagatatgatctttgctgtaacaagactattatataacattctattacacaggcatgccacttttttaaaattccatctccttttctttgtttcaatttttttgctataaaacaatgcttgaaattttttatgcattcattcttgtgtacatgtgatttttttcttacaagtacattatagaacatgagaatctataactttattaaatactgcaaaatagctctcgcaggtaattcccaatttatattccacatttaaaacctagcaaagtaatcttacttcattttttagagcttgcaaatattcttggcctttcttggatctaggagagactaactaggagtctgacaccttttaaaatctaaaaagacacatttaccatctattctctatgaagcctgctacctggaggcttcatccacataagaagaaccttggcttccacaacccaccttatcttacctcaagcaatttttttctactgacttcaagtctttacacaaatcttaactcattcaaccaactatcaatgagaaaatcttagaatccaccaatgacctgtaagcttctgtcccccagtcctggagcctggagatgtcatgcctttcttcttcctctctgtaatatataaaaccaaactgtaacccaaccacctcaggcacacattctcaggacttcttgagactattcctgggtacatagtcactcatattggctgaacgtaaacctctttaaatattttatggagtttgagtttttagtctacaaaagaatggtatctgtcatagaatatgagataataaatatttgttaaatgaatacatgtctctagctttcaggactgatccatcacataatatttttcaggttgagggacataaagctaattacacaattagtacactgcccagcacatagtagccactcaatatatgcatctgtaggccaggcgcggtggctcatacctgcaatcccagcactttgggaggccgaggcgggcagatcacctggggttgggagttcgagatcagcctaaccaacatggagaaaccccgtctctactaaaaatacaaaaaattagccaggcatggtggtgcatgcctgtaattccagctactcaggaggctaaggcaggagaatcgcttgaactcatgaggcggaggttgcagtaagccgagatcatgccattgcattccagcctcggcaacaagagcaaaactctgtctcaaaaaaaaaaaaaaaaaaaaaaaaaatatatatatatatatatatatatatatatatatatatatatatatgcatgcatctgtaaaatgcagaataaaataggtagatcatagaggtttcatgaagattaaataaggtgacatataaaataaaatgtatataatacataaaaacacttatcttaggctgtagtagacactgaataaatggtagttattgttaaaatcttgaaagactaaaactaatttaatttacatgttcagtaaatgtttattaaattgaatgactgattaaaaagagacaagggaagtgatggtaaaaataaaattaggccaactattgaactttgaagcagcaggaggattacagtaacgagacatatttctgaaatggtacaaaaggtgatttacaaattattatttcattttatttctgcaatttaaaaacattcctacaatgaatgcatatattacttatgatatgaaaatgaatagcatgaatagaaatctttatatggtagcatgccatcactaacatagttctcacatttctattcagcaataatgaataattttatatttaagtccagaaactcagcaataatgcctctcaatttctggttttgtatttcagtaaagtccaataactcaacaataatgaatattcaatttttttatttctaaaagcagtgcaccccaaacttgctatttgatatgttagtttactttgtatttggttttagagaaataaagtaattgcttcacctccatttttaggctaaactactgaagtgaaaatattattttctaatttattaatgagctttaaggctgctatcccaatatggataaatcagctctacaagatattgatctatatcttcaatcagcttccttgaatatacagagtactatacctaaaagataaaaataatatcatagaataggctttcacttgttctaaagcatcatccttcaatgttcctgataatatatatttgaactctaattcttccatgtcctcaccacactcttcattgacctgacacttaaccacacattttacattggacacagtattaatgtgcacctagagaaaatcctagaatcttagtaggttaccaccagaaagccattctttagttcttctaatttacacaaagtccagtgtctgtgtgctaggcatggctgggggggtgttggggtaggggctctggggttgtacagtaatggattctgttccaactgcctccacgttggcagtattgctaacctctaggatgtccagacccttcgctgaaaactaaacttcacaagccaaagaaagaaatgagagaggacaagatcccctacagacgggatatttgagagaaactgatacaactagaagtaggactgggaaatgcccgctgagaaggtacctctatagaaaggaagaagaatctttgtggagagctagctgtctcttcacaactatgccacaactctgagatatctttgccttggcctgaactcagagtcattttatttttgtacatatcaaattaggacagtgcctggcagagccaaggcaggtggatcacaatgtcaagagtttgagaccagcgtggtcaacaaagtgaaaccctgtctctactaaaaatacaaaattagccgggcgtggtggtgcgcacctgtagtcccagctactagggaggctgaggcaggagaatcgcttgaacctgggaggcagaggttgcagtgaacctagaccacaccattgcaatccagcctgggcaacagagcgagactgtttcaaaaaaaaaaaaattgtttaatgtatgagcaagtcttttaatcttttaatataaaacagcattatttttatagttatctgaaactatatgcatgtgtttccataggaaggtacatgtgcatataagaagactaagctattgtgacccaagcttggatctaagaccacataacaaacagaaaagataaaagttaatcatgagacataaataaacaactaaacaaagtaaacaaatcaagcaagaagagagagaaaccaagtacaaaagcaaaatcagatgaaaatccaagatagaatttaaaaaaataatggatgtaagacgccagcaccaagtgtccaatgaatagcagtaatttacagttatatatatatatatatatgtttacatgtatatataagtatacatgtctatatatacttataaaaccactgaagaaagaataattaactccttcagaagtatatcagataagtaatatttatttttattggataataaaaataatagcacctattaatatttaccagattgtggaaagtattctcccccttttctttctctttctctttcttactttgttggatctataaaaacctctgcctaaaattaactaatgctgatgggaaaacctgttgcatgtgtttgccattttgcttataatagggtgtgaataagcagctgaaaaattagacattgttgttatttgcaaatcctcaaatgtcctgttattattaaggtgctgagaactggtaattaagcaattacagtaaatgttggaatttttctacatgaagcacacatagactgacttttcaagatggtaatgatggagataacttgaaacaaaaaaagagaattcattcatgcaaaagatttgttgacatttgtgtcagctaattcatttatatcattagtttccacatgataaagagacttcaagtgtttaatgagaaaggaattaaaaaatacatgtagttgatggaatgtgaggttcttacaacattttaatctaagaatatattctgggctagttgcatatttcacttgactatgaaacggatgctgttaatttgccataatgtatatccactcaaacttgcccttagcatgtctgcctatgagatccatctcatatgtcctattggctttcatagggtgggcttcttaccagattacatattagtgttctatcattgacaagattgatgtccagtactcaagttatagaagacacataattttatataatgaaaatatccaaaacattcaatggtgttaatgaaggattatgccctcctttacatgaatggcattaaataccaatacattatagtaacaatttgaaatggtgacttgttgttaaaggaggtttgaacccttaggaattgattttttaaatagattcatatcccagcattcaccatggcctttctcttctattttccctaactctggttttagcagttgctgccttattagttagcgataggggattgtttttggggtgtcagtaaatttgcattcaagggcaaagagcttgtttttgagggaagagccgcctatacatgaagcatgcatgccatcttctccacctttctgtattctcactggagttcaagcatctaagggaacagtctggagtgttgtaaagttgaaatgatgattgttctttccccactaattgtcacagggcaattgcctttacaaaatattaatctcctagggctgtgaagctacaccatgtctgcaaaagctgactgttttctttgtaagttgtacgaccttaggcaagttacttaaccttactgggcgtcagttattttatctgtaaagtaaaaataatagtactacatccctcaaagtgtttcaatgagatagatatgaattaatgcatatgaaggaattagaataatgccttgcatatgataattactcaacaaatgttagactagaagtgactgttaataatttataactgaagtaataactcaaatttataatttcagttcttccatgttccgcagccattaatcaagtagaaaccaaaagtcaaggaaacagaaaaataagtcaatagaacttggctacatcttatagacaaaacaaaataaaaagtgcttgcaatatccctttgatgatgacaaaaaatacgtcaattattaagaatataaagttgacaaataggcaagaagagaagacaatatgaacttctattgcaaataaatatatgtaaaaattatagaaaaagcacaagctcactggccttttcccactctttgaactgctgaagttattgtcttagaattgatgtttgccaatagtagtacttgtttcaaagctctatctagagttataaattagcaatgtgagtaaaaacaataagcaatagtagtaattacatatatgaataataaatgaatatacagtatataatacaggtgtatatattgtatacattttatacataatataatgtgtatgtaaataatatatacagttttatatatcacaagtaaacataattaccatcgttattattcatttgtacatgtaatacatatataaatataccatcatacataaatgtccccacatatataaatataccacatatataaatgtccccatcacaggactcattgcactatatttggtttcgactatttcaagctccttcatgggctcattatatgctcataacacccctgctatcaagagacttttttatgcttctctctaaacctttctagttttccaaaaatctaatcttcttaaactttcctagtcaacatactataagggatgacatcacaaacaatggagacaaggatgcactttcaattctgattttttattactgcatgtataaattttgaaattgtttcactccttccttcctttatatatttaatgatttttagattatatactatgtgcgagtgcttggctatttgctgtctatacagtggcataatgatgaacgaaaggtatattgtatgtgcatttaagcgatttagaatctagtgatgaatccagctgctgacacatagataattaaaatatgaatttggtaaattctataaagtaacagtaggagtgtctatgagaagagataaagagaaagtagagctgtaaaagctaaaaggagtagtggttcatgttgcttcatctgtgttgaggatttggagtttaatctagatgcacttggaagcctctgaaggattttaagtgctagaatgacaagaccaggtatctgtttataaaggatcaatctggatgctggataaggaagagtttatacggtgcacaggggaaaggggataccaattaagagcctattgcagtgtttcaggtgaaaaatgatggcaaataaattagagtggagaaggttgaaaagaaccagacagacttgagatacatttcagatgaggagctgacaagactcactaacagagtgggtttagggagaggtgagcatgaaggaggtgtcaagaacgattctcaggtgtgttacttgaacacctgctggatggaagggtaattactgaaaagaagaggctgtggggaaaccagatatgagtcactgggaagagacttagagtccagttttgttcaggttaattttgagattgcagcaaagcctccaagtatgtatactgtctatcttaactacaggaatcagaagctcatgaaagagtttgagattagaaacataaatctttcagtcggcaccagagcacatctaaagagttggcttcctcatttgaaaatgagagtggcagtgcgtgtggtagtaaatattaatatgtgtaaaattccagagacatgacactgagcaggtactcacggaacacagatgtgtgggctcctaggaaacctaatgatattcttgcaattcgacttttaaacacacacacacacacacacacacacacacacacatctgttcagcacatatttagtaggggcagaaagaaaaaagatttctcttgataaagttgtatgcaaattcaaaataagaaatgtattacatatataattgtattatgtaaggatatgttaactttctggaaatatctttcctttagcagctttctcatcacttgtaactggatgaactagtcactcatgctcgctgagtggaaaggtaacttctagcaatatcagtcaaatcctgtagctgcacatgacagaatttctgtttcacaggaacaaaaacacagttccagtcccaactggctttcagttacagaatttggaaagtaattatctgacacaaacagtgctctatttttattttccatttcaaactccgaatgtgaatcagattctcacaagaaatgtgacagaaataggaggaaaagaaatggatttacttattcatttacactagctgaagtaagtcaattctctgaaaaattcagtaagacatttttccacctttccatagctcttattccatttttgctttattacacagtgttccacaacagactactttttagaagaatgttaccaaatttaaaatgtatgtatttctttttaccacatatgatgataggtaagcagtaacctgttaggtttctgagttttaattgattgatataatggttaattttacatgtcaacttgactagtctaaggaaggcccacagagctgataaaacatgatttctagatgtgtctatgagaatgtttttttgaattagtagatagagtaaaaaagatccccctccccagagtggacaggcactatctcatcttttgagggtctagatagaacaatgaaagcaaaggaagggtgaattttttctctctcttctagagctggggcgttcatcttctcctgccctccgacctcagagctcctggttgttgagccttcaggcttcgtaacttacaccagtagctttcctggttctcaagtctttgaacttggaataggagttacattgttggctggcttagttgccaggccttcagactaggtttaaatgacaccaccagctttcttggttctccagcctgcagacagcacatggtaggactgctcagtctccgtaatcatgtgagcaaattcccacagtaaatctcctcttacctacctatccatctttctatctatctatctgttgatccatatatactttggttcaatttccctggagaatcctaactcaattagaaataaaggtaattttatgttacagggcttttagaagtattgtcattgcaccaaagcaatctgacccactaatgaatgatgacaactttatttgttaaacaactgcaaaaagcatgaaaaaagtatcagaatatagacttataaataacatacaaaaaaactgtacattagtgcagaccaacattttttatactcctccataaagataaactagctatggtagaactttacttctactttagaagaaggacaagttatttagacgactaggcacagaggcatttgtgattacgttagatagcaagcatgattcttccaaatatattaccattgttgtcatagcctttatagcttggcatttgggacagtgaaataatttgatgatattagagtctgaccctgggtaatcaatgaatgataatgcctgttcttctagagctaatactcctcctcctccttctactatgacagaaaaccctgcaattctataaatcttcacctaccctactaccaatattttgctgttttcttctaaagacaaagtacttaacttggataaaggaatctaagttcagatagtgattcagggctgttatttttttggtaaaaatatttcacttattacccaccttaagcctagagctaaactaatgtagtcaccagtaattaacatttttctaatttcaaaataagtagtataaccattaaagcagttgtatggaacaatctgtaatctattaagagggttttaagtcattttatcaatattcctggaactgcatcagaagcaaatatttgttgccccagagctaaggtgatcataaggttcattattaaatgtacactgtattttattatgggaaatcagatatagtccagggatgccaggagtgaaacataccacggcttactcacacaaattttagaatacaatctttccagttgccttttacaccgtaaaattaattgtggattttgttgctattagaaacaagaaaatgaagagtttaatgagtgaaacttagaaggacagagaacagatataatatgtacagcttagcctttggaaagatagacaataaaacaaataaaaaccaaggtcctcgtactgtactcctgaaaggtaagagaggatctgagaataaggggttatggaaggagggtagataacctgactccagcttcaatatattctgggagaggattaatctctatagatatacaatttgaagagaaggattagataaacttctgtacatgtgcgaaggaatcacctgtataaaaatggtaagtttggtaatataattttccatatcttaagttccaagatgctacaactaaaaaagtggcttaagttgaaataccctcttgaaaaatatttgattatttatgaattaaataattaatatcctctctaaaatttcaagttaaattatcaagattcaactacaatctagtgaattctgttttatttgaaatagtcctacaaatagcattgcatcatgaaatataactaactttgtagtggtgactaattttatgtatcatcctgactgggctaagggatgtccagagaggtggtaaaatgttatttctgaatgtgtctgtgagagtatttccagaagatattagtatttatatcagtatttgggattagcacttaattcaacatgggtgggatccatacaatcaattgagagaccaaatagaagaaaaagatggagaaagggtgagttctttatgtcatagatgggacatccatcagtcttgctctccaaaattggcactcctgattctcagttctttttacttgtattgaatgacatcgcaagctgtcctggttccaatgttgagacagaagataatgggatttcttggcctccattaacaatgtaaaccaattcccataaattgatccctttttttctctccctctctctctttctctctctcccctaatattctataggttctgtttttctgtagaaccctaatataaactataactgacctataatgtgtgtaatagcatatgtaagtaccatttattttttaaaagccatgcatgaaatatacaggtataaatccccttcagtgatataatttgataaataagaccttcacactgttaaatatgataattcaatgtgtgaaatatgttctagacttctagttcagataagatgatatacactcatttttccctattccttcctgacaagtacaattataaaccctggaagtcacacaagggacaaatgtaagtgatttctgaaaggtatgaaaaaggcatgcttgtttgcagccttaggtctggagaaataggtcagcagcagggtatcttgtatctcctgaaccaacagaaaaaggctacccaggcctagtgtttcctgtcccacaacctgacagcaaaaggcagctcagcttcttgcagagaaatgagcttacccatttcaaacagaagtgtctctgaaaacatcaggcaaacatgacagctttgccaagggatattgcttgggagtcccaccaagaataagcagtcagtagaagcattctgcttcttcataaattatgagacttcctttatcactaagaactactgaggcaggttgtctggaaagagttgacaacagttatcctggtccagaagcatgtttgacttcgtggtgtcatgattccccatccttgtccaaggactgtccaaggacaccaggaaagctctgtctaagtacagcaggaaaactgaagttcagcagtaatggaattgctccacatgatggctccaccaagcaacatccacagaatggtctaagggaaacccattttgtgccatcatgcagcaccagtggctccagataaacttagtaagactgaaataaatataggcactgaaaataccctgccatttaaatcacagtccacaaaaattaggccaagccccacatgctaaacctaaacttggtgagtgacttaaaatagactttaacaagactaatttaaacaagactctgaatcttctatcataataagaaaaatgtctgggaactaaaaagaaaatcacctactataccaagaacggagaaaattgtaacttaaatgaaaaaaaataatcaattgatgtcaacaccgcaatgaaccaattactggaaatatctgacaagggtttaaaagtagcttttataaaaatgcttcattaatacattaagaacttattttgaacgaagtgaaatatacataatctcagcaaaaaataaaagttattttaaaaataactaagtagaattatagaacaagaaaacaaaataacaggaatgaaaacattgctggataggttgagtagtagagtggagatgacagaatagaatcagttaacttgagaacagaacaataaagttcacccaatctgcaaaacagagagaaaaactgtctcagggacacaagggacaataaaaaaggtccaatatttctgttactaaaattctgggataaaatggaaaaatgactgacactagaagaattttaaagatataatgactgaaaactttttcccagatttggtgaaaatcaaaacctacagatccaagaagctgagagaattccaaacaggttaaattcaaacaaatccacaacaagatttaacataattaatcctttgaaaactaaaaatataaaagaacattttttgaaagcagccagagtaaagtgatgcattacctgaaaggaaaggcaattcaaatgacagtagatttcgcatgtaacaccattgagacttaaaaaacctggtgcagtattttgcaagttttgaaagagtagaactgtcaactacagattctgcatgtggcagaaatgctcttcaagaatgaaggaaaataaaactattttcagataaaggcaaactaaaaggatctgttgatatcagacataccttattggttggctaaagggagttcttcaaatagaaaggaaatgacacacaaaagaatactgaaactgaagcaacaaggggaagagcagaaaagtgaaaaaatgcaataggctgttctttccttcatgagttttatctatcatatttaaatattgaaacaaaaattaaaacaccatatgatatccaaggcgataagtgaagaaagtcacagaaccaaaatggaagtgaagctttcacacttccttcaaaatggtaaaatgttgatatgtgtagatggttaaaagtcacctatgtttgtggtaacccctaaagcaaccacagtgagaaatatacaaagaagtatactcaaaaacagaataaattaattaggacagaatctttaataatgttcacgtaacacaaagaatagcataaaaaagaaacaaagaaatgagaaacagagaaaacaaatgtaagatatataataaaatagcactcctcattaatcactaattatcttaaatataaatgatttaaataaaataattagagaaggcatactgaacacacaaattactatccaactgtatgctgcttttaaaaaaattacttcaaattcaatgacacaggtagattttgaaagtaaaataatggaaaatactataccatgtaaatttttttttataaaagtaggaatgattgaattaatattggacaaaatacaatttggagcaaggaaaaacatgtctgctctagtaactcttatccaacttagtaacttctactcagtgcaactataaggcagaaaaagaaaataaaatacttaaagatcataaaggtcagaataaaattattcctatttttaggtaatgttattttccatgtagcaaatcccaatgaatctacaaacaaaacaaaacaaagaaataaactaaaactcatacaactaagtgagttcaacaagttggtaggatagaagatcatcaaacacaaatcaatactaacaatgaatattcaaaaactgaaattaaaacaattgcatttacaatcactaaaagaactactgccacatgtaataaaacatgcacataatgttttatgcactgaatgctgaaaattacaaaatactaatgaaagaaatcaaagacaaacaaaataaattaagatattacatttattaactgggagacacaacagactaaaatgtcagttcttcccaaatctataggttgaatgcaatgatttttgaaatcccagcttgaattttttttataaatataggcaagcctattctaaaaattctatggaaagacacaggccttcaattaattaaaacactcttgatgaggaagaaaatcataagaattactctttgatattaatgctggtgataaagctacagtggacaagacagtgtggtgttgcagagagaaacatagattaatgggacaggatagatgacccaaaatagaactccacaaatatcttcagctgacttttgacaaagttgctagtgggtatggttataaaatgccagtgaaagatcctagtggttttgaaactgttcagtatcataactataatgttggggatacatggacctaggcagtagataacattattatacaatttaatacccacatatacacataaaatgggacaaggagatgtgggggaatctgaataaggttgttggatttttatcaaggataacatcctggttctaatatcaaactcttaaaatctagttgtgaaaaatattgccaatgaggggtattgggaaaatttgcaaaggatgtctccgtattatattttacaaataaatgttaatttgcaattatctcaataaaaatcttcattaaaaaattatgctcaattgaaacaatgtaaataatctgtgatgaatttccagacctttggaaatactcatacctgataagcatttttatctttgaattggacttgggtagtggggtgtgtggggtatgaatgaaatgaggctctgctttctagcaaaaataaatgctttttttccctcatatttcatatcatgaaacaagttttagaaaaaaatctcaaaaagttaccatttatctccatgcttttaacagaattaatttgaaattatattacatgttgaaaatcaatttctgctcattctaaaactacaagataaatcttagtgttttaaagcttagtgtttttattccgctaattatttaattcaaatattgattaaaatatattactggatttttaggtaaatagattataaaacatacctgacatgataacatatctttggaaattagggaaattgggtggaatatttcattattatatggcatatgtaaacacaattatactgatattaacataaattaagatacctttttaaaggctaaacaatacattattatatattaatactacattttctttatccatttatctgtcaatggacatttgggtgtttccatattttaggtattacaaataatgccaaaatggacacaggtgtgcaggtatctcttcatgatgctgatgtcaccattagcaacaatatggatgaacgtagaagacactacgcttagcaaaatgagctagtcacagaagagcaaatactacatcatttcacttatatgggatatctaaaatattcagtctcacacaagcatacaagagaattgtggatgcaatgggctgggggaagggagaaatgtgaagtgtttgttcaatgggtgtgaagtgttttgttcaatgggtataaagttttcattatgtaagataaatatgttctggagatctattgtacaacatagtatctatagttaacaatatggtattgttcaccttaaaacatgttaacaggaatgttcccatgttaaatattctcaacacacacacacacacacacacacacacacacacacaccacatacataaggaaaattttgagggtgatgaatgtgtttagtaacttgattgctgttgattgtggtgatgtcatgggtataaacatgtgtctaaatttatttaaatgtatacattatctaggagtaatttttttatatctattatacctcaataaatctttaaaaagataactttgctgctacactactatttcagaggattatttttttcctgttgtctaacatctaacacaatgaagaacaatgaagtttagtatgttagctaaaatcggtgactagttgacactgaaaatgaggttcgtatcatgcattatcttttatgtgcttgatagccccaatgcttagcacatgcaaacttttcaaaccaactaccatttttcaagaagcattataacacaaacagatacattcatctttatgtgagtttccccagtttttctgttcaagatggaagatggagcacaagctttatatttttttcttctttctaaagtcccattaaattattaaaaggatttaaaagatttaaacttcccacaaagtaaagtttgtagggtttgctctcaacacaatagatagttcaataagatcctcaaagacaaattgtaaataaagtaataaatgattgataaagagagagaaggataaaagaaaccatatccttaaaaacactattgaaaggcttctgctgtgcaactctttgacctgttttgcatttttcctgagaagctcaggagtcaaacattccaagcataatggcaggtgggggcaagatagctctaaaagataaaggttaatggaaaatatttatagaaaaagtacttaatgtctccaaccagagcatttagcacgtagtcataaacctctgccaacaattgtgcctattcttggaaaaaaaatgtatgtaatttttttaagaacaatattaattatgatgtctgggataacggaaggagtcagtgatgaagggaactcaaattctcctcatttatctgaatgtcttataaacccaaagaggggttttctgtatcctcatccaaaaaaatggaaagtaattgtaacctattagttaatgaggacaagaataaatgtatcagtattttatatatattgaaaaggcaatcaaaggaagaactataaaattaaagataaaacactatgaggacaagggaaaaagaggtaggatttgtgtaaaccattggattctcacataccatagcagaaaatcaagataaaatagactctggttaaaacaaaaatactaaactattataggttggtttttatctgtaaggaagagctctgagtagaaaatggtaggaaaaaaaatggagagtacttctgtactattttatttttccatgacaggcatgtactacattcataataatcccagcattttgggaggccgagtcgggcagattgcctgagctcgggagtccgcgaccagcctgggcaacacggtgaagcccagtctttattaaaatacaaaaaattagccggtgtggcagcatgcacatgcagtcccagctactcaggaggctgaggcaggagaattgcctcactgcttgaggttgcagtgagctgagattgcgccactgcactccagcctgggcaacaaaatgacactccgtctcagaacaacaacaatgaaaatagaaattaacataatacaataatagaggtggcatgaagacgtgtagagaaaaaaatccttggtttcctttaacagtatcttttttaaaagaatattttcatttagaaatttcttcctcagcattactcaaagccaggcaaaaagactaagtacacgtatgtttcattacgttaatcactattttacaggtgtcagtcattgaaacaatgtagtaaagtctaacactgtcaaaggtctgtgtcactttattcaaggtacccttatatatcatactgtttaataaaatgagtctaaagaccaatggttctcaaagttacatatcaattcagtataatttcagtagctttagaaaatattgatatccaagtcctattttcagattggcttacttaattgatctgaatgtataatttgggcataaggattttttaaaatctcttgatgtgattctatcatccaaacaaggttgaaaacaacagacacatactttattcatatttttcccaagggaatatacaccagatcagagctttgtttttaatatatcagcccaaatttagcatattcttatttctttgttttcaacattctttacagacactaagaaaactacagctgcaaagtgcagaataaaaaacaacttacatgcaaattaacagctctccagaaagagcttttggtctcccacagctgcattacttattgacagttcccccccaacaccatacaaatatttacttacttaatgttgtttgtgccaataattgatatgtaattagatattattttgccattctctatctaaatgtttactaaaattgtaacaaaattgaaaaatcaccctcatcaatttaattaaatggaacactaataacagggttcaaagaacaagcataacaatgacaatcctacattaaaaagtaaaaaaaattagcataaactcataacataaatcatacgtaaaagagaaatgtaatcctcagcaaaatatatatgactcccttatatcattttctttctgcttggtgttcttttattttaattaaaaatagtttatgctgcctcaaatactataaatgtgtttaatacttctcataattttgatataacaataggaagaactcaagcatgcaaagtagctaatgaactgaacaagcaattaccgaacagacaagatgttccagaacaagtttatgaatcattacttttagttttatatatataacctgacaagtaaaatctctttttcaaaacaggttggtggacactggagtaagtttaaaaaagaaaggtagtgacctctaattcttctgagatgctgcttactttaaaataaaatgaattatatttaatatatcttgatggcataacagataagataaaataacaaagtaaaattcaaatatgttaaaatttcccaaagagttgaggcattatactaggtatatgctgggcatatgtgtttgtgtgtgtgtgcgtgtatgtgtgtctttcatgtacacccatcttacttttgaaaaatcaatactctattgtgaaacttttggtatgaaaccttcaaggggcagattttgcctcttccttacttaagctgccagatcactggctcatgacttaggctgggccaaaaaatgctcttgtctggagctttgaaatttgaccaagtgacacaaagaccaagggaaaaatattatttacggttgtgttatcaagaacaaagaagtagcagcaataatagtttaagtctggtgacggaagtgtcatgggcaatggtctggcccaattgttcctaaggtgtcagcgtggctgcactttcagctattcagcctccctcggtttctgttttattttcacccttcctcactggcctttctgccaattgtgaaaactattcaaaatccatccaaaaagtcacttttacgcttaaattactcagagccggattctgttacagttaagaaggtgatctactgaaccatgcctttgggtacaaatactccacaaactcgcacatttataaatacagtgaacaataacaatgcatgctatctgaaaccaagatgaagtgagtctgacttaactctcccagtcttcgtaacatttttacatattagagttaggtattagattcataatgtctcacacgcatatgagtttatgtgacctttacagactcatcgctttagatccattttgcaaatgtggctacattttcttcctaattagtctaaacaagtactgtctgatattgtaactgatagcttagacacatatttaaatttaaagtaatgaaatctaaacattcagcctctcagttgcactagccacatttgaaatgtgcagtagtcacatgtagctagtgactatcgtaatagtgcagatgtacaacataaccacaactgcacagttatgttggccagcactggtctaaacccattatggtaattcagccttttcccagcgagtaattctgaaatccagacttcagtcatttggcacaggtcgactgtcattcatcgaggtaatccagtaagacgcaaagcaagaatgtttacattttcaataaaatacatttcttattttacattttattttatatttctgattaagctagctaataaattgttttcaaccaaaagacgttgattgataaactggtacctagaaatgattgataaactagtacctaccttaaaagataaatcctaggccgggcgcggtggctcaagtctgtaatcccagcactttgggaggccgaggcgggcagatcacgaggtcaggagatcaagaccatcctggccaacacgatgaaatcccgtctctactaaaaatacaaaaaattagctgggcgtggtggcgggcgcctgtagtcccagctactccggaggctgaggcaggagaatggcgggaatccgggaggcggagcttgcagtgagcggagattacgccactgcactccagcctgggcgacagagcaagactttgtctcaaaaaaaaaaaaaaaagaaaaaatacgaaaaattagccgggcatggcatcgggcgcctgtagtcccagctactcaggaggctgaggcaagagaatggcgtgaagccaggaggcagagcttgcagtgagccgagatcgcaccactgcactccagcctgggggacagagcgagattccatctcaaaaaaaaaaaaataaataaaataaataaataagtaaatcctaaaatgtgtacttgacaactattgggcacttaacattctcccatacctaggtaatcctttctataataaaatatagaaactgactgaactatatagcctgtaaatctaggtacttggacctcacacaatttgttaatttgccactttcgagggttggtcaaaatcccaatcaaattatttgtatctctgattctacctgtgcctacaccctgttctactcttcaggtatataagctcagaaattacttcccattattaagcttgtttcagatggtttattccagggccagcaggaaattactaaccaatataaacatcattaaaacagataagagatcaggatgattagcatgttgagaaacatgtaaattttcacatgccctggattattaatgagggcgatgactaaaacagttgaagaagatacatacgtctattacaaataagtaaataatccatggattcccattaatttatagtcttcttctatcactagtcaatattcttgaatatggctcagcctctgaagattactaagtctcttcaggagaaaatagccacctaggcataaaatcagctatggaaaaaaatcattattattattatgattttttttttttggacagggtgtggctctgtcacccaggctgaagtcccatggcacacaatctcaactcacggcagcctctgcctacaaggttcaaatgatcctcccacctcagcctcccaggtagctgagactacaggcgtacaccaccacacctggctaatttttgtatttattgaggagatgggattttgccctgtttctcaggctagtctcaaaactcctgggctcaagagatccacctgcctcagcctcccaaagtattgggatcacagacatgagccaccatttctagccgaaaatatatcattcttatattattctcactggagcatcagattttgttatccacgtcctccttgaaactttctcctttgtctactatgatttcacttccacttgattctacgccctctgcagaattttaatttcaaactctctgtgaagtcccagttttctctttcccctttgaagtttttgttcttcagaattccattctgaataagatatccatatgtgttttcctaactctttctccatggcttcaattaccatctaaactccagtgtctcctgatgctactctttagcctacatctctctgtaatactttgcatttttctatacctgcctatctgcaggcccacaaaacacccagatgaagcctgtccaaataacttcatcactctcatgccctttactcatcagtcctttaatacaagccggagcctgccaaccaccttcaaatagtcctgcagccctttttttttccctttcaacagacacaaagtcgtgtcaattctacatcttaaaaaatatttaatcaatctatttccttctctcaatttcttctacaattgtcaaattcctgtctagatttgtgcaacaacaaagcatcctctctgatgccaagcttgttctaaatgtcacaatttcatttaccacttggtaatctcccagtggattcccaaacacttatggataaaccatatagctattttcttcttcgaatcttctaccaggattgtactcagtcacccatccacgttctctggcattattctcaggcccacttctaacacatgcactctgctccaaccgttacccctgtttgtccttgaatgtgacacatttaacctttggatatgtagttcctaaaatttcactggagttccttcttaacaaacacattttaccagcctcgttttctactaagagcaaaatatattagtgcaagttatttttcttccaaagccttccctaaattgatctcagtcaaatgcatctctcctcgtgcaccactgcctgcgtgttcagcactgctgttgcactatcagcactgtgatacaattatttcttcacaaaactgcctctgcttcttgtcttaatttcactaatcattgcagcggcatattttatcaatgtaatctccaaatctaacaaagcaaatggcattttgttagttaaatttatgttgaagccacaacttttgaagtgaaatagggttttagcatttgtcttgttcttccgccttatcaatgtacataataaaactgggctctaggaggctggatttaccaatgtcaaagatttatatcgtaaaaactgaagaatactagttcaatattccttcttcggtttctagatacttaatacatgttacaagtatgtctcaggggagttgtcctgaattcataatgcattatatagcccaaacttgtattgtcacttcaatcattatgttaaagtaagcaaactttgctctgctaccctctttcctattgcctattaactctttacagaaattaacctacatttgattttctgaaaacctttcttccctgaaaccagttgctcacagagaagcaagactgattgtataacgatacatatatgtcaataaatacagtaattcattgcttagtgtgtgtcattagcctatttcctcactggggaaaccctataaagtgtagttaaactagatggtacagcctactacacactaagactatataatataatactctctattgctcatgggctaaaaacctgtacaacttgttactgtactggttactacagacaatgttaacacaatggtgtgtgtatctaaatatatctaaacatagaaaaggtacagtagctctctagtttaattagatcccatttgtcaagaacacatggatgcagggaggggaacaaaatatagggacctgttgggatttgtggtgggggtagagagagcattagggaaaatagctaatgtatgctgggcttaatacctaggtgatgggttgagaggtgcagtaaaccatggcacatgtttacctatgtaacaaacctgcagatcctgcacataaaactttaaataaaactaaaaattaaaaaaagaaaaggtacagtaaaaatacagtgttataattttatggaaccatcatcattgactgaaacaccattaatgtggcacatgactgtacattgatactacattactttccttcttaaaagtaaacaatgtcttcagtttctccaaatattaagtccccaattatttccttaaaggggctttgtaatgtcgaggctctactgagaagtgtagttttctctctctcctcactacatcttctttcctaaaccacaggtacctgagtctttgagccttcactgcacaaacttctttccatctcaggatttttacacatgttaattctccaccacgaacacttatccattcccaatgaccacacaaaacacatcagcattttggccctgattggctcattttcatttttagatatcagcctgattattccttccccagagagttcttccctcatcctccatctaggttttacactgtgtatgtagtaagtttttttcacaattctcatcattgtttatacttgaatatttatttgtgtgaatgtcaatttaatgttaacctttcccaatctatctgcttttttcactactatataaacaatgtgtaacatagtgaccggaacacaggtcactgtgcattttaaataaatgcattttgagtaaatgaatatatcctatatagtattcaacctttgtcaaaataaactcgattatagtcaagctaaagcaccaaacaatagaaaacaaggaaaaggccatgactaagttagtatactattatatgtaatattattcttttgtttttaatgtagaaaaatattttatagcatatattgtttaatctctatgaatataatgacaagtatgttgcataagaaacaaagaattctagctgaaaatgattgattatatttaactttgtaacttttgtaacgaatgcctataattttctttacaaaagaaaaaataaaacaaaacaacaacaacaaaaaaaaaacaaaaataaaactgaatgtatttgaaggcccactaggctcaacttttaaattaaatgtctttgttatgtgaggtccagtgcaattaaatgttcatacattcattggataaaaatcaataaaataatagaacataccttctgagaataatgtaataccaatgttaaaaacaattcatttccttaaagtaaatacctgttgaaatacatcagtctaagcctggatgcggtggctcacgcttataatctcagcacttagggaggccgaggtgggtgaatcacctgaggtcaggagttctagaccggcctggccaacatggtgaaatcctgtctctactaaaaaaaaaatacaaaaattagccaggcatggtggcgcacacctgtgatcccagctacttgggagtctgaggcagaagaattgcttgaacccgggaggtggagcttgtggtgagccacgagagcgccactgccactccagcctgggtgacaagagcgaaactctgtctcaaaaaaaaaaaaaaaaaaaaaaaggaaaagaaatagaaaatcagtctacaattagttataaagaaaaacaatttttggaatatatatttctacattatatttgggaatattttagaattttatctctgtatctgtgtgaaagtatcaaagcatgataaaagaatactgtatgtatatccagaaaggatattaaaaatattatttaatacaaatcttgcttttgtacaaaacaaaacccgaggaaagatgtggccataaaaatggcagacaaagctgatctaggcatttctcttactatgaacaattagaaatggtatataaaaattcaaactaaaatacaatacaagcaatctagaaacagtaagagataatccccaggggagaaagaagggagggaggacttagggacatggaggccattcccaactgtcagatagcccagtgcctctggggaaaattaactaagtacacgctctaggcaccaataatttgatttttacacctcctgaagactagaaaaaatagactttcattctccttaagatatagaattagaatggagctgtctgaagaaagccaaaacacttaaaatcaactccctgaaattaatgggtgcagcacagcaacagggcacatgtatacatatgtaactaacctgcacattgtgcacatgtaccctaaaacttaaagtataataaaaaaaaattagactatatactcaccagctttaaaaagtagcaaagaattttgtggttattaggagttcttggtaaaaaaagtttcatatgagaaattgaaactcaaacctacagcccagataaaaggaaatatatgttttatattttagtgttgttgttgtttacattaagtgtatacataagaatcagtagttaagaattaaatccatatttatgaaaccatttgttgacagcagttaaaaagataagtggctctctatgaatatttctcaagttaaagtttaaagggattccactaagaaccccattttttcccatcataaaccactggagaccagtgaatataaaaatgttaaagatgtaccaggatcaaatctccacttccaatagtgaatagacaaaggaaatatgagaatgggaacatcgagcacacacacggaaaatagaaaacttgaaaaagactgttatttatgtggtttggaagaattgaagcaagaaaaactagatgtcaaaatgaggcctggtgaggtggctcctgcctgtaatcccagcactttgggatgccgaggtgagcggatcacttgaggtcaggagtttgagaccagcctggccaacatggtgaaaccccatctctactaaaaatacaaaaattagccagacatgatggcgcacacctgtaaccccagctactcgggaggactgaggcatgagaatcacttgaacttgggaggtggaggtttcagtgacccaagatcacaccactgcacctcagcctgggtgacagagtgagactccgtctcaaaaaaaataaaataaaaataaaataaaataggagaaaataaggcaaaaggaaagagacattttaagacaaattcaagttaatattcatacttaattcgaagagcataggataatgatttaatttagttcaagacagcattaatacattagagataaaacttaagaaattatatcaattagaagttttagaatgaaacgaggatgaaacaagttcaaataattgttcaaataaacaagaacaaagcaaatcaatatatttgattaagtaaatatatttgattaagtaattaagtaaatataatatacttaattatatttttctaattaggtgtaaaaatcttaatcaattaaaaagtactgatattagattgccttgggctcaatagtgcatatgaaaaaagcatatgttggctgggcacagtggctcacacttgtaatcctagcactttgagactctgaggctgttggatcacttgaggtcaggagttcaagactagcctggccaaactggtgaaacctcgtctccactaaaaacacaaaaattagccaggtatggtggcacatgcctgtaatcccagctacttgggaggctgaggcaggagaattgcttgaacccaggaggtgaaagttgcagcgagctgagatcctgacactgcactccagcctggatgacagaaaaagactctgtctcaaaaaggaaaggaaaggaaagggaaagggaaaggaaaagggaagggagaaagagaaaaagaaagaaagaaagaaagaaagaaagaaagaaagaaagaaagaaagaaagaaagaaagaaagaaagaaagaaagaaagaaggagagaaagaaagagaagaaagagggagagaaagaaggaaggaaggaaggaaggaaagaaaagaaagagataaagaaagaagcatatgttaaagctctgaaccccaatacttcaaaatgtgatcttattaagagatagggtctttacagggctaatcaatgtaaggtagggtcattaaggcagtcattaatccaacatcagtgatgttcttataaaatggagggctttggacactagatacacatacaggaaaaaaactgtgtgaacctgagatggctgtctaggagagagacctagaacagatctttcccttcgaaggaaccaatcctgctcacctcatgatttcagacttccagcttcccaaaccgtgagacaataataatatgctgtttaagtcacccagtttgtgctactttgttacggcagctctaggaaataaatacacagaccaaaaaatataaaaagaaaaaaattatctgagccaaggtatattagccaatccagagaacacaagggacatagtggtaatcctgaaataagcctaagagaaagaaagacaatttaaatgaaattatagcaggcttatcagcaacaatagaatccagtatacaatatatcttcaacaaaacaatagtggaaaaattcatcctagaatccttcacacacacagaaaaaaatggtaattcaacaaagaagaaaaaaatgaccattcaagatcaaatacaaaaataaatcagtaaaggttctacataaacaataaggaaatcaaactgggaggaagaaggggatagaagcaatcaacaacaaagatattgataaatgtgtgtaagtctaagcaagagtgaatgtttaaatgattttagcaataaggacccatctggaaagtactttataaaacaaagaaacaaaatgctagacaaaaataatgtgaacaaagagaaagtaattagtgtttaaatatcctaaggtttttgtattgtttagaactgtaaaggtatcaactttaaactttatgaagtatatctgttaaaaataaatagagtacagtcatagttcagtaaaaagcaaattgaagccaggaagaagaaactggatatagaagcagagagaagcaaacaaagtgttaaatatgttagaaatgtaagtatatactttatacattaatactaataacaataattattattatttggaggtttaaaaataacttggtgtattatgaaagtgcatgtagaacgtagaaaacaaaatatgtaactgaaatttgaacattctatgtcgttgttggagaagtagaaggagatattatgttttgacatggaagtaataaatacatgcaaaaaattaagagcaatcacaattgcaaaaagcataaaacataaaaccaccaaacagatagaaactccagtagacgtcattacaggagaacaaaagaacaacaaacaaaacaagaaacaacctaatcaacaaaaatttgttaagcagaaaaaacaaaataaatctgtaatgggtccaaatgcattaaaaattacagtagaaacgcttttacactgttggtgggagtgtaaattagctcaaacattgtggaaaacagtgtggcgattcctcaaggatctagaaccagaaatagcattcccaaaggattataaatcattctactataaagacacaagtacatgtatgtttattgcagcactattcacaataacaaaagacttggaactaacccaaatgcccatcaatgataaactggataaagaaaatgtggcacatatacgtcatggaataatatgcagccatgaaaaaggatgacttcatttcctttacagagacatggatgaagctggaaaccatcattctcaggaaactaacacaggaacagaaaaccaaacaccgcatgttcccactcataagtgggaattgaacaatgagaacacatggacacaaggacgggaacatcacacactggggcctgttgacgggtgggggactgggggagtgatagcattaggagaaatatctaatgtagatgatgggttgatgggtgcagcaaaccacaatggcatgtgtatatttacgtaacaaacctgcatgttctgcacatgtaacccagaacttaaagtataataaaaaaaattacaataggcacaatggaataaaaccattgtttaaaaaaagaattgtcagattctataaaaaaacagaaagttaaaactcatttctatgtggataagaaaagaagataaatatgatatatatcattataatgatataattgcttggagaaaatatttaagagcatttttaccaagagaatctttttatcagaattttaatatctcattagagagactcttcagaaaaaagacattagaactatatattatttaatgataaactaaatcatttatctgcaacctgtaattctgaactaataactattttggaacttaacttcagaaagggaaattacaaaattacaagaatattgacacttgtagtcatagtaaacaattttatcatcaattccacaaagggaaagccaggatatttaaacacatttgaattgagagtgtcataaaccattaaaatacactgaatatacatattttgaatatttaattctatttcaaaactacattgttatgataattattgacactaatgtgccaaaacagaattttcatattatcaaatgtggaaaaatctatgatttttttggaagcttttttttggaagctttcacttacatgtgtgttaagtctattgagaacaaataaaataagccaaaataagtcaaaaccagcttctggtagtataaccagaagtattatccagaagacgtaacaaccttagggatgaggaggataggagaatattgtctttttgtgtgtgtgcagattttaaaaaaaataaatttaatatgggagaagaaagaggctcttttgctagcatgacattaaaataatttaaaataaataaagtctcaatagactattgagactttatttatgtttcaaaaattattttattattaaagtaatataacaaatgaacttttattgtaaaaatacccaataatatgagcaaatcaaatgtttcccttgttgcttaacgaatattactcccacactcacagaaacaatagataatactattggttttggtttggccttccaggcatgaattatgtcctaaaaaaaaacactcttgcatatgcacacaaattgcatatacatacaaatgcaatatacacataatttctcaaccctggcactattgcaattttggactggatgattatttgttggtggctggttgttctatgtgttatagaatatttagcagggctctacaaactacataccaggagcactacacctatagtcatttaaaaccaaatcccaggagggcgttaaaactttcacgaaccctatacccttttgcacttgtaggtccttttatcaattaaaaaataaatttgatttacaaagaaaactgatagaaacaataatagaatgcaggttgaataatactcattttcattttttattctgataaaaatgtattaaaacattttcctaggccaattgtaactaatagacaagccctggaaaaaaaaatgtttccaaatattgccaaatgccctctagcatcaaagtcacctctggtttagcaaaattgttacacacacacacacacacacacacacacatggacacacacacatagattagtatgtttgtatgataatataaagttcacaatgtgaataaatatatacactgtgcccataatgtgtattgctgaactttaaaaatttgtcagtgtagacttaggaaatgctttcattaaacatttgctgaattattcaaataaaatatcacttattctctaaaaacataattaaccttaattaaatctgatttatttaaaaaactcctaagttactacaagctgaatataatatactcaaataaaattcattttctctgcatccagtttgttggaggactgtatctaaatagttgttttcatgatgactactggaaaagttatatattcacgtagaattgtgtgctataattaattttacatgacaccatgtcatcatgttgtcatttgtataagattcagatgtcacgttttgatataaaagctttcccatttcaaggaagctatgaaaacatgtttatatagttatcatcttgacaatattggatgacaattgagaccttttcttgttgtacatttaatttttaattcagagtttatgatgacataaaagctatcttttttctaaaaagcttgaaactttctatttccttttacatgatttattctctctttaacctaaaattcatttctttaatttgaaaatacatattaaatatcttcatattaaaaaaaaattgaaggttgtcttctaagtaatgaaaaatatagaataaggtcagtgatagtgatgatgagagacgtattttatgccctctatattgcaaagtgattttcattaaggaactggatatctcaatttttttgacacctccgtaactaatcctatgaacacgaagaggcctcttaactgttttgagcatcgctcctttctatcacttgaggaattcagcaaaatagtttctcagtttttttatttcactggaactttttccttaccctctgtttcttgtagttgtttttgtttaataaagaaatctacacctatttattcacacatgataggacacaggtaaacagatgagtgagtgggagaattttagtaaccaagttcttaacagatgtaagcaaaatcttcaacatacgatttatatctagagaaaattctaacagttataaacagatacaccataaatacagtgaagatagagaacgtcattcttttgtttattcagaaaacaatgtttttattaacttttattaatgaactatttttaatgtcaatatagccaagattctaaggcaacattggtaatagattagaatattttagcctaaacaatatggcacactatttggtctcttatctattctttttaatttttattcctatcctctttaatggtcaaatagtgcaatgtggacaagatccacttacaaatacttggagataaacatagagtttcttaattttcttaagaaagactgtttagtcagttaaaaacatcatcaatggtgtttttaaaatgaaaataatatgcatttatggagcacaacatctagctaatcacaaggacttagcacttgaaatttatgaagcatattgccagcagctttgctttagcaaaacagacatgattttaaatgtctccttagttaaattatatcaattgcagatgtttaaatattcctaacatattacattaataatccacacacttcacaataacaaccttcacctctagaatatttcattggtaaatatgaaacataaatccaatctagtcaatagttaatgactaaaaataggaagtcagatgtattttaaattataatttctagtccctaacataagcaatttcactgctgcatcattcttttttatttaataaaaaaaatttaatacaggtgttaaaccgaagataaaaagggctaaggaattcatttttctcaactgctattaactctgaaaaccagtaccctcatggcttagaaagtcctaggtcaaacaaaatataatttcagtcaaaagagtgcaaagaattactatattaaaataataattttattaaacaaaacatcatgaacaaagttaaaagacaaatgtcaactgtgaaaaattattaataacttttatcactgacaaagaactactgcacctattatgtaaagaattaatagggctgataagttaaacagactagaaaaataatgtaaaataaaggccataaataggcagttaataaaaaagaaataattacatctcctcaaaattggaaaacatcatcaattttactcataatacaagaaatataaatttaaagtacacggggatatctttttttcacccatcatgtttgcataattccaagttttaaaaacaaccctatgtgttgttatctctgtaaagaaacaaacactcttacacatcattggcaaagggagatactgcaacatctatggaggaggctctagtgatagctatcaaaattaaacttacttatctttgaatcggaatctcacttacagaaatctctcctacagatataccaatatgtgtgctacatgatatgtgtacaaggacattcataacattattacatgtaatagcaaaaaagtaacaagagacaataaatactcattaagttaataatgggagaggggtgagtacatcagtgaaagtagtgaggtagagacttccaaaaactcatcaataaaagtactgattaataagacagaatttgtttaatcattttaaataatcactgcaatcattaatatggctatcaaagtttatagttcatggcaaactttccagtgaattacaacatttgatcattctactaggcaggcactatgacaggtactgtgtgtataaagatacaataattccagaacctgatcccaagacatgtatgatatatttttttgaggtagacttcttacccaggagctcaaaaacatttcctgtgaatggtcaatactgaatatttttgaatttgtgagtcctactccctctgttgcaactactcagttctgccattatggcatgaaattagccatagataatacataaataaatttgtgtgtctatgtccccataacatgttatttatggactctaaaatataaattttatataaattccaggtatcacaaaatattattttctttccatttttttcccaaaatttaaaaaggaaacagaattgtatgtaggcaatacaaaaacagacagtgggctagctttgacacacagactgtagcttaactgaaccctgatctaaaccataaaccaaactttataatatacttcaattcgtaatcaaaatgtcaacagtatttttcaattttacaaagatgcaaggaattaaagagacttaacaattgtaatacaggaagtaaatggatgagttataactcaagcttagctcctcactcagtaattattattatctcatgaagacaagaagtctattataatgagcattatgatgtatgacatgaattgtaggatgtgtgtaatatcttaagtaaaattatactcttatttacaacatgattcattcagcactattcaacttttgaaaaatgaaaaatagactaactagtctgttagtttttacacgattttttaaaaagaacgaacaaattgttttaaaattatagtgactaattattatatacagtcgtgcttcatttaaggatggaaatacattctgagaagtgcatcgttaagcaattctgtgtttttgtgaacatcacagggtatacttacacaaaccgagatgcaatagccacacaggcacacaggctatatggtgcagcctattgctcctaggctagaaacctgtatagcatgttactgtactgaataccatagataattgtaacacaataataagtatatgcatatctaaacataaaaacagtacaatataatatgcactatagtccatcatatattctttccatagttgactgaaatgtcattatgtggcacatgactataatttgtttcaggagaaaatcagttactttttactaaatttgctactattattttcttatcgtaatccttcaattattttaaaagatctttaacaagtaatcagatctatgagatatatccctccgctagtttggatacttgaactctaatggcaattacatgttggaaaaaaatgtgacttatggattatcatatatatttatataagtaatacatgtatatatacatatatgtgtttatacctctgtatacaatttatcatttattattacaaagttctctaaaatcatggctttagccacatgtatatatattagtaaagaataatatatattgattaatgtcaacagaattaattatatcataataaatctaatcattgagaaaatgtttaaaaattattataagaaacataagggaagctagtacatatcaaaatacttgggcttgaactcttattaaaaatttagtaaagtagaataagatggccaactagacacagccaggagatgtctcttccaacaagagaagctaaaatatcgagtaaaccatcacattctgaacagatcttttgagagaaaacactcaaagtcaatggagaagtgatgaagacaccgagggtgaatagggacaaagctaggaagcctatatggagtctccaagtgtcaagaatggctcccagttctgaccaggtcctaaggaaggggtgagtgaaggaactgtgaggcagcacactcgcattgtaggtgggatcccagctacaagagatcccatgaaccccacagatatttgaattggcaaggggaacttcccagagaggaggcagaggcttgcacagagcccaaaaggttttgtgtgggaggcagctgctgcaaaacacaaccataagtgtccatcccccaaggctctccatcttgctctgagtggctctggctcctgtgaatggccaggttgggagaacagggctgcctttcccacaggaccatggtgcatctgatttacaaaacccctttttagctggcccctcccgaggtccctgcctggccactcccataagaggaggcacacagcacagcctccattgccccagctgagtgtttttccagtggcctgagagcagtttgcccctccccagtagagtcaggggtcccagaggacaaagctttcaaagctttgggcttagtcccaaccctccagggtttgagcaaaacacccaggagtattgaggtaagatctgggacttgtgctcaagttggggatgagcccctactctcagaacattgaaaccaatgtctgatgtatgggtttgtgtgctggcatgggagttggtcatccctctctccacaaaaccagacaagaaagagtgtagcaagttggccagctgcaatttctccctaaggcagccctagagcccagaacacccagagtgacctagcaatccgggcacagaaggtttggcacaaaactagctgttcagacctgctcctggagtagacaacagagggagaaaccaacaggggagtgacagctgggcagttcccacagccatctgtttggcaaaatatcctgggccataggtgccacaacagctacacaccaatggcaccacttccttgtctagggatcctccaccctaggcccaccgcattaacagaccacttgtagacataccccacaacccactttgactctgccaaactcagaggaccaaaaggtccccagtgaatggcatgtcccctggtggactaacctttgactcaagtagcccctgtgagagagtgcagcctgccagggacctgtttgagcctaaagaaatggggacctagcaccagtatttggaaggggttcccccaaggcccaggaatggagttggtgagggtctcatctactggatctcaccctgaattgtaccaccaaataaaaataaatttctctacctggatcacctgtgaaacccaaggcaggaagccagctacaactaaggaacccatacagagccttggactctaaaagcacaaagaaacacaaccaatccataatacataacattcatctcaatcaaacacacaacaggaaaaaaaataaaaataaaaccaaaaagcttcatcgcaataacagaaacttcaaaaaaataatgaaacgttactcatctcagatgagaagacattggcacaaaaactccattaatttaatctttggagtactctcttacctacgaagactacactagctccccggcaatggattctaagcagattgagatgacagaagtgacagacataggattcagagtttggatggcaaggaagctcaacaagatccaagagaaagttgaaacccaatccaaagaagccagtacaatgatcctagagtgcaacaatgacgtagccatttttagaaagaaacatacttgaacttctggcattgaaaaaggtactacagggaatttcaaaacaagtttgaagccacaacaatagactagaccaagcttagaaaagaatttttgagctcagagactggtccttcaaatcaacccagttaaccaaaaaacaaaaaacaaaaaaaaaaaaaaggaaaaagaatttttaaaatgaacaataactttgagaaacatgtgattatgtaaagagaacaaacccacaattcctgagagatggagagacagtaagcaacttggaaaacatatttgaggatatagtcaacagaaattttcccaatcttgctagagaggtagacaagcaaacgtaaaataaaatctagaaaatctctgtaagacactatacaagatgactacccacaagacacatagtcatcagggtttccaaggtcaaagtgaaagaaaaaatcttaaaggaagctagagaaaagtgtcaaatcacttacaaagggaaccccatcaggctaacagtggacttctcagcagaaaccttacaagcctgaagagatcagggccctattttcagcatccttaaagaaaattaattccaaacaagaatttcatatcccagcaaattaagcttcataagtaaagaagaaaaaaatcttttctcgacaagcaactgctatgggaatttcctaccactagaccagccttacaagaaatcctgaagagagttctaaatatcaagacaaaataatgatacctgcttccacaaagacacacttaagtacttagtgacagacccttaaaagtaactatacaattgagactacaatataaacagctaacaacatcacaaccggatcaaaacttcaccttgaatgtaatatcaaaattaaacttgaatgtaggtgctctaaacactctcacttaaaagacacagagtggcaatttggatgaataaccaagaccatccatcttttggcttcaaaaggtccagctcacatgtaatgacacccataggatcaaagtaaagggatagagaaaaatctgtcatgtaaatggaaacaagaggaggcgttgttattcttaaatcagacaaagcagattaaaccaacaacaataagaaaggacaaaaaggggcattacataatcataaaaggttcaattctatctggggaaattcagccagatatcaggcaaaactcacccccgatatttcacgtaggttcttttctattttccctaagtgtcagccagtttgagaaataaagggacagagtaaaaaagagagaaattttaaagctgggcatccggggcagacatcacatgtcagtaggttccgtgatgccccacaagccgcaaaaccagcaagtttttattagtgattttcaaaggggagggagtgtacgaatagggtgtgggtcacagagagcatgtgcttcacaaggtaatagaatatcacaaggcaaatggaggcagggcgagatcacaggaccacaggactggggcgaaattaaaattggtaatgaagtttcgggcacgcattgtcattgataacattttatcaggagacaggatttgagaggaggcaactggtctgaccaaaaatttattaggcgggaattttcttgtcctaataagcctgggagtgctatgggagactggggcttatttcatccctacagctcgaccataaaagacagccacacccaagggggccattttagaggcccaccctcagggacgcattctctttctcagggatgttccttgctgagaaaaagaattcagtgatatttctcccatttgcttttcaaagaagagaaatatggctctgttccgcctggctcaccggcggtcagagtttaaggttatctgtcttgttccctgaacattgctgttaacctgttcttttttcaaggtgcccagatttcatattgttcaaacacacatgctctacacaacaatttgtgcagttaacacaatcatcacagggtcctgaggtgacatacatcctcctcagcttacaaaaatgatgggattaagagattaaagtaaagacaggcatagggaatcacaagggtattgattggggaagtgataagtgtccatgaaatcttcacaatttatgttcagagattgcagtaaagacaggaataagaaattataaaagtattaatttgggaaactaacaaatgtccatgaaatcttcataatccacattcttctgccatgacttcagctggtccctccgttcggggtccctaacttcccacaacacaattcaacaagaagacataactcacctaaatatacatgcactcaatattggagcatagagatttataaaacaagtacttctagacctaagagaagacttagccacaataaaatagtggaggacttatcaccccactgacagctttagacagatcattaaggcagaaaactaacaaagaaattctgaacataaatttgacactgagccaattagaggtaatagacacctacaaaatatttcacccaacaaccacagaatacacattcttctggtctacacacagaacacactctaagatcaaccacatgcttggtcataaagcaagtctcaatcaattcaaaagtatcagcagtgtgttaaacatactctcagatcacagaggaatgaaaatagaaatcaaaactagatgatctcccaaaaccacacaattacatgaaagttaaacaacttgctcctaaatgacttttgagtaaataacaaaattaattaataaccttaacatcacaactaggggaaatagaaatacaaaaaaaaataaaaaataaaagaatcccaaaactaacagaagtaaagaaatagctaacatcaaaagtttctgcaatgtgttgaattcacgtttgatgtagatgctaaggcacagtggaataatatacgtggtccaataattggatagaagatggcagattagaagctcatgtgtgctcctctcacagagggggagcaaaacaggctagtgaatactgaccctgcaagctgatcaactgagaaaccacgtcgggacccatcaaggcagcaaagtgacacagagagcagagaggagtagagctagacaccagcctgtctgggctcaccatggagacaggagaacctccccagtatgggaaagggtgagtgatcgagagctcctaggggattcatgttctccacaggaacttgtgcaagactggaaatgagagaatcctcccaagttccccatgccttccccactaccatgcttctagacaggcagagagccacccggacattttgaagtggcaactttggagttcaacaaaacttttacaagccttgggtcccaaagcagatgagcaccagcaccatatcccccgtagaggccccagttttggtgcctgtgagtagtaagattgcttcactcctcctagctggatggggcttcacaccagcttcaggcccagcagtcccacttctgtgtgaactcagccaaaggacacaaccttctgttgtcttggaaaacacccagatgacagagagggtgacccaatccaaccctgcaactggtagctgtgtgggcaacacttgctagagcttctggcccagtgtccttgcatctgtatggattcaaccagtgggtacagtgggtacaaccttctattgtcccagaaagcacctggacagcaaggcagataatcacacccatccctggcactggtaaccaggtgggcagcacctgctagaccttttgacctagtggttttacttttttgtgaactcagctggaatgcacagcttctggttgtcccaggaagcatccagatagcagggcaagtgacctcacccgctcctgccactggtagccaggtagacagtgcctgctagagtttccagtccagcattcccacttctgtgtgaactcagcaagtgggcacagactcctgttgtcccaggaagcatccagatggcagggtgggtgactcaacccacccttgcctcttggagtcaggcaagcaatgccagctagagcttccagcacactggtcttatttctgcttatatttgccaagggaaacagcctccagttaacctcaaaaacacgcagacagcaggaggggtaattctacccactcctgcctctcaaagctagatgggctacacccactagagcttccagcccagtagtcccacttctgcctgaactctgcaggcaggtgcaaccccatgttcccctgggaagcactggacagcagattagggctgacaccgcaaggatacagcctgtctgccaactgttgcccctgtctgagggagctgcatagaccagaacacctaacaaaagaaacatggacacagagacagtaattgaaaggagtacattcaagatccaggggcaaactagattcaaagcttgtcaatagaatccaccttatacaataatcaaactctcaagggcatcaaagaagataaaagcaaacaaaacttatgcaaaggacagcaacttcaaagattgaaagaataatagccaacacagatgagaaaaaaactagtacaagaactctagcaactcaaaaagccagagtgtcttcttgcttcaaatgaccatggttgcttccggcaagagttcttaaccaggatgaaatagctgaaatgtcagaaatgcaatttagaacatggataggaatgaagatcatcaatgttcaggagaaagttgaaacccaatccaagaaatctaaggaatataataaaatgatactggagataaaagatgaaatggccattttaagaaagaaccaaatggaactaacagagctgaaaaactccaagaatctcataatacaatcccaagtattaacagcaaaattgaccaagctgaggaaataatctcagactcaaagactggttctctgaagtaacaggcatgaaaaataaagaaaaagcaatataagaaaaatgaacaaaacctccaagaaatatgagattatgtaaagagaccaaatctatgactcagtggctcgctgaaagagaggaagagaaatcaagcaacttggaaaacagatttgaagacattatccacaaaaacttccccaaacttgctaaggaggccaacactcaaatccaagaaaggcagagaatccctgtgaggtactataaagatgaccattccctaagacacagtcatcagattctccaagtttgaaatgaaagaaaaaatgttaaaggcaactagaaagaagaggcaagtcacctacaaagggaaactcatcaggctaacagtgaacatttcagcagaaatcctacaggccagaagtgactaggggactatatttagcattcttaaagaaaagaaaagaagttacaaccaagaatttcatatccagccaatctaagattcataagcaaaagagaaataaggttcttttcagacaagcaaatgctaagagaatttgttaccaccagacctgcctaacaggaggtccttatgggagtgccatagatggaagagaaataccattaccagccagaacaaaaacacactaagtgcatagatcattgacactataaagcaactacacaatcaaatctgcataataaccagctaacaacaaaatgacaggatgaaacctgcacatatcaatattaacctcgaatgtaaatgggctgaatgtcccagttaaaggcacagagtggtaagtgagatgaagaaacaagactcaactccacgcagtcaagaagtgacccttcttacatgcaatgatacccacaggctcaaagtaaggggatggagaaaaatctaccaagaaaatggcaaacagaaaaaaagtgagggttgttattgtaatttcagacaaaacagactttaaaccaatgaacaaaaaaggcaaaaagaaaaagtgttacatgatgggaaagggttcagttcaacaagcagacttaactatcttaaatataaatacaccaaacaggatgtcccaagttcataaagcaagttcttagaaatttacaaagagaattggataacaccacagtaatagtaggagacttcaacaccacactgacaatatcggacaagttatcaaggcaaaaaaaaaaaaaaaacttaaaatatttgggacccaaacttgacatttgaccaaatgagtttaacaaatatctacagaactctccacccctctgaaaaacagattgtaaattcttctcatctacaaatgacataaactgtaaaatcacccacacaataaaaaataaaacaaccctaagcaaattcaagaatgctgaaatcataccaaacatactcttggaccattgcacaataaaaatagaaatgaatactaagaaaattgctcaaaatcatacaaagatgtggaaagtaaacaggctactcctgaattacttttaagtaaacaatgaaattaagtcagaatcaagaaattgtttgatattcatgagaaaaaagatacaccatactagaatatctgggatacatctaaagcagtattaagagagaagtttacagtactaagtgcccacttcaaaacgttagaaagatatcaaatcaagactctgacaccgaaataagagcaaaccaaccacaaagtttgcagaagataagaaataaccaaaaacagaagctaaactgaaggaaattgatatgtgacacgccatacaaaacatcagcatatccagaagttggttctttgaaagaataaattagattgatagacttgtagctagactaataaagtaaaaaagagaaaagatccatataaacacaattagaaattacaaagggtacattaccaatgaccccacagaaatacaaaaaaccctcagtaactactacaaacacctctatgcacacaaactagacaacctaaaagaaatgaataaattcctggaaatatacaacctcttaaatttgaaccaggaagaaattgaatccctgaatacaataataatggaatctgaaattgaatcagtaataagagtcttaccaaccagaaaaactccatgaccacacagactcagaactgaaaagatgtataaggaagagttggtaccattcctatagaaactatttcaaaaaattgagaaggatggacttctccctaactcagtctacaaggccagcatcatcctgatacaaaaatctgtcagatacacaacaaaaacaacagcaacaacaacaacaacactgcaggccaatattcttgataaatttatactcagaaactttttacattcaaaaaatactagcaaaccaaatccagcagcacatcaaaaagctactccaccatgatcaagtaggctttatgcctgggatgcataattggttcaacattgcaaatcaataagcgtgattcatcacagcaacagaagtaaatacaaaaccaaataatcatctcgatagatgcagaaaaggtttctggtaaaatacaacatcgcttcatgttaaagaaacctcaacaaacgaggcactgaaggaacttacttcaaaataacaggagccggctgggcgctgtggctcatgcctgtaaccccagtactttgggaggccaaggcgggaggatcacttaaggtcaggagttcgagaccagccctggccaacatggtgaaaccctgtctctactaaaaatacaaaaattagctgggcgtggtggcatgtgcctgtaatcccagctactcagcaggctgagacagaagaatcgcttgaacccaggagacggaatttgcagtgagccaagatcatgccattgcactctagcctaggtgacacagtaagactccctctcaaaaataaattaattaattaataagtaaataacaggagccatctatgaaaaatccatagtgatcaacatactgaatgagcaaaagctggaagtattccccttcagaaacagaccaaaacaaacatgaccactcacaccactgctgttcaatatagtactggaagtcctggctacagcattcaggcaagagaaagaaataaaaaccatccaaatagaaagagaggaagtcaaactttttctgtttgcaaatgatataatcctatacctagaaaaccctatagtctttgtctaaaagctcctaagtctgataaacaacttaagcaaaatctcaggataaaaaatcattgtacaaaaatcagtagcacttatatacaagaacaacatccaagctaagagccaaaacaataatgcaatttcattcacaatagtcacaaaaataataaattttataggaatatacctaatcagggaggtgaaaggtattgacgatgagaatttcaaaacaatattcaaagaaatcagagatgacataaacaaatggaaaaatgttccatgctcatggataggaatacctaatattgttaaaacggccatactgcccaaagcagtttacagattcaatgctattgctatcaaactgtcaatttcattcttcacagaatttgcaaaaactatctgaaaattcatatgaaaccaaaaaagagcttgaatagcttgatgcaggcatcatgtcactcaacttcaaactatattacaaggctatagtaaccaaaacaacatggtacaagtacaaaaaaatggaccaaaagatcaagggaacagaatagagaggccagaaataaagccacatacctaccaacatctgacctttgacaaagtcgacaaaaaacaagcaatggggaaaaggctcgctattcaataaataatgctaggataacggtatagccatatgaagaaggttgaagctagactccttccttacatcatttacaacaatgaacttaaaatgaattaaggatttaaatataaaatctaaagctataaaaaccctggaagatgacctaagaaatatcattctggacataggtcccagcaaagattttatgatgaagctgccaaaagcaattgcaactaaacaaaaaatgacaaatgggacctagttaaactaaagtgcttcagcacagcagaagaaactatcaacagagttaacagacaacttatgcaatgggagaaaatatttagaaactatgcatcacacaacggtctaatatccagaatctatatgaaaattaaacaaattagaaagaaaaagcatcaaagaactccattaaaaagtgggcaaaagacacagacattttcaaaagaagacatatacccagccaacaagcatatgaaaaaacacacaacatcactaatcgttagataaatgcaaattaaaaccacaatttgataccatcttactacagtcagaatagctattactaaagtcaagaaataaaaaatgatgacaaggtcatgaagaaaagggagaacttatacactgctgatgggaatataaataagtttagtcatggtggaaatcagtgtggcaatttttctaaaaacttaaaggagaggtaccatttcacccagcaatccaggtattgggtatatgcccaaaggaatataaatcatcctactataaccacacatatacgcatatgtttgtcactgcaccattaacaatagcaaagttatgaaatcaatctaaatgcccattaagagtatcctggataatgaccatgcggcacatacaaaccatggaatactacacagccttgaaaatgtatgagatcacatccttttcaggaacatggatagaggtggaggccataacctgacacaaactaacgcaggaagagaaaaccacatacttcatgttctcatttataagtggtagctgaactttgagtacatataaacacaaagaaggggacaacagatactggagtctttgtgagagtgaagggtgaaaggaggatgaggattgaaaaagtacctatcaggtactatgcttattacctgggtaatgaaataatctgtacaataaacccatgtgacacacaatttacctatataacaaacctaaaataaaaaataaaactacatgtctttcttgacataagccttggcaaataatttatggctaagtactgaaaagcaatcacaaaacaaaacaaaaagtgacaagtaacatctagtcatactaaagagcttctgcacaacaaaagaaactatcaacagagtaaagagacaaactatagaatgggagaaaatttttgcaaactgcatcctacaaaggtataatatctagaatctgtaaggaacataagagaaaaagcaaaaaacaaccctattaaaaatgggacataaacagacacttctcaaaagaagacatacaagtagccaacaagcatgttaaaaatatttatcaccactaattatcagagaaatgcaaatcaaaaccacaataagacaccatctcacaccagtcagaatggctatcattaaaaagttaaaaaataatagatgctagcaggactgtggagaaaagggaacacatacactcttggtgggaatgttaattagttcatccactgtggaaagcaggttagagatttctcaaagaactagaaatagaactactgttcaaaccatccaacccactaatggatatataccccctcccccaaaataaattgttctaacaaaaagacaaatacacccatatgttcattgcagcactattcacagtagcaaagacatggattcaataacttaggtgtccctcaatggtggattaaataaagaaaatgtgacacatatgcataatgaaatactacacagccataaaaaagaacaaaatcatgtcctttgcagcaatgtggatacaactggaagccattatcccaagtgagctaacacagaaacagaaattcaaatatgtattctcacttgtaagtgggagctgaacacaaggtattcatggatataaagatatgaacattagacaggggactacaagcgggggtgaagtagaaaggggaggaagggttgaaaaactacctattgattactgtgcttactacctgggtaatgggtttgatcacaccccaaacctcagcatcgcacaatatatacatgtaacaaaaatgcacatgtgccctttgaatctaaaataaaggtagaaattttttcaagtctacttaatattattttataacgtaaaatataactatagatacaaaaatttcaatcgagttcaaagataatttggaataatcttacctaattcatctattaaaaaaacattcttttaataccagaactgcattttatgagcattattttaggtctgttgacaaaatgtttgctggcatttctgtgacagggaggaatagaaaagatacttctcagctttttggagttatcccttctcacgtttacagtgatcacaataattctactttttatacaagactgctatgaaatttcttttggcgtttttgtcatgaagtcttagcacacgcctatgtcctatatggtattgcttaggttttcttctaagatttttatggtttaaggttttatatttaactctttagtccatcttgagttaatgttcgtataaggtgtaaggaaggggtccggtttcagtttcctgcatatgtctggccagttttcccagcatcatttactgtataggagatattttccctattgcttgtttttgtcagatttgtcgaagatcagatggttgcagatgtgtggtgttatttctgaggtctctgttctgctccgttgctctatatgttttggtaccagcaccctgctgttttggttactataggtttgtagtatactttgaagtcaggtaatgtgatgcctctagctttgttctttttgcttaggattctcttggctatatggggtcttctttgatttcatatgcaatttaaaatagtttttttctaattttgtgaagaatgtcaatggtagtttgatgggaatagcattgaatctacaaattactttgggcaatatggcgattttcatgatattgattcttcctatccatgaggatggaatgttttttcatttgtttgtgtcctctcttattttcttgagcagtggtttttagttctccttaaagaggtccttcacatcccttgttagctgtatacctaggtattttattccctttggagcaatcatgaatgggagttcattcatggctctctccttgcctattgttggtgtaaaggaatgcttgtgatgtttgcatatcgattttgtatcctgagagtttgctgaagttgcttaccagcttaaggaaattttgggcttagatgatggggttttctaaatgtaaaatcatgtcatctgcaaacagagacaacttcagttccactcttcctatctgaataccttttatttctttctcttgcctgattgccctggccagaacttccaatactattttgaataggagtggtgagagagggcatcgttgtcttgtattagttttcaaaggaaatacttccagcttttgctcattcaatatgatattggatgtgggtttgtcatgaatagctcttattattttgatatatgttccatcaatacctagtttattgagagtttttaacatgaacggatgttaaattttatcaaaggccttttctccatctattgagataatcatgtggtgtttctctttggttctgtttatgtgatggattacatttattgatttgcatatgttgaaccagccttgaatcccagggatgaagctaacttgatttgggtgagtaagttttttgatgtgctgctggattgtttctcagtattttactgaggattttctcattgatgttcatcagggatatcggcctgaagatttttttgttgttgtgtctcttcctggttttggtatcaggatgatgccggcttcataaaatgagttagggaggagtcccttcttttcaattgtttggaatagtttcagaaggaatggtaccagcccctttttatatttctggtagaattcagctgtgaatctatctggtcctgggatttttttttttttttattggtaggctattagttactgactcaatttcagaacttgtttttggtctattcagggacttaacttattcctggcttagtcgtagtagggtgtatacatccaggaatttatccatttcttttagattttctagtttacttgcatggaggtgtttatagtattctctgatggtagtttgtatttctgtggggacagtggtgatatctcctttatcattttttattatatctatttgattcttctctctcttctttattagtctagctaacagtccatttattttgttaatttttttcaaaaaaaacagctcctggattcactgattttttggagggttttcatgcccctatctccttcagttcttctctgatcttagttatttcttgtcttctgctagcttctggattagtttgttcttgcctctttagttctttaaattgtgatgttaaggtgtcgatttgagacctttctagctttctgatatgtgaatttagtgctataaatttccctcttaacactgctttagctgtgtcccagagattctggtgtgttgtctcatggttctcattggtttcaaataacttcttgatttctgccttaatttcattatttacccaggagtcattcaggagcaggttgcatgaaattgaaattgcatgattttgagtgagtttttaaattctgagttctaatttgattgcagtagatgctggcaaggccccagagaaataggaacacatttacactgtcgatgggaatgtaaattggttcaaccattgtggaaaacagtgtgggaattcctcaaggatctagaattagaaataccagttgacccagcaatctcattactggatatatacccaaaggactataaatcattctagtataaagacacatgcacatgtatgttaattgcagcactatttacaatagcaaagacatggaaccaacccaaatgcctatcaataatagactaaattaagaaaatgtggtacatatacaccatggagtagtatgcagccataaaaaggaatgagatcatgtcctttgcagggacatggatgaagctgaaagccatcatcctcagcaaactaacacaggaacagaaaaccaaataccacgttctcactcataagtgggagttgaacattgagaacacatggacacagagagggaaaaaacacacaccagggcctgttggggggtggggagggaacttagaagacaggtcaataggtgcagcaaaccaccatggcacaaccctgcacgttttgcacatgtatcccttttttttgtttgtttgtttctctgtatttttttagaagaaataaagaaaaaaaagagtactatgaaaataattggttcactatgaatgtatttataaatgtgaggttaaattaattttctaagcaagttaaaataatggcacagaagggaattattttaagcatatagtaattgctgagctttgcagtttttagtttttaatttttagttaagcatttatgttacagggggtgtgtgggagaaaaaaaatctgtacaattaagttagaattgcccataaaggcaaattagaataaagtagaaagactatgagcgaggtgtccctgggtcagatgaggaataagaggacacactttcatgtttgaccttttatacctgtgcatttgtccatccatactacagacaacagaatagacaacagtttcacagaaccgccacaaacctgaacagcatcacaaacctccatcgcctcctgatatgtgaggagctctcaaccatatgttcattggcaccatatgttcattcaattccagaaagattgtttagaactgatcttcctattgaggcttcatcttttaccaaaactaggcgagcctgaaaaacaagttgtctgaatttccctcccttttccagaaaattttgtttctgtttcttagttagattaaaattttaagaaatatgcatcataaaatatttttaataataaaatagttttcctcttggtttattccaaaaagggcaattttaatgattcttttcttgtgctaatttcaaggatggaaaggatacagaaaaaggattttgattgaactaatttacactcccaccaacagtggaaaagtgttcctatttctccacatcctctccagcatctgttgtttcctgactttttaatgaccgccattctacctggcattagatggtatttcactgtgttttttatttgcatttctctaatgtccagtgatgatgtacttttcttcatatgtttgttggctgcataaatttcttcttttgagaagtgtctgttcatatcctttgcctactttttgaagggggtgtttgtttttttctggcaaatttgtttaagttctttgtagattctggatattaaccctttgccagatggatagatggcaaacattttctcccattctttaggttgcctgttcactctgatgatagcttcttttgctgtgcagaggctctttactttaattagatttcatttgtcaattttggcttttattgccattgctttttgtgttttagtcatgaagtctttgcccacgcctacatcctgaatattattgcatagcttttcttccagggtttttatggttataggtcttagatttaagtctttaatccatcttgagttaatttttgtataaggtgtaaggtgattcctaaaggatcagaaataccatttgacccagcaatcccattactgggtatatacccaaaggattataaatcattctactataaagacacttgcacacctatgtttattgtagcactgttcacaatagcaaagacttggaaccatcccaaatgcccatcaatgataaactggataaataaaatgtgacacatttataccagggaatactatgcagccataaaaaaggatgagttcatgtcctttgcaaggacatggatgaagctggaaaccatcattcgcagcaaactaacacagaaacagaaaaccaaacaccacatgttctcactcataagtgggggttgaacaatgagaacacatggacacagagtgggaaaaaacacacaccagggcctgtctggggttgggggctaggggaggaatagcattaggagaaatatctaatgtagatgacgggttgatgggtgcagcaaaccaccatggcacgtgtatacctatgcaacaaacctgcatattctgcacatgtatcccagaacttaaaggtataatttttttaaaaaaaaaaggattttgaagttcataacccaggtaaatttctactaatctaatatattatgctttgatgttattacatttttaaaaatttattttatgaaatacttggtagggaaaaaagcatacaatgaagatagttcttctgtctcattttaatatgcatatgagaatatgatacaattgttttagatctttttttatgttctatattctgactccacagctcctgccttgtatagaaaatgcagctgtaacccagtccctgttggacaaggggtggaacagatggcttgtgatcctgtactgcctacacattagggaagcgccacggcttagatggaatactattttttttagtactaacagtgctaaagtgagaataaatcatcaatcgggggatagaagccactgagcctgcagtcacggatattctactgctgtgcttgctgtttctcccataggttttgaacaaactgaagtgtggctacttccaaaaaccagtaattaatcagaagaaggcctctccaattcccacttcgttctcaatcctagagcctagatgacacatgcttaaactctcccatgttactgaccacaaaatttcctgaacagtttgatcagccattaagttttcgtgtctgcatttttgagagaaagggaacttgacctgaaataactgatcattttgttaacttcattctattgtgattttttttcaaagcctgtatatccagtgcatacttaatctatattaaaagatttcaatgtttttatgaaaattaactttgggttttgaaaaatattcatatgattttaaaggctaaaagtacatctctaaaaattaatagagaatattagatattttctaatatttaattatgatattagaaaatatgtgtgatgttttcatgatagagtgccttctttttagccacatgtgcaggagcaatatgtgaaaatagcagtaaatgtcagtgtgcgaataagtgacatgtgaattccaatataccttcaaggtaataaagaaaaaattacttaattgtgtgttccattaagtgtttccaacttacaagagagaacagaaaaagtaatatgcttgttatgaatatgcagtcttgtacatatgggccaatgtttagagaggtataatatgatgaataatgttttctttttacaataattattttgagctctctagtataagtagtagtttctatagcgtaattcactctacaacataatttgcttcatttgtctatctcttcaaatatttctccaacatgagctcatcttaccccacaatttctcaggatagaaaaaacagcaaaataaacaaaatcttacctttccaacatactgaggatctggtcccatatgttcttctaaaacaaagaactgattccatacccatccccttttgggacgatgatggacttcggtttcaccttcaatgtgtttggtttggtttctcatcaccttgatggagctgtggtgagcagttccataacacctctgcacaaaacagagacacactaggactggacagatgcaagatgtgctagtaattttcattgtaagataactttccagttcacagttttccttcctttccttgtcagctacgaaagcttagtgagcattcaagagagaagccagagcatctttaggaaggacagtccaaagtaaattgtttagcgtgtccatgatttaactgtccatcagggaaaggtcagatcatatttacattctgaaccacttggaaaatcaaagccgtagttgtctgattccaactcttcacagtagttgaacacaagcaaccattttcaacctaatggaaagagaaaattatatgtgttacaaaacacggtttttttaactatttgctctgaatacaaatgatactattttgcaatgtgatattgataggcaaagaacatatgcaaaatctctaggacacatccacaaacctatacacctatatgtctacatgcatttttacatgaaccttcctgtctgtaccattaattctcaatgacaaatatatgtataattcttgtttttgttagacataatacaaatttgttatatatactacacatgaattacctactgtataagactcatcaaattttgacaaaatatcccaagggctgaaaaattgtcacagaccataacagcaatcaaataggtacttaaagtgctcagtaagtaaagtggaagaaaataaaagatcaaagaaaaaggtggctgaaaacaaaaagaatgcaacttaaaattactccaggtttggggaacagattggtaaagttgggtgtgagtgacaatgtcaattggctgaattatagattgtgtaaattttgataggtcctgcatatctaccccgggtatgaacttcacacacagacaaggcagattttcaagtttgggaattacattactaggcttgatttctagtacacataattctagcaattatctaaagacaggattaaagaaagaaaaaaatagcggtaaataaacagaggaaaaatgttttgatttttaaaattaaaagaagttgaaggccgggtggggtggctcacgcctgtaatcccggcactttgggaggtcgaggtgggcagatcacaaggcaaggagatcaagaccattctggctagtacagtgaaacccgtctctagtaaaaataaaaaaataaaaaaaaaaatgagccgggcttggtggcggtcacctgtagtcccagctactcaggaggctaaggcaggaaaatggcgtgaacccgggaggtggagcttgcagtaagcctagatctgagatcgcaccactgcactccagcctgggagacagagtgggactccgtctcaaaaaaaaaaaaagaaaaaaaaaaaaacaacacgttgaagacatgagtgtaggttatactatgattgggcaacaaagtaaaacacgaaaaacatttctgaaaaactaatgacaggatatgggagagaaaagaatgactgaaatttgggctgggtgcagtagctcacgactgtaatccaagcattttggaaggctgaggcaggcagatcacttgaggtcaggagtttgaggccagcctgtccaacatggtgaaatcccatcactactaaaaatacaaaactaggtgggcatggtggtgcacgcctgtaatcccagctactcgagagactgaggcaggagaatcgcttgaacccaggagatgggtgttgcagtgagcagagatcatgccattgtactccagcctgggcaacaagaatgaaactctgtctcaaaaaatacaataaaataaaaagaatgactgaaattataagcttatttaaagaatataaattttgcatcaagttttgctgtagtattatatatgtgtgcttgaatatatgtttaggaagattacattgattcacgaatatggctatttcatttaataaaaagtactaaataaatcactttctcattgaatgcaattcatccctgcaaatcagcacaaactgaaatgtagatctgaataaataacaaattgacatgacagtataattaatttataatactgaatacaaataattggttacagcatgattctcttacacagttgaggaaagatgctacacagatttggtcacgaaggaaaaaagtcacattagattcaagagcacggcatttttctctgagtatttcgctccttaaatgagggttagtaatagtgcttacttcaccattgtgcaacaattgtgtaggattagagtaattggaatttcacttttatcatttgacaaatataaaatttatgttttcaaatattttctgaaagcaaaggtatccttccctctgatttaaatcaaaacaacttcaaaactctcctaaaatataagagagagcaatactattctagcttcaaaatggcaagagcattggaaagagagtcagaaatcacaggttttattttttgatagtttacttactatattaatttatgtgaaccatctcatgtttttcagtctcactgccctcatttattaaaatttgtgactggaataactgtatttaatattctttccagcatttgtaataaattattttaataaatttatattaaactttttatttcccaagagattcttaattttcaaatcatgaatttcaaaaaaaaaaaaaggaaactttatctagcttttcttcttagaagccaagttgttgaagacatagaaggtgttgttattttaatactttcacaccatttggtgtgattttcaaataaaattaacatctttgcccttcatgctaagttgtttaacaaagcttaatttatgagtacaaggtgaagaaagtggcttttgcaatgcattacagatatgtaaaatgagtgttttctttacaatactgattgtgagtcattccaaaaatatataaatgcattttgatctacatatgctttatatgtttgcgaatctcaattatgacaattatgaaaatagatatatactgtgctatggaataaaagaacaaatgtaaacatcactacagcgcttatggagataattttatttactatataataagaggacataacttcaaatataaaatttttctgcattactgcaagaaatccatctctgcataagttagaaaaaattgaaatgcaaataataagaaaacaaaccagtgattgagaccaatacaatagaaatatgtggtagacattttccattttatgactgagcagtgttcaaagacccttctgctttcatggaacattccaatatgtgaattctgataaaccgagccctgactttcaccactagtcacttaggcaccaatatggtctggctctgtgtccccacctatctctcatcttgatttgtaatctgaattgtaatccccattttgggaaagggacctcatgggaggtgattggatcatgggggctgctcccccatgctgttctcttgatagtgagtaagttatcacaagatctgacggttttataaggggctcttctcccttcactctgcacttctctctcctgatgccttgtgaaaaagaacatgtttgcttcccattttgccatgactgtaagtttcctgaggcctccccagccatgtggaactgtaagtcaattaaacctctttgctttataaatttcccaggcttgggtatttctttatagcagcatgaaaataaaataatacaatacattttaccagtagagtggggtgctgttataaagatacccaaaaatgtggaagtgactttggaactagataacaggaagaagtaggaacagtttggagggctcagaagaaaataggaagatgtgggaaaatttggaacttcctagacacttgttgaacggttttgacccaaacactgataatggataatgatgtggacaacgaagtccaggctgaggcagtctcagatagacatgaggaattttttaggaactggagaaaaggtcactcttgctatgtttcagcaaagagactggtgccattttgtccgtgtactagagatctgtggaactttgaacttgagagagaaggtctggcattggaacttatgtttaaaagggaagcacagcataaaagtttggaaaattttcagcctgatcgtgtgatagaaaagaaaaactaattttatggaaagaaattgaagccagcttgagaaatttgcataagtaacaagaagccaaatgtaattcaccaagacaatggagaaaatgtctccagggcatgtcagagaccttcatggcatcccctcccatctaaggcccagagtcctaggcgggaaaaaaatggtttcctgggccaggcccagtgccttgctgctttgtgcagtcttgagacttggtaccctgcgtctcagccatgggtaaaagagaccacggtacagctcagcttgttgcttcagagggtgcaagcaccgagccttccaccaagtgcttggaagcaccaggtggcttctacatggtgttgggcttgcgggtgcacagaagtgaagaattgaggtttgggaaactccacctagatttcagaggatgtataggaacacctggatggctagcagaagtttattgcaggggtggagccctcatggagaaactctgttagagcagtgcagaagggaaatgtgaggtcggacccccgacatagagttcccactggggcactgcctagtgaagctgtgagatgacagccaccgtcttccagaaaccagaattgtagatccaccaacagcttgcactgtgcatcaaaaaagctaaagacactcaatgccagctgtgaaagcagccagagcaggggcttgtatcctaaaaagccacaggagtggagctaccctaggccatgggagcccaacctttgcatctgtgtgccctgcatgtgagacatggagtaaaaggaaattattttggagctttaagatttaatgactgtcccgctagattttggacctgcatggggcctgtagcccctttgttttggccaatttctcccattggagaagaattcaaagattgattcttattcaaaactattcccatttcagggagcatttatccaatgactctatccccattgtatctatgaaagaactaacttgcttttgattttataggctcctaggtgggagtgacttgccttgtctcagatgagactttggacttggacatttgagttaattctgggaagaattaagatttttcagggactgtagggaaggtacaatcgtgctttgaaatgtgaaaaagacaagatttgcaaggggtcaggagtggaataatatggtctggctctgtgtcctcacccaaatctcatcttgaattctaatccgaattgctatccccattttgggggagggacctcatagaaggtgactagatcctggggactagtcccccatgctcttctcatgataatgagttgtcatgagatctgatgattttataaggggctctttcccctttgttctgcaattctctctcctgtagacttgtgaaaaagggcatgtttgtttctccttccaccaatattgtaagtttcctgaggcctccttagctttgcggaactgtgagtcaattaaatctctctcttctataaattacccagtcttgagagtgtttctttatagcagtgtgaaaatggactaatacaggaaccaaatactttctttctatatcctttcatcagaaatttcatcagtgacagaggcacataaatgatatgctcaaatgatggaaagatgtaggaacagttgagaaattttccacagcagtggcaattatttcaagacccaagtatagtgatggtgagctctgcagatatgacagacagaatccagtggcataaattaaaagggttctagctatgttgttctagtggcaagtacttgatataatttctagctgtctaaattccattgtttcctacttctccctaaacctgatttgtaaacaccctcatcaattcaatggctatccaacacagttcaaacaaatttatttgttgctttttatgcccagaattgacttctggtgtttgaaacattttaaaattatacatatactgtacattacatgaataaaaaccactagcccttactaagaagacatgcacagtgttaaatattaccaagatgttaatgaatattgtctcttaaacattttcagcttcttttaaaaaatatatatccaaattatagttgttaagatagtttctttgtatccagttcatggaataattcaaagaattaaaaaaaaataacaaataaacataaatgattctgtttccttgttggttgaccccaggatatttcctaatttctcttgacttttttctttgacccattggttgttcaagaatgtgcagtttaatttctacatatttacaaatgttctgtttttatttcgctatttatttctacctaacttccattgtatttggaaaagacaccagctatcattttacacttcttgaatttgtagacttgttttgtggcccaacacgtgatctatcctggaaaatggttcatttctactagagaagaatgtgtgttttgatgcagttgggtgtaatgttccatatatgtctgttaaagccatttggttcatagtgttgttcaagttctctgtttctttattgattttctgtctgcatgttctacacattattgaaagtttagtattgacaatttctactattattgtattattctctattcagttctgtcaatatttgttttatatatctaggtgctctgatgttgggtgcatatatatttataattgttttttttctgctgagttaatacatttataattatataatgcccttatttgtctcttcctacagtttttaactgaaagaatattgtgtatgatataagtatagctttcctttgctctctttcgcttaacatttgcatggaatatatatatatgtattatcctttctctctcaactgatttgtgtccagaaatctaaagtgagtctattgtagaaagcatataatgtgagcttatttttattcattcagccactattttttgatttggaaatttaatccatttatatttaaagtaataattgagagggaagaaatttctattgccattttgttattgttttctgtctatcttgtagctatttttatccctgttttcctctcttgctaccttgctttgtgtttttttaaatttcttttaattacattctttgacttctttctcctttttattcatgtgtcttccacagtatcattttttgtgcatacaatgggacttacagaaaccttcttatagttataacaatctattttaagctgataacaaattatattcaattaaatataaaaactctacacttttacttcacccacactaacatgctttatgttactgatgtcacaaatacatttttatgttgtgtaccaattaatatatttgttatttttatacttttgtcttttaccttcataccagaatttaaagtgatttacacaacactgttacatcattccagcattctgtttttgcctatatatttacctttactatcaagcttaatacagttgacccttgaacagcatagatttttaactataaagttctatttattagtggacgtttttcagcccattgtggagctaaaatattcaggggatgtgaaacccatatatagggagggccatctttcatatatgtgggttccacatgaccaactgctggacttgattacatgcagattttggtataaacaggggtcctgaaactgaacttccatatatactgaggggtagctgtactttcatatattttcaaattgctgtttagcatgttttcacttcaaataaaagactccttttggaatcttttgtaagacaggtcttgtggtaatgaactccctcagtatttagtctatgaaaatcttcatctctttacttttgaaggtcagacttgctggatataatattttttgtcggcaagattttttttctttttcttttacctttagcacttttaatatattatcctgtcacttctggcctttatgatttctgcttagaaatctgttcatagtcttgtggaagttctctttcatgtgatgagtcacttttcttttgtttctttccaaattctcttatctttgacttttagtagtttgattgtaatgtatcttagcaagttttgtgtttaaactatttcaaattcattgggctacttgcatctattatagctattccctttccaatgttttggaagttttctgccatcatttctttaagtaaactcattgatcttttctcaatttcttatttttattggaatctcacaatgtgcatactgatctacttgatgttgttccatatttttttccttcagtgttttatattctctccatagactgaataatttcaaatggcctgtctttaagttatctgattcttcattcttgttcaaatctgctatagaacttttgcactaaaattttcagtttagttgtattattcagatcccaaactcttgcttctttttatatatttaatctctttgttgatattcttattttgtttatgcattgttttactgagcttcttgacatttttaagatggttattttgaattctttgttatatatttcatatacttccatttttagggttagtatctagagatttatatgcctcttttgattgagccctgttttcctgtttgttcattttccttttacctttgtgttggtatctgcgtatttgaaagtcagccacctcttccagtctttacaaaatggtttcctacagagaaagactttctccaactaaactaagattccgcagatcactcaaactttctctgtagacatgtcttttgacttatgtgtgtatattcctaattagaggaatcttctgatttcccttttttgagatctcataatttcttgctctttctggtgtctatatggtgtaccgcacatccgctgaagaaccagcacaatgcttgactctcttttgttctcattggctcccatgcatccagattatggtgggcccatcagtgctttcactgggctatacaaaaggcagacccttaggcagccccttgataagggtagaatatttgacatactctttactcttctctttatcccttgaggcagaggccactgagttgtatcagcctctgtcttctgtggcacaagtcttctggagcaggcaggaaactgcctggttatttaattttctcatgagccattaggcatgaagagtacatccaattccatcagtgctctgaaacaagtgagacaaaaatcagtctctcaggtagcttccatgacaagctagaatgttggacacatggtccaatatctctccttccttaataggtgtgaaaccaggaggttacagtttcctacagaccacatgatgctttaccagggcgaggtattatgatgagagggtgccacactttcctatcagcttagattcagttagtttcacactcacctgatatggaggaggagcctcttaatcagtttctaaatttatctgaaagagaattggtccatgtattgttgaaataatgtctccatgggatgtaagaagagcctggggctttctattctaccatattgttaatataactcaggataatggatttcatgctaattgaaataggaagacactgcagtgggttgagaagtgtataacataaaatgattttaaaagtcattctagcttccatgaggagaatgcaatatagggcaccaagaagattaaaagaggtaatgtaggactggtttgaggactactgcagaagtgcaggtgagaaatgatggtagtgaagacaaagatgatagcatataaaatgctatacatatatatcatataaaatgctatatatatagatgatagcatataaaatgctatatatagcattttatataggctatattatatacatatatgtatataatgtgtatatatacattttatatgggctatattatatatatgtgtatatatacacacacacacatatatatgtatataatatagcctatataaaagctaaggctatgtgttaaattttatgatagatggattaaaagaagaatacaactcacaaagtctcagaaaaggtaggaagtaacaaataaatctactatttacaaataaatagctctgtcttcaaatttagtaaatgtttgctattcataatggatttgaaaggaaatgtggagcttgcagccaattaaactagtctcagctcagtggaatggtcaggactgaaggtattggcatgagagtcagcaggataccttgcaaagttaaattcatggagtaacaagatcatgttggcagagattaacgtagagaagagtatagggcatagggcacagttctgggcattaaacatctagagttaatagtagaggatcaggaggctataaataaaaagaagaaatgtgcagtgaatggggttcggaaagatggggtagcatagaagcctagagaacaatgtgttttaaggaggaaagaattgaaccaccaattaaatcaatatatttattcatacaatacccagatgccataaatgtacgctttgtgttgaatttgttaatatttatgtaccaatgaagtatacaaattagcatttcaaacatatatatataaacatatatatacacgcatatatatataaacatatatatacacgcatatatatataaacatatatatatacacgcatatatatataaacatatatatatacacgcatatatatataaacatatatatatacacgcatatatataaacatatatatacacgcatatatataaacatatatatatatatgaacatatatatacacgcatacacacacacacacagaggcactctatattccatatactccactagatgcttaaaaccattatcttattacagttgttttatgaccatttttgagttgaagatactaagatatagcattgaagtcatttgtctcagatgaaatttgagtacagttctgtcttagtccagcatctttttctaacacaggatttaaattgacatggatttgaatcatgatgcttttgtaaccttgtgtcatggcctttgagacataagttaatatcaaaaaatttcagttccctgagtgctgaatgaatatgacaacagtatttaagtcatagatagaattatatgaagtgaaagaagataaaagactgataaatcttcctgattaataataagtccttaaaatgtatgtaatatttttgttatatagatacaccatttcagcattcgactcatatttatttttattacatggcactttttgtcccattcgtaaaatgtaaagataaaaatgaggcacgaaatttaataccttttattaaaactagtatacaatcttaaaattataaagtaaatgtatgcatgattacaatcaactacaaataatgtttagggtagatgtgatttttatttctaccacattatcattatctttccaccagcttagaaaaatcaaagtcatgcatattcaaatgtcttctaatagcctcaatgagataagaagcttacagtttaaatgagtctgattctcctgtccttgcaaactaggataaactctaggaacaacttccatatagtgaagtttcttatatgaccgataaattgtattttgataaattgatctgtggcaaacagaaagaaagtagggagattgtagaggaccttagtcatctattttgctttcagtctcccagagctataaaaggaaaattaaccctaattgtttaaggtgttactaaattttgagatattaatagaatgatatacataaactaattttctgaggtggcttagaaaagtaacaggtttttacttttactatctgagaactcattgagattttatttgcaacgtgctgtacatatatccagttcttacatcatcctgtttatgctactttatagcttttaacaattagggaacaaataaggcaacatatttgcataacatagtcattcaaaagactgaatatatcacctggttgcaaaaaggtcctggtggatattccaatgaatttttattgggtattaaggtataactttgttgaatattagtgaaaagtaataataagactcacaaaaacaacaaaacagtataatgtcctcgagagtattattagataatttgaagatccatttacacggggaatttgccatgttgttaatataactgctgcactgtggtcctataaaaataaaggctttccagctgatataactttgtcgggaatatttagaaggtttttatatcggcttttccagagacttaaaagtatattctctaggtctatatttttgttcttaaaatatttattattatgtttctattatttgctcttattataaaaaatttaccagtttatgtaataaaataaaaaataaataacaataaaattgaatataaaaagaaaagccaaaaaaaaaacaaacccaaaaaacccaaaattcccttcttcccttctaccttccaaatgaatatgcatatatagtcctggaggtaaataaataaaataattaacagttgtatcaacaagcagagtaaatgaaagaagaaaactaaactgatcattctttacactgagtcatattaatactatctaacagttttttgccacaattataaatgcattttatgtctcttgtatacttaacttattttttactaccacataccacatattgtatgaatgtaaaataatttaatattcaatatcttactggggaatatatatgtgtgtgtgtatgtgtgtgtgtgtgtgtatatatatattccccttgaaaagcgtatatagtgtcaagtagacaataatctcttttggttcaaaagattaacttaaaatctgtgtgtttaaactccagagaaagccagccttttagttcattagctgataaaatagagttttctatgttacacaagaaacaaaggaaatgtatgtatagaatgtgtttctaatagcattgttttgtgtacgtggataattaaatgcatctcagaaaaggtcaaataggaataaaatggattatttgcaatatctcacttgtatcatgtcaacttcataaattaccaaaatagaagaaaaattattcattacacaatttgtccttcctggagagactatctggattgaccaggtggtagattaaccaggtagtaaccaggactttggggtcaagctgatttctgtttcagttttggttcaccactcattattagttgactggtgttacctaagcaagtcaaacttctgccagactcttgagttctcatgctggaaaagagcataatgacaactgctcagtatgaataactaaattgttacatgagatatctccaagagcctagcctgcatcagtctctgaagtgtacttagtaataatattattattagcatcatcagtaaacagtaaccgttctcattgtttacttttggggagggcacccagacatttgtgaagcattcgcttgtaggtctgggccatgaggatttatatgtgtgcatgtacatccaaagagaaagtcatgaggtttctaaagtccttcttaggtttctaaagttcaatagctttattgaaactcttactaaatattctctacttttcattatctggatagtataagccatggcataccatgatgtcactgttttggtgataaattagggaggctgcaaatattccctttttattttctcactgaaaacttattgagttgtcctgttcacttttacgaaaacccatactctacctacacatcctccaataactgatttttaaaagtgagaattcgaatactggtttctaggaatccatttggccaaacagaacacatgtattcttcctatataatccagagcaaccggtggccttcaggagtattgaaaactgcacttataaatggaattatcccagaaacatctggtatgaaattggatgtgtacatcagcattacttccatatcccactgaattttactaaaaagcaatgagtacaagattgtgaaaaataaagaataaaaaaaatacttgcaatgcctcctccagtaaaactgtgagaggcatgtgcattagtcttttggggatgtcataacaaaacaccatagtgtaggtggcttaaataacagaaatgtattttctcactgttctggagactaaaagtcccatatcaaggttctggctgacttgatttctgataaggtctctcttccttgcttgcagatggccacttgttccctatgccccacatggcctttcctcaatgtatgttctcgggcagagacagaggaagctctctgctgtatctctattaaggacaccaatgctattagagcagactgatcttatgacttcatttaaccataattacttgcttagaggcccccattccaagtacagccaccctgggggttcagccttgggcatatacatttgtggaaaacacaaacactcagtccataatgagacgtattcttacaatctaagttacatgtaagggcttccaaaagctacagaaattaaccacagtagtttttattgtgccacatggaacaaaatgagggcaagaaaccactgaaagggacttcagaagcaactgaagttattaggagtaaatcacagcaaaaatacactttctaaaggtgagagtgcatgctcaggtctgaaacctgtgtgcagttggaaattaggtgagtggaggagatataagttttgctgcaaacctttctggacctagctagtatcgttcaccagaggaggcaagattgcacccacaataacacaaacacagcagcttcactgaaagcaatctctctctgacaagacagaaaatgcttacattgtgtaaaccaactgatctggacaactataaatatatgagggtggatcgtgggagaactccttttttagcctatgaaatcataaaagaaaagattgttaaaaaccacttcataaaaacggaaaatgtctacgtggcacaaatgtgataagcaaagtaggcaaagtgctgaagaatgccaccctacaaaatctggcagtgtccacccaacaactcacagagaagacatgcagggcttttaaacatatcacaaataccatcaactttactcatgagacatggacattaggataattttggaagggcttttaaacatattcatgaataccatcaaccttactcatgagacatggatgttaggataattttggcattccatttctcactcaacagattataaaaaatctaaaggtctgatatctgatttggcaagactgtgaccagaggtgtgaacccttacacggggcttatagttatatacaacaggccaatcattttgagggaaatctgtctatttctatcaaaatttcaaactttatatttgatgactaataaattctacttctaggaatctgatctacagattgctaaaatatataatttcagtagaaaacaagaataaaaggtggtcagcatgttcttttcatgtctcatgaagaacaatttttataatatttaatcatactcatggaaaatgacatatgtagctattaatgtaatacttagcactatgtaaaatggaaatgttatggtaccataaaagttcacctgttaacatttacagacgactagtaaaaaggattacagtgggtccatgtaatagaatactaggcagctccttatgaatatggaatgagctccaagacattgtttaaagataacaagtttcctaggagtgtatagtaggctactatttttatttatttattttaactttttaatttttttagcaccctaatgtgctacttaatactagatcgtattcattctatctaactgtatttttgtatccattaaccattccccctttatccccctccccccactatcctttccagcctctgataaccatcatgctactccctatctccatgagttcagttttgtttttttttttctagttccctaaataaatgagaacatgaatatttgtctgtctatgcctggctattacaactaacataatgtcctccaggtcctccagtcccactcatgctgttgcaaatgacaagatttcattcttttttatggctaagtaataaccgatattgactaggtgtgtcctaggactgaacgtaccattcattgaatctctgcattgttccccgaactttatttcttatctctctttcatcttgttcccctgctcttctgtttcctatgtgtttataagaagatgatttaaaatgaatcacctttcgggtaccaatgattcacagactttcagagctgggaaagactgcaaggcccatctagtgggctactatttttaaatgagataaaatagccatttatatctccttctttatgcataaccattttcaaaagaatatatgataaatttatagtatctttgatttgggggtggatgaaaatcagggagagtgcattggataggaaggagccttttctctgtgtacattttattttattttttttcttgttttaagcaatacatttttattatctataaaaaatcaacaaatttggaataaaaagactgtttggcacctccccatccctctgctcactcatccatgtgtgtaaataattctgaacaaatgacagaaaatggagcagctggtgcttgaggtggtgagaagctcccagctgtgcttgatcctcaaaatgcaatatgttttccagtagtaatggtttaataattattaccctttttagctacaacagataaaattgcatgttgatttaatgccactaaaacaaataagagcttatcaactattatgtagattaagaagttactatatttggaaagtcagacttgaaacaaagggaaaaagactatctttttcaaaataactcatttaagatattttcaaggtggtttttagaaaaagggaaggatttggaagaaaatggcagaaaagacagttattattttctctattgagagaaattccatgtggttagttaaagccaagggaatgctcacagcaaaagacttctcctaataattatctagagcttctactttgtttcaataaacacgttaagtgaaatcatcacatttctcaaaagaaagagcaataaaaagtaacttgagtcagcgtgcatgctttggaactgtgctacttacattttggcaagcagcatcagcttcagctgagagctgattggaaatgcaaattcccaggctcgattcaagacctactaaaactttgaagatagggctaggtgtctgtgtttttccaagttctacagttgattatggtactaatgtttataatgtactgccctaaaattttatacacccaagatgacagtgtaccctacctgttttgatgaaaaattatgagcaatattccatcaagagaatataaaagactgggcagatgtacaaatttgcattctaatttctaatgatgatggattacacatctttccaatattagatatccttgacttactctggcttcaatgttgcagtaatggataaaaagatttgtaaagtatcactgttatatgttgaagtctaaatctccagtacctccgaatgtgaacgggtttaaaaataaagtcttcaaagaggttatcaagttaaaatgaggctgctagcatgagccctacttcaatctgatgagtgttataaaaagaaggtatttgtttttctatgtaaagaggcagcaaaaaaaaaaataaaaatctgcaagccaagtagagaaatttcgggagaaaacttcttcgggaccttgatcttggacttccagcttcaagcactgcgagaaaataaatttctgttgtttcggccacccactctttggtatttgttatggcagccctagcaaatgaacacactcactgactcgatttttttttctttctaaaagtaataaaatagttccaaattagaaacttgaggcaggttgggcaagatcactcacgattgtaatcccaacactttggaaggctgaggcagaaggatcacttgaggccaggagtttgagacaagccagggcaacatagtgagatcccatctccacaaaaacttgaaaagaaaattagtgaggtgtggtggtgcatgcctgcaatccagccacttgggaccaaggctgaggcaggaggatcacttgagcccaggactttgaggctgcagtgagccatgattgtgccattgcactccagcttgggcatcagacagagaccctgtctctaaaataataaacgaatactaaaaaaaaaaaaaaaagttgaagcaatgatttctgtcactagtcacaactggaaagcatacaatttaaacagtgtgattttgtgtgtgtgaggccaatttaccacttacaagagacgtgaccataggctagtaaattgacttatttgcatcttaacttcttcagtataaatgatgataaatagctgacacagactggatgttataatcatttaaaaaataatgcctttaacacacatagtacagtagttgagacacagacataacacagacatactcagaaacagtcatatatatgtcttgcttggtagaatgttaacaaaaaaatataaatcagactagtagggaagtagcattcaggatcaggtttttaaataacactgcattgtgaatcatgactttctttatgataaataagtatataaactgaatatctgaccagcttaactaaggtatcaacaacagaatatatgttaataaggcaatttccaaattcctctaagtgtctcttaagcaaacttaagaaattcagactcagtgctacattttatacctcagttagattagggaaataaaaattctacatgaaaaatgttattttctctgttaaagaaaaccactttcaagtcagaaattatttttaaaatcttgaccaatttatttaaagagcataaattgacaaatacctaaaaatctatctaatattaagtggtatgatatttaggttagtataatagtcacttgatttccttgtttgtgagaattcaaaatctgcagcaagttcacattatcactgcagaattctcctggcttattcattgccgatatatgataatgttaactcaaagcaaagtacattttagggaagcatggacatttatcagtacatttaagatgtatattggtttggtccagaaaggcaggacaactggaaatgggggcttccaggtcctaagcagatttaaagattttaattcacaattgtttgaaagagttattatttaaagacctggaatcaatagaaagaaatgtctgggttaagataatgagttggggatacaggtttcacagccttcagagctcttatcagacctaaaaagttgctggacccagttattctctcccagatcaggaaaaagacctgcaaagggatgtctaggtttgtcataaactattttagggactttttgataaattaaataataaatcaagttgtggcttgatagcgccaatataattgcagatcaggagcatataaacgaactcagaaattatgttttagtttttttcctcatgggtattgtattaggaatctctggttatcagaactaagcagatttatacaattagtaaagtctatgctgtgagaaagtgaagataaagtttgatgaacatttcaaaattaattggtcctgttttaagttatactatatcaatccatggttcttaccaaactggaaaatgttcttgcactagaactcatttatttgatctaaaatgaaattattaaagacaaacagtgcaaatattaaagcaaaagattattgcaatatcacaaaatgcagaaaaactcatttgttagatattacttttttctattaatgctacttcaaaaagtatacaatatattagacctattaaagcacaatgagcatacaactagggttgcctgataaaatgtaatgtgtacagctaaatttaaactgagcatgaaaaatgaaaaaaaaactattttattgagatattaattatgtataaaaagtggcttgtatttaatgtgtacaatttgatgagtttacagaaaagtatatacccaaaaaaaccatcaccaaaatcaacgccattgtaaaccacaaataaaattttaagccccacaactgaccgatggatgctcacctcagccaagggcattccaaagttaacctgaaaaactagttcaggccatgatgggaagtaggggtgggacgtgcctcattatactctcctccctttggaattcaggcacagttgggtagcattaatattaaaatagagatcttaagactgacaaaacagacttttggtagcaataaaacaccaaattccagctgaccctagtatagcatcagatgacaaataccaggccctgaaaggaatcaaagtatttcacccccaaatatatttctatgacatattctgaaataaccctgaaaagctgtctcttgtggggaaaattcacattctgtagagaatctccttccctttccaggtctttttcctgatctaggagagaattaactaggtccagcaactttttaggtctgataagagctctgaagcctatgaaacctgtatccacaactcattatcctaacccagacatttctttctattgattccaggtcttcacataataactctttcaaacaattgccaatcaaaatctttaaatctgcttaggaccaggaagccccccatttccagttgtcctgcctttctggaccaaaccaatatacatcttaaacatattgataaatgtccatgtttccctaaaatgtataaaaccatgctgtagcccaaccaccttgggcacatgttctcaggatgccctgagactgtgtcttgggccattggtcattcacatttggtccagaataaacctcttcaaatactttacagtgtttgactctttgtcacaccataaacatatccatcacctcctaaggtttctttctgtcttattaatttacttgtttgctttgggtgtgtgtgtgtgtgtgtgtgtgtgtgtgtgtgtttaagagtattcttaagaataaatgtatccgattaggcatttctcacattttactcctaactggaactttatagcaatctgtttatggtcatccattgaataattttaagtgattccaaccattggcaatttaaattcattttttcctggaattgagaaccctcagaatatgactaaacagtgaatagccttattttttaatattcctcaaccagaccctttgctctgtccattgcatccagtgttgctaatatgagctgtgatcactttgatgatcacatatttgcttatgttttatccttttcttattttcattctacatctccaaatccttccaagtttatctcaaactcatcacttctaaataatcttcccttattttttctcattgccttcttttcttcttcttcttttttttttttcctattatggcactttttgggaatttccatatacttgcagatagttttattttagttcatatcatttactttttaaaaaaataccatttttatattggtctgacttgtccctcaaatatataatatactttaaggtacatagtatatttatgcttcaaggttctgtacatgaatttttaagttgaaagttttttcaaagacttagaccaatatttttcagtattagtgttacattagcttaagttacttaaacatcccactataatttataaataaattaacttcttaataatgataattaccattaaacatgattcttgcggaaagagatactgaaaaaaagtgaacctaaatacacataaccgaaaatattcttctgaacatcttttattatacttagcatacaatttaaaagaagaaattgtttcctaaattacttgtttctttttcactcataattgtctctctaaatacctctaagtttgtctagtaaattttgatgaaaaccaaaagttcattccatctgaatgtaggactaagattttattctatatctcatgaatgcatgagttgagataactaaaataataaagaaaatcattatttcatcatttttaacagaaacaaagtatactatcttacagaacgttattaagtgttcccattgaggacctagattattagcaagtgaaggtctcagtgcctcatgcatttctgtacaaacttgcatattcagtagtagtaattgcctcccattggacagagagaatatttatataaattaactattggactttaatttttcctttggcatcaatttaggtgctgtaagaggtacagatgggtttttttttatatctggggacagagaaccaggctgaggacaggaacaggcaaaagccccaagtggtgtacccaggagccgggaggaggctaggctgggtataccagagggggctgtgtaagaagacaaagtccagaggtaagaaggggcaaacagagaaggatcccaatgtgaactttgctttggttttgtgtgggatggatctgaagcagggagatgacatcatttgcttttccttaggaagtctttggatttttgttgagaataaagagggacaaaggcagaaatgtgggaaacaattgacagagtagagagagtggtaccttggacttgagataatgagaagggtcagattctatatatattctaaaggtcaaactaagagagcttattagtaaatccaatatggggagtgaaaaaagaagatgattcaaagatggctccaataattgtgaggtgaacaactgaaaaaattgtgcttccaattattaagttgtggaaaatttctgaaagtgaaggttttctttatagtgggtgggaggaaacatgaagagttcaatattctacatgcaaaaattgtgctatttgactgggtattgaaatgatgagtgagtagaaatcccatttagaactaagggttcagaaacagttctggctggaatgatacattggtgcattaccagaaggaagatgatatttgaatctttgaagctggataatacattatcaatgaattcgacataggtggaaaatgaagagaagcccatgtgatcagtagaaatatgtatatcagggtagcccaacagagcaatgaagaacatgcccatggaggagagcagtcactatttcaaatgttggtattaatctaataagttgagagtaaattattactatacatttgatatgaaacaaatacattacagaacattcaaaataatctaattaatgatcaattcctttgtttgaaatgtttttatatgtttgtagcactgaggaaagtgttctgtcaggtatctcacaattcttttgcactatattttattatctcaaaaacacacctttgtgtctataaaattaggaaactgtatcaactgttcctgttcattcaatccctcaaaagctgtgatgtatgtcaagttgagcagcggtcttctgttagtacaaacatacgattcaaagccaccagaacaaggtaatatactatcccaccagaggtaaaatcgtaatgttacattttactgaaggtcatttatgaaataggaggattctcacctaattgtgaacagcttacattatttaacttcttcttgggtaaacatacctcagtactgcaggcaaaatggtataagcacaacaaaacctcagggttagacagagtgtgagtcctgtcacttaatagaggtgactttaagcaagaaacttaagcctatctatattcatgtttcctgaatgaagaatttgctactaaccacaggtcgtagtccaaaataaaaacacaaactggctccagccagtgggattttattttttaaatcaggtatggtgagatcaatagacgaggagacacctgaccctgaaaagacagtttattatgcatagttgccaggagaagggggtatgccaggccagccctggcaaggtcacatgagagaacaccagggttggttggtcacaggcagagagaaagcaagaaaaactgtaggaaagattgtactgtggtttttttaacgggggaaaaaatgggagaacagggtaagcaggagaaacagatttaggattgactaatttgaataaatttagtgggctccagggaataggggttgtccctggttgtcttatgcctggccctgagataattaaggtagggaaagagaaactggtgttacccagtgtgagagcgggataaactatgtgggttggggaattggttagtttaagtataagaggcagagagtattttgctttctctagaatccattaaccctgggaggggctatccctttctagccaacaatgtccgtgatgtcaaaatatcagatacacaaactagaaaacaaggttaacgcagtggggaagtcagtgtccctttcctattgacccaacacactacaggtgagtgaatcccaaatactggcaatctcttccacactgagctgtacttaatatctagattgtcagtattctgaggatctcattaagcctcctgtcaaattccccatggtgctgacacaggggagaggacagtcattgcctcatcctcctccccatgacaccgttaattgggcttgaccctgaactttcttgtgcccatgctcagcccccactaagagaaactgcaataatagaacatgatcctcccttctctatccaccaatgcaacctggttattgcccctggcagcaggtggcagtggccccaggatgcagaagggaggcataaagcctaataatcaggtcaccagagaaaagagactgggcagccaccaacccaggcaagaacaacatagggaggctgtgagaggtgagactcactgtgaggagatgatccaaatcccagtgcgggctccattaccccatctgacttcacttataaaacacaaactcgatgtggagaaataggaacacttttacactgttggtgggactgtaaactagttcaaccattgtggaagtcagtgtggtgattcctcagggatctagaactagaaataccatttgacccagccatcccattactgggtatatacccaaaggactataaatcatgctgctataaagacacatgcacacgtatgtttattgcggcactattcacaacagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcacaaggacaaaaaaccaaacgccacatgttctcactcataggtgggaattgaacaatgagaacacatggacacaggaaggggaacatcacactctggggactgttgtgtggtggggggaggggggagggatagcattaggagatacacctaatgctacatgaggagttaatgggtgcagcacaccatcatggcacatgtatacatatgtaactaacctgcacattgtgcacatgtaccctaaaacttaaagtataataataatttaaaaaaacaacaacacaaactcaaagataacactcataagacttttcacagagcattaaacctcagttgcagaacccttctgatcacagaatcccatgcgatcatcctggtcacacatgtgcaaatcttggcctggatcttgggacttttatgccacacctcacatcctcttggcctaattttattctggctcctgtaaggcaaccagttgtggtcaaatgtaatccaagcagcatctttctttcaatgcccagcatatatctgattttctagctaacgaattttttgccactcttacatgtgaccctatgggaaccagctcagtgattctgatacatgcacaaatttggatgtgcaagggactgcacaaccaacgaccaatgaggaaacattaactgatgggaaatacttccttctttgggtccctggacagacaagtctgaagaatttcctccacaatcacctagctcctcaatgggtgaaacctctgctgcccacaatgaccagatgcacagacacctttttacttgtctttctttctgccctaggtcattcttcctagggccctcccaagttcctgaggatgatttcgctttacaaaataaaccgtctgcatgcaagcccttaaataaagccacacttgctgtgggaactctgaataatactgtaaataaatgagttatttggaagaataaatgagataatagatgtcaaataccaagcatgagacctggcaaattataagtacctcaattttgtgagttcttgatccttcctttctctttcaacttgaaaagctgcttgatgtacattttacaacaagatgcacaaaaaatatagttttgttacttaaaaaaaacctcaatctctatttcaatattgaattattcaaatgctggtaaattctatccgggcaaatttaaatagtcatttcagtattttactcttctagctgtgacaggtgggggcggtggaggagtaccaagagtgtcagtacccaggaagtcatctctcccctacagagacaaccatccctgcttgttcccactgagaatcccacatggcaactcagtcctagcacccaggaccacccaggtgcttaatgctcattagcatctctgggctacttctttgcccctttcaggggtttgggaaattcagttaatctctaccagctctcttgagctgcaagagactggggaagagggcggttccctccaatcctctttgttgtttatgtaatactgccatttattttctcttgctgctagggtatggtggtgtttcatggacagaacttgtttccccaggttctaactagggagtacattatgttctctctgcttttgactattaaatgtatttgattccttagctgtattgtctagacctgattcagggatcaggagcatttttcaaattcccaccagtatctaacacgatgcctccacttatattctcctcctatcctcagccagcgatatttttgtcaaatctggatacgtagggaaagaaaaacaacaacaacaaaagccctgctcattgtttaaggcataaacttgtggattagaggtcaccaatattgcttctgaaaacagaaaccaagtctcttaaaacacatgaagcattttctcgctacaaaatgaagcatgccttgaggcgtttctataataaaactctgagagcaatcagtctggaatggggattgtgcatgaagaacacataatcagtataatcaaattattatcctgtcaagaagaaaatgtgtccttacagaacccagcatctaggaaaactcagcaggcttttagtgacttttccattcagcctcaatgcagaagaaaggcagtcttttgctcagaggcacaagaaagtgaagcatcaaggaaggaattctgaagaagtttttacaactttacatgcagctgggttttgtcagataaagaaggaagagaacactgcaggtgcaaagacaagatgaagaaagcaagaaggcgtggcgaacctatctggtacgaagtaagtagggcagtttaattaaagtgccagggaaaggtgcagaaaaagaaatccctattctggggcaagatttctcagtaggtcactcacatctcagttcatccagaacagtctcattttgtctctatcaacctggcacaatgattaatatctcctctttccgctcttgaaagtaactgggtttgggcaatatagtcattccactcaataggcaattcgagcatacagttagggcattaaaaaaatgcactcttggctgggcgtggtggctcacacctgtaatcccagcactttgggaggccgaagcaggcggatcacaaggtcaggagttcaagaccagactggccaagatgctgaaacctggtctctactaaaaatacaaaaattaaccaggtgtggtggtgggcacctgtaatcccagctactcgggaggatgaggcagagaattgcttgaacccaggaggtggaggttgcagtgagctgagattgcgccactgcactccagcctgggcaacagagcaagactccatctcaaaaataaatgaataaataatgcactcttagccaacacccactcacctcctgcaaagaaaatatttctgtaatataatatgacatttaataattctacagactactaaaattgataacagaaaatatcagattttattttactcatcacttatttgacaattaaaaaagcattatgtgggaccctttaggaggaactaaatcttaccttcataatctgaccctggcaggaatataactgacataaagtttatattgaatcaaatggaattagatatacagatataaaataaatagaagctaaagaacacacaataaagcaaaatagaaatattttatatttacatcaatatctatttacccatctatatttttacatcttataagcatcagaaaaagtggcatttgctacatacttcaaagcttttatgtaaagcaaaaacttggaatataggctattcaatggtgacttacttgctgattttatgaatgacatattgcttgattgatgtaattttattggaaagggtcttattttagaatatcagactctaaatatatatatttatatatttatataatatatatgcataatatgtataataagatatgcatataataatacagccaacacaaatttactgattgcaaaaaatcagtgtttctaaatacacattttggcattccatattattataattatgtgacctattgatatggtttggctgtttgcccacccaaatcacatcttgagttgtagttcccataatccctacatgttgtgggagggaccctgtgggaggtaattgaatcatggaggtgcttacccccatgcttctgttctagtgagtgagttctcaggagatctgatggttttataaggggccttgcccactttgctcagcacttctccttcctgccatcacatgaagaaggacgtgtttgcttccccctctgccatgattgtaagaatgtggaactgtgagtcaattaaacctctttcttttatacattacccagtctcagcagttctttacaccagggtgagaatggactaatagacctatatataaattactacatttcaagtgaaatggaataatattagtatgtgttagaggaataaatataataatgaatgattacctgcaaagtttcctctatccctctcccaatttcaccaccaccccctatctctgtggggatccagctcttcagctttatttcagatggagtgggtactgatccaagtggaacaaactagagaagccattataattaataaccttacactcagaaaatcactaacaagagatatactataaaaatctgtcattctccaggtcctcagagagatgcatactagaatacaccacgaaacatacgcttaaaattgaatttactgtattttattctagggctttgtcacctatgtatagtgcattgatttaaaaacaaattatagtttgactcagactcaaacgtaccactttgtggaaaatatgtatatcaaatgagttgagaccaccaactcctcagattcctcacatggaaagagactgaaccataaaaaccttagggacatccctcaatataagaaggaactcatttctataaaatgaaacgtatgttcatgggcattcctccccagtgctcaatcctggagtttacagagttcaaaaaatagcataaaagaccatacaactccccattcagccagggaatgagggtcccagctcatgtctgcactgcaagtgtggggaatgtgaaagggaaaagagaagaagaaaccagaggagcaaggatgggctaaggaaaaatagacttatttgatttttgagcttgatattttctactggactttaaaatgaaagattgtataactgaaagcggacagccacttatgaaatatgaccataacatcattaagggacaaaataagtagaagtgacagagccattatgaaggcaatgtatggagaaaataaaacaaaataaaataattttggtttaatttattgtactgtgccatatgcacactagaatgccttcttagtttctgaagatatgcaggacgtcaattaatttattaattaagcacatgcattaaaactcagcattatcatcctatgtttaaggagtaaacacattaatcatcatgcctgttttcaaaaaaataatctgagtttcaaataatataatgtatctcaggtacttttccctatcatgtaataatttacccaaacagatttggtacacagttttcaagacaacttggtgttaatttcattgtacccaccctgagaacgaatggctaattttgagcatcttataatttcacccgataaaatgatcccctaaaatgaacataataggcatcttttaagtataagcattatatacaatgagttggtttttattttctctatcaagaaaataaaaatcttcttttgtaacatacttatttgtactgatttgaataataattctacacaaaaatgcctcaaaaaaacttccaatgtcactttatgacttcttgttcttggaagaagctgtgaggattaaatgagatcatccattttttcaactacaaagttattttatataaggcattagtagctttgctcaatctgttattagacaatgctatatttacattattggggctaaagtatttgggacagctaatgagtagttccgtttcaattcacatttctagataattctgttatactaactcccaaaattctagtaaggcaaatctctgcctacttttcataccagttcacagttcttgtaagtcttactagaacaactaacatatcaacattgcaatttcaaagttatacaatttttaatgttatttatttctaatttttcatgtgggaaattcaagttgtaaacatcatataaaatgttctaccattaagctccagtattttaaaggactgtagctttgccattttataaaccaaatgaacatattattactagcagtacaaaaatacgccttagacaaatatgtgtgagatcttaaataggtaagagagatgagttgattcatagctctttttgacaaccaatatattccatgtccttactttgagtcagttgcataacactgtgaggaatgtcaacatcattttagtcccttacaggtcatgtaattcttgtcaaaaaagagagtggattctcactgtctaaatacatgtcagtagttacacatgtattttgttgctctaaacttgttctactttatgctatcctaatacagttttgggagaaaagatagttttctctagatattgcaaaatcagaaggttacattaattttttcaccattatatatttttatgagtgcacttaatgtcacctttgatgtttagctatgactaattttgatatcggtatgatattctcttgcttatctatagagtatccttatgttataagatgctgagacttccccaaatgcttgcagagaataagatttcttcaactggagccacacctcccctgagcaagtttatgttttcttgtgctagaggtctaggcagcattaaaaaccattaatggcttctattttaagagttataactcaaaatgcttaaaggtctaggcaaatatagaaaaacaagcagtgtgaatgcagatggtggagattagatgctacgtggtccaaggattcagtgtattcttactctgcataaatgtagaaattatgttagctcaataatacacacctctgggccagatatttacccatgtgggccaccagtttgtggccttcattgtgaattcagtcatcttttctttgtatgcttctacaacatagcatacattttagattttccatttattattattatcatcatctttagctgacatcatttgatcaccatatcagatgcaggacactaaacacttaacctgtattatctcatctaagctttataatatttctatgagatgagtactaatattttatccacagatgtgcagaggtcatataactcatcaaaagttctaaaattcgtgagtggaagagctgttgttgtatctcagaattaagtacctcaaaaatccaaattcctaagcttttttaaaaaaattcactaatagaatgacagcatcctttttgtattttcagaatttaaggcactgcctgtcatagaaccagcactcaccaaatattaaaatagcaaataaaaagctgagcatgtttctactttgttttacaattatgtagctcaattcatatactattctaaagtctatttttatctattcataaacttatcacatctttttttatttctataaacttctattcaagacccctttgatttctttgtcacaatgacagcaaagcaaagcgaaatgaaatagcacatagcgtttgaatgcagactccagagaaaagaaacgttgattccaaacttttttaggatgtagcatattcctaaatatgtgcatgttttctaacctcttaatatttcctaatatgaaaagctattttgggtttttataaaaataaaatgagataaggataagtcggcttcatactgtaaattagagaccagattccttccatcttgtatgtctcccctgctctgaggcatgaatgtcttctgcattcagccaacagatgggaaaagagaggatgcaagatcctgtgggaagtttttatagaacaggcctgaatgtagtttttgctactttcagccatgttcctttggcaagaacacagcaattatagccatgaagcttgtgtggaccttactaagatgtccagtaagtatcaatacattttagttaggattaatgttaataacactatactttatgcctatcaacaaaatgacatgtgagtttcttttttaatctggtgttagagaaatcttgtctcccattggaaactggtgaaccaaatcctttcatttagtggaaactctttgttttatacatatttccttagagtttacacaattatgtcatcatttaattataatcctataccataatgtgttcatagtcttattcaaatgaagataaaagactatgttacatttggtaaacagcctgctgctaagattctattggcaagtgagattagtcatcacaggtattgaaatgtattcaggtagagatcagaagctcccttggaagaaataccctaagataaccttagggtatgtgaactacatacttgtatattctccttcctctaagggcagaacctgtagctggtttctggtcaataagtgatggaaaaggtttatttatatagtaaatgtttaaaattttacaaatttaattgaggttttgaatcagttgactgaggcaatcaaaagggagattctcattcattggcctggcttaatcatatgaaagccattcaaagaaggattgggccctccatgaggtcagacaagcttcctactggccttgaagatgcaagctgccatgagttctgcagccagaaaaaatgaattctatcaataacctaaatgagcttgaaagcagattcttccccagtcaagcttccagatgagaacacagcccagctggcaacttgattgaagccttgtgagatcctgagcagagcttcagttaagtcagctaagtcagttaaggctgactcttaatgaataaaaactgagatgtaataaataggtttcaagcgcataaaagcacggtaatttgttacacaaaatagaaaattaatatatgcccaatccctcaagtatacaagcctagagggcctctctggagatgagaatcccaatgtttgtacttaatctttcccaatggtattgatcttctgagttccaaagatttaagagtctatctaagataattagataagtgcaaatgaaggataatcttgtcaaaggacagaggttctagagagaagtatataaatagtgaaggggaatctggtctgggactcaaagtaagtactaatttttatgttgctagaaggaagtgtttattctagttacatgttatggctagttttgtcaacctaggtaccatggtaccttgtgggaaacttggggaaaagctcatgtatatggatgcagaggactttgaaattcaggtaattatcttctgagaaaaaaaaaaaaaagcctgaacaagcatggctcaagaacaagagaaagcatggttcagcttaaagtaccatctttgtcctgatctcatatctcattgaaagtctaaaatgggcctgtaatagtaacagctcatctgtggtggctacagcaaagggaatgaaggcactatcatctgaagaaaaacatagtcggtgagggaaattctggttgtgttaaccataccataaaatataatataaaaataatgcatggtggaagagaagaggcttaggaaaggcaagaagttgaaaatgaaaaggcacatagaatgaaatccttaatgacatatacattccctagtagttgataaaaaacggaagctaaagatttgaagcctttggaaacctaagttaaaaatgatgcattatcaactttatgttttgtactttcaaaatatcaaaaaaaacttttttttttcttttgagacagagtcttgctttgtcgcccaggctggagtgcagtggcacgatcttggctcactgcaacctctgccccccaggttcaagcaattctcctgcctcaccctcccgagtagctgggactacaggaatatgctgccatgcccggctaattttttgtattttagtagagatggggtttcaccatgttgcccaggcaggttgcgaactcctgagctcagggaatccgcccacctcggcctcccaaagtgctgggattacaggcatgagccaccgtgcctggccaaaaaaaatcatttttgatacacaaagcagaaataattttctcttcagtttccacaaagaacatgttgcaacacataatttgtatactggcatgtgctcaagggcatgtatacactcagaagtatgtcatttctccaacacaatattataaaatgtaaattattttaaaatattaaagcatgtgtagattttacctaaatgtacaagtttctatcttctcttgagaaatgtgaagatctggtgaaatgtgatctatattctgtttggcattgacctctctgacctgggaaatgcattatcaattcagaatggcctgttctgcacatcactgcagtctacataagccagtcctcattttattacatctgattctaatcgcttatttaagttatctgcctgactcctttaagctattaagtttaggatttctaaggtctttaataatatcttccacaacaactttatgaaactataacaaagcattttatatgtttctatagtaaccatcctaacataactaatcatactttgtttttaatctttgttcaaagataacagtgaaatctccttctcgatcctatagtctacatttaacatcatagtttataataaacttgctttcttcctcttacggtcttgaccttgaatttagatttgttccttattagtagaaaatgactttaatacattttagaaaaataaagaatggatttaaagagagagaaattgaattgaattttactatatcattttatttttatgtgtttgcttactgaatgctcacaagaccttgtctgctgcaactcatttataggaatacttatttttgtaatgtgtaaaggacataacaatagtaaatggaacattaagtgctgtagctcagtttttacacattttaagtttctggttgcaatttagaaaaatgctcaggatggagcagaggtagcggggagcatattctgtcacacaccataagtgcccttaaaggacagcactagaccagccatagtcaatctttagattgcatcagaatcacccagaaggcctgttaaaaacagatggctagtggagtctgagaagatgctggtctaatgagttcacaggtgataattcttcccatcttggaaacaccatttggtagccactgcatccaaccataatcctcttaatagtagatacctgacttttttaattcttgaatccctgttaaatcacactttgtctcacatatgggagatgcttactacaaaagtgttaaagtaattaagcgtttgatattttgacctaataatatttgactaataggatttgatgggccccaactaatagaaaagtcagcaactgagagagaagtgactaaacttagctttcacttttgccttttacctatgtaactggggaatcccaggctttgtacttgaaaatattcttctatttcttccatgggtatagatagatagatagatagatagatagatagatagatagatagatcgatcgatctatagatagatagatggatagatagatatacatatagattataaagatttaaagccattggaaacccaagttaaaatgatgcattatcatttttatgttttgtaccttcaaatcataagaaatcatttttgatacataaagcagaaataatttttatatatatacatatatacatacacataaaatcataattttgcctatttttaaacacaagtaatcaaaatagaattgaatcttttatattgttgaatctagaaagaatttgtttactttttccttaatttttatcagtgttttattcataattacatttcaattctttgtatttttaaaatattgtagccaaattatagtttattaattgtcattgaaaaataaagaattctggaagatacaagattttatatttttaaattttattccttggtaatttttttaattgtaacttttttttatacacagactacatccaaatttcaacaggacaattaaaatgaatcaaagttattccctaatatagaggtttttttatttcccaataattaaggcaacaataggctgatgtttaccaaaattgtctgctcctggccatccaggtttggctataattgctgagtccttgccaaagggacatggctaaaagtagtaaaaactacattcaggtgtggtccataaaaccctctcacaggagcatttactattatatgggactgattttttaaaaaatcaatcaaaatcctacccatttgtgaagaaatcttattgacaaagaaataatgatcctggacaataacattttgataacttgagtctcagataaacctttgcatcctgaggcttgaatatacaggtggaagattctaggagtcagtcccaaagaacagcttatttttcactgcctactccagatgtagttatggaagaaaaaagtgcaagaaatatcaactataaggtacaactagatggtttataaacaataacgggccagagagttcccgttatctggaaaaatcactgtctcatccccaggagtatttaaatattgatatgaactggaaacatctgtttgcttcttatttctccttttcccaggagggaatttttgttgtggttaccctgtctcagttctgcccttgatttgggatatctgcaggggtgaggtgggattgccttttagatcctgaccatttggagaagactattatccaggaatctttaacttttatgtatgggataatgcttgtcttttttggggtggcatgagtaggttttatgtaaagcatgaagattcagttatttagtgaccagaagggaaaactcaggtagggactggttcattgtttgctcaaccaatgctccggttttcctgggcacagagctatgctaacttcctaaccttccttgaagttaaaggtggctatacaactcagttctggccaatgaaatccgtgtggaaatgattaagtcacttcttggcatggctcataaaatcttcccttgtgatcaatcctccatttgctctacccatctggtggatgaacacacagaaaaaattgaggccttcgaagaaggctgagccacagtagaagaatgaatcccccaatgactatgaaaacaaagaccctcaccatgcacaacagacttcaaatcacctgtgttaagccacggagacttggagatttgccttttagcagtattactgtaccatgaagcaagcgtgctacagttttggtaagatttcattttggctaaaaactttcaaactgtaaaaaaaaaacctatattaaatgtcgtaaaaagtggggaaaatcgttacttttattcaacattgtgaaggcaatactggaaaaatcttcctaagtaactgtactttacagtatgctttgaattttaaatgtgggtatgctttgattgagcaattctaatttggggatttttttcctaacaagaaaaatgtgaacagttgcacaagaatgtaaatacgaggatagtcataaaggtagatattataggcacataaaagtatagatgaaaaggggctagttacatacttcacagcatgtgcacatgaaagaattcagtgtagctattaaaagggtgtcatgtaatttttttattgacttattcaaagctggctatgtgtgagacatttatgtttatagtaacatagattgaaaaaatagaactggtcctttcctcttggaacattacagcttggaagtagggcctaaaacaagtagatagaattatgtaactgagattacagcaaagagaatttcagtgtcattcaaaggcaccgatgtaggaaaatagaagcatgttcttcagccttaagagacagatgtttgaggacaggctgtgctacctacttcacttaagatctgggaaaagttgtttaggaatcaaaatgatagctattcacaaaatcatttcgcatctcatatatcataatacatgtgaagcatttcagataatatctgacatatattaggtgctcagtaaaactaggtattgttaataatgttattatgatgattcattaccactttccttattgacttggagagcactgcatactaacttcgttgtaagaaggtagttgtagaaccaagggttcaatatgttcccatttttgaaaacctaggtggataaaaaggagaaaaaagttttccaaaatacttttccctttaggtatggcaatttgaggggaatttcaacttattctttataaatttaattgttttaattgtctatgattgccaatatttttgagagagacagccagatgttatcctattgtgattagattgctaactttataaaacttacatgcttaaaacacatgacatggcagaccttcaaccatcattctaaaatatacaaactggagttagtactagaacgtatttatattattctttgctacaatgtcagaatacaaacatacggcacacaaacaattgttaggaacttaggcaatagatcttttcatgctgccctggtacaatggttccatctagagaagaaaagcctgtgaatgttgtctgcttcctgagttatttctgtggctgatggaaaggagataatttacctacctaaaagaaacaaagttcctacagtgtggcaggcacagtgctagatagtttctatccattctctcattctctcatttaaggcttacaattattcaaatagggaggtatcacagaggtttatcttatccatgaaaaaaaatcaaggttcataaacattaagcaacttaactacaactacataatttgtaagtagcagaaaaatgtaataaaatagtaacttacattacatgagtctatgataaatgtactctcataccggaaagtcattttataaaaaaatctttttttgtgtgtcacaaagtaaaaatttaaatttcaatttttaaagacttaatttttagaactagttttcgaatgttgcaaacttttaaacagtaaatactattcaaggagatcaaatagaagctaaaaaatgtctctagcttattactaagaatttttcatttattcatgcattcaaatatctaccattatatactctcatttttataaacaaaatataaattatataatttaaagcctctttcaagtccaatgaataatactctaatctaagctttctaagctttcttcagctaaagttatcttaacttgctcattacacttagtgctttaatctaagcagaatcaatttttttaaaaaagcaagtgtaatgttgcaaagagagatttttatggggtggtaagaatgccctaagtgattgaaaggttgtgtcaattcttaaggtaaataacaagacttgtaagcctttaaaaagaagtttgccacataactgcttgtttttcttagctctagtatgggggagcacatattaatacattaaatactgactttacaacaattcccatatttataaggaaatgatgaaaaggggaaaaaaagacctaaatgttctagttcactgtttaaatctaagttctgatatctattacttgtatgatattgggtaagtttattgaaatatctgctttattatttccttaggtgtgaattaaatagaacttaaaaacacggattggtataagtatacctacagcagtagatataaagtattcattaaaataattggaacaacactgtgattgcagcaagcatttggtaagtttcagttgaagtatttagaaacaccaaaatatgaaaggcttatataggaaatgggatatgtgtgcatcacagagagatcatagatatttaattaaatacatttgatttgtttaattagttgtttctttcaaagacatagttggagtctcctagtttgggcctaacatgcttgaaatattctactgtggcctcttctcagggtttcatttgatgtcatgtctatatacatgttaagaaaatacttatttatatcttttaaaggtgacttaatgaattgtttgcttgaaatcctgttgtgtcctaccaggcaaattatagaaaactatgtacacaaagccaaatcctaatgtatttctatttaggggcattaaatataccatgcaaacatacatttgacattgtagaaataatatgttcccagagtgtagtatgaaccaggcttctattttgggaaaatgctcaaagaaatcatcatgttcaggtaaactctatatgtacttctatctcttttcttttctactatctaactgacccaaaaccacacactgaaactcccttagatggatataagacatgaagtcattcaaaagttaccaaaagaagtccacaagcagaggcctagctatattagaaacttaagtatattaaattacattttatttaaattcagcttccaaacaacaaataccatttacatatacagaggtgaatgcaaatcgagtaattttaaacaagaagaagcatttttagaaaccctaaaatgaagagtaattatactcatttagataaccatcaaatctataggatttagctttcaagtgaattaagcattgaagaaggatagatttatttgacagtctgttgaagagctcctctgaattgcaatatttttggttgatacacatgtgtacaagaccaactactttgaaaatgaagtgctgtgaaaaatgtcaagagatcaatttggtgtaatcattgctctggacttaagcactgtggaatgaactacagtaaattattcaagtatctcattctgaagggcacattaaatagcatttaattatgtctgttcaaagcatgaaggcattttttaatgcaacatccaaaatctaaaattagtttgaaaaatctgtttgaaacacttgtatgctcatagagaaacactaaaaatctcagaaactttccaaataaagatgccattaactctcaaaaggaatgtttcccatttagtcacttatctattgttaatcttatctctaaattcttattgactctgttggctgtaattgttgacactgcaaacaatttctatttactcttacttagcatgaagcctatagccctgcagggagtccctttgaattcacacagttaattatttcctgctctccagggaagtgttattctggcaaaaggagaggtgagagagtttattaaacggtgccataagctagacaatcatattatgaagggatatgtatgaaggcagagggcagatacaatattaataagaaaaattactaacatttggaaacaaggaaaagggaagagagtaagtcctttcaatgccttgttttaatagtgggtccaaaacttatgtaaatatctagacaaatatttctttgtcttatgtgctacccactattgattaaaggtcaatactctgttgagttacataataaatagattttttttgtcaagacaaatgcaaatggttcagcctagtagaaactataacatcaaaggtcatggttttattttcatgcagaacatcagttttgtatctggtcaaacagatttactctagtctaatgttcattattcaaacgctgacaaatacccagctcttcaagtgctttttttttttttttttttaagatggagtttcactcttgttaaccaggctggagtgcaatggcatgatcctggctcactgcaatctccacctcctgggttcaagcgattctcctgcctcagccttccacgtacctgattacaggcatgcaccaccacgcccagctaattttatactctgagtagaaacagggtttcaccatgttggccagactggtctcgtactcttgacctcaggtgatccacccgcctcgacctcccaaagtgctggggttacaggcatgagccactgcacctggcctcaaatgccttttgaattacctttattattctgctggttccctacctgatgggcttaattacatcttatacatgttcattctgtattctattataaccatgttgaactatcctgtagttcaacaggggaacaaatttttggtatttttttacatggaacttcatggtatacctccactaattgtaatgtattttgaaaatctcgacttagatgatgtcacatacaaatgtgactattaaaatttcaacaacatattatctttgtgaattattgccaggtttgatctccttccattagtattctgtgttcaaaaatcatctgtgcaactcataatacatgtcttacaatattattttattcatttttgggaagaaaattgccaactcaaaagcaatgttcacaatttacagttctttccttgtgattctttgattctgtgtctcattacttcacctagaaaatattctgagtataggaatagtttattatttttcataattcattgtatataacatttaggtagatgtacattcagtaataaattcatttttattataaaatgcaagcataacatataagccacattaccttgtggctgttttatttttaaagttatgtcaaaaagtttaattttcttaggatcattaagtcaaatgaatcttaagagataaagaatttcatacacattgtttaaaaattggaaatattctgagtattatctaaattaaaataatagtttggactattatatattaaaaatactaaggacaaaggttcatttcactgttttactttagtttcagaaaagttttgtatccaaactctctgaagtattactgcagtgaaggcatggcatcaatatgtgctaattgtgatgtgaatgaagataccaaaccttagaaagaagtctcagaaaatttttcattaatatgtaatcactgtcatcttagaattaatgccctaagagaatgccagaaaaaaatacgtatgtatgattatggaatagatattactatatttacatcctcactgataaatgaaagaagcaagaactatgaaatttaactgtaagttatcaggtatcaagatatctttggatgcatttttgttatctttataaaattactattatatttatatgaccagatgactttcaaattaataacaagaataatatatgctattaaatatatttagccctttaaaggaaaggtgtggttgggcttttcaaggtagtttaaccctgaaacagaagaaataatctgtgcaagatactctgcctcccacgtgcttcagacagccccaaatgctggctcgagagcactgaccttgacttacagaatcaaaatctgtgggcattggctgaaaactacattttaaataagcttttcagatgattcttatgacactttggaatctaacgttaggaagctaatgcttagcatcactggtcttgagaaatgatataaacagttctttgaaacgaagattgagttcaaattgtgttacactctgtgataccgttagagtagcactcaagtcactgacgaaatcacaagcagtttatacactgaaacctactcttggtcatacaggttttcacacaatgactatccattgattgtttactacatcaacatttttttttttttggtagggctttgtgatatatttgacttctaagcatgagttttgccctttcatctctaatgatttagaaaaagaaccataattgttttgtccagtattacattttcaaagtgagtttctcttttatatttgtttatatagtttaaatattacattttatttgttcagtatcatgtcttaaatgcaaagattatattctgaatattagctagaatttgaaaatgccaagtgaattggatctgaaataaaaaggggtttgacgttctgtttttaaggcaaaatgtttattctacttgaatttttactttcaaatgcagaactaaatctcaacttgtaaatatacaaggatagacgagagtttactgaagcaatgtgcttactcttttcaatattaaaataatacttttgcttagtataatgctaatatataatattaaactattattcatgtcatcttcgtttaaattatattttactttctgaaacatgacttaaagaatacaatttgatttgtgttttacaggccataaagtgtttatatctttttaatgtgtgattatttttatgtgcagtaaagcatgggttgtcagttggatatgttgaaatgtataatctttaagccttttatggagatttctgtgaatagcacatctttttctatatattttcaactgacagtcaatgggaagttaaaattacagctacagttagagccccatgttctactaaaaagtctgaaaacaaattttgcggcaaggtcgcctacttcagctcatttcttgctataaaagactgttaacaaaattgttttcactaaaactttgatgattttggcagttgattctctgaggtaaacttaagacctattaatggaacagaatgagaacaataaaaggagaactaaacagtcctgaaataaattagaaatatagaaaagttattaaatactgcctaacagagcattattttacctttgaggctaatttctattttaagttgaaatctatcatttcatttcttactgaaaagagttcctatacaaaacattaaaattataaaaaatacataagtcatccaaaatagtatataagtatattgtacaatattattaaattataaaagatacatagattaaaagaaatatgggaaataaataatataaatgttttacatacttatgacaactctgtgttttaaaataatataaacgttttaaatacttgtaacaatcctgtgtttttaaaaaaagtattggtgtgaatcatcttttatgttattttatcattttattgttgcttgaaaggacaggattatttctagaagcttaagtaagaaatttaaatctttacaaaaattttttaaacagtcactctttctctttccactaaactagtatgatatgtagtacagcaaggttatcaaataatagcatttataaataacagaacaaaagcaaactagggacattataattaatggattataattaatttttcacactatcaagacattatacatttttgcaaagtgatattggtagtttgagatgttacggcagttcaaaaaaataataatgtatcactaatcaacatacatttatcccacctcctgcttcctttttccactgccttccatattatgggcgaaaaattatttcaaaattagataactttgtggttaagggaatgaactctggtgccaacatatcaaagttcaaaatctagctctatctttgactatctctctggctgaggccaagtgacttaatctctaaaaccttcatcttaacttgtacaatgtatattaaaacagcatgtactttggaaggttggtgtgaccgttaagttataatgacatccagtttattttaaatgctgtcaagagtactagctgttatcaagcaaatcagatttgcatacagcatttggcatgatgtctaaaaagggacagtaaatctgtaatgtgatttcatacatctaagaataattcattaggttttatattagtgtaaaatacatcggttaaaaaatgcattaacatttgttgtttacatcttaaattgccaaacaaagataacaaactgtacttaagagcaagagatctggctttagaaaacaagagttctacagggtcttgatctgtttgctcaggctggagtacagtggtgcgatcatagctcactgcagcctagagcttccgggctcaagtaatcctcctgtttcagcctcctgagcaagctaggactacaggcatgcaccatgacactcagctaatctttatttgcaaaaatgtaaaacaatgcagctcttctattatttttaaatacagctatttttcataacaacagatgacatgctaatatgcaatgagttgttattgttattttagaaaattaaaaggaatgtgtttacaatttcttagttttaatttcttatatggtgagcgttgatagatcttatctacagaaacaaaatctctttatggtcctcaataaatttgagagtgtgtgagaccaaaaagtttgagaacttctgtatcatgccattttatttccatgaccatagcggtagcaaggaatttcaatgagtttttcacaatcacaggtttcttcttaaagcaaaaaagtaaaacaagaataaaactgattaactcacatactttggttgaagcatctctaattatcacaccactcaatctttattacttgatactgggctcagaattggaccctgaataaagccagctgacaataatctttcttggatctagaatttagattctgctggtgaagtacattagatgactgcagtacttaaaatgaaaatgcacccagtacctgatttagctttcgtgacatggtgagtcaaagccacatgcaagctaaaagctatgcagtagaggagattgcatgagtaagcgaagaaagctagctggcaaaaagaatcaaaatcacagagaggacagaaacagagacaagaggcaattatttcagttgccaaatatgaagaagcaaccctaaattctgacatccagtccgagtttctacaagccagttaaatttttattttctgacttaggatgttcctgagatttgctgtgtttcctcgcaatcaatctttctcttttgagtatgtgtgttactccggtaatgtatcttttattgtaataagctttcatagaaatatatgacatatataggagggtggccacacttgtttcaatatacacttcagtgatgtttgtaaagtgaaagcacctgtgtaatcacatccagctcaagaattacatcaccagtatccagatgtctacacgtgtcccctttgttcactggttttcaacaaaggtaacctacctctgctgtcaattaacttgaaataattatgtcatatgatatactattctttttgtgtggattcattcattcatcgttgtgtgtgtcggatgtatccatttcataaaacatagcagtagcttgatctttacattgctatatattattgcatatgacaaattaccaatatttatttatgcatactgttattgatgtatattgggttgatttagttgggtaccataataaataaggtcagtataaatacacatatacttggcttcaggtgcccacatgtatatgcattatttatgtgatacatacacagagctaagagaagaatggctaaaaatttgtttttttgttttttgttttttttttttgctacccttggccatttactttttcacatacaacttataattagcttataccaaaaacgtaacagcgcatactcactaccagtttattcccaaacagctttccaatgtagctatttctccttatctcattggtttctatgagttatattctgagataaccgcattgcctaatatatattttatatatatgtgtgcgtttgatatatctcctgtgctttatccctctcctcatgatctgttttgatgaatagatttttaaaatagatttattaacttttctttaatagtgatttacgttctatttaagaaacaaaatcatgatgttattctcatgtgtctttttccccaaaagttgtattgttttaatattcacctttagctctacaatccatctgggacttgctttttttttcctctagagacagtgtctaactctgtcttcagtgtggagtgcagtggcatgatcatatttcactgtagccttaaccccctggggtcaagtgatcttcttgcctcagcctcccaatgtggctgtgaccacaggtgcacaccaccatgtgttttttttttttttaatttttttgtaaagactgggtctcaccttgctccccagactagtcttgaactcctggactcaagcaagcctcctgcctcagccacccaaagtgttgagatttacagatgtgaaccaccacacccagggtcttacttttgtatatggtgtgagacaaaggtcatggttcaatttttttgaattgaatattcagttgattcagaaacatatgtcaaaaaggccatgcatacacaattgcatggtgtggccaccacctatatcacaaattatatggcagtatttgtataggtaggttctaatctctccattctattcccttattctatttgtctcttctgagatttctatcacactgctttaccatgttgcattataattagctttgatgtaaaatagtgctagccctctacccttttcttcttcaagattatttttgctatctttggccatttgcattttcacgtacatcttacaattagcttgcacacaaaaacatacatgtgcacacacaccgacagtttatttttattttttaaatggatgctacagacctattttgaaagaattcacatcttcacaacacttaaatccttaacaaggtatatatttccttttatttatgtcttctttgtttttttcagtaatggctttaggaattttgtatgtgtgtaagtcttagatatctttcattagatttatttctaaccatttcatgttttctgatactcacacaccacacatatatatggtgtgttaaatttataaatgtatataaatttatatatatgtagtagtttaaattttaaatttctaatttggggctggtctatagaaataaaattagtgtttgcattgtggctttctaacagaaaatctgctaaaattatttactaatttcagttattgatctgtagaatctgtgcaattgtttatgtgcatagtcatcctcctttaaatatcacatttaaaaatttcttcttcattagatgttacactcatatttcatgttctttgcattagcagaggcctcctgtacaattttaaatagaagtcctggtaacagacatttttttacttgttgttgatttccagaagaatgttttaattatttttgccaataaatatgtttgttttcaatacgtttttacctggtaaaggaaatgctgttttatagcttcccttggtatctgtgagggattcattccaggacccaccaggggtaccataatctgtgcatgctcaactctgtgatataaaatgacatagtatttgcacataatatatgcacatcctcccatatacttcaaatcatcattagattgcttataacctaataaatgtaaatactatgtaaatggttgttgtattgtatttttttagggaataatgatagcaaaaaagtctgtacattttctgtacaaagccaatcatcaggtctttttgaatattttctatgtatagatagttgaatccaacaatgtactactcatggatatggatggccatttgtatatctagtttgctaataattttataataaattgacatcaaatgttagccaattttttttctgtacctcttgagagaaatgtgtaatttttctccaacatcctataaaatttttgaaatttattgagtttcaaacttaaatgaccatgtgtttcagaaataagttcagcctagctattttttatagctcttgtatttttgtgttaatatttttatgagttttgaatttatatttaggggagactctggcttttgtttttcttttgttataatatcattagttgatctcaataaaccattactgtcctattctgcagaagaatttatcttaaaatgctgttattttaaatgaaaatattgtaaaggatttacatctgatgccaccaggcctagggttttccttaagggaaggtttttatagtacttgacttttaaaatcaaaggatctctgattagaaaaatgagatctagcaatttatattaatttttaaaaggcctaaacacacatatggtcacagccaaaaaaagtcatgattttaaaatgtgctcataaaatgcattatctaataacaataaatcagagatatcagattgtgtccaaaatgctgtttgctccagaagagaattacatgcgatatcatataaatatgtacacatgagaaaaatcttgcaatgcaagatgaggctattaacaggaaaaggccaaatggttaccatctaagaatcttctgaagatgaattactgtatttgtttccaatctctagtataatcaaattaccacaaacttggtagcttaccacaaaacaaattaattggtttacagttctggagttcagaagtccaaaatgagtctaacaagctaaatagtcttggcagattcatgctcctggaggttctgggggtcatctgttttctgtgctgttacaagcttctggatgctgcctgcatttctcagcttgcagccccttctgccatatcagagcacatcacactccaccttcctggactgtcacatctctctctgttttaccaacacttgtgattacttcgggcccacccagataaaccaggagaatctcccatctcaagacccttaatcacatctgtaaagtactttttttccatgtggtgcatttagaggttctgaggattaggatgtggaaatctttgggggactaccattctgcctgctacaatggtcttgttgaatatataaatgtccaatggctaagctccattcaaagatacttggcttgctgagaaacgacacaattttgacactgcacagaaaatgcagacatttcacattaatcaaactcagaacagcattagcccagaacaccatttttttttttttttgagacaaagtcttgctctgtcgcccaggcaggagtgcagtggcataatcttggctcactgcaacctccgcatcctgggttcaagtgattctcctccctcagcctcctgagtagttgggattataggcgcccaccactatgcctggctaatttttgtatttttattagagacggggtttcaccatgttggccaggctgaacatcaatgtattttaaatgtcatataggttgcaatactttttccagaataaccacaatggtcacttcttatagatagatttgcgtagaaaaccaatttaaaaccagtttctgagtgaatgtggaatcagaaaaagaagatttagttacataatagacaactttactattaatgggtgaactatctatttccacaatagtggataacatccttagtaagactctaatatccaaaattcattatgtaattcttacttccttgtcaatttctacccttggcactggcatcctttggcttggtctgctctctgtatcattccattttacctatccctgttctaaatgatatagtcttcaatatgcctttatctgtggatctaagaatctttctatctcgttcaagtgacagtgcacctccaaaataaaatgtgctgattttatagtttcactttctaacatcagtataattttatttatttcagaattcttgtctggatggcagaggaatggggatagggctaacgtgtgagtagaaacctttcccaaatcaaaggttcatgactaagagcataatcctgaatccttacaaaaaatattttgtggaaactagaacccttcaacttgaattagtgttgcttcagagattatgttatgcacaaaatgaaagataatcacgtaaaagataatttataatttttttactcagtttaagtaataactcacaatacaacttataacagccccaaattgatcaagattcccacattatctccctcaggagataatgaattccctgttataagtgcctcaaacaacattaactggattatattcaggagaagattctagcctcagattggtgtgagatccatgtaacctctgaatttctccccaggctgagatactctgttttcagaatagaaacatcagctttggaaatgatacaaacctccagcctgggcagatcccatctccctattatatatgtttgctttctaactgactcacacatttactaagagaatggaatgtaattacatattttatgtttaaaagcatttcctaggagcaaagcaggagagaaggacacttcgagaaacaaagatcaaatgaagagttgccacagatgagatgtctttaagggcattgtcttgctgactttttatttggctgtgtttcaagctcacttttctgttctcttagtcctagcactttgtgggaaatgaggatgagtagtaaatgtgcaattgggtaggtgtcagggatgataaaaatgcaaaataaaaactagatttaatttgaaaatttaatgcaataggaaacaatagaaataattaaggtttaactctattgcaaataaaagttagaagacactgtctgaagtagctaaagtatccttagagctaaaattctacttgcttggttaataaaggacaagtatatctttaaagtgctctagctaatgttagtttacctttgggaggaaaaataatgcggtgatatatgatactcattactttttgatatgttaaaataataaataaggaaattcaattttactttttcatattgagaaagggttggaaacaagaatttgtgtagggcatcaactttgtaatgttattaccctcataatcatcaattatattgtctaaaattcttaacactggaatgacttatttagctaagagacagtctccaacgatctgtaatcctcatgtgcatttcctcctggtatttatgtacctgtatagtcctctctgacatggagtagggtgaacctgtgaccaataagaatattgtagaaatcatggagtgtgacttccaaaaactcttcaccttgtgttctcttggattgttcactctgtggaaagccagttatcagatcacacggacattcaagcagaggcccagatagaaaggtaccgattccgagaacatatgggtgagctcattttctaggcccagtcaagatttcagaagatgacatccctgccaacacttcttgaaagtgatctcataagagaccctgaaccaaaaccacccacttacgtggcttctaatttcttgatccacaaaagtgatgcaacatattaaacactggttgttatttaagctgtcaagttttggagtaatttgttatgcagtgccatggcctaaatgcttttgtctccccaaaagtcatatgttaaaacctaattcccaatgtgatagcagtgagagatgggaaatttgggaggtgattaggtcatgagagtgaagccctcatgaatggcattagtgcttttatacaagaggcctcccaaacagctccctctgcccctctgcctctgaggacacaggagaaggtaccaggaggtgagttatggatatcccagcttccaaaactgtaaattactattgtttgtaagctagctaattcatggccttttgctatagcagcctgattgtactaagctatgcagcaacaagaaactgatacaatataaaatatatttgtgtatgttaatattgatacaaattgtgttaataagtacactagaattagtaccatagtgagaaaagttttccccaaatagcgtttgcatatatccacattatttctagacacaaggaattgctgaatcacacagagggacttcaaaaagaaaggaccaaattgtattttcaggaccacatagactgacacagcttgataatgactttaaaaagcattcctagtttgtaagcagaggttatttacacacatatacatacattcattttctctctctttctctctctctctcctacaagattatttagcctcacattacaacagattcagggggaatattagggagggcacaactgtaggggaacttcagtcttgcttatttgtactgagtggtagagactatttaaggaagatttatggaagttaatgtgacttttcagcacttgttgtttgttatttttgctcacctaaattctcttttaggaagctattgttgctaaaatgtggtggaaattgatttccagtgaaaacatatatttagcctcctgttatttttaactcattatctcatattgaaaaactcctatattaaagatcagaggtgggaaagtaaacaagcagcatgttctatgattttacagaagtaatttgcattgtcaaacctatcattatcaccttgcatacccgctatctttttgcttttcttgcattttaaaaattatttatcttaaaatagactgtactgattgaaaagtaagagattttatatttatttcttttttaaagagagatgcaagggctccataatttctaataaccctcaaacacattaaagaatcaagaatctctagaaaaaatccactgatattttaaaattggatctattttagtttttaaacttcctcttttaggtgaaagactacagtatttcaatgtaaacatatcaaaaatttaataaccacttgactatttggatgccattgttaatagaagtgatatgttcatatgaatacaggtttttctacaaaactcaggatactttaaccagttaaatagatacatttcacatgtctactgagtattctaatacatacttaatatgagaaatagacatagtaaacaaatggcatattaagaaaatgacaagatcataagtcactaggattaagtaaatgtctggctacctaaaaaaaaatatttctaaattcataaattggattatttaaattattaaaataaacatatactgaagttcctgtaacagcaacttattctttatatttttgtgaagatattttctattattatagaaaattaagaaaccatatgtgcattgtgagctgaataaaattgcatttgttttggttgtcatacagcattttacaaatgagttcccatttatcttcatagctgtttgtacaagcatttggggctagaaagtcagtaacatttgacctctgaacatttctatcttttctcagacttgttcaatgttagtgaacatcaaagagtaatttatcactatgtcacacttgcctgaagaatttcttagggtctcaagaagaatgatgaggttagtctttaagtcctgaaaattcctgaaggtgaatttttctctctgatgtacacagataattctgtctttgctgaagatttgctcctgtgtctttgttctcattgcaaatgtttaggttttaggttgcctattcaatatttcctttttaatggaaccttggatctaaatgctcacttgaacactgctctatgtagtagatattttggcctaaatctggattatgttcactgctgggatagaggcatgttggctgaatttatgggaaaaatccagctgaagtttttattatagtgtcaatcagggaacagaactgagattctccctgagaagaaacttgagctgaaataggtagatttttgatggaatgtcttgcaaactggtaaggctttcaataaaagtctgtgttgccaggaagtataagaagaagccacaaatgctgagcttgatcttgtttaaggtcatactttttataaatgagtggtttttctgatgaaagcattgggcttacttgaatttgtcttagctgtaagactgtgagtcttaaaagagcaaagggtctgagagttaaaaatgatcaagttctaaacctcccagcagttccaaacgacccagcaatttcactcctgggtattgatcccagagaaatgaaaacttatgttcacacagagacctctacacaaatgttgatagcagagttatttgttataacctggatctgaaaataactgaagtgtccttccacaggtgaatcactaaataaaccatacagccataccacaacgaaatggctcagcaataagaaaatagactatttataaacataacactcggatgaatctccagagaattatgctaaatgaaataagccaaaccccaaaggttacatattaaatgactttacttatataacatgattgaaatgacaaagatacagagttggaaaacaggtaagtaatttccaggggtgaggggaccagtgaaaagcagttgagactgaggtagacatggtaaaaggggctgttctgtattctgactgtgatggtagctacacaaatctaaacgtggaagactgaaaaatggtccccagaaaacatccatgcttcaatctctgcaacctgtgtcgcattatttggggaaaaaaaaatggtccttgcagatatggttaaattaaaaattttaaaataaagagcttggtcggacgcagtggctcacacctgtaatcccagcactttgggaggccaatgcgggcagatcatctgacgtcaggagtttgagaccagcctggccaacatggtgaaaccccttctctactaaaagtacaaaaaaattatcagggcatggtggtggcagcctgtaatcccagctactttgcaggagaatcatttgaacccaagaagcggaggttgcagtgagtcgagaacacatcattgcactcgagcctgggcaacaagagtaaaactccctctcaaaaagataaaaataaataaataaaataaagagcttatcctagattacttgggtgagacctaaataccatcataaacctccttctaagagagaggcaaggggctaggtacacacataaaagatgaggctgtgtgatcacagaggaagagattggcatgcaatgacaccagccactgggagctggaaggccaaagaacagattcttccctagagcctccaaagcgagcacagcctggcaaacaccttgaatttggtttagtgatactgactttggacttctggtatccagaacagtgaaaaccaatttctagcgttttaagccaatgaattgacggaaatctgttactaattactatatgtgtgataatattgcatagaaacacaaataaatacatatgcaaacgagtacatgtaaaattaaggacatctgagttagattggtggactatattactaccaattttgtggttttcatattgcattataactttacaagatagaagttaggaaattagagaaatgggttaaagagtacatgggatttctctgtgttaccttagatttgcatgtgaatctatacttatctcaaaattaaaatttaatttaaaagatgatagagttgtttcattgttagaaagaaacaaacagtagaatatcttcatgactttagtgtttgcaaagatatcttaaaaacaatgcagaaaagcatattaatcataaggaaatatgttaaggtaaaatatattaaactaagaaatataattccttaaaagaaacacccattaatagaatgaaaaagcaatctaagggtgaaataatatatttgccatacaatttatatgacaaattcctcatataaagagtttctacaaaacaattaaaaagccacagtgaaaaaaagaaatgggcaaaatgtttaaaccgaatgtcttcactagagtgatatcccatattgttgctaaacatataaaacaatgatgaaatttattaattatcaaggaaatgtgaatgaagaccacaaggtgataccactatatactcagcagaatggctgaaatttaaaagacacataatactatacattagtcaggttgtggacaaactacaattttcttacattgcccacacatttaagttggtgtatgcaatatgaaaaactactcagcaatatctactaaaactgaatatacatatacactatgattcaataattctactgatgaagccaacagaaataagtacatatatttttccaaaggcacatacacgtatacctagagcaacaatttttacaataatcctaaactgaaaaaaagccaaatgttcatcatttgaatagttaaatactcctgtattcatacatatcaatattatacagcaataatcatgaaataattacaactatatgcaccattatgaatggtgctaaatgaaagaaaaaaagagagtccatagtgaacaagactatttatttgaaattcaaaatctggtaaattaatctatgaaagtagaagtcaggaaccttgtagggggtgaacagcaattagcatagcataattttgtattttgatgcaattctgtttctttatctggatgaagggaacatgggtgagttcactccatgaaaagtcattgagtcgtacttatgatatgtatgcttttctatatgcatgtgatgcttcaatttttaaaaatgtgtttctttctgtacctattctgaatgttctttagttccagaaactatactaaagagattgcaatgcatttatagacttgggaattatttttctctatattattttatttatctctgtattattttctctatgttatttatttatcaatagtattttaatatccaagagtatgccatatcttttcattatgtaatatttattcctttaagaacagcttttcagtatttatttaatgtaggtcatacaaaattggtggtcacatgattttcctattttacatgtagtccaatcattgttcttatagttaaaaaaaactttttaatataccatgtcttctaattggttaatagtgatatataggcaatattttccaaatttcagggtgccttttataaaattaatcaagaatgttcttcatgaatacatttagagagattcatccagctctgcttattgaaaatttagcagaggggattactaataaagggttagttttttttaaaaaaagggtatgtccatgtaaaggaataatatggagtgagtaaaaatcattcagtatatgaattcttaattatatatggaaaataagaagaaattatatgtggaaaataagaaatcattactaagtgaaacagcagattacaaattaaagttttacaaaaaatcataggggaaatgtttcatgacattgggcttggcagtgatttcttggatatgacaccaaaaatataagcaaaaaaagtaaaattgtgtacaagtggggatacattaaacttaaaagctttggcacagcaaaggaaacaatcaacaaaattaaaagaccacttatgaaatgggagaaatatttgaaaatcatatatctgttaagaggctcattacaaaatatattaggaactcctacaactcaagagcaaataaccaaataacccaattaaaaagtgagcaaaatactagaatggtaatttcttcaaaaaagacacacatatgtggctgaaaggtataagaaaatttgctcagcattgctaataatcagcaaaatgcaaatcaaaaccaaaataagatatcgtctcaggccaggcacggtggctcacgcctgtaatcccagcactttgggaggccaaggcaggtggatcacctgaggtcaggagttcaagaccaggctgaccaacatggagaaaccccgcctctactaaaaatagaaaaattagccaggcatagtggcgggtgcctgtagtcccagctactcgggaggctgaggcaggagaatggcttgaacctgcgaggcagaggtcacagtgagccgagattgtgccattgcactccagcctgggtgacagagagagactccatttcaaaaaaaaaaaaaatgatgttgtctcacatctattatgataattattacaaaaaataggtgttggcaaatatgtcaataagttggactctgtgtaaactgctggtgggaatttcaaatgatgtagcttgcttatggaaaagaatgaggaggctcctcaaaaattaataacacaattaccatagaattcagcaacttcatttctggaccacaaaactgaaatcaagatctcaaagagtaatagcactcctatgctcattgcagcactatttataatagccaatatgtgaaaacaacctgaatgtccactgatggatgaatgaataaagaaaatgtagtatatatatataacagaataatagccataaagaagaaaagccatatgccacaacgtgggtgaatctggagaacattatggtaagtaaaataagccagtcacaaaaggacaaatactgcatgattccacttatacgaggtatctgtgattgtcaagctcagaaacagagagtaaaaaggtggcttccagggcctggaagagggggaaacagggagttactcttcaataagtacaaaatttcaattacgcaagatgagtacattctagagatctgctgtacaacactgttcctataggtaaaaatactgtattgtgcagttaaaaatttgtggtaagggtagaattatgtagtcatacattcttatcacaatttaaataaaatgatgttaaacgaaataagcaggcatagaagacaaatatcaggtaatctcactcaaatgtgaaactgaaaatgttgttctcacagatatagagagtagaagagtgattaccagaagaaggggaggggaggaaggagagagggagggaagtgatttgtcagtgggtacatacaaaattacagtcagaaataaattttgacattctattgcatagtagtatgactactgttaacaatagcgtatattttaaatagctagaagagtggtttttgaatgttctcataacaaataaatgataaatgtttaagctgatggatatttaatgattacacaatgtatacatgtatcaaaccctgattcgatcattgcacaatgtatacatgtatcaaacgataatttgacaattacacaatgtgtacatgtattaaaacatcatcttgcacttcatacatatgtacacttatgtgtctataataaatttttaaagttgaaaaataataaacaagatattgccaagctttcaaaaattatgtatggtataattccacttacatacacataatttttaaaagaatgaatggatatataccaatttttaacaattataaaacattagtgttttgcttatggttacttttgtcttactattttcaattatttgttctcctgagttttaaaaataaactttagcactaagattttataagctattatgttttcagtggaaatctgcctttttatcctctttgaataaaaacatgaatttttaaaaatatcagtaaagacgagccttccaagaatatcatgtgtctaagtggaaaaaattaacaacttaggaatcaagcaaagcgggttgaaatcctgacttgcctagtgtggccttgtgccctgcgaaatctatttaacttctctgagatttaacttactcctttataaaatttggaaaattaaattgtaactttggatttggtgagtatatcactgtctggttattattactattttctttattattaatatagtggagacagttttgggaatgatgttttgatataactctgactactttaaatataaatcaatgtattatacttttaaaagtagatattttattttactcttatgtaattatgttttaaatgccattgataattttagtgaagaataaacttttaataattttataaattttaacatcagtaacagaagaaaatatataattcagtattttcatttttgttgcatgactagttttcttgttcattgtctccaagacatctttcttcatgagccaaactaataatcccttaatttatccacttacatttgaattccttacattaattacattggaagcaaaattagcttttgagaatgtcttaaaactctactatggatagtcccaagtttcaaaaggtctggacttttcactgagttgggaacaaataagtcttcaggtatgatgtgatgtatcttagaaatatatttaataatgttctaaaaataaatgttcacataggcattaaaatatctatgaaccataaagttggaatatatttcctgatagaatttataatattagatgcagatatttttaaaataaaattttagactcaaaatgaaactcaatatttatattttccatattatggcaatttgtgaaataaatagtaactcaccattaccacccaattattgaatacttttttcacttatgatatataatatataaaatgacttaatatacatctcagcatctcattcaataactaaataaataataatagaattattttaatagaaataatactaagttcctttgtctctgaaaacatcatgatactctaaataaatgtttaccatgcgtatcattaccttaaataactctaccattttttcttgtatcaaaaaaacatgtacattaaatcacatgttaattcattacctgttcttataaaaatgtgagagcaatactgacgtcaattttaacatattcgtaatactcaatgaataaatgtagtactttacatgtgacaaaacatatagggaagcagtctgtaacggtagcatggtagtcttaaaaatagaacgacacatttttaacctagcctcactgagatggtcgagattcatccttcatcccttgagtgtgagttacatttagtgactccattttaataagagaatatggctgaacggatggcaaatcacttctgggatccttacaaaagaccgcagctttcaccttgggtctctcttcctttctccctccctccctcttgaaatggcttattcccaggaaagccagctgcccttgtggaagtggccttacagaggagctcaagctgaggggctgtggagctcagtctgcaagcagtgagttaacagaagcctgtacacaaaccgtgtgagtgtacttggaagtggatactctagccccagctaaacctctagataaggacaagcaactccagccaacggcaatcttgtgcgagatttctcatgagcaagaacccagccaagctgttcccagatttctgaccctctgaaaaggtgtgagataaccattattgtttcaaactgccaagtttaggggaaactaacacaggtagaaagaatgcagaatttggcaacataatcttggctggatgcccacttgccactgcatgtgtcattttatatttcagaactttggtttcccactctctaaagtgggccttatctatctatatcttgcaaggtaattccattgtttaactcttatgaagcaccccgtattgtatcaagtaaatgggcataagaaaagtaatccataagtgacatatagagtcttatgactttttactatcattttcattataaagtattattattttaaaactttgttaaaatattcaaaatataaaaatacattatttaatttaaataattattctatatctctatacaacagctttgcccaaccacagtttattttggaataatttaaatatatcttccaaacttgtacaaaacttagacaagccaaaactataaatccagtcatataatgataaacatctccacatcataacaaagtattccacattttaaatttaaaaattaaattaatttttaattaaaggggaagtgttaattaatttttaattagttaattaaattaaaggggaagtgttagatcacatttttagctttagaatttctactaccagaaaattagaattttttgtaggttattaaccttaccacttgaaatagtgttctttcctccctccctccagaataatgcttggaagagagtactctgttacctctgagcttctaagtgctttttgaaaaggaacaagctgatacttagtataaagagatcaatatgtaacattattttagtagtaaccactcaaaataatgactctgtgtgtgtgtgtatatatatatatatatatatatatttgttgagcctcagccctcatgccagtcccttcagtaacaagcaaagtggcttttttttttttttttttttttcctccaggactataaatacaaatcctctgagcagcactttgcagcatgtggataacactcaatcgagcacctgaaggagattccacttgtctctgggaaaaaaataaaaaatgtgtccattatttcatgggacacagagggttccttccaaattgcatgctgacaactagggctgtgctccagaaaaattacaatgtttgtcagcagcgatttcctcatatgttgcataacacaattgcaatacatgatacttggattctttttgtactagataatttaatgcttccatttaataagaagatctatccaataaagccacataaactaacagcgtatacgaaatcagacatcaggccaggcgcagtggctcacgcttgaaatcccagcactttgggaggccgaggcaggcagatcatctgaggtcaggaattcaagggcaggttggctaatatggcaaaatcgagtctctactaaaaatacaaaaattagccaggcttggtggcgggcgcctgtaatcccagctactcaggaggctgaagaaggagaatcacttgaactccggaggcggagattgcagtgagccaagatcgcaccattgaactccagcctgggcgacagttagactctgtcaaaaagaaaagaaaagaaggaaagaaaaaaagaaaagaaaaaacgaaaagaaaagaaaagagagagaagggagggagggagggaggggaagggaaggggtggagaggggagggggaggggagggaagagaagggaagggaaaggaagagaagggaagggaagggacagtttgtgggaagttgtgaagactgggaattggagagacacttgagggtataagatttaagtatctatgcctaccttagggaaatgttattatcagagaaaaagaaactcacacatctctttatacgtaagttcttgggtaaagtgaaagatcgtcatcactctgtgtctaactgcggctctgtaaattagctagatacataaacttggctaaatgactactatatttggtgatagcttttctcatctgaaaaacaagtgttggatttatgatttgaagtaccttgttgtattcaattttatgttgatacagaagtattataatttgattttgatctagcttagcacatgtattactttcccaaatttataaaaacatatcttcatattgtgggaacaggaggaggaaggtccttaatttcttcaaaaatatcatgacagttgcagatttgctttcttgaaaaatgcagagattcaaaaaatgaccacaaaacagagtacagtcttaaatgcatgtctgagagataaccatgggatttatgaggatcttgtaactgcaaatggtttcttgctgagagatgtttctccatactgataaagaacctcaatttatattattgaagtaggagcttctgaaaggtggggctagagtaaggctgggagaattctgcaaataactagagatgtgaaaagaaaaatgaagttcaagcattccgatttccaagttagaaattggaaactgtttcccaaagaagcagctggataaataatggccaagttctgcaataatactgttgctacattttaattacattttgatttaggtagaatcttgcaggttggttttgtatcctaaccacattcatcatgcaggttttatggagaaatatgttccaaattctaacagtggcttacaaatgaacttgtagagcacaacctgattgcaatttggaaatggcttgcaaatactttatttttattaatattttatttaaaatattggaagataaattgtatgatcaatgatttataaaacatttagatcatatccaattcattaaaatatatataatttatatgtatacgtatgattagtagtttaatagccactttttaaaaactttcttaccttcattcatcaaaaagaattggtcaacactaattacaggtaagctaaaaaatatgatgataatattatttttttacctatatatacttgtttttaacctttaaaataattgttaggctataggaagtgtcagttgggggtgacttagcatagagcacgtgagtctcaggctgtgaaacaactttattaaaatcaattttaaaaatcagaaaaaaaatcagaaggatttgcaaatgatctaaaatgaaggctgacagagaatcaaagggaagactgacaagtcatgactgagttgatatagaatttactgcaatagataatattaaaaaaattctgaattgagaacaactctagatgcgagttagccatcctcagtaataccatcttttctttctagatatcctgaagctagttaacaagttatattttctcctctagtcattaacatacttttcaacaatgtgtgttttccgaaatcaaacttcaattgaataatctgcagagatagtgaaaaactaatccattcattagtgattagctaattatatgaaaaatggaaactggatgcccacagttcccatatctagtgaaagaggttaaaaaaagaaacttgacatgaattccatgatagcagggatttcataggactaggaaatgcaatccatagacattaattatgtaggtctcataattttaaaaaggagccttcgaataaacaccttctaccccagatccttcccattaatattacatctaaatgtgtaatacaggttaaagtttaaagattcatgtaaagatacctaatgacgattttcaatttattaaattgaatatgtctatactggatctatatctatttttatgtcacctatctaattaaaatgtataaaataacaattatattaaagatatttctgattaacctaaatgtaacaatattactagtgaagatgttctacaccttgataacatactattgtaaccctttcttcttggcttcttcttatcgcatcaaaatgaaggacccacagaatccaagttacagagtcttttgtacaagatggtttgaagtgctgttcaaacttgtgtaattctgacaaatgtattcagaaaagtatccctgctcattcacctattcaaaatagcaagagtgctatgtaaacagaaaatatggttaacattgcaacattctaaggtcaattattaaagactaatataaatagatccatgattgggccatgataataataaataaataaaatccacaaccaatcaagacacaactatcacctgcccaagtttgtgtctgtctctttctctctaagctgttgtatatatcagctatcataagctgctaaccaaaatgaagcgatgtatcattttataggtaaatagagtttaatgaaaagaaagataactttcaaatgataaataataaaataatagtgttttgtctactctaaggtatctaaaatgtaaaaagaacatgatgattgctgaaaattgtcagttaacttaaaagttaaattcctgttttatggttatctttgtggcaaccattatatgattaggcttcttaaaatgtcagtaatgcaagacattgccatataaaaaaattcatggttatgtgtgtttcagaaatgctgtctatcaaacccgtgtctgtagattgacaaacaatacactttgcacttgggtcaaaaatcatagtataggttgagtatctcgtatttacaatgcttgggacaaaagtgttttggatttggggttttgtttttaaatatttgcaaatgcataatgagatatgttggggatggggcccaagtataaacagcaaattcatttatgttttctatacaccttatacacatagcctggagttaatttaatacaacattggtaataattttgagcatgaaacaaaattttgactgcaactgatcacatgagtccaggtgtggaattttctgcttctggtgttatgtcagtattcaaacagttgattttgaaacagttcatgttttggatttttgaattaaggatgctcaatctgaggtataaaaatttaaatagcctcataaggctaatgaaaatcatgatgataaatatatttttactgactttttttcacctacaatttccaactgatctgaaaaatttaggaaaggcatattcatgacattaatttctataaaatattatcacatcattatatgttgtctgtagttaatttacttagtgaattttctaaattcaaagattactttcttgatctttacaaacataattttcaatcaactactcattcaatatttagcagcaatatttccagcttttgacttaaaataaaataacatcttacatttagcaacctggtatatatactttaaaatccttaaatggggatatggaagagttaatcagacatttctaactaatgtataatttccctttattatttctcaatgacgtttcctagcaacattaaaaggctagtcttctatttgctttgtgtttgtattcttcttgctaaggaagtaaaaatcatattcagaaggcttatttactataattataaaaattatcagaaatacttaatcattcatttaccttgttttgatggggaaaaagccagtggaactaatatgataactccttccatggaaagtgaagttcaggtacttttatgtttcaaagcaagagaattttggcgtgttatagtattgacaatgacatgcttcttatttatatacagaaatgaaaactttaatctcatttaactaaaaatgtttttattatgtgagcatctcccataatcttaaattaaagttagatatgtactatgatgagttagataggagggaggaaaaggtatactaagaaaaatatagacaaccttgaatttcaaataattataagaaacattaatattttccacaataaaattctatccttctaaaaataatttgtatagttttataaacttttcttcctgggaagtgggagatattgaactgttagaaaaatgttttagaatttattcatctttttccaggttttcacaactattccttatacagtatattatccgtgcatacaaaatatgttgaaaacaagttatctgtcatatggcctattttcatctgagctgagatttccattgcttccaagtaagcagtggtatgaggatgaacattcataatgattaaattaattatattttatcaggcctgaatgctaacatagaatctaatattgaaatctgcttggtaaactgcaggtttccctaaatccaaaacggaataaaaatattaatgtctgtttattaggacatttacactaagatgtggatcagtgcagtggataagagccaaacttttggagtcagttggtcagacttgatttcatattttgggccagccacaggaccagccatataagctctacattgctcactgactgggagcacatctcctatcctcagatacattaccttcattagctaaaaaatgagaatagtaacagtgcagacaggagaaatagccgttttctgcattttctacatttatggaggaaatgcaaactgctatgacacgtttcctggtgaactgaaatcccaattagtcagcaactccacaatatatttttaaaagtgtccttggcacctaaatgaaaacagctctatagagaggttgggaaggtaaagaaaagaacgcaagtaaagtggtttccttcacttttttttttttttttttgagatggggtcttgctccttgccctgcctggagtgtagtggtgtgatctcggctcactgcaacctctgcctcccgggttcaagtgattctcctgactcagcctcccgagtagctggaattacagtcacatgccaccacacctggctaattttgtatttttagtagagatggggtttcaccatgttaaccaggctggtctcaaactcctgacctcaggtgatccacccttctcaccctcccaaagtggcatgagccaccacgcccagccagccacttctgctatgtaggaaacttttggtgaatgcttttattatattaataattattacagcattagaagtctgaagccaaagttgcccagtaggtcaaatggcaaaaaaaaaaatctatacatattgatgtctgtctgaaatcattattcttatttcggactatcatttccttcaggtttgcaggaaattatactaatgacaaagaaggttaaatgtatttggtaacagattcagtaagccaaataaaatcagtatggtgtgatgattactggtgctttcctttattcttttttggtgagtaattactacacttttaaactcaaaaactacatatgcgttgaattgtatgtcattttcatcttttttacccatgaacatagattaacttcagtttagtctgtgagttcattcttgccgtaataaacatcctttatgggtctcccaagtagatttttctcttctgttaatgttatcagttaaccttcagaaatggatattttcttttcttttcaggaaataaatcagccccaatgtggctcaataactgtggccaaaacgggaagtgatgaggaaatgtggaaagagctatttgcaaatttgtgttattgacatttattgagaatatacaatatattatgatatatattctagtgaactagagcccaaattagtcagcaacaccacaatcattcttctaacgtgtctcagctacctaaataaaagccactctgtacaggtttatatcaccccagagtgcaaacaagcacattttccttaaggacacagcagcagggatctacgctccattaagctctgtattatgaaccgatgttgtggagatttagctgcttttcctattttcagaatttagctctattcagttgtacccttatatgtaagttcacttataatggattcacaaatgcatatggtcagagatatttctaggcaatcaatcaatctttctttacttctattaataattaataagatttataggcactatgggaaagaaactatgaaacaaaataagtactctaagaattcattgtagcacaaacatcaaatcaaaataaaaaggtgtctgaaggccatacatgataatcatctattcaaaaaatagttatctaagtcttaccacgtgtcctggacattggagatgaaatgggtaccctatgaaaaaagacccttctcttttggagcctatagcctaggaggtggggtaaagacatgaatccaataactgcataaataataattattataaatactctaaattctggaaaagatatatacgtaaggacataaaaagtaggacttactctggcctggggaaggcattgactctgaagtgacatctgagctgatgtgttaaagctaagtaggtacctactgagtaagcagactggaggtaggggaaaattttcaggtagagagagattagataatctttcaatgcctgtaagcaataggaaactgaaaaagggctaccatggctgccactgaaagagcaaggagttaggtggagagggtaagttgggcatggagtatggagacctaagtgtgtgtcagcctgactgtctattttggattatactcctctccctgaacagtgagaagccatagaaaggtatttggtggctgagcatgctgatctgattctcattcttattacaaagctcttccttccctctgtttagcaagggaagaggaggggattatgagtccagataaataagatagaataatggtttagaagagagtgttgatggtagagttagagagaaggggaaagattatactattaggagataatatctgttatgcactgaaaggtcatgtgctatccacacaccctcacccccagattcatatgtggaagttttaactgccaattggatgatatttggaaatgggatcttttggagtaattaggttgagatgaggttatgacggtgatgttcccatgatgataatagttcccaaatagaaagaggaagagacaccaaacctccctttccctgctatgtgaggacaccgagagaagacagctgtcaacaagccagggagacagccctcaccaggaaccaaatccaccagcattttcttcttgctgtgagattctctagaactgtgagaattaatgttggtgatttaatccacctactctgaggtattttgttatagtagttcacacctacttagacaatatccataaaagaggtgaactgaatagaagaatagggagtgagtttcaaagtgttatttttagataacttgcttgagcttttgcataaggcataaaacagggaaccatggaacagcctatatttgggttggtggatgaggataattacactttagatgtggtcaaagggaagataagctgcttttgagatgttaagtagtggtatcattgaagcggcaagattgacagctctggaaatctaaggagtcatctaggttacatgttactctttgggagtcatcgattccaggtaataattaaagacatgtgtgaaagtgctcaggaagagagcatagaggaagaaaaaataaagacatgaattgtttagctattaacaataataataaaaaaaaaacacttaacggcttcgtaaaagcaaagccaatggaaacaaatcagtctcagaggaaggggctaaggaagagaggtgtgtttcattcacatcacatgaagtttccttaaagaagataaatgaatacatcaggtactgaggctctgggagtttaagggagataaaaattgaagagcatccatggatttagtgacacagaggacatgtttctctgaaacagaatcactgtattggagcaatgaggccagatatcaaactggagtggggaatcttgtcaaatgtagagaataaaatcaaaccattttctgaacaaaacttagttgagtgatcatctactagtttgtctattttaagcttcccttttatcccatgaatgttattccatttgcaagtgaagaagaagagtttatttatttattttactgctaatgagctatttcatcttacaaattcataggcaactgatgctatgggaaagataatgtgtgcatagaagaatgatgaaaaactgcttaaaggcagaaagatttgagtttagcctgaagaatgaatcacatcaaatgaaatgcaggaggaaagaagggaagctaaaagtgctctgtgtcaagagtcacaataggagagagcagggctttcttagagggagaagacatcggcccatgaggacaactcaaagcaaagataggacactgaggctgaggaagcagcagggtctgggtgattctcaagtgtcttgaatgccagccagaggagttagccatttcttagagactatgagaaggctttgaagcatttggtcagaaaaggggcagaaagaatatgggtattttaaagaaaatcaattccttctatccatcactgtggagagaaagaaagaatcaagaaaaatgatagaaaagaggtaccgattttttaaaagcaaaaattgacatcttgagtgtgtacactagatacttttatgttttatgctaaaaaagaattaggccctcatattagtcatgattataagaacctctaaaaacatgaataatttaaatgagataagattaataaatataatgctcttcatactcttttttctcatatatgtttttctctagaaagaaaaacacaaataaagcatatctgttgatgtaattgttatccttgtgttttttagaaggaattggtgtgtaggggtaaaacaggaaagcgaagaagatattaaacttgcaacaagaaaaagttagaaacttcgatcacaaatgctgagttcccaaggttgtaaattttcagttcactttgacttttcccagactctttggtcaaaacaaacaagtaacaaactaaacagtttttctatcaccgttgcaaacctgatatgaaatcagagagtaggtatgtgttcatggcagttcaagaatatatcacgaggttaggtgcatgtgcctataagaatagaaagtggttcttcagagatgtgtgtacttagatcagacatgatatctatctaaaaaaaagaatgatgctgagctaagatggaggggagacctccacagcccagaagtctgaaactctagagaagcatctgaaataacatattaaaatgttatctccttaatacatgataattacgccaccattgagaactcttctgttcctcaattaggctaggaaggtgcagatttaggggaagaggaaggaattgacagtatcacagggatgagaaataaagcaaaactaccttcatgtgcagtggaataactatgctgaaaaataatatagaaacaatgcgattattttagcttctatcaaatatgattctctaaaaaatgagaccattaggatcatagagcagatagtgtgcttgtattgaggttatttagctcacaaaaaggaaactaaaatagcttaggcatctattttgtttcctttttgagatgcaaaataagatggagagatatagtcaatgggggaaaatggtgttctaggatacatatgtgttgtttgatacaaaatttaatagtgtcttatatgcagtagggtaaaaatagcataacctttagtatcttttactgctgaaggaaagaagaccattccgttatatgcatttacagtaatgtaaaatctctgggcctaaatcaactgtataaagttatatactctccccagagccttgagacaccctctatactcccagtaaaagaaaaaagaaaatgcaattagcatgacattattaggtcaggtagtcaattgtttgcttatttttatatttggacttatctatctatatacacacataagtgtgtggatatataaatgcatacacacttctaaattgtatacatacttatattgtacatatatgtgtatatatatactctctttacatatatgtatgtgtgagtgtatatgtatatatccacacactactaaatttttggcttttagtgtatgtgattattgattgtaaaagtagtgagaaatatgaatttctagtaagataaaagaatcaaataatcaatttgaattttatgcattttgagcacctagcaataatactggctttttagggcccaggaatcaatcactatttaccaaaggaaacaaaatgaaacatcaagtcaatagtttcctaagagctggagacaacacttctaaaaagaaatgcacaaatacaaaaaaaatttctcccccaaatttgtaatatgataatagaaggaacttaacaatttttttgtggtgatattatcaaaatagtttttttccaactactaaccttaattactttatttcctccccgaaggaaagaattaaccttactaaatgtcctatgtgatagagttccataaggaaagaattatttgtgcttaacactcttttagaaaataagtggtatgagggagttttgatgttccactaaaacatactgctttcttttaagaaatatattaaaaatggcattttctgcctgaatctgtctttgatttcttagtctctttagagactcttctactaatttgcttttgaaagacagtgctgtcttccactactccttcccagttcgtttctcagttgtctttcttttcttcaagttcttccctgattagcaatttacattctttcttctgttggcaaagtttgagacctcagactgctttgcttttatagctgacccttggacaaggtgggggttgaggcgccaacccctgcacagtcaaaaatcctactataacttttgactttccaaaacttaagtactaacagcctactgttgactggaagccttcctgataatttaaccagtaaaataaacacattttcgaacagcctactgttgactggaagccttcctgataatttaaccagtaaattaacacatttttgaatgttatatatttctatactgtattcatacaataaagtaagctattgaaagaaaatgttattgagaaaatcacaaggaagagaaaattcatttacagtattatactgaatttataacatacatatatatcattgtttgtttacaagataaattatctgtctgaaatggcaggcaacatagatagatggataggtgttttttttttcttttaattttcttttatgttttgtttttctaattttctatttgtatatatgtttattaaaggaggcaatgcttactaaatgcctggtccagcgaccagatcatagttaggattcaataaacaggtattttctaattaatctattaacagaacgtatgtgttggactctaaaaattactccttcccttattttaaagttctgtactaatactcagacttattcatgtcaaatcctttaagttgctccagccattattgaaggattctagacttccctctttgtctggcacctcacagtagctttctaactgacctttctgctttcaccttgtccccttccactgtctaatcttaacacagaagccaaagggatcctttcaccagaaatcagattctatccttcctcagcttaaaactatcaagagccacacgtcctttatgccagcccatagagcactgcaagatctggcctctagttacttctctgacctcctgtcttactagtttcctcaaaaactccatgctcaccactgagtccttaccccttaggcaaaaactgtagctattcttctgcaagaaatcttccagtatccacagggattacgccctcttctcatcccagttcttgctcaatccccaccttctcagtgagacatcacttgaccttgatattgaagactacagcctgtggatccacagtcacaccaaaagccaacttcatcctcctcttccttctccacactttctaacctgcacatctctattgccttccaaatattgtttacatttcattttctgtgtctctcagctacagcataagatctgtgacctgtgaatgcagcaatagggtctcctgtgttattgaggtagtccaagtctctgcaataatgcctgaaatttagtagatacacaatagagttctattttttaaattggaatttgacatttattcttacaaattttttttctgttaagttctagcaatgattcaagtctgtgaagggcgtttaattttttgatcttctcacccaacataaaataattgtagctattttggttaacttggatatttataaagaatgcttcaacaaaatttgctgctaagattctgttttatacagttaaggccaattaaagagctgtggaacatgccccattaatcaagatgtcactgattttataagcatttttgcaaatattccattaaaatgatgacacattaaaaactggtgcaatctacacttctttaaattgtccttaaattacttcgaaaaaatctgttaaccgcatgtttgaactcaacatacatcttgtctaaatattaacttcattttactagtttcatgatagcatatttttgtaaatgagttcagtttgagaaaagtgatacatagtgacttctaaaaattattttctaagaactcacaaattgtggattttttaaaaaaggaaaacttttggtgtatagtaaacagaacccatttttccatgtactttaaccattgggggatcttttgtgtcaaatgttattctgggcttccttacgttctcctcctgttctcaattttttctttccccccccgcccccttttttttcttttctgatcagtgaaggttttagagtcatatttgcatgttcttttagaacaatggtccttaaagtttaaactacttttagcaactaggtatgttagtttcctgcaatatggtctaaaagagtagcaaacactgtatattaagagtaaaactgcctggttttgcatgtttgtgtccctgcttaatggtcctgagatgtggaaagcattgtttccagtctcttaggtgcaacttcatctatataaagatagcaagtggtattcattccgtgtatcgctcatgggtcaaccagagctaatggatgcagatgcacagtaatacatatcatattaaggcaagaacctattgtgaactcttcaaaggtagagcattgcattatttattgtcacacttcctcagtaactcgaagagtgttttgaaagttgatactctaaaaatatgtgctgagctagattgcataacataatgtggtcaaaaattccatttttattatttagctccttgatgcagcacaacaaatttgaattatacctctacgacagataagtagtaataaatccttattgggcaaataccaataaatccctgggtagctgaagcagagacgtgagatgtgggagatgagtaaggtaacctctgtcttcaggaactcatcattctttctgagcattattgcttagaaaactgggcaatattataattctccaaaaaatatgtctcttaatgttttagtatctcaggtgatctttcaggcaaagtgaattttatgcactgatcaacacttatgtacatcgtgtgccacaaatatactctgtcaaattatgtcaacatcagccttcatctctgactttaaataggataactttgaaaaatgaagaacttccaacatgacaacaatttgactgtcacaagttagtacacttcaagataatgtgaacacacatttatcttaaaaaatggattagcattttactgactgaatttaattgcactccatcatcagacttaattattttatatataagaaattatgcttcaaaacttatcatacatagaacctttggaaaaatccagggaacataaaacacgccacaacaatttctctgcaaatgaataaacataattcatcatgacatcatgacatgtgctaaggtcacattgtaatattttaagatccatggacatattaatgcagaaatcacatttgttcactggtacattcatagtggcactatgtccttcaacaaaaatgaaccgcaataattctagtagataatggataaacaaatgctatgagaggtgtattttgtagctactttattaaaattccattttgaaaaaatggaaagagatctcaaaagcatgaaataagttgtgatattttgatataataataaatacatatttagtcatcattcctggtttctgacacactttccttctaaaactcttggaatttcacctctgaatgacagaggtgataagcgtgtcttttataatttataagaaacctctttcatgcacatcccagtttatgctaatgagatgtctggtgggtaaaaacccagagatagctttagattgaggactggttgccagaggaaccaaacatatgaccagaagattagaacgttcagccccacccagactggaaatggttgagtgactggagattgagtaaatcactaatggctagtgatttaatcaactctgactatgtaacagaaaccccatagaaaaccctaactgaaagggttcagagagattccaggttggtgaatgcattaacgtgccagaagggagctgcacccccactacacagactcacaagcgtctgtgcacagaacccagccaggcctgccctgtgtccctcttcatctggctgttcatttgtatcatctatgatattataatccttattatatgtataatacataggtcaacatcaattaaatatttctttgagctctgtgaatggttatagcaaattattgagcttgaggaataggttgtaggaactcccaatttgcagccaagttggacagctgaatacccactacttgtgacaggtatctgaagtttagagcagttttgtggactaagcccataacctgtgggatctgtgctaacgtcgggtagctactatcagaatcaaattaaattgtggaacatccagttgatgtttgcaaaggattggagaattgcttgatgtggaaaacctacacatttgatatcagaaatattgtaacttgaaataaattataagggtagtagatatggaatttgtctttctagtagaggaccacttatactatttaatattttacagatatcaacttatttgatggaagaaataacagtcatttctactttgaatatgtgatgaaatttcaattcactgtgagcaaacaaataatggtgataatataataataaagagaaagggattattatatagtgtggacatacagttggctttctgctttagggtttttcatatacaaataaaaaaagttgaaagaagaggcagtcctgcaaaagactaaccatattaaagtgtcatatctatgttaattatcttctcttttgtactatatctagatagtagtcatttctatactataaaggaagaccaaggcctaataaattgcaaaatctatattaatagatcactttatggctcaatttttatctttcagaaacatgttaaagtaatagcagacacaacattaggaagcactgtttttgaatcccataatattttcagtactataacattattttgttaaaacctggttaaaatcttgctatctttgaaatttcgaagttataattcatatcttagagaaaatcctattttgactttattatataatttagacattagaaattaataagtaaaccaatcacttaatttcagccattctaaataatcaataacagaaacagatgttaattcattggaaataacatagcaacaagtaggacttgaaaactggatatgaacagacaacagttttggcccaagctatgcagtaaggtcattgctgtcactaccatcaattcctttagaatcaccaattatccgatttgcattcctacaaaaggatgtttattaaatgacacagattagacacgacatttaaccttactttttttttttttttttttttcagacggtgtcttgccctgtcgcctagtctggagtacaatggcacgatctcggctcactgcaacctctgcctcctggtttcaaacgattctcctgcctcatcctcctgagtagctgggattacagatgcccgccatcatgcccagctaatttttgtatttttagtagagacggggtttcaccatgttggccagtctggtctcgagctcctgactccatgatccacccgcctcggtctcccaaagtgctgggattacaggcgtaagccaccgtgcccggccccatttaaccttacttttctcatctctgaaatttaggggtagaggacaaactaagcattatatatatgtatacccacaagagcacacacacacacacacacacacacacatcaccacagggggatagagtacatgataaaaatatcatttccaagcaatgagggaaagatgagtcatttaaaaaatagtattgtgatacttggttagtcatgtacaaaaaaataaaattagattactacctcaaccatgatatgaaaataaattctggaaagaccaaaaagctagacacaaaaaaatgcacttgaggaaacaatagaacaaactttttgtcccttaaagtcagaaaaaaattgtaattatgaactggatgtgacaaattaaagattgataaatctgattatatacatttcaaaaaattccgttaaaaacaacaaaacaggccgggcatagtggctcacacctgtaatcccagcactttgggaggccaaggcgggcggatcacgaggtcaggagattgcgactatcctggctaacacagtgaaaccctgtctctactaaaaatacaaataattagccaggagtggtggcgggcacctgtagtcccagctactcgggaggctgagacaggagaatggtgtgaacccgggaggcagagcttgcagtgagccgagatcgctccactgcactctagcctgggcaacatagcgagactccgtctcaaaaaaaaaaaaaaagccaaaattaaagacataatggagaaatatctgtaattcgtatcaaagtcaattgttaattatattaaaaactataaatcctgtaaaaacgaggaaaacttcaaatctcaatataaaaatgagacaagtatatgagattttaccaataaagaaacaaagtcttaaaaagggatatgcaacatcagtcataagtagaaaagttcaaaattagcatatttttcacttgataaattagtaaagataatttttaaaattatgttgataatcaagtatgaagagagaaattctcataattctccagttttaatttctaatacaataaatatcactagatacaacccatataaccaaaggctaactcgatgatttttttttttaagtataaaggattctaaatcgaaaacctttgaaaacctctggcctagagggtaggtctgtcacacgtctctttggttttactaatggagaaagttaataccaacatcagatcatttctgagaatgtgaaggtggaggggttggaagatggaaagcattgctgaattaacagtttcatgaatgaatgatttttctcagtcagttgtcaaaatgaatctcagtttgtaaggagactgaattttttcatttgagcaattaatccaatccctctaatataaaataaactgctagtgataataatttaatagaagggtttaaactaaaccatttcttgtgttatgcatgtttctgctttagctaggtgaactgaagcaatattaatattttaatccatcaggttgtgaaatggttaaattagcttgaaattactacaaaatggtgcttttgaaaacatgatcaaaatgttcacaaatgttaaatataggagcatgaaacttatttcacccaaagaattttgtggatattacaagagatcaagcctgtcatataagcatcaaatgctatcatgcagcttaatattatatctttgatcctgtcagatttatatttttgacatgaaaatcaacccaaacctcctttctctatctgctgttaacaagatctttgttggcttgtgacagaaaaagtgtaaaatcactgagctgctatgtacttgggtgaatttacttttaatcttttttctataccgggaaattgttctttcatccctggacattcgtttaaactctctgtgtttaattttactaacctttgagacatttatttttccattattctactggagaacacatgaataattattgaagaataaaagaattgaacaagaaaaatcatacatcttcttcttggtagcatactcaagacgctcctgcatttcaagctatttttggaggaagggaaggaaattgacttacctgaaaacaaattatatattcgtttaatatctcctctcaaatatcctttttaaaaatttagattcaatggcatttttaatttgaagtatgtgaccatcctctaatgataaagtgacgtctctgtaccatctatttctatccggtcagacctatgatttcttcgagcaatagggtacattataagtgacactgtgtctttgagtcctgagacataatgtaaaccctactgctgtcatattgtaaggatgcccaagacacatgaggctctttaactgacaggcacatctaagcccagttttcaaactatctcagccccaagcctagatatgtgaatgatgaagcctccagatgatttcagcagccaaccaattagacaaccctgagacttttacattttttccttataaggctccagaaaacatgaaacagagacaagttatcctctctgagccctgtctgatttcttgatccacagaaacttttaagcataaaaataaaagttgttgcttgataccggtaagtatggagtggtttgttacacatcaatagacatctagaagagatcatttccactaactatctttgtcatttacctacagatttaatttgcttttccattcttagtgcacctccaatttcacatgtgtagcagaaaaaatgcaaagaatatgattctagactctggcatctaattaaaatataagaatacatccttatggagtagtcatggagaagctgaacaggctctcctccttatatttcttataatcatatctctaactcagaacaaacaactgagctaaataatatgtaaacagacagtgtggttatttgtaaagccctaaatattgtgctcaaagccttttaaaaatctgcagccaaacttaaaggatttcgtattatatcaaaatatactcttctcaaaaagatagcttgtggaagattcacatttaggctgcagaaattctgacaactgcctaaagctgttgttcacctcttgtggaaaagtggctgcagatcaagtgccaccccatcccccggtgagatgtggcaatcagaggagctgtactgtgtactgaaaaggcaagaagagtgtgtgtttcagtgaaactatgagaccggtactttcttggaagcattgtcatagctggcttacattttattgcatggaatataacccatacaatgagtaaagctataaatatcatagttttcaactatgaatttatcataaacacattattaaacaaaaactatactcagttgaaaagggcaacaatcaggggagaggtaagctttgagagtcatgctcctttggcacagaaatcctgtctctaaatcaacaatgcagcatgcagtctgtcctctcctctcctcctcagtgccactctctatttttttaagatatctttttgcattactttttatttttctttagctttttaaaaataggactttggccagttgtggtggctcacgcctataatcccagcactttgggaggctgaggagggcagatcacctgaggtcaggagatcaagatcagcctggtcaacgtggcaaaaccccatctctggagtttagctcggagtggtggcaggcgcctataatcccagctactccagaggatgaggtgggaggatcacttgagcctgggagacggtgattgcagtgagcccagatcgcagcactgcactccagcctgggcgaaagagcaagactctgtctcaaaactaacaaacaaacaaacaaacaaaacaataggactttaaattttgactaataggacattaggaatcatttcatacaaggtaaaacaccagtgaattctatgaagtagacaggtcatgtgaatggtggcacctggctgagtataagaacacagagcagagagtgaccaaggagaagtgtggagcccaggaagcatccacagcgtgcaaatagatcaactctttaggtggaattaagcttcaacatcctgtgccctcttctctatttgacaaagtggcatttaaaatacaattgacccttgaacaaggcagggattggggtaccgatgctaagccatcaaatttccacatataactttgcaacccccagaaacttagcaactgacagtctactgtgaaccagtagcataaacagtcagagaagacctattttgtatgttatatggaatatatactgtattcttgcaataaagctagctaagaaaaatgttaagaaaatcataaggaagacacaggtacagtactttcctgcatttatcgataaggtaagtttacatcacccatttacaagatgagtcttcctgaagaggagggcacccacagcagcagacctcaagctacagtatgtataaagcaattcatataagattttattgtaatgtgagtgctttgtttccggaagtacttccaggatcattagtggcactccctgtgggtcttctggtgttattcaaggtttatggtattgcagtaaaaatgatgaaaaatatgcaagaacgcaagacatcactttttactgtgatccgcaatttattggggagacgaactcatcacatggggatgattagcatcgcactgcatttttctttttttttcctttttgagacagagtcttgctgtcaccctggctggagtgcagtggcatgatctcggctcactgcaacctctgcctcctgggttcaagcgattctctgcctcagcctcccaagtagctgggatcacaggtgcctgccaccacgcatggttaatttttgtatgtttagtagagacaaaggttcaccatcttggccaagctggtcttgaactcctgaccttttgatccacccacctcagcctcccattacactgtattttaagtggatactcacgacaattgagctcactgaaataagccacaggaagtggctctgaaattactacagtagtatggtatgtactatcatttcttttatgcagttctgatttaattctgtatctttacatttgttgattcaactgggaatggcaccaggtatggtctatgtgtgcataagttttgataaattttaagttttataatagattcgtgtttattttatagtagcgaataataaaatggaatagtatcaacttttttttattcatgacatatcaactttaaaaatatttttacggtacttctaagctacgtggttcacctgcaattttttttcaaattgttgcaaatctctaaaaatttgttccatgtatttattgaaaaaaattgcatataagttgaccataccgttcaagcctatgttgttaaagggtcaactgtgtattcactaaagtctgaaggagctttagaggcttaataaatcagtgattttaatttcactggtaatatgcttgaaatacttttaaaactataaaacaaataaaatgtcaaatatgttttataacaacttttaacacatcagcaaccatcaattcattgtattatccagttaaccaacttttgtacagacctcagggcaaaggtgtttctatctgaatttgctaagtgagttcttaaaacagggactacatgtacttacttatctttggtaatcaaaatattctcaattttgtaaaaagaaagtgaaacaaaacaaaaggagactgaagttaatataaggctaacattttgatttgtaaattccagtatttaatttccatatcaagcaaaacagcttcatctttctaactaaataatgtaatatatattataggtaataaaattgactctcaagtatgatttcattgttttgatttattttccattagatagtttacaaatgatttggtaaggcatgaaattttcttctgctacccaaatacaaatcagtgtatcaatttccaattttgtttttttctgaaaaggtatgccaagatatttcacaatttcatgcctagaaataaaacgtatctatatatagatataaatatgtatatagatacaaatatataacttgtattttcaggatagaaaaggtttgcataagggtatacctcaatgaaggagtcaaatagttaaaccatagtctaattaaattaaacattctgtcatttataaagaaaaaataagcgttaaagaattgctacagaattgttttagtcagttgccatactgttggccttgacagtgtcgagaatttttacattaagtacttcttgttttatgacttcttttgattatatttgtaatagtaattctagataacgtttattgggtacttacaatatagtcaataactttgaagggtttgagattttatcctgcttgtatgctatgctaacctgctcataaagtgttagaaatggtggcacaagacaggagatgacattcagagagtaaggacatcattactcaggacacagcaggcggcatgagcttcttacatgtttgggtgagaatatattaactcatttcattctcacaatactctatgaggtagttttgactcttgccctcacttaaaagatgaggttacgcaacctgccaaattcaaaaagcttcaaagcatcagaaattgatctcaaaagtctccaactccagatactgaattcttaatgaccacactgtactgactttttaaatgtatatagacagtaccttaataatagtaacatatttcctttaataaagatgtatgattctgaaataaagtatgaaagcacatatatataaattattatgatgtatattattttagcaaaatgatatttttatgaatgttactgcaggtcagctattttctaatgcagacatgtaattttttggagattatgtataaaaatatttcatttcttaaagaaaaaagttatcaatctaatatgtgtcagaaaaaacctgagaaatgtggtcttagtttattcccagaataccaaacaaccaatatgatgttatatttattcatttagggagcttgcaagtaaattgtactctctgttctgacagacccttgagatggcataagccttttccaaattttgcttcattgtgattctgagtctttaaatagagaatttggctgctaagcctacaagagattccatgtctattaaatccatcctatcttgttgtgtttatttgaggtaatctattagtttacacaacttgctctttggtcatgcagagctctgaaaaacacagcctgccagggctccgtcctgattcattgtcatggagaagctcaaacaagaaccagacactgtgaggacaaaagatccctcaaattacctgcagagagtcgccctggctttcaatggctgcagtccaaagacacttagaccaaattaaattgtgccaaaacatttaaaagcaatattattaaaacagaattcttctcaatatgctgctcagccacatgttatttgtattttcggtactaaaaactactgacataaatgaattaatgtttgcaaacacttaaaagaaggcccggcacacagaaagcattatacaaaaactatgagactttgctaaacaaaataaaagatgggaattctacgcatggtcaagatgacttacttttgtatctgatttagaagtcaccaaatatgtataaatttcacttggaagaaataaatgatcatcctgaaagttctatcagtacatggaacgtagcatgtatatccatacatgctacacaatacaggaatgtaacatacatatccatacaggatacacaatactcctgtgtgagcttgagaatgtgttaaaagaaagaaatgaacaatgggctaagagtagcaaaagagatcagaacactgggaggattggcaggaatgaacctgggaagaaaacagcccagagtgtgtactgccgcaaatcatcagctgaacttaaaccttggcactcaggatctctgaataaatgcattggctgcacagtggggctcaggcactgctaagctcttcacatatgttatcttatttagtccctacaacagtcttatagatgatgactagcaatatcccattttacagatgaagaaatttagtcagaggcattcctggagactgggttgaaagagacctaaatcatttttattttattgtttttcagattttggccacacatacacatcgttttcatccttaattacatcatgggagtgaagcttccataatattccttgagagtttataaatactgtaaacaaaattttctaacttttcataattaatgaaagtttctaggactgcaaagtacacatgtgttcatgttttatatgatcaatggaaaagaaaactggccctgactcatcttcgtgactagcaatctcatggttatgagtcatcacttcttcctctcctcagtattagacaacacaaaagacaggccttttaatcaaatgacttaatcacttaggtttagtttggcatcagacataggtattgatggcacctaaatgctccatgctccataagaacagaagagcattactatatgcagaggacacagcaagcattaggaaacagactgactcctcaagactgaatcaaacattttctgtgcaaaattagtgcaagaaatcacaaggaggaaatacgaaatgttgagacgaagaataaatatttagatggtatcagcccagagtagacaggaggcattacggacaccttcagagtattttcatacccttgcaattggctttgtcaaacaatttttaattttgatgtacatgtgttatgcctccctaataatatacagaaatccagaatttgggactagtctgcatggtatttaggatgtgacttgcaaggactttaaacacaaaaaaaggcctcaatacatcaatgccttaaatgttggtgtgtgaatgtaaccatcttaagttgatttttgtaggctaggctttacctcttatttgcattcattatagtaaaaggaatcagcccaacttatttatatatgttgaactttcattttatattcataaatggtcatcattggatgactgtatttccaataatttactgaaaattaaaacacaatggctttctgcagcaggaaaaacgttggtttaggctcctgtagaggttgaagtagaaactaagaaaaaataggttcagatgtataatgacagtgacagggtaaaagataagaatggcagctaacacccattgataaaaggtttagcataagttaggcaaatattcaaagctctttgaaacactagttcatttaatctttaaagaaccttaagggtcacagcttataattatcattctcagcatatggatgaagaaaacggaacaaagggaggataagtgacatactaaaggtcacatacacacatccctaattagtaaccctgggattccaactcagggaatctactgccaaagtatgcattcttaattactatcaaatattgcctctggactgtgttaaaaagctaaatggagagcgagcaaggagaaacatatgtgtacacactgaagaagcagagttagaacatagggctaaagaaaaaggtgaaaagagaagaaaaatgacttggagatggaaataaccattattaaaatgaaaattaaaaacaaatctctctcatattatggaagtgtgaaaaacaacagagaaggctctcctatattttccacagtagcattttgtgttctacaatcatatcaatcaaggaggaaatattgatcatgtggttaccatgggagaggctccgcaaagctccgggggacacttgtacgtgagaagataaataaaagggtaaggtagcaagtgtagagttcagagcagctcaatagcaagaggcctagtgtgctgtcaaggaaacagctggctgaaaacgaatcataaactctatctctaagcttatgaaactgcccttgcttgtagtgcataagatccgtaatatatttaaagatgatcatgtcttcatttacaaaggaagacaaattaaaaaatcaagaaacagtcaaactaaataaaccaaagtcttaagatgtttctgcagcttaataacagaaactcagttcgaaacacagaattaagaattataagtccttataaacttaagaatggaagtgtgatcaagactctcagttgctacatcttggcagatatgatttagatatatgttacatgggttggttcacgatgtactcaaatattgaaatacttaagtagacaaatagtattagtcaaacaatgccagtgagctcacatgaggtatagcatttaaaaaaattacatcactaattttgtcacatttaagaattatttaagaatatcataacccttcatattatctacttgattaataaaattattccttttagttcaaatacaagattcttcaatggcaattttatgtctcctcaatctaatctgagttgtgatttcatctgtcaaaatagtgtcaacttagttaacatgctaacacatatctacagctaatttttttctgtcttacagttcctaaatgaaataaaagtcatttctgactccaacaatgaaattttattttcctttgaagtgaacatgcattaaaacatttggaataaatattttccctgtaatgtggttaaaattgagccctaaatatttagggccattgctgttactacctaataaaaatttttctgctataaatacaagtactgattcctttaacttctcagagacacagcatttcaaagtagaaagtctaaaaactgttggtggtgtctggttagagatcagatacaaaagctatattattaatatttgtttattgggcaaatgcatgagaagtgaaaaaaaacttttcatatatagaaatgggaaaatgcaacaactaatattttcctttgtttaacacagaatgaaatataagacttgctccaaatttctttctctttccccaagtcctttatatatctctctgctttatattaactcctatatccatctctccctgtgcttaggtacctgtttaactggctttttgagtgttcatctctctatatacacatctaaatttccctgccgtttaagtttcattttccccttttcctcccattgttccctctatcctatgccacctctctttatctttaagcaaagatcactccaactcctcactctgttctcttcactcaatctttcactccactaaagtacattttttataagaagttaaatttattgaaagaacatgtatgaactaaaagaaaaagttgaatacaccactttccaaaccaatgagaatgaactgtagattccatatgtggcatatgggatatcttatagttctctgagaactataagacacgttggcacttggaggatgagaaaacaataaacacacaagcccacactactggaatgcacaaagcttttcacagaaatgtatcaacatgggaaaggatgttttatactcatgtgcagaatattttgcagagaatctaaacttattaaagtacgcgtgttatttagctcctttttaaaaaacaatctcactcagatattctctacaacaatcccatcaaaaatctatgtagatgcccctcctaacatgctgggtttctcaatgtctttacttcctcttcatcaaagatagctgtctatcccctatctcattccctctctgcaacagtacaatggtcatccactaggccttgtcttaacaataattacaatccgcccctctccccacaatacacacaccttgaatttacaagcatcaccttttccccaccttctccaatctttgcagttcattcactttgttatactaatttttaacaaatctttatctgtccctgacccaatagtccaatgatcctactaccttttcatagtacttaatatccatcctgtctgcctttttttcttcatcccatgcctaattattaaaaatattcccttgcatacatgctcaaaccacttgtctaattagctctttacatacctagatataccattagactaaattgtgacactgataaagtgcaactctgtctactccatgtatctgtacatacaactgaaaatgactgaaaaagaatccacatagtaatttttacttgtttcttattaaatatatggcccttaacataggcttctaatactgtattacatacagtaataggtaataataatacctaataccttataggtatatatacctaatcataactgtaatgcaggtctttattcaatatccttctctactggctggtacttttgtcctttgaactatcttaaaccttcaccaattctcccctttaatccttattctaggttgatgatcatatttcccatttaaccaggataagaagagacaaccataagtgaaatttttataagcttgctctaccacatttgcccacctacttacacctcctctagtattatctgcctttttcctcttttaaaaatttaccagtagacatatctgtgctcttgtgcaatttcatgtaatctatttgtgcattaagttccatttcacttatattctcaagaaaagcatcccatcaattgcacccctttcctcatccatcattatttttctccttttctttacatatttttaccagtatatgaatgtattcagtattgacctaaattctttctccagctattgtcccaatttttgccttgaaagcaaaacttttggagttacctatatttagtatctcaatttttctcttttgcaccaattttaatcagtattttgccatcataactccacctaatgtactcttggcaagatcagcaacctccattgttcaatccaatagttaatttttgctttcatccattatgaccaaataggaggattcaaatttctccttactgttttcttcctagttattgaaatattctgaattttcttcttactttctggcacattttagcgtccatttctgatgcctcccttgatccttaaaatggtgaaaaggaccattttctagggttctttccttttttgtcatttaggaaagagataaaatgtactcttgtggcttcaaataacaaacatatagtattgacttgccaattttatctctagtttggatctatcccttgaactagactaaaatgttcaaattgcaacaattcatagctacttggatgtctaagagcatcttaaattttaatattcttcattccagttccggtagttccaaaagatataaattccatgagagccaggattattttccccacttgtaaatcctagtacttaggacaacaggtggtaaaaatgtgttatcaaagaatacaataaataagagtagaaaggaaagaaggaaacaaaagacagaaagagaaagagagagagagagaaaaggaagaaaggaaataaaagaataaatgaattattttatgaacattagatgtgagaaggacttaatgtgctggatgatttctgtatccttcatggacgtccagtgacataagtctgaattcatatataactgtcaattgcatttcagatttctgggtctaagcatccctcttttagggataatgacaacccagtgggctctcattctacctttcctaaatgtttctgttatatttatgcacaagccttccctttctaacaggtatggggaggtcattcacacacagacagatggttccctaaagaattcttgctaacaatgaagcctaaagcaggccagaggaaatgtttaaacatgttttttaaaggcccacttttacttccatttcataaaactaaaaaagagcttttacatgcactgagaatatgcactaggggctctttgattaaatttggctttgatgtaaagatacaggggtcttagttaactccctcagcaatgctatgtggtcacactgaggattgcctttgtttatagttatcatctttttgcaaatgtttagacaatggatttcattttattaataaccttgcacagaataatagagtcaaaaaactctagatctatcaaagtggctagttatggtctttcatattttattttatcctaagtcctgattgctttgttaaaataaacccagataaaaagaggagaggaaaacaattggatccatacatcatgtttatttagcatatgtccttatgtataaggaggttttgaaaagtttgttttcttggcctatgattatgtctcagtcttcaaataccacttttagtttggaagctgagaaagaggaagtaagttgttatttcaggggatgttctttcattgttagctgactctttgtccggcacctccagaagaaaataccctcaaaaactttaaggacccttacagttcattagaaatatacctgttcatgaccagcttcttacatcttaaggcaactttacatttacttgtcccaacttggaaagatgagaattaacaggttttgatttgactacttttagtatgtttccctatattttctatagacattcttaagtaagctaggcgatttcagttacagttctgtgccctatattgaggtttcggtcaccaacagaccacttatatgacagtggtcctataagattttgctattaatacagtattttaatgtacacactttttctatgttttgatacttctggatacaccaataccattgtatagcaatttcccatagaaattagtacaggaacatgctgtacatgtctgtagcctaggaggaatacgcaatacgttatagcctaggtgtgtagtagactataccatctgggtttgtttaagcacattctgtgatgttaacacaaggacaaaaaaacacctaacaacgcatttctcagaatgtatcttctttgttaagtgattcattatcccctttgtatttaaaaactttttttttttttttactgtggaaaataaagaatcttaatgtattggttgttcataagcactgagctagcttttacatacagtcaggaactctctctctctctctctctctctctctctctcactctctctctgtcccaatgtcttctcaatgctcatttccaaacttgtgatttttttttttgttcctgatgtgtttcgcttaattgtttagtcacacctgttagtactgttgttccagactgtatgattgaaatagctgttattttcccagtttctgtagatcacatataggaagttctgcataatcatagtgatgaaaactcatgtttaaaaaatccatatataattagcgtgatacaacacagcatcttaacactgaggctttaagttttaataattctgttattctcagtaacactgaaagttgcctgtgctctttctgtcacacaattgattccaatgtattttaaaatgtgtttttctgagtcatttgttgccttgttactttttaaaatttccccttcggtataaaaagtgcaacagcctgtttttgttttagcttaatttttcaacaagaaatgttttgaaagttaaagagcactttcttttttaaaaaaataattaattataaatgatgtttgtttctctggctaaaaattaggacaaaatgttgaggaaagccatgggaatgttcaaacagaaagtcctttaacctgaactactctgaattttatgtttttaaacactgtataccatgaatttaaaatttttaaagcaatacaacaatgattaaaaataatgtgctgtatactttcacaaaaagagctgtcaaataggtactctaaggttttcattataattaatagatactacaaatatgccacaattttgcttcttagatgtcatgtttttctttaaagaaaaaaaataaaaactagaagctctagtataacataaattttacattttgggtaaaatgttgagattctgaatatatttcttgaagttttaaacaaaatagccctaaacttatctttagaacactctcctcttaaaatatatgtccaattcatttacttattttatgtgaatagaaatttcatgtttcaagatttaaaaataaaatatagaaactgacaaataagttaaaaaataggttagaaatgaatatagatgtaataatattatacatatagatacagatactgcaattattgtgattttcagtttcaaaaaatacttcttagagtaataataccactgtaattataaacatggccatatatactcttttcaagtatttatgtacactcatatgttactataaattaaaagttagagcaattttttgaaaaccaatgttataaatcagatgaccaattttattagtttaaaacattatagacatttggaaaattattatatccttcatgtttacactgttgagggacagaaatttaagaaactgaggtgggaagggtcttttgtaactatataattatggttacagaaaagggccagttctggacacctatcactcattcatttgattaggcaattattctttcattctgtatactagtctctcttgagcacttgcaatgtaatatgaactggcattctcaacaagaaagtaacaaggaggtgttatggtggggtagtgaagatgtgatttacatatggccctgatgtgtgtgaggcacaatggctgaacaggattaaactgaataccaatattgaaaacagaaactctaagtaatatctgcagaaaataaacagacattacaatggaatttttcaattagttttgattgcaaatatgttttctatagcaaacgaatgcacacaaacatataaccacacatgcacacatatagactgacctgcatacacagaaacacacaatgtacaatttcaaagaaagtataaccgaacaatacctagcctcactatgggcagcacacatttcctattctattgcattatatatatgtacatattttttttcaaagagggcttgagagaaatgagacttcctcttagaaatactacatccttgaagaacaaaaaaatttcagcagttatatatatagagagagacatttttagaaattaaataagtatataataaagggctagactgcctttattggtggcttgtaacattgagaaaggaaattttttttattgaatttcacaaagacaagaatcacatttcaaattatgtcactaaccttgaaaaaatatatttgctatatatatatatagtgtatataaatagcaaataaaatatatttgctatatatatagcatatacatagcaaatatatatttatatatttaaatatatatatttaaacaatggatacatagactttttttgggagatggtgtttaaaaataactgaatttagagatttagagggtgtatactgtgaagcagtggagtcactgaaatgtaatgaccatgtttcatggaaacttgtgaaaccttccaagattgtggaaaaaggaaaagagaaattttagggatgagggactcaatgatgctgggttatggaaaacttactctattgtcatggttaacttctgctcatatcctttagacttcagacttcctgactgaaacaacaagtttatttattttaatttttttattattattatgacttccgatatcctagattgagcatttagcaatggcaactttcagcagttagacaccttctcataaaatgcactccataacccaataaggtacatacatttataatctcattttatagctagaataattaagtaaatattaccaaaataaatcacatatgtcatcagaaatttcatgaatatgacttgttattcttcttattcatattttctagttaccatattcaatgtcatggctaactttgactttctacttcatgctttgttcctgaaataactatcaggacataaagtatatatcttggtatttttagatgatgttgaccaaaaaatgtagaaaaaataaacatgcttgcctattatatgccttttaaagttataaaggtactctgtatacagacatgttctcatttaaaaaaatcactagtagttcaatagttataaatttaatttttaatgtacttaaatacatttggagcatttctttgtttaattctaatttaaactttaaaataagtttatagacaaagaaatgttccaaatgtatttaatataaattcaatttttaatgtacttaaatacatttggaccatttttttgtttaatcttaatttaaacttctaagaagttcataaacaaagagatgctccaaatgtatttaattacattaaaaactgaatttatataccaagaaaggtaattaatatttagaggatagaactaatactttcagatataatatgttatttaagtgtcctttcataaatgaaaaatcttttttgttaattttaccaatgaggatcaaaacactttgtcagtaaattttatttgaaatgaattattcaacaacagttaataattatactttttctttttcttttctactttaaatctagcagtagtctatagcaaatatattttttgaaggttaatggcataattttaaatgtgattcttgtctttgtgaaattcaataaaaaaaatttcctttctcaatgttacaagcaaccaaataaaggcagtctagccttttattatatacttatttaatttctaaaaatgtctatttttgaaattataatccaggtttatttagctttaaagctgatttcaccactgcatcactgattaaaaagtgtctaattttttattgtacttaagtagattgaaagtgctgacaatttttgatacaattttctgtcttaattatatttgcaactccgtgttcactaatcatgaattaaagcatactgctggaaaatattttgtcttttatagagtaattagactcaagatattttctttccattcttgaaacagaatgaaatttatataatgtaaagcaaagctttcatcttgtggtatggaatgatgtatactggtgatcatttcgatttgttaaattgagaactcaataatagttcataataccataaaattttcatcagtttttggactggaaagactcatcaatttaaaggagactttacttaatttaaatgctttatatatttgtgaggtaatagataagaatccataggcttccaaaatttgggaattctttcttcttttatgtgacttactctagttgtacaagcaaaaatgcatagttcctattttaacaagtttttagtgattgtgcaagaaaagctgaatgttttcaatatttgcatctacatgcatcaacctgtcacttttttcttacttatgtatatagagaccagtacttttcttttaactttatttttatacctcaaaaaagaaagcctcataacagaggcttagcatatttaactttttgaagataaaatccactattcatctgattactgagaatattaaagataaagtaaatatttatagtatttatagtaataataatatatattttccaccaagtcaataggttctaaatattgtaaaaatatagcttacatgtgaccctatctcctctacaatcttcctaatttaaagcagaagcttctctgtcctaactcattgcactcttctcttaactgatcttcaattttcagatattgcctccagctcattctccacacatcagccagactgctatttcaaaaatgtgtatcgaagagacctacacttaggaaaaaaatccaaatttactatttggcttatgtagctctgtataaatcatttcctgcataaatcatcatttgtgtcttattcacacaattttttttcagtacctaccactgaccaagaagacctttgttgaaattttcacttactggcctttgtggatctagagattatttttttcctagttccttctcagttttcatggttcctgtcaatgtcatctcctcagagaagggtcctctaatcaccccgattaagatagagcccttcctctagtgtcttttctccaagtactagtttattttcttcatagcacttaccaccaacaacaatagcaacaaaaagtctccaattattctgtattgtttgcatattttttccccaagtagaattcaagatacagaatggaactatattttccttgtttagttctatagttttaatgcctaataaaagttccagtctattatttaaaaaatagtatccccatcctaaagggggagggtgaaagaaaagttcagagagagtaaagtctttaaactaaatgtttgtgtttctccacgattctgtgttgaaacctaatccccaatatgatagtatttggaggtaggacctctgggaggtgattaggcatgagggtggagtcctcatcaataggattagtgctcttataaagagactccagaaagctgccttgccccttgcaccatgcgaggaaagagtgagaagtctataatccaggaaaagggtgttcactagacatggaatctgctgacatcatgaccttaaactcctcagcctctaaaactgtgagaaatgaatttctgtgttcgtaagccactcagttcctggtattctgtcataacagcacaaatggaataagataactaatttgttaaaatgcacatagcacatgtttggttgagacgggactgagtagaagtagtccaactttactgccagtgaggtgaacatgtactctgtactgtttgctaattatgttttaagaacttccttgggccaggtgccatggctcatgtccgtaatcccagaactttgggaggccaagatgggtagatcatttgagcctaggagtttgagaacaacctaggcaacatagcgagacccccatccctacaaaaaagaaaaaaaagagttaactgggcatagtggcacatacctgtagtctcagctacttggaaagctgaggcaggaggatcacttgaaaccaggagatgaaggctgcaatgtgccgtgattgtgtcactgcacaccatcctgggtgacagagcaaaaccctgcctctcaaaaaaaacaaaaaacaaaaaacaatcctcatctaccctgcctaactcctaaggtataaaaaatgtgattcattgacagacatatttgcctaagatcataaatgaagctagttgaaaaactgagactaaagtgaatgttccatcttctcaatcatgttcatttcattgcacactactgtctcccttcaagttgaccttctggagcattatatgagcctagacatggcagatatgtttaggtccaggtcacaaagaagacataatcaggaaagcagacttcaaaaaaataagacctaaagagcagataaataatggttcagggtcaagaagtatattaaaccagggatcaagattatgaagatctctgacaggggatgatgttccattcccaactagtattgaaatatcaggaggatacagacacccttttggaagaagaatttcagtgtggtcatattccctgcactaaggcacatatgattttccttcaatggattatcattctttcctggaatatgttaaattagcatcaaagtgcttaaagtttggcccttgccaataagtacaatctacttcagctgtgaattgctgacggctgaatgaagaatgctaccatttagaagtgtctctttgattctcaattcatatacaaataaaatatccttttgctttttatcaagggagcgatattcctataaaatattcaaatttaccacggaaaatatgtccattctacaaatccctggagggtaactttgatccttgacttctggttttcaatctgccatttttactcatgttttcctgaaacaagtaagcccacaggttgagtccttccaaatgaattccacaagctgatagatgtcacccttcttatctaattttgacctatctcctttaaggctttctggagacagattaaagaatgaggctttggtttgacatcagttcaaaagatagagcaaagtgtgagcagaaaatagaggtcaaggtggaagtatgaggcaaacctcaggagcatagcccctgtcaagaaatgccccgactctcagcagcagtcgaggaagcagctggtctggatttcttgtcactgttagggcttaattactggcacatagcaaacacaggccttggagatgggactgggtgacccatgtcgggggctaaggctgtcttctgatatactctctgccaggtgaccctcgtgcctcatgacagcatgatgcctctttgagcttagttctatctagctgcaagttacttgtaaagagacagttttagaaacagtgatcataatataataattcccaaagtgtgtttacatcatatcatcccatattcatcttcctgacaagactgtgaggtacccagagggaaaatgattgtaataatctttttgttgttgttgtttgggggggtaagaaaagtaagaatcagagaagttaaaggatttgacaagcatatacagttgctgtatggtgaagttagaattcaaatgtggtctcttgaatctaaatgccatttttattccactacaccatatctatctaagtaattcagttctcaaagtgaattgggaggaaacatgaagctaaatgtaatatttcaaggagatatagaaggaatccaaacatatgaatcccaagatagagctcagattgtaaataaccaatcttgtcaagatatgaaagccattgcaagctctaaactgagatgtgatttaaatgtcatatttgaataacagtcctctgatccatcatctgccataaattttaagatctcatttacagaaaataaaaacaaacaagttaaccttttttcataccaacatgtaaaaactgtataatatcctgagtcttttagagagaattgggaccaaaggattccagtcaatgaataattaaaaaaacactcgaatatcctgacacctgaccctttagagtattatagtgttctatttgtaattaaatcttaacatgaaaaagatagcaaaataaatatttaaaacctccccttaaagaaatatacccaatgctgtgctatttggggagatcttattatttgataatttataaaaaataaattctaaaagcaatgaaatataagcagtttttttctaatagctattttgtattaccaaaaatcagtagttacatgtattcattgtgacttcaaatataccaaataccaggaacataaataccaggttaactaattcaaccaataagatgaaacaaaatgttattcacttttaatttaaagagctaggtgaattgaagaggtcaggatgaatgtacctccttgacatcttctcctttttccttttccaatttaatatatttcttctaatctccagatgattgttcgtttcccactactcctctggtttagtaatggaatttccactaaaacatttgctatcaattttgttttgtttttacctgaagttttaactgtcttatataatttaatattattacattttaccagaaatagaaacagctaaagtctacctattccacttaatttaacattgaagggaacaaagaaactatatatttaattggtaaaacataaaactcagaaaaacctaagtctctaaagtgtgtatataatttattaaatgtactagattcaccattcctaaaactaagtttttgatttgagtggtgaatgtttactgtgactggctgagaagatagagatataaatcttcaactcccttcaatattgcacatgcctggagaaatgcattgtactttatgatagtagtttctgtttttgtagttctttctgtcctctgcctattgcactcaatatcattgttgaaaatgagctacctgtcttattaatatcagcatattaagctggtatgtttattgatatggatacatacatgctatgtccatttcttcaatatgtattacacatgcccagatgagatggtatagattcactttttttggtagctccctctaactttaactactcaagaaatgacacaatagacagccataaaaggattccaaaagctggaaagacaaatagtaccaggctggggacttcaagattcaagaaacgggattgcagtggcttgtctgggttttctgttcatttaccattacatttgaattgggcaccagggaggcctacaacctcaaatcatcagcaccaaaataaaaacagcctgcctctctggccaaatgacaaagaacggagtagcccaatagacactaagtgtggatcccccaatctctgctccacattcatggtggtggtaaggctgattatcctacagtggtaaagcctggtatcttcaagccctccatctagaggtgtatggatatccaggcccaatgtctgccagtcctctaccagtgaaagagaattagcaagcccagcagcttcttcctacatgctcccttccacctccaggaggtagctcaggaaacctataggcaacacaagcagggatcaagctggggatacagaagtgctaggaaaatgaagcagacaggcaaagagtgcaagggatctgaaaactacattgaaattctagcacacaaaagaaggctagaacctacacactaagccaaagaagggcaactgaatggtgaaatcaatgacttaaataagatcaaaagtctgctaatattgtatctagaagtccaggatttaatccaaaacctgtcatcatagcagggagggagacatccacaatctgatgagaaagacaatcaactaacatcaatactgagatgaatcagattttagtattatttgacaaatatcttaaaacaggcataatgaaaatgtttcatcaatccattataaattctcagaaacagaagaagagatagaaaatctcagaaaaataacagtttttggaaaacaaacaaatggaaattatagaactgaaaaacacagtaactactacaacaaaccatgctggatgtccttagaagtggtggaaatgatagtgcatagaatcagtgaaatttagaaccagtcaaaaaaatttggtcaacacagaaaaataaaagactaaaaaactaacagactcaaaaatcattttgattttttgggacaacacaaaaagatctaatattcatgtcattggagttagaaaaataaggagaaagaatatgaaactgaaaaattactcaaagaaataatttgctgcacgctccaccaaatatgtaatacatcaagaaagggaaagaagctcacacaggataaaaccaaaagatacccacaccaagacaaattagagtttaaaaagtaaaaggtaagaatgtggaaagaactcataaaagcaaagagaaaaatggtgtcttacctaaagagaataccagtttgaaagacagcagatatctaatctaaagccatcgaggcctgaaggaagtagcataatatatttcaggtgattaaataaaagaactgtcaacagtgaattcagtattcaatgaaacatccttccggaaggaaggggaaataaacacatcctcagagcaagtaaactaagataatttgctctcagtagatctaccattaaatcatagctaaaggaagcactctaaacaaaaataatatgttaatagaggaaaggaaagaaaaacaatgagatgtgtaaaaacagagatctatgcaatagactgtgttactccttatgagttttttagaccctatttccctgcttaatcaaaatgaacatcatctgatatggtgctaaatgaatccgaagaaaatacttgagaatattatactttaaaaatggggaggataaagaaagaaacttaaccaagttggaatatgtcacctgaatatccaacatgctcccaagcctagatggctttaagaaaattaccaaacacttaaagaaaagttaacacaaattgtatgcaatctctttcaggaaatagaaggggaaggaacatttcccaacatattttataaggccagtattgccttgataccaaaaccagaaaaggatagtacaaagcaagaaaataacatactgatctgtctcataaacttaagagtaaaaatccttaacaaagtattatgcaattaattcagcaacgtataaaatttacatcggtcaagtggggtttattcaagatatgcaggctggttaaatattcaaaaatcaaaccatgtaatccaccatatcaacagaataaagaaaaaaattatttacaatcatatcaatgatacagaaaaagcattcaataaaatcccaaaacatttattatataaacttgtagaaatttagaattagacgatacttcctatactacataaagcatatatacaaaaaccctacagacaacattgtatttaataaagtaagactaagttcctcttttatcctaaggtcaggaaaattgcaaggatgttttctcttacaagttttattcaacataatactggacattctagctagggaaataaggtaagaaaaaaaattaaaagcatacacactggaaatgacctagtataaggttcacaccttgtatgaaaattaacccacaaaaaaatcaaaggctcaaatgtaattataaaatcacacttttataggaaaaaagacattgaacaaaatcttcaggatatatataggcatgatccataatagaaaaaaagaataaacttgactcttttgaaaatacaggccgagagtggtggcttacacctataatctgaaaactttgggaggctgagttgggtggattgcctgagctcaggagttcgcaatcagcctgggcaatatggtgaaactccatctctactaaaatacaaaaaaaaaaaaaaaaaaaaaaaaaaaaaatagccaggtgtggcgcctgcgcctgcactcccagctacttgggaggctgaggcagaacaattgcttgaacctgggaggtggagattgcagtgagctgtgatggcgccactgcactctagcctgggtgacagagtgagagtccatctcaaaaaaaaaagaaaaaaagaaaatacaaactattgcttttcaacagactctgttagcaggctaaagagacagtgagaaaattacagacagtgagaaaatatttgcagaccacacatcaaacaaaagggttttatgtagaatatataataaactctcaaatctcacagtaaacaaataaacaaatacatccaattagaaaatgggcaaaagaaataaacagacctttcactgaaggcaatatacagtgagtacgtaagcattgaagatgttcaatatcattagctatcgaggaagtgtaaattaagtccataatgcagtatcacaaacaccatttagaatagctaatgtaaaaatatgttgatgaagacatagaaaaactggatcattcatgtgttactggtacaaatgtaaaacaagacatccactccttaaattaatctgtcaggatttttttaacttataaatagacttatcgcacaaagcagcaattttactcaggagtatttatccctgagagatgaaaatttttgttattgtagaaatctgtacacaaatgtttataataagtcaaaagttaaatcaaatgtccttcaacgggtgaatggttaaacaaactgaattatctatgtgatggaatactactcaacaataaaaagaaatgatatgttgatacacgcaacgacttggacaaacctcgtggaaactatataacattttaaaaataaaataatcatagagatgaaatacataggagcggttgccctctgtaagggtttctgtttagtgcagcacaagggaggcttgtgctagggcagttctgcatcttgattgtagttacgtatagctacatggatgacaaagttgcatagaactatatatacatgcacgctcacacacacacaaataagtgtacaaataactttagaaatctgaataagcttcgtagattgtacaagtatgaatttcatggcatactatatttatgcaagatgttattgtgggagaaagaatggagagtatatgggatctccctgtacttttgtccaactttctgtggatatctaattatttcaaaataaaagggtgaagaaaatatattaaatgtgcccagagtttgctcaagaactcaagcaagttaaggaaagctagtgtattaggaaaaatgtaattatactgaagtagccaagactgctttttttcacaatgcctaactctaaacaatagatcaacttaagcatacattttcaaacatgattgaaagcttcacctgctttgtaatcataagacagtaacgaataaaagtaagcacagctacacatgtggaatcaaatatttcattagccatagccatcacactatattttctcaggatgtttcttctctgggcgcagaaaaataacattaagtctattctcaatgtctcccaaaagactccgaaatgggttttgcttgatctggtacttagatctcagtggtgtattcagaataaagaaaacaagttttgagatatgtgtattttttcttttcaaggttttataacagaaacccatctaggtataagacagattagggttcactgtcacttccctgcctctggacataatatttcatgtagaggcagaaacaaataatatttctctcctattttaaaaagcttaacaatatataaagcagactgtgccctcacagctcagtcttgtccatttcaaaaccaaatataagttttggactggaacaatatgcccccaaatttctaaaaagaatgtaagcaagacaacttagtattatcaacttttgagaatgtcagtctggaaatagaatattcaaacaagtacatctttcttttcgtaattgaatttttcttttaatttttctggaaagtgcaaaaagattatgaaaaatttttgctaaacaataattcatttacttgtctgaatagataaaatacgatggcaatgtatttggccagttttggcctaccacctgcttcaaattataaaagaaaatgatgaatccctggtttataacattttaaattttgacctacaatttgatgcaggaatctcactacttggaatctacccagaggaaaagaagtcattatgtgaaaaagacacttgcatgcgtgtgtttaaagcagcacaattcacaattgcaaaaatacggaaccagcccaaatgcccattaatcaagtgaataaagaaaatatgatatatatatatatattaaatagacacatacatatctcacattggtatactactaaatatcacattgaataaatatgagatatatacatatatatgtatatatccaatgtgatatatacatatatatcacagtggaataattggaatactactggaatatcacattggaataaatgtgatacacacacaaacatacaccatgaaatactactaagatataaaagggaatgaaataatggcatttgcagcaacctggatggagttagaaacaattattttaagtgaaataactcaggaatgggaaaccaaacatcgttatgttcgcacttataagtgggagctaagccatgaggacacaaaggcataagaatgatataatggactttaggtattcaggggaaaaggtgggagtgggttgagggataaaaaattgtacatcaggtaggtgtacactgctcaggtgatgggtgcacaaaaatctcagaaatcaccactaaagaacttacctatgtaaccaaacaacagctgttctgcaaaacctattgaaatttcttaaattgaaataaagaaaatattttaaaaaggaagatatttctatctcatgatatgtgaaaaacattaactaaaattgagaaaatattttgaaccaaattttgtcttcttactgattatcttaactactatctggaattaaagttaccaaataaaagttgatatcgagaaataattgaaagtatttaattataaaattgagaacctaaccacaaatagctattgaaaataacaaatatttgacatgtaatgttatgttacattgcatataaatattaatggatagaaatgaaatattaattttaatatgaagcttaaaagtgtttttcaaaactttgtcagcacacagcatttattttaaaacccacacttctctgctaaaaccttatcaacaggaaccacacaaaataaacaggatacttctccttcacttagattaggttattcattgctttggttcaatggcagtgattggctattttaagagtgaatcagtttatctcatgttctcatggaccaaatatatttgattagatctggggtgaataggcttcaacttcagtgtcagttccattcaattggctgtggcagacatgagcacagatttgggaagaaatccaagactcaatggaaaagactagaaatgtctggcaattgtttgagacccagagtgtcataatgcatcagctaagtatttttctctctgggtaaggcacttaaattctctacagataaatgagaataaaagcttatatatctgtggcatactaaaacttcattttaaaagtatatttacagtagaaatcatgtaactagaacaagcaggacatcctttaaaggacggttatctaacaagctttagtatttgtattttctctagtatttttttctctaacaaatatgtagatgagtaattgacagtatctatttgaaatagggcatttttagcattatccacaggagtttagaaagtgttgggcatcagtctatccaatttggaacttgtgtatgtttttcccaaagaaacctaaacagagtcaagtaggactctgatgtcataaaactgagttaattatgataccttattttatagagtatagaactctgggattaatacatatgtctttctagaagtgttaaaatgattgcgtttttaggaaaatctggaagctttacctaagagtacacatttgcattataggatactcagggtttttcaactatgcaggtggggaggaggaaaggtgccagctgtttgttatcattattctattttgcttttgtcttctccccacttaggggtatccagatggttataaatatttaggaatctgaaggcatttcaaaaatatcaaatctgttacattctaaatacaaaattagcaagtcactaattctcaactcacttatcccttacttgaacatagagagaaacagaagccaaaaagataagtactgtatctgaaaagatccttccttatttttctatgtaattatcctaattatacttttccaatttattttatttatttatttatttttaagacagagtctcactctgtcacccaggctggagcgcagtggcgccatttcagctaactgcaacctcctcctcccaggttcaagtgatttctcttgcctcagactcccaagtagctgggattacaggcacccgccaccacacctggctaattttttgtggttttagtagagacagggtttcaccgtgttagccaggatggtctcaatctcctgaccttgtgatctgctggcttcggcctcccaaagtgctgggatcacaggcatgaaccactgcacccagcctatacttttccaatttcaaattgcaacagaggcagaaccctaacctaataactctgcttcctaggttagtgagtgttccaagagtctggttaactgatccttttatgtctctgttgctctgctgtcaatccaaagccaaatatatatgatacacaaacacacatcagtccagtaccttatgtgtccttcttcctaatactctccattcattattagcacataaaatctctttggtttatttcacagaataaataaacatattaatatccttaaaaataaaactattttgctgaaataacttgtgaaattatatttcattgcactttaagctgtcaccatttttacaacacatagaactggccactatataacacagctagtaaatctatagttcaagacattcaatatatattcaaacctcatataacatattcaatgatatgagaggcatttaggggaaatattttggagaaatgaggatttgtcacaatagtaaaatgtagttatacagttgttcaattgcttgaaactagagcctctaaaacagaaaataaatttatagaaactttaccatctgaattcagtctcaattatctattttattcatttcacttatctgacaaggaaattagactagcaaacacatatttatctacacaattatggaaagcaattacttgggtgatattttaagactcaacttctaagaaaacatttgacatgagctgctgtgctctaagtatctattttggggttcacaggaggaaagacacaaacagtactcacagagcacattgaaacaacatacaatctcaactagatcctaaagtctagaatacctatggtgaaaaacatattcacaaatatttataaattatttaaaatgaggatgttgttaaatacaacaaaaatacaggaagtctgtgtacagaatcaatactgaatatgttaagactgaataataaatgagtttagtacttacatagaggaagatttattaatcaattaaagaactagagtactgcttattgtctctctattggtttctgttatgttgactgatgcagtatagggtaacaatgagcaatccttagaatttctgtttgtttattatactgatatatttttattattatattttattcatgggcattattggtaggcaggaaagttccaattaaataaagtaaaaaataaaatgattagagtttaaaaataattacagacaagacttaaaaagtaatgaatatcaaatacatgtttatctgccagaaaaataaatccattttgtggtgtatctttagcgttgacataatgatatatagtttgtttcctgaagtagatttaatggtgttgattattttgtggactagaaagcagcagaggaaatcagcatattgctttatgtcattcttccatagccttttgccttgaattggaacactaaataatagtcaaactatgaggttgttttcctgctttaatttttttctgtgtgttatctgtatggggaggggagttaaatggaaaaagaaaaaagatttaattaagctagttactagagttataatttttccttgaaaaaggaatatattttcacaaaaaagttgaagagactttcaaaatgaaaaactattaaaattatagccatacaattcagattatttttaggagacagtaattggtcattttacagaagttgattctaccacatctttgcattcatttcaggacctattatattttctgtacttactaaatatcctaaaaataccactcaaatctagcacttggatcatctgggattatgaactgatattatgaataatgtgtgctgcttttcaaaaagcaatttctaatcacttttatctttcatgctgatttttgttaatataattgatccaattttaggaaaagaacaggtgaaaaggctaaaaacagtatcaaactgtttttctttggtttaattttgtagatgtatgcattaatactgtgaataaaagagaagcaacggttaaaatttaagtggtaaaaaagtatattcaggacaaaaattaagagaaaactacacatatcaattcatatttgaaatatgagaaattcctattgagtgctacaaaatatcccaaattagactgatgtatttggaaaatagcccaatgaaattacagataaaaccttatagagatttatattaaacatgtctttaatcataaacatgttggaacatcaaaaattacaaggtgtgtttatttaaagaaagcacgctgaagaaagaagagaccaagataaccaatctgaataggtgtcaaaaagtaaataggaaaaaaaatgcatacatatttttcagtatatattcatgtatatattttcaaatgttcatgctttcaaatacaaacacacacacactaactcacacatacacaatgcattcacaaacatacatttcaaacttacgtcaacccaaacaagaagcacctgttatgaaaaataacaatctcaggaaaaaaaaaaagagttattgggactgaagatacgactgcacaagtggagtgaagtttaggagatagtgagtgatatcttttggctgtgtcttcacccaaatctcaccatgaattgtaataatcccccatgtgtcaagggcaggaccacatggagataattgaaacatggaggtggtttctcccatgctgctctcatgatagtgaatgcattctcaggagagctgatggtttcataaagggcttttcctccttagcttggcacttctccttcctgctgccatataaagaaggacatgtttgcttccccttccaccatgattgtaagtttcctgaggcctccccagttatgctgaactgtgagttaattaaatctctttccttcataaattacccagtctcgtgcacatctttattagcagtgtaagaaagactaatacagtgagctaatgtgctcatcatttcacaatagcatcaaatatgatggtaaaggtaaaaggaatgagaatcaattgcagaagtacaacaataaaagcaaaaaaagaactaaatgcaaaaacactgggtattttaacaatggaattctgataaagctgtgagatgatgaatttaaattttattcccttccctgtatgaatttattgtagcatgtacttgtatagattttataccacttaaagaatacacattaagaggacagttaaaagataagtgctgctcctagttttaactataatagagtgcccaggcaaacttaaaaacaaaggaagaggtaacacttaaaatttatagcacatactggacattcctagttgctaaagaatttaatgaaatatgtagatagatagcaaagttaaaaaaaatagagtacaatgtgagaaaagttaagaatgaacagaaataataataagctacaaataactacacattcccaaagagtaactgccaggcataacaggtgtgaaaacagatttgtggatcccatcatccagtaaattaacttgctgaccaggatgttactctcaccaagaaaatataccaattgaaaatacatacattacaaggtattttatcataaggaactaaatttacatgtaaagtttcagatatccaagtataaatacacagtttagtttcccccaaagtatcaaattatgaacatatggaataaggggctaccttagaacaacatgatattttcatagtagttagtgaaaactgattttatagtatctttatttacattactctggcataattgtaagaaacatgtactttaaataagctaagttttattcaaatgaaggaaacaaataaaaaggtatcattgcaaacggagaatgtttctgcagttgaaagccaattctatgtctaatttagatgctaaattgaaattaaccttggtttacttcttccatactttctaagtaatttcatttatgcagtgaaaagtatatatgttcaattttaatctttttgatctgtccactctctaaataatttatttgtgggaggaaaatcaaaagataacactttgattacctttcttaggctaaaagagtaggtcaacatcattcctaatcatcagcagttagtgttaaatatattgattactggtaaattctttcattacagagtgatgctccttataattttctgtacaggattgccaacaaaaaaggtcctaaaatatttagtgataatttacattcaatactgattgtttcagttatgaatactaagaaaccatttcttaccaaattatcctgcctttaaattctttatcaaattgttaacaatatatctaacaagtctcttgtaatataaatagttattgccttccaattagtattgataatacagtatatattttacttcttaaagtattatagaatatttgtgatgctcagtaaaatatatatgtttttaatttatctttttctcctgcacgatcactgtattagaaaaatgttaccattggttaacattttcagttgtcatgcataattcgtataagaatctcaagagcagaaaactgtgaactaagagtaccttagtaaaatcccaagtagtagaggtggatgtaaatctatgtgacttatttataaactttatgtctctatatagctatctataattacttttaataccacttacttacatactaacaatttctgccctggtaggtgtttggaatattctgggaaaaattaaaatctgtttctcagtttagtaaagtgctgcaaagtcctttttgtatgtttcacgtcccatagaattgagcatctctaatctctttctctggctattttaaggagaaatcagccctggggcatctggagaatctgttttatttcaccaagcatggacaagagaatcactgataattatttttgtactttcagagtgaattcaaacatctgcaaacataaacacacaaacatgcatatatgtatgtgtatatatatgttttatatatgtaattataatttatatttatatgtcattatatacatcaataataatatatcatatacatagaaggaataatatatcagctctatgtgttatgtatatctgtgtgtgtatatgtgttaggtacatataagggtatatttaaaaatatctacatagcctttgaataatcttttctaagttttcaattaagatgtacattgcagttagtatgaccaaaatgtttctatttagaaacatggagttattttagttattgtttatcacttggaaataaaattttgggtacacttagaaataaattaccatcaaaactccaataatctagtatttggttttgagctaaaaatatgtttgcaatttatttaagagtagacattggccttactctttgtccaatcgagaagaattatatacatttttttctttgcttccatcatctgttgtaatttatgagatgatgtacaatagaagactatttattttcagagttaaaggattctgctgagaaaataacatatatgtttttactaaacagctattttctacaaaaatgtaatatgtagataactgaaaaatacaaaatctatgttgataattttcatgccaaaacatcacattgatgagtgccttttatgaccaagtataacagatacagctgaccctttctgaaataaatctttttctcttctttgttggctcacaaataaactaccattttcacctcctttgtgtttggggatgaacttatgatggctggcccagccattacattttccaagggatctctctcattgtttttccccttcagcagactagatagtgatatccagtgtgaacgaagccttatgttgataatggtagagctttgagcaccctggatccctaaatgcctggagtagaataaacactctcaaccattgatctaagccatgttgcgatgcccaataactaaacaaacaaacatataaacttgtattatatccagcttaaaatattggagcttatttcttatactagataaagaaactcaataggatgatctttccttcaccaaaaaaaaaaaaaaaaaaaaaggagaagctaaaagattctagttaatgtacttaggacttatgaactgccatcaaggtcattatgaactgccatcaaggttactgtatgaactgtaaatgacctgtggccaggggccaggtgtttataccctcagtacctagcacacgccaggaacttgataggcactaagcagtattggctgaatgaataaatataaaagaaaacatgtaaaagaggagaagacaggtaaaatagtctctataccacaccaagagcctgttagtgtcagcctgggaagccccaggtaactgacactcatcctttcatctctatatcctggaatatgcttgaaccagtttgtgtaactttggaaagtctggaagtaacaaacgagacatgagaacatgtgtgatgttccgtgttgcatcgcattttatggttctatcttatggagaatgtttggacttccagagcagtgtgaagtggcatcacttcatcaggtcattggtgacagtggccttgaagaaatttgctgaccattctgctaggtatcctcactgccataccatcttctgcaccattaaataatttactcttatttgattaactcaacaatgtctgtacctggtctttctgttattctgaaacaatggtaaacgttttttaaaatatagcagtcatgaaagagaaacaaagaaagatatttgtaaaatggaaaaagacaaggcaaagaaggatgaagggagggaagagtgaatgaaaaagaaaagtagaaaaagattgaagatgagaagggaaacagagagtcctgaaagcagtaaatattttactgggcttaatattcacatatcttcattagcttgtgtgtgtataactgtaggtgagtgtgtgtaaaactattaaatatctttatttatttaaaaatattatttaagatgccattaaatataaactcagaagatatactaatgtatatttagttatgggaattttaaaaaatgcaaataaggggtacaatattaaaatagttttcaaatacattttataaacataattgtaagtatactgtatttaacatttgtatttattttcccacttattcagtcttttccatgtttaattccaagaaaactcattttgtgacttctgcttataacattctacctacaatttatttaataatgttaaattgtttgataatttagattatctctaatgttctgttactataaatacaggtggtttaaacatatattttccatattgagtgctgtatcttggagacagatttccagaaggagaaggggcaagaaaaatgattttcagtcatgcatcccttaatgacaggaatgtgttctgagaaatacacccttcaatgatttcattcttgtatgaacatcacagatttgtgcttacacaaacctagaggggataggctacttcacacctaggctgtatgatatagcctattgctcctaggctacaaatctgcacagcatgtacaggtggacaactgtaatacaacggtaaatatttatgtatctgaacatttttaaaggtacagtaaaaatacagtataaaacataagaaatgatgcacctgtataggatgctaaaaaggaagcttgtgggactgaaagttgttctgagtgagtcaatgagtgagtgatgagtaaatgtgaagacctatgacattactctacactactgtagtctttataaacactgtatacttaggtaacactaaatttaaatattttctttctttaacagtaagttaattttggcttactgtaagtttttgcattatcagctgtttaattattttaaaacgtttgagtgttttaaataacaattagcttaaaacaatcacattttatagctgtataaaatattttctttctttatctctttattctacaagcacttctctatctttcatttgtttttactttttaaacatttttgttaagaacaaagacactaacatgcaaatcaggcctatgctagctcatgatcatcaaaatcaatgttttccacctgcacatcttgtcccattaaaacgtcttcaggggcaataacacacatagaactgtcatctcctatgataacaacactttctcctggaatatctcctgaaggacctgcctgaggatgtttaatatacgtgtgtgtgtgtgtatgtgtgtgtgtgtgtgtgtgtgtgtgtgtatatatatatatacacacacgtgtatatatatacacgtgtatatgtatacatatacacgtgtatatatatatacacatgtatatatatgtatacatatacacgtgtatatatgtatatatgtatacacgtgtatatacgtatatacgtatacacgtgtatatatatgtatatatgtatatatacacgtgtatatatatgtgtatatatgtatatatacacacacacacgcacacaaatatacatacatatatgtaaacactgtatgtaaaataacaataaaaactatactgcagtaaatcataacccaataacatagtcatttattatcattatcaagcattatgtagtgtacataattatatgtgctatgtgctaggcttttataagactgggagtgcaggaggtttgtttataccatcatcaccacaaacgtgagtaattcattgtgctacgatgttacaatggctatgatgttactaggtgataggtatttttcaactacattataattttttttttttttttttttgagatggagtctcattctgtcgcccaggctggagtgcagtggcgcgatctaggctcactgcaacctccgcctcctgggttcatgagattctcctgcctcagcctcccgagtagctgggattacaggcgcacaccacaacaccagcacgctaatttgttttgtatttttagtagagatggggtttcactatgttggccagactggtctcaaactcctgacctcgtgatccacccgcctcggcctcccaaaccgcaaggattacaggcgtgagccaccgtgcccagccaactacattataatcttatgagaccaccataatatgtgaggtttgttattgacctaaacttcattatctggcacataactgtatatatgttattggtcaatatcagttgtgaaattgtgatgccactggcaatgatggagtgtacccacttcagcacaatgtcaccagcactggattttgtttcacattgaaaattagaaagatagtatcttatcttcattatgaatataattattgtaatttcacataagcctgaaatttatagtgattacattactcatgattacattattttgtctgttgcctgttgtctttcatgattctcttaattttaatgtttcgatacataccatatccaataatatcattttgttgtcctgattccagctcaaaaggcttttttaagtttttattatggtcatgtaataaaataattggcccttaatctcgtttgcagtaattattgcattagctttctttaccttttattttttttacttctaagtttgtattttttaaaccaaacaattttttctctgcaagttttttaaataaaatttggaaacttttgttaaccttctctcctgtagatattataaatattctgttatcattccttttgatatgttatgatcttttcataattgattctcagtacattattttgtttgaagaaatagagttttaattgatttccccaatattgtcataatttagtataatgtctcttctttaaccttgagtgggaagtcttctccactgtttgataaatgtttttatgtaaattatttatggaatattcttttatctctatttctcatattttacatgagtatcaaattttgggttttaaagatggaaaaatatatttgctaatcagatttactatttacaaacatttaataaattaaattgaagagataatatgaaccagtgattacttcgtaatttagagaataaacgtcaaaaagcaaaaaaaaaaaaaaaaaagaaaattcaattcctttaagaatatttgacatatttagactcagtataaaattttacattgcatagcattgtattttatttttcaaaaataagggggcggggcgtggtggctcatgcctgtaatcctagcactttggtaggctgaggtaagcagatcacttgagatcaggagtatgaaaccagcttggccaacatggtgaaaccctgtctctactaaaaatacaaaaaagttggctgggcatggtggcaggtgcttgtaaatctagctactcaggaggctgaggcaagagaatctattgaacctgggaggcggaggttgcagtgaaccgagattgcaccaccgcactgcagcctgggcaagactcggtctcaaaaaataaaaaagtaaataaatacatcttaaggagattctgtggaatacttaagtctcagagaatattatttaaagtattcataatgcataattcatttaagatgatacaatgtcccatctaattcaccaaggcaggaaagacattattgagcttgctatcctttctcttgagactcattgacactatagcctgacaaaacaactcagtgtattttctttgtatttgattttttaaatgtattctcttatttctagtttaaaattgatccataatcattgctaacaagagatctgacaagaaaaacaaaaactgaaatatgaacatcaagcctcaataagcatagcccacaaatacaagctaatgtctatgtacccattcattcactgaaatcacacaattccttacataccgtcataattttacagtatttccatttatgaaggtttaaaacaattcttaagcagttttcattcctatccaacttttcacttcaaggtattaaaactacaatggtgttggaaggtgataatagtgatatgaaatatgtattattctgctctcacactgctataaagaactgtccgagcctggataatcaatatggtttggctgtgtccccacccaaatctcatcttgaattgcagtaatcgaattcccataatccccacttgtcatgggagggatctggtgggaggtaattgaatcatggggatggttacacttatgatgctgttctagtgatagtgagtgagttctcgtgagatctgttggttgtataaagggctttttctccttttgcttagctctcattctgctctctcctgctatcatgtgaagaaggacatgtttgcttccccttcaaccatgattataagtttcctgaggcctccccagccatgctgaactgtgagtcaattaaacttctttcctttataaattacccagtattgggtatgtctttattagcagcatgagaatggacaaataaagtaatttacaaataaatgaagtttaatcgactcacagttctgcatggctggggatgcctcaagaaacttaacaatcatgatggagggagaaacaaacatcttcttcacaaggtggccagatcaaaagagataaaagagcaaagggggaagagccccttttaaaaccttcagatctcctgggaactaactcaatatcaagacattagcataggggcaagtgcccccatgatccaatcacctcctaccaggtccttccctcaacatgtggggattacatgggaattacaatttaagatgggatttgagtgaggacacagccaaaccatatcaaaagacaaaggcaaaagctaaaacacagatttttaaaaatgtttatgaagtctatcatttgatttaaaaatttgaaaactagaacatgatataaaaaagagtacatatcagatatatgttgtttcataatataatagattcagctacatgagttgttaatgactgcgcaaatttggtttgtcatgcagacaagttgaaatgaacctaaagattgggtgcagtggctcattcctgtaatcccagcattttggaaggccaaggtggaaggatcacttgagcccaggatttcaagactagcctgggcaacatagtgagaccctgtctctacagaaaaaaaaaaaaaagaaaagaaaaagaaattatatgggtgtggtggcatgtgcctgtagtcccagctacttgaggggctgaggtgggaggactgcttgagcctgggatagtctcagcttctgaagatgctgaagtgggaggatttcttgagccttggaggttgaggcagcagtgagtgggattgtgccactgcactccagcctggatggcagggcaaggccctgtatcaaaaaaaaaaaaaagaaaaaaaaagaaagaaaagaccttgaatgtaaattctgaggtataatatggaactatgtatttagaacctgaaaaaatttacatattttggctaattccgttatagaaattaaactaagaaaaaatcagaaatacaaaacaatttgaacaaaacgactatagcaatgttggtagtagcaatagaaataaacaaaagagccaaacataataatttagatgaataaattttgatatgaccattaaagatataagggctttaaatagcatgatattgaaatacttaagtttattaaaacattcaatgatgtattatcaggtgcaaaatttgttcaaaatccacacatatgcaatatataccataaaatggttgtacttatagagtacatttgcttaaaggaatatttatcaaagtttttgtggagattatctatgagtggggggattgcatgatatctttattttgtagtttatatgttttctatacccgcgttttaaacaatagatctatctcactctatgaagaataaaataaaattaaattaaaaatgcaagcataacaatgccataagctattttataaaaacacaagtttcaatcctctggaaatgtataataaacataagtcttatgtgtatacaagtgaataaatgtagccacatatgtaggaatataatgggacctacatagagtggattttctccacaattctgacaaataagaaaaactctaaatctgaactttgctgtattcaatgttttaaatggcttgatgactttacataaactatatctgactttactatatgtttaaaatatggaaacacactcccctgatacaggaaatgacaagcagataattataatttgtagatttaataaatagcattatatgttagcaaaatatctattaaagttgaatcagtgtgctagaattacaggagtgatttattagatttcttttattctgataattactggggaaaagtacaaaaactatacagtatgtcaacagtttcactgtcctgaaggctacatttctccaccaggttacatttaaggaggaaggaggaagagagaggcaggtagaaagagagaggcgggtagaaagagagaggcaggtagaaagagacaggtgtgaggttcttgtgggaacaaaagtgcaactggacagaggacaggatttcctagtgtattgtcccgccatgtcaataaacagctacctctctcccagcgacacttacatgacagagacagtgtgcatgcagtacaacagaacacacaatttgcttttcttttactacaatgacaaaaacctgtagtaaatacaaacagatggtatgtggctttcataaaaaaagaaaaaggctttcaggagagaaaacgaataaattttgttgtgtgagtttgaacttcgtactatacacactactttgatttatatataaaaagataatttgtttaaaagattgaaagaaaggcaacagaaagatcatttgtgaaacctggtatatcagtggaggttattcatcattaaaacatactatatgcttatttctggacagctgttgtgttcagattatttaattcaattatgatgagattaaaaataatatatccaataatgctcttgctcagagagaaaaacatgtcacaatttcatggatattagttaggcttctaatctttaatcactaaaagtatgaaggcctgagagaagattaagagctcataaatctggataagaaagagaaaggtttatcacattcaatgttatatcagctatccacataattgtatattccaactggatgttatagattggttattttcttctatatacaatacctgaagcatggagatgatatatttagcaaatcaccatatcagtcacatggtataaagaaagtagcaaaattgctaaatcattaaaagaaaaaacaattatttttcttaataaagggattctatatgtagaaaattttactgatggaaatcagctcaaagcctgttttttttctggagcagattttctttccaatagtaaactactagttattattttcaagagttatatatgcgtgcttattcacctacaataaataatgaagaaatagataaagaatttcacttcattaacatagtgatgagctattttaaagtcatttcagagtattctcatactttgagagtttattttaaaataaaacataataaaagatggctacataacaaaaattacagttatattgaatgtacataattgttaatatcaaatattagtgaaaaaatgtactaataccaaacccattaattaaaatttatagcacatccatataatatatttgcaacaagaccaggtctaggtgacataaaaaagaaaataataatgtcatatttattctgaagcagtatgcactacacttaggtttaaaagaaaaaaatgtaaaaaaaatctataataaaggaaagtgagaatgaatgctataaaagctatagtaaactaaataggagagattaacgatattgatgtgatagttacttgattcagaaatttgcatctaaaggatacattaattacaaaaatgaaaaaaatagaaacagattagaggagaaatattcaatattattttagacttttgaccttaaagaaatcatggtgattccaatgttataattagaaaaatatagaagattcattcaactgttaagaatagaaatgatgatgaaacctgttttactgagtgccttctgtgtgcttgacactgtgttctgttctagaatcataaaattttcattcttttggtttgtgttgtacatattgtacagagagcaaattatataacttgcctgtggtgatataaactttaatgttactaagcttcaaaacaatttgtgactgattctcacattcatacttatataaaatcatgttggtctcagaaaaatagaagatggcatagcacatattttcatttacatcataaggaacactgatacactgatcacaaaagaaggtatcctacgtatctcaaaataataagagctatctatgacaaacccacagccaatatcatactgaatgggcaaaaactggaagcattccttttgaaaactggcacaagacagggatgccctctctcaccactcctattcaatatagtgttggaagttctggccagggcaattaggcaggagaaggaaataaagggttttcaattaggaaaagaggaagtcaaattgtccctgtctgcagatgacatgattgtatatctagaaaaccccattgtctcagcccaaaatctccttaagctgataagcaacttcagcaaagtctcaggatacaaaatcaatgtacaaaaatcacaagcattcttatacaccaataacagacaaacagagagccaattcatgagtgaactcccattcacaattgcttcaaagagaataaaatacctaggaatccaacttacaagggacgtgaaggacctcttcaaggataactacaaaccactgctcaatgaaataaaagaggacacaaacaaatggaaaaacattccatgctcatgggtgggaagaatcaatatcgtgaaaatggccatactgcccaaggtaatttatagattcaatgccatccccatcaagctaccaatgactttcttcacagaattgaaaaaaaattactttaaagttcatatggaaccaaaaaagagcctgcatcgcccagtcaatcctaagccaaaagaaaaaagctggaggcatcacgctacctgacttcaaactatactacaaggctacagtaaccaaaatagcatggtactggtaccaaaacagagatatagatcaatggaacagaacagagccctcagaaataacgccacatatctacaactatcagatctttgacaaacctgagaaaaacaagcaacagggaaaggattccctatttaataaatggtgctgggaaaactggctagccatatgtagaaagctgaaactggatcccttccttacaccttatataaaaattaattcaagatggattaaagacttaaacattagacctaaaaccatcaaaaccctagaagaaaacctaggcattaccattcaggacataggcatgggcaaggacttcatgtctaaaacaccaaaagcaatggcaacaaaagccagaattgacaaatgggatctaattaaactaaagagcttctgcacagcaaaagaaactaccatcagagtgaacaggcaaactacaaaatgggagaaaattttcacaacctactcatctgacaaagggctagtatccagaatctacaatgaactcaaacaaatttacaagaaaaaaacaaacaaccccatcaaaaagtgggcaaaggacatgaacagacacttctcaaaagaagacatttatgcagccaaaatacacatgaaaaaatgctcaccatcactggccatcagagaaatgcaaatcaaaaccacaatgagataccatctcacaccagttagaatggcgatcattaaaaaatcaggaaagaacaggtgctggagaggatgtggagaaataggaacacttttacactgttggtgggactgtaaacgagttcaaccattgtggaagtcagtgtggcgattcctcagggatctagaactagaaataccatttgacccagccatcccattactggttatatacccaaaggactataaatcatgctgctataaagacacatgcacatgtatgtttattgcggcactattcccaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcacaaggacaaaaaaccaaacgccgcatgttctcactcataggtgggaattgaacaatgagaacacatggacacaggaaggggaacatcacactctggggactgttgtgtggtggggggagcggggagggatagcattaggagatatacctaatgctacatgaggagttaatgggtgcagcacaccagcatggcacatgtatacatatgtaactaacctgcacattgtgcacatgtaccctaaaacttaaagtataataataaaataaaaaaagaaggtgtcctaaagagtttataaattaacaccttattatagtaatataaacatttaaaaatccaagaatgttttacatccaataagtttaaggagtagaacagtataagacagtggagaagatctgctcattggtggaaataaaagacccgattagaggttaaaggacagagctagatacatggagcactaaaattacatgagtgataaccatgaaagttgatgagctgaacaggggagtgagaaacaaatggtcagtaaagaaccattgagaaacacctactgctccagggcagcaagaataaaaaaggctcagaatgaaatagacagaaagaagcaaattcatcaatgaataaattataataaattatagtattaatacatattatatataaatatcacaagaatataaacatgaataataagtattttccctaaaaattactgatactgccatggtacagtcatctttatatttataatttgttaataataaatgtcatgcatttccatatttaaaattaaatttagcaataagagaggatatccttctgttcaatatatatttaagcattttacacttttgcaggaatatttttcatttaagatcacaagtgaaaaatcaaaattttaaaatatagttaggtaaattggtatattatataggaaactccctaaatcattatcttaaggttttggaactattactgtattacgttttcttttaaaaggctatgtagtgttgtgggtaaaccgaagacaactataaaaaacctaaatgaagaaatatttaaatgctaagttcacgagactcatgggaatacagttcataagattttttgaaaatccctatcaggaaaataattattcatacatttatttataccgtaaaataatatttaatctttgagattaaatattattctacatatattaaatatatataagtgtttaaaataataaagaagatagaaaaaaatagaattttagtgaaaactaacttgttgacatatataggtaatacagaaaactttttaaaaacagatagtgaagaatatctccattggagacggagtgatgctattttacaagaaaacaaaatacattattaaagtttgtgcagcaatcccatatttcttctctagctgctggagcataagtctttcttatttttagattttattctaaaagaaatatatttttaacatgatgtcttgaaaatagctcattttaaagcaaattaatccattttaaccctaattaaagcaaagcatgcttattgatgaaatgctagtctaccagacaaaaataaagtaaaattctgaaaatattcagaatatataatagagctggtatccagtttgcttgttctcaagtaaatatcataaaaataacattttccagtataaaataaccattaaaatagaagtactcaaaagtgacttgcaccttcaattgttcaagagctaatgtatagggatgaattcacatacatcacttataaacctaatcagcaaaaaaagttcaatgccacagaaaagttttgttagaagcaaagtttaaaatatattaccagagcttcacatattaatttaatgtatatataaaaagatagtttgtttaaaagaatgaaaggcaacagaaagatcatttgcgaaacttggtacatcagtggaggttattggtcattaaaacatactatgaaacataaaacataccatgaaacctactatatgaaagccaaatactccatgttctcacttataaatgggagctaaatgatgagaacatatggacacatagaggagaacaacacacactgggacctttccgaaggtggagggtggaaggaggaagacaggatcaagaaaaacaattaatgagtactatgcttaatacctgggtgatgaaataattggtacaacaaacctccatgacacaagtttacctatgtaacaaacgtaacttgtgcctctaaacttaaacgttaaaaaaaaaaagagagagagagagagaaagaaatgtgaatcgaggtgatctgccaaatagtgcaataatttagcttcaccatcggagtctccattataccagtaagaactacatataaagggaaacctagttttaaaaaatacaaatgtgctttctgaggtctaaactaccattctttggttgtcaataactgtatttgtactaagtaaacaaagatgatacaaagaaaatgcgatattcttttggtggtggcattatctgcaaatggcatttcaaacctgattcatgctttaaatatgatgaacaaattgaatgagtttgtttatttttagcacagcctttgtttttctcatttatatattatcctcacaagttgcaaagcaaaatttgtttccttagcatcttgaaataaatatacttagtatattgtatttatactgcatcttaccattctacttgcaaaactattaaagtaaatcaagaaaatgttcactaaatgtcaaaattactaagtctataaattcagaaagcttttcaattttctaccattgaaagtctgcatccaaatggtaaaagttgttttcaaacagttagaaaaatgaaggcggtgcattatcaataaagcgaaagtggcaaattaaaacaattgatgactccagtttaagagtatgaatgttcactgcattattctttcaaattttactgtagttttaaagattaaaaatatagcaggggaataatacaatgagataccactacatacctgccaaaatgactaaaatgaataagacagacaataacaaaaatatatctcataatggtgtaggaacataaattagtagaaccactttggaatatgatttgtctttatctattaaagctgaatatatacataacttataacataacaattctacttacaatatacactcaggaaaaaggcacacatatgttctccaaaagtcaaatacaagactgttcacagttatattatttgtaatagtttttaatagaaatagtaaatagaatagtagtaaatagtaaatacaacagtaaatataccgtaaattatccattctactactgaagggcttttgtgccgtttctattattatctgaagtaatagtcaataatattaattaataatattacagttaatcgttaataaaagaaatggcacaaaagcctttcagtagtagaacaaataacttacggtatatttataaaatggaataatctacaggaatgaaaatgcataaacaactgattaattccacaaaatggatgcttttaacaaaagtaatgttaaaaagccaatggaaaaacactgtggaaatatttttcaatggaaaaatactgtataatttggtttattttaaatacacaggcaaatgccacatataatgttagaagtgaggataaaaaggttatatctggggaagagaataggactgtaaaagtgcaaaaggtaggcttcaggaatgcaggtaatattccattttgtaagagtggtggttacctgtgtatggtattcacttgtgtcctattatctatgtacgatgtacttcaaatttattttctgagatatagtatgggctgtgcagcaggaaatctcttaaaccttggaaatccaaaggtaagtgaatgctcaatatcctgggttaaggaaggtttactttttacttggaggtgagaaaaaaggaaaggaataagctaataaacagtattgaagaacatggaaaaagttggctagtgtgatggagaactactttagggaaaagggttctgtttttaataggatgagaagagcatgaaggacaagaagcttaccataaaaaatatgagagaaggacatttcagactaaaggaacaagccagttcaactgcttagcatatttgaggaggggaaagtataaaactgtcacttaatgagcatagatagggatcaagttggacaggaaggctagatgagaatataaaaagtttttgaggtgatggcaagaatttagccccctgtttttcatattgggatccttggaagagttttgaaagagaggaacaacatctactgatttacacttagagggagtatttgctgattgtcatatgaatatatcaatgattcgagaagggtatttgatgatgcaagccaaatgaaataaatcattatagaagagatcatggtgatttgaaccagtagggtggtagcaaagatacacatagtgaacatatttttaaaatattttagggttagaacatataggatctgacagtggtaggaggtataagggtgacaaaggtgtaaaggatctttctcagttttcagactggtacaaatgggatcatttactcagatgtcagaaacatgttaaatctgagcagagtaaataggcggtgttgtccctggatgtgttttaaagatggaagtttccaccaatttgggaggccgaggcgggcagatcacttgagttcaggagttcgagactagcctggccaatgtggtgaaaccccgtctctactaaaatataaagattagccaggcatggtcatgtgcacctgtaatcccagctacttgggaggctgaggcagaatccaggaggcagaggttgcagtgagccgagatcacaccattgcactccagcctgggcgacagaatgagatcctgtctcccaaaaaaaaaaaaaaaaaaaaaaagagggaagtttccagagcacacttatgggaaggaccattagagagtgatactttaatgatgtaaccaattaaagagagaagtcagggagggtatggggacagaatcctgagaaggaggtgcagatatagcaggcattgtccttcattataatttgaatagaggcaagagataggaatattggtactagttcatatagattggtggaagtgagcttgtcactgtcccgttgatttagcaaatttatttctgaaatgtgatatgagcccatcagctgggatccagggtgcagggggtgtgggtgctggcctgtgaagaggcattatggatggaagaggaaagctgggcatgctccattctgacccggctacttttaagtaagtgtgtcccgtagggccatctaggaactctatgacttaaatgtactcttctacaaaatgaagttaacaatatctacctacactcctgtgcagtaggccaagaaggaaatgtcatataaaaaatgattactacatgttgaggttccagagaaaactggcagttaatctggttgactatgcatgcacaagtaaattataaatgatacattatataaatataacattaactaaatcaataagttatataaaatctcagttcaaagtatacattttacttaaataatttctatgattttttcagcataccatgtctccacatcgtacttaataaaaattatgttaaatttgtatatttttgtacaatgaaactcattttgccaaaataatatacttttatgtgtcataaagctgtaattttcttaggtagtgatttttaaataaaattcaatatgttgggaaaaaattgagtagtgctagatgaaaaataagtatgaagaaaagtaaatgatgaggtttgtaggaggattgtgtactaccaaaatatctgagtgaatgtattttcaatgaaaggcaaggtctaggttgagcatttagagcagaaacttcaataataattaaacacgatttgatttgaggcaattgttattttaaatattttatgtctctcaggaaatcaaatttttataaataatacttttttgctgttggtaataaattagagatataaacacatattagctaagaacaaactattattgtagagtttattgattagaacaatctggtttttccatttagttaatgtgttactttttcattttaaatgtttggcatttcttttagtaaaagaatggctatcatttctaggatgctgacaaagtgtcctagtttacttctttctgaaagcacaattttacacttggaagagtcagcacatccaggatgctaataccaaatttaagtgttaaaaatacctttttgcatacacattaaatcctctttagcactggactgaaaatggagtgagatgctttctcagagaaacagctattcctaacggttacttatttccagagtcacagtcacacaagaactgcctctgaagttggcgagagcacctcatctgaaacggtgattcatacttagcaaatttcgacccagtgaaattcatattctactgattcttattgtttcatgcttcttttcccttttattacctgagtgagtgttaaatggctcaaattaaataattcttaattaaacttccataaattctgtttaaaaactctgaagaaaaactattttaaattttactttacataatacattaaaaagatctaggaaaataaaggtctttagatatcacagacaatgcaaaaagctcacagattctggcaatctacataattacagaaaaaagagttgaggggaaaaacacattttatctacacacacacacaaacacgcacatacacacacatttgttgtttcagtacagagtggacacagtagtaaactaatggttatgacctttcaacagtctcaaagaatcaccaattgtagattgtcaactgcagtatttcagggaagaaatatggacttagtcttactgaggggtttcagaagatcagatggctctattactcaggcatattatttagtagtataaggtagatggtctctgaaaaaagaggattaatgaggactggaggggattgggaggattagaaagattggtagaatccagagtgacagaggaaagaaataatattgttagaaatataatgatacagagttgaaaataggaaaacaaaagaatacctacaaatttcaaaggataagactaacttatggcaacatgacaggatataaagacagaaacagggatgaaaatgagttatgaggcaaaaataaagacaagaacgcatcagattgacatattgttttgtagagattttaatgatctaatattaagtaaggattaagtagagtagtatggattaaataacacttgatttttaaaaagctgaataaaattaatgtttgcatgtttaaatatatatgcttttcaggtttatggaaaaaggtgtaagtggataaacaaattattaatttgtggatatatagtttgtagatatttcaactcagtgggattgaagaaagggaaacaaagtataatttgacttgttacaataaacacctgtcacttaagaaattaaaggaacaaaaaaataattcaggaaagtaaacatgtaagagaaaaataaaatggcacttccttgtgtgtcagaaatgaacacattattgggagttggttctgcttctgagtacccagccagggtctttggaagcagatcagatgctgatgtaatctcggcaaactggtgctttcacaggctttgcagttagctgaagttattccccaaagctttggctcatttgcacgttttttattacctagaattcaattatttgaatgaggcactctgataaagaatacagaaactcagatggacaatttgtgccagtatttccaacatcaccaataagccagattaaagaagactggcatatgtcactccatttgcatactccatcatgtctaggattgtttcacgtgcaggcaggcaaatcatacaactgcttttagaatcctatgctaaagagggcttttataaccaggtataagcaaacaatatccatgagacattttaaagaaagaaataaaattgatattagccaaatttaattaatttgccttaatccattcttttatttttttatacccttgaaatttgacatttttctatgaacattttcataggtgttatgatttaaacatgagataaggccattcaaactggaaggataaatttttccctatttagcagttttaaaaaggttgagcaacattctagtctcttagttaaaaattagtttgatcagtaaacacacagatttctatattctcattctaagccaatctttgttaattatatgaggttacattttttaattgagctatagaatattctactatgattgaattcactttttttaatgacattgtgcaaaagttaagtaactatttcctgcactacaaaagtaaaaagcagagagggtaatatgtttcttttgcaaatattccatattttactttgtttattgtttgcgtggatgaataatttacctaagactgtacaaaataattcaatactattttaatcatgtttggacacaggaactggaagttcaataaactcacataaacactaataatatataattactagagataagaacgtattcattagggaggataaattattttctttcattaggagtaacatttaccttctttttgaggcaactagcatccttcaggaaactaacctttgggtttcatatgactttttcatcaatttaattttgagcaatataacaattccagactgatagtataattattacagattaaataacattctatatgtttctccttggaaaattcacatgatgtgctgtttatatatatgcaggaacttcagaaactcaatatgctagttttattagtttcccattgccagaaagcaccacaaatttagtgctttaaaaaaacactaagttattatcttgcagctctgttggtaagaagtctgacataagtctcaactgagctaaaatcaaagtgttagcatggctgtattccgttctagaggtactaggggagaatccatttcctttgtcttttccagtttctggatgctgaccaaagcacttggccctcttccttcatactccaaaaccagcaaaatcagactgagtccttctcacatgatcactgtgtcctcctctcttcctccctctttcacttttaaagagccttgggattacattggacgcaccaagtttatccaggatcatttccctactttaggctctctaatagacaaccttaattccatctgcaaccataaccctccactgccatgtaatataatcacaagttacagcgattagtatgtgaacatcttggggaccattatgctgcctaccatgctagcattcaaggtagtcacacgcagcacttatacattaatatgtttgaagtattgttgtaacttcactcatagagtgagtttcagaagctacttcacttagtttatcttagaatataaatattctgagtgaagcttggttgataaagaactagctaatcaagctgattatagtctcttaagtttaataaacagtgtgattataaagtcataaggtgattgttggtggggatggagtgtgtgtgtgtgtgtgtgtgtgtgtgtgtgttgaagcagagtgtgtcttgggatagttgtatgaaggaatactttaattcgtatgaacaatgctgaaataatcttgcaatatagtaatcttgtatatttgctaaaatatcagtttcacaacttaatcacctcagaccttctgctgaaactgtagatttatatctcggttcctaatgatttaccttgcacttaaaagtctgggcataaatcactaggaaatggcaaggtaaaaacatatggtcttttaattgatatattggctggggaaacttcatattttgtctactcttcttttactataatcatttgtagcataaattgaggttgacaggaaacaacattttaaaagaattagtactaaatgagagtttatgctgctacctagtcaggtctgaaaaagcaataattatagcatccaatttaggtaaacctaataaatgtaatagaagataaaaatacgttgactaataaaatacatagatgattaaatgagtactttgtggcaatagctgtttttatggcatcaagaatgttccatttgtttctaatagcagattcacattgatgtaataaaagccatctatgacaaacccacagctaacataatactgaatggggaaaagttgaaagcattccctctgagaactgcaacaagacaaggatgcccactctcaccactccacttcaacatagtactggaagtcctagctagagcaatcagacaagagaaagaaataaagcatcgaaattggtaaagaagaagtcaaactgtcactgtttgctgatgatatgattgtttacctagaaaaccttaaagactactccagaaagctcctagaactgataatataattcagaaaagttccagatacaaaattaatgtacacaaatcagtagttcttctatacaccaacagcgaccaagcagagaatcaaatcaagaactcaaccccttttacaacagcaaaaaacaaaacaaaacttaggaatatacttaaccaaggaggtgaaagacctctacaaggagaactataaaacactgctgagagaaatcatagatgacacaaacaaatggactcaccttgaatatagaatgatttacataaatacatacatcagaaaaagtaagcaaccataaaaatttttaagatgtttttttaattaaggaaatacactctttatacctaaaataaaaattccactaaatatatattgaatatgtgttcatatgtatttgtgagtttccatttccataatttaaatgtatttcaagacagtgtcttccttgaagtccatcttcccaggcttcaagacagtcactcaccggagcttcctcctctcactacagctactccttagttgccagtttctccccatcttttgaacccacaggtgtttgctgctccaattccaggccgttatgtttttaacattttctctcatattcagtctcttcactttaagtgcaatctaatattgcatacaaatttgtattttatacccgcaccacaaagctctccctgcaacgctacagttgcgtattccattgactgcattttatccccacttggacatctcaatcaatatatgtgcaaaactcaggtctttacttctactgcctctctccttctcctgcccaacttgattctcctcaattatttcgcttcttagggaatatcagttgcagccctcttattgtttaggatacaaatatcacaatttatcctttcacatcactttcccccatcagacttatatcttaagcagtatcacatcctgccaactttattttcatgataaatacagaatcaaaccttttctctcaatctccactgctgtcactctgctgcagacaccatcatctctccccagaattcttgggatagatctgtaactggctccctgtttctgttcttgctcctcttcagtctatctgcaacagagtgacaagagtttcttgttgaaatatagatcagataatgtcacctctctgctcagaatgatcaaataccatccatactcttgtaggaaaaatccaaagttcttaaacagatctacaggatctacacatgatcgggtttctattatttcttaacattatcacctcctgtatgctatttgttagtccattttctgctgctataacaaaacaccacagaaagaataatttataaagagcaggcatttatttcctcacagttcagttatgaaggctaagaagtccaggattgaggcactggcatctggtgagggctttcttgctgggtcttcatgttgtggcaagaggaagtgaacccactcccaaaagctctcttaataagggctgtaattcacatccttatgacctaagcatttttcaaaagatgccacttctcaaaattgttgcattggaggtaaagtttccaagacatgaattttgagggacacattcagatcataacactccatttcaattatttcactcagctctgctgttcttgttatgtgtcagatagccaggggtgctccttccctagggcttttgcacttgcttttcactctccctggaatatggttcctgagacagcaacatggttcatatccacacttcctcccaggcttcctagccaaatagataaaatatcaaaccaccatctatctcttgacaatttttttctgcatccctttttcattttttctctttaacaattttctacaaatactacaaaatactaattatgcccttgtttaccagctttcttcccaaacagatggcaacctccatgaatgaatgaatacaaaattttaatttactatataacaggaaaaatataatttaatatgcaattggattttatttttgctttaaaaaatttctacaggtagaattttagttatcaaaataggaactttactgattggtctttgggaactggtttattttataatcttaatcatacaacgctttcccatctattgctaagctaaatagaacaaatgactcaaaaagtgggttctccataacaagaaaaattcactacaaccaaaatagattttcatggacactatcatggctcattcaaattatatcacattagtaaaaactactaatgagacattaaaaaataaatacaatataaacaacacagaaaaatctagaaaactcacatttttctctcaaaatttttctgaaaattttttaaaaattatagcatacataaaatttagtatcaagcttagtaaattatatttaattgccatacatttatcattctttgattcaaattattaaattaattttaacttattaaagagtttcttcatttttgtgatatttttaattatttcctaatttattcccacaagttgtatataagggaaactacactttcctatctctcacaatgggttgcaaattgctttttaaaatcgatatattgattttcacttccaccaggcaggagtaaatacaagtaaaagttttatcataactgtgtcaacattggtttcagaaattcttttaaatattataattcgaggccaggcaccatggctcacacctgtaatcccagcactttgggaggccaaggcgtgtggatcacgaggtcaggagattatgaccatcctggctaacatggtgaaaccccatctctactaataatacaaaaaattagccgggcttggtggcaggcacctatagtcccagatacttgggaggctgaggcaggagaatcgcttgaacctgggaggtggagcttgcagtgcgccactgtcgtccagcctgggcgacagagcaagactccatctcgaaaaaaaaaaaaaaaaagccaaaattaaagacataatggagaaatatctgtaactcatatcaaaaatatatatatgtataatttgatggattgaaatggcaccctatctcatttatatcacactggtaactgtggatctaacctagatatttttatttaaaatacttttaatatcaggtagactgaaaataattggatcaaatgaaattatcagtaatatctaattgtgcatagttacatataagtcatatgtaagtcatctgtattaatcctaaaggcctcaaaataatggcaataaatacctatttgagaatccttatgatcatctaaacataaaatgaaacagaaatgatagttgaattccctttcagtggaggcgtctgcacatcttcaatttattttaccaacaattcatctatcatattccatgtgttttgagtaaaatcttgaataagacatagtcctggcattgaaggacgttgattaaagcaaatatttcactcaatatttttagggatcaaactttgttcattttgttctcagacctaccaagaaatttctaaatttatgtggctcaacaatgtagaaatttatatatcagaactttctagtatccacaaaagcaacatctgagcatgtcagggtgcactagggcaaatgctcctcttacacctgctcctacatttcctctctacctgctaattttcccagaaatagtttcctggaacgtgtaccacacttagaagtcaaaacactaccagcagtgatagaggttcttaattgtttaacttgtgttggccttctctttgtcatttaaaaagattgtaataagggattatttaaataaatagtatatctatgcaaccatatgcaataatcaaaatgcataatactaaatatggtagggacacccaccaattcaaagttccttgacttaatgagtgacctgtaaacaaatggatgtcttcaacattgaactaagcatcagacctatgcctaatggcacactggactcataaaaaaatcatgtatcctctctactattcacatggaagacaaacatcctacaaaattagttacatataatattatgaaattgtatttattttatttaaatatatatttgtgcacatgggtttatgtgactgtatgcctctctatgtatatcactatatctttctaaaaatatataattttagttgtatatatccatattaatctattcattgaaaaattatttttaaaatatacatcaagcattaataatggttactgtttaagagtaaatctcaagtcacattctatgttttatatgtctacatttttataataaattttaaatgtggataatatgaggaaggatggaaataagaaaaaaattgaggtgtattcataatcttaaattacatatttcaaattttagatttgaaaatattagaaatttagatgttcactttcatccatgaaaataatatagcagagaatattaacctttcttgtagatgatttttaaccacgctagaataactgaaagactcagcatgcttaatccattttaatcagacaaatcatcaaagacactgaatctatgataatttaccaacattagtgtagacctttacaaattgtaagccagtataaaaccttgtatattgggtttttacacctattatcatcaccttttatggataaagaaaatggcctacagatcagacacgcatgatgcgttaatccatgtcagtatgcaccctctgccatgtcttcaaatcattaagctcagttcttttccattgtgctacacatcagcacttgtctaaaactgtaccttttaaatcaaactgttctcattttacttctggaggctttaaacactagaaactactccaagcatatagaataaccagagtgaatgctccctccctacaacccacacatatacaaactcccaaaatataatagtagaagcaattatagagaagaaccagtatctttatttatttattatttatattaaaggatcatctgaagaaaattaaagtgaaatttgtcttcaacctcaacatttatactatctctcagttttcatttccttttgtcccaaaaatgttagcatatgataatatagccctcgtctctcagtttactggcaagatcttccacagtactgtgttagggatctagtaaaacacctaccaattgaaaaccattcattatcaaagcaaaaggaggggatttatctgtagagcatccaaactggactgggcagttgcctactcaaacagcatatgcatgaacttttttctatatacatcctttggtttggcttagagcagtggttcccactgagtggttctcaaaattgcattgagaaccactgctcaaaattgctctaagcagtggttctcaatgtaattttgcatcctccccaggggatagttaacaatgtctaacaatgtatagagagatttttttattgacacaagttggaggtgctactactgggatctagtgggtagagaataggtatgctactaaggagcctacaatacacagaaaagtcccccaggagaatgatagagctcacaataccaacagcaccaaggttaagaaggcctaatctaaaatgcagtattatagatatgtataatgcaagtataatgaagtcatacaattaagcacatgagggcctaaagttctgtacttaattaaaaaaaaaagaaagacaaagaacaccatatacatgctttgtctttaatgtctcaatctctctcattcttcactagacttcactgtgtcagatatatggattcaaaagaagtaagtttttcctggtcaataagttcaatatgttttatcctagcttggttgaagtgttacatgcatgtttagagtctgaaagacagttaagtcaggttgcagatacttaaggtatacttctgtgcaataagttaaatacagagctgttgggacccaaaaacttgcaaacatgtggtttgtattcatcagactgcaaaaatcaatgcaaagcataataatgctatttatatcagccaatgggacaaaaagtactttatatttatagcagctttcatctaaataatttataaagttggaataaatgactcatatattctcacaagtccactatatctatttgaaatcagtcattgagaggaataataatttccagattgcacaatgtatggacttcattctagcaccgggtgctattgctcatacttgtgactgctatagctaattataatcagtctgcactggatacagttacagctagagtttcctgccactcactgtccttctactattatattctcctttgctattgggttatcttcagctgggcatttctgttgcatgtataatagccaatgctcattttctacctcccattgttttcagagaggcaatcaatcttgaccattggtatcagttcctttttgtttgtttggttggttttttaagttggctatctctgagaaaaagcatcagaagtatagttcataaaatactcaccaaggtgcactaagtgaatgtcttctaggggaagtgcatcagttgacctataccaggtcaatttattattaagatatccagaattaaataaacaacaggaggcttgagggcaactgcaatcataataggtgatagcaccagagtgttacacaatggaactcattatctacgagtatcacatcctatcttcttcctcccacatcccaacaaggtatatgtaagatctaggctggacctcaaactcctgatttagaattaagcattttctctggtaagacaaatacactaaaataaaaaagaacaattattgcaggagcaaagtcccctgctttgaaaaatctgtgggtgatcccagagtgaaaaataaaggtttgaaaacacagtcagagcctgtagttagtttttttggctgcataacaaaatcttcctctgatctgtctctcggctcaaagcagtgatgccatcacctgagcaaaccgaaaaccataatacttttagctaagatttttattttattttttcttgacttccaacaggaaaaaagcaaggaacatttattcttgactacaacattaaatgcaatgagacattgaaataaaaatattttaatagccctagctaataaaattctattttttcacctgttacatatgagaggtttgcctagagccacatctgtacagacaacacacacacacacacacacacacacacacacacacgcataaggcataatttaccttgttttgcagacataaaaatcaagacaaaataatagttacttccacactaaaacaagaagttaagaaaaagaaatgaatgagagttaacaaacataaataaagtgtgttgctgatcacaggagcctacctaatttcttttcatgcatcatttataagtgccctttaaaagaagcaaaagtttcatcttaagctttaataagcatttaaggcagggattcgtgggaagaaaaaaaaaaagaatgaaagaatataaatgaggcttgtcctgctgcagtttcagtgctcagaaatcacgtaattttagaggatactggaaaggcaataattaaaaaaagcactatcgaaaattcaatttcagtgcccctgtttctattctgaccatgcgtcccctcacttttacagatagacataaatgacagcttatactgatgccatcattattgcaatgtgccttgcagagtattcttccaacttcttcagggaagacaacagcacaggcacagataaacataaacagacacgcagctggattctgagactcgcattcgataggctctatggcagcattcctgcataagaaaattcaaatgtataccagcgataaggcagcctgcattagctacaactttcccctcagccctcgatcctgtgaaacccatcggagatgaagatttcacccaatattgctttgactcagaactgggtaaagcagccccgctgtacacaaaaatattcatgtcactagagagtaaagtgtcatttattgaagccttaccttggcggacttgccctaactggtggaaaggaacttaatttataagaagcaaagagaggggactttcccagagctctgggcacagctgctcgccgtcctcggaaagcccagactcaggctccgcgcacctcgagccctgggctccgaggctgggtctct

SEQ ID NO: 147 - DNA, 515200 bp, Homo sapiens; identical to SEQ ID NO: 146

SEQ ID NO: 148 - DNA, 66571 bp, Homo sapiens
aatcggggccttggggagcccaggatggaggtggcggtcgcggcggcgggccgagccctgcggcgggcgggaggtaaggggggcctccggcgcggcgggccggtcctgggcgcgggcgcggtgcgagcggcgcggcgggctgggcagtgtccagggcgcgcggtggccggcccgacgggtcggcgggcggagttgcagctgccacgcgcgcccgtggcaggtgtgaggtctgtggagcccctggcaccagcgtggggatggtgacacgcgtggcacgggcgtgggcaacgtgggtccggcacaggcggcgtggttttcctggaacgggtctcagaagactcgcctccaccttggtgcggtggtggccacgcaggtgtgaggtggtgcagctgtctgcacaggtaggtgatgggcacggccttcggactggttatgggataggtggccagctcgtgccggcatggtggtgccgctagcatgggtgtgaggaagtgctgccattgcttgggtgttgggatggttctggccttgggcttgacatgatctggggtgatagcactgggggcttgaagaattggtgttctcagcatggctagagttcctggcatgactgtgagaaagggccttggcacggtgtggtgcggggggctacccggcactgccgcggggggagtccgtggccctcccatcctgatgaatgggaagggtaaatgcccatccttcctcacgggcgatgaaggggacactgcctctgtcatgggggtccagttttaatgcctgttgggtacactggactgaggagggcagaaggctgggagaaggttggtgtcctttataatgggcataaacaagagatgccaggagaagcttctaccacaagggccctgatggtaacccagatagagaccttccaggcactaccgttgtcctgggctaaggtagagagaaccattcatctagcttttcatctagctttgggaatgaagggaggggtggatgattttcagtggtgatcggtgtcccagaatatgtcctgagaagcaagcaggaccaagaggtaacccgggtcagcgagtgagggagtggtatggcgcaccatctatctgtagtcacggggtcctgccttctccctgggttgatgggttcactccagggtatctgggagttgcctctcttctttgatgctggggagcctttgggtccagaggattggatcgattggggtatgcttgaaagatgattctgcagccactgggaatctgctggggccaccgggactcccacccccaggcttaaattcctttccaagggctctgtctgtcctctctgcttagctcctatgttaaaacccctccatctgcgctgagattgtgtttgctctcaccagtcctttgggaagctttgggtgaaggtctcactcagcatcacctagtgccttactttacagagaagcaatttgcagctcctcctagagaagtcttacagtgtaggggaaatcttcagttctttgtggatctcttgggggagtgggatcagtggtagaagaatcacagggttgagcttgtgctggggaaggcacttatgagtccaaaaagatgatgttgagggtagggtggcaggtggtcgccaaattgccaaggtgggtgcttggagatgctgatgagttccctataaccggagcactgtccgatgcctttggagccatatcactttaattccagtgttggctgtgtgaccttcagcaggtgacttcaccaatcaaggcatgtcacatggtggtctggtagtaaagaatgaaaggaaatggtgcacgtggaaacactttgcaaacagcgaaagactgtacaaaggtcagagagtctcatcaagtaaagagaccagggctggaggcaggagccataggaaatggtggcacgggatgtgattgggaggaagggagccggaaggttgagggcctgtcatagggaattagaggccctgagcgcacatgctcccggtgggggcaagtgggatctgttgacactgtgagtcagctgctgagctggaaccaggcccccggtctccagaggacagtcctgagcatggccccggcagctgtgaagtcctgcaggagtggcccaagcaggaggaagcactttgcttgggcagcagacgtgcctcattgccagggtaggtctgggaggtgtctgtggctgacagatctagggtacctgtgtgggaggaagacttgggaagtgtgtgtgttttctctggagaatttcctttggctctgggttctgagaacgggggtggggagcagtcacatcagcgtcttttgggctgtggcctgaaggaaatgaagtgggtcagagcatccacagatcgatgtggctcaggtctggatggttctgcgggaggttgaggctggatggcagggggacgggggggggaggtgtggaggatgccctcagacacataggggaaaggaaagggggctacaggcacctctgagggcagacaggtgtggcacctctcccaatgtggccccacttctggctgaagtgccttcccaggtggggaggatgagggtggctgcacagtgctttgctctctgccaccaggagcctaattcccgacaacaagctgcagagcctgagttgcagaccctgccccatggcgctggaagtcctgtttttctctcacccaggccgtttcttcagcattccatgcgggtgtctgccttagccagcaacctgtttcacatccttgctccccgaggaaagtttttgccctgtgcccaggctgcagtgtcaagccatgtgggtggaaggaggacacggccctcccagacccagggttgtgagctgacttttccatgctatggactcgccctgtccccgtagctgccacgcagacactgtccagcattgcaggtgcttccctggtcattcccatgttggtctgaggggtatccatggcctgtctcacccgctccctgcagtgcttcatacctcccccgaggagttgctgggcacttcagctcatgtctggaaagctctcttaagtgcagagtccattaaggaggaagcctacagcctccctgttgtgaatattcagtattcaagtctcctcagctcaccctccacacctcctcctgtttgttctgatttgtggctcagccttatggtttggggctccaggagcccttttcagccaccctttgccttctgcttgggatgctgggactgcccaccagagctgagtggcaggcagggcagatctgaagacactgagaggaggagttggcctctgttccccaaaaggagagctgagctttcttcccagtcctggggttttggggtagcagggagcccagccaggttagcacccttgtcattgtgcacagatgctgatttcgagtaagttccagctgaggcagggggccagtcacttaggagtggacctcgagggcaagcagctccctggagctacaatatttcaactctggtccccagtcatattcccattttccttgtccatgtttctctaaaagttgctttcctcagctcctggcaattcctcagctgccccataaatcacagtgcctggctgctgtgctttaggggtgccggggagccaggcatctgtggccagaggatgctggaccagagctgacagcagcgggccagaaggctgcagctgaaggcacagcttgtcactggaagccactcctcccccagtccctctcctcgagaccagaggggaacctcagtgtttaatcacctgttggcccatcactctgtgatttcaatttctcaccggaatagctttacattacactccagtggactgggcaagtagcgctgggggaaatatcaatgagcatgtggtcagaggaagataaatcttttagaaccgcggagcccaggacattgcaggatgcggttacctccccagcggatagggctgaaaatggtttattttgattttctttttttgtttctgatactgacttgggctgggcgtggtctttctgggttggatgggaagcgtgagtgtgggtgtggacgtgggttgtgtgtgtgggcaggaaagacccaggaaactgccttatctgtgaggacctctttgctgctgaggaaggagtccagggagatgccgtggaggggattggtgtgaccacgggtaagggtgttttcatggggtgtttggcaggaacgcctaagtcctctagatggggatggggctgttattaccgcggggctgcccggggagtgcacgtgtgtaaagttgcttgtgcccataagtgtttctgtgggaagtgagggcggagggggtgtggagcgcctggtggtgtgggagcgcgcaggctcccgtgtctggctggcctggtgttggtgggtgtgcggagctgggggttgccgggctcttcacagcaggagggaacagtgggagtcggaggaggctgccttcaggctgtgggagggcagagggtgggtttcatacctcatgttatgactctttacatgaggagccgagtgctttctcagtattccttagaaggaagctgggctgcaggcggggctctcacacacccttctgtgtgctacctgggggcgtctcacacgcctgcttccatgctcctccttgaaccacctggaagtcagctggggacagtcccctcccccccatgacagaagatagcattgtagcccatgggtagttatgacttcagactctggaacctcacggacccagattggatgctggcacacctcagtttcctaatctgtaagatggggacagtaaaacctccgagagccgaatggcaagaattctcccaggtaatgcctggtgcgtagagagatcctgatgaaaacacgcactgaaaaaatgtttttgctcttgcggccggaatcctttccatagagaagtggttatgtcgtgatctgcatatattagcagtagggaagatgtaatgggtctcattacttgataagaagttagctccccacatccttgggatagacagaatcttgcatatctgttagcagtgtcatcagcaagagtatatcttagccttgaggaatgtttccacttggacatagtcgatagttatttcttgagcgcctgctgtgagttgggggttagtgagggcatgcagatgaggtggtcataccagagcctataaggtgtagattctgacctcaagttgcttaaaatctgttgagaagatatagttaatttctagaaatgagtgatgccagaggtcaaaggagggagagtgactcgagccagggaggttggggagactcgggtggccacggcctttttatgtgggccatgggtaccggtgggagtgaacaaaggaaggtgcttgtagaggaactggcagcaacgggggcgggttggcggggtgactggtggctgggaggggaaactgctgcccgtctgttgtgtgctgtagggcgcatacaacagaagtggtgaaagctaagattggaaaaatgagctggagctgggtccccaggagccatgatggcagggctgaaggtttggtttccaatctgtgaacgcatgggcattcactgaagtgttctgagcaagggtttggaggctggtgccacccaccaggaagagtggtatggcagcagggtactgagggacaagagtagggggtgcccaggtacagagggcttgaaccagggcagtggccactctgcaggggaaaggggagagacaaagcctggttgattatggaagggagacagaaatcatgagattggtcagtgtggtcactaggaggggaaggggtgggaagtggggccaggaagctgagctgggcctcggaatcgctgcctagaatgtgttgcccacacttgactttcagcgggtctgactcccgtcagtgctgggcgggagtgtgaacggcaggctttcagggctgccctcgaggccgttcccatccctgaggacccactgagggggttccagtgttcacagcacttatttccaggcatttgatcattttctcaccaaattaccccttgaaatttcgcctgcctgagttcagcccaggaggttactattctgggaagtttcatcaaaaccttttcagtgtttgggagttctctgagcctggaggaggatggaggagaacagggcttgccctcacctgtgtttgggggctgctcctgcaaaccagtcctacacctggagacggtcctggccagggagcctgcggctctggggtggaggtcgggacggtggccctccgctgtgtaaggtgagacaggatgctgcctcgaattcatcctgaatgggcccctcgtcattgtctctcctggagccatttaattaattgatgattgatgttcctggacttccttgaggttaatctattattgatgtcccttcgtttatataacatatgctgcacctcccagcccctggctgctcctgatgggcaggccacaccgtggagtgggctccctggggctgcacctctgtctcctggggacagggccctgcacttagctttctcaaagcctttcaggtttggggtcagggagggcaccagggcgtgtctttaggaggctttgctcagccacaaaataatactagtaacaataacttccattttctgaatgtggatgaactgaacccaggagagtgtatagaggatgtcatttactccttgcaacagcaaccccctgcacgctcccatccctccaacctccatcttacgggcggcttagggagcttgcatcacctgctcagggacactcagagaggcagggagccagggtttgaacccaggatgggttctttttggtgtccctgtccatacgccacctctccctcaggtcccacacaatcccacctcctccatgaggccattctccatgctccactgactctagcactcttttttttttttgagacggagtctcgctctgtcactcaggctggagtgcagtggtgtgatctcagctcactgcaacctccgcctcctggttcaagtgattctcatgcctcagcctccctagtagctaggattacaggcacgtgccaccacgtccggctgatttttgttttagtacagatggggtttcaccatgttggccaggctggtcttgaactcctgacctcaggtgatccacccgcctcgctcggcctcccaaagtgttgggcttacaggcatgagccaccgcgcctggccaaacaaaggcatcttgtagcactctcttatctgaatagcgctggcgcccctcagagagagcatgtgtgttcccctcactgatctgtgtcctcactgaagcataacaatcatggcgaaataacatttagggagcacaggtgccaggcaccaagctcagtactttttgtatcttctctcatttaatcctcatgaccataacaaggagcatgggactgctgggcctggagtgttcctggctctgctgggcagctgtgaacaagtcacttttcttttgttagcctcagttgccctgtctgtataatagcagcaatgatatttgtcctgtctccctcactgttcaaaggtgacactggatgggaaaggcctttgggaaagacattgtactaacaaaggattagggatggctgggtgcggtggctcacacctgtaatcccagcactttgggagaccgaggcgggcgggtcacgaggtcaggagatcgagaccatcctggctaacatggtgaaaccccgtctcactaaaaatataaaaaattagccgggcatggtggtgggtgcctgtagtcccagctacttgggaggctgaggcaggagaatggcgtgaatccgggaggcggagcttgcagtgagccgaggtcgtgccactgcactccagcctgggtgacagagcaaaactctgtctcaaaaaaaaaaaaaaaaaaaggattaggattgctcgtacatgagattcaagagctggcatgaaggctgggaatacttaaggctgggcacataaacccaagccaaggcatctgcacccaccctctaagccaccccagcccggcagatgaattctgcagcttgccagctgccaagaacttgcttgaggaacctgtgtggccaggagtggggcgggagatccttagagtggctgccaggccctggtctgttgtcctggctggatgagcagtgcctgggtccttggaggcggtccctcccactctgggcgcctggattttgtggaagtgcagggggcccgtggggggttctgggccctgcttcctctcccatctcccacatgcagcctaactaggtcagttcaggctgggtgtggggaggaaggaggatagctcgccaggcagccacccagacctcccctcacccctcaacacatgcggaaagccttgtgaggaggtgagccctgtgtctgttccggaaagcgacggggccaccagcctcacagtggcaaggctcccggggcactggctgggaatcctctgctttctcatcagctttactcggagcgcatttcagtgctgggctggggctggggaagatgacacgtgctgccagggcctgaagaaaagggcagagcccttggacttgtgggtgggggcaaggcatgcctgccatcgctcattggaaattgtggccaggctactgttaggggatgttttgtttcacttcccaagtttccgccttctgcgggccgggattacatcaggctcccctggcacgccctttagccaactcccacttcatccaagctcctccactgccctgggacagctgccccgctgcagttttggggcaggctgcagaatcactgcgcagccctaggcccagtggctaaggggactgtcctggccttttcagcctcatctgcagaggctgggaactcccagtgccctgcctcccagttagcacctgcccacttcacccactcgagtctgcctggtctccaagattatccacttctgattcattctctctccctctttaaattcagcatagcacaggccttcagacatgggctttagcataaagacagagctttatatgagaccactactacttgtgcaagtcacttgacctgtttgagcctcagtttcctcatcttttttttttttttgagatggagtcttgctctgttgcccaggctggagtgcagtggtgtgatctgggctcactgcaagctctacctcctgggttcacgccattctcctgcctcagactcccaagtagctgggactacaggtgcctgccaccacgcccggctaattttttgtatttttagtagagacagggtttcaccgtgttagccaggatggtctcgatctcctgacctcgtgatccatccacctcggcctcccaaagtgctgggtttacaggagtgagccactgtgcctggcctcttttggtactgcttctatccactgccttttctttgtctaacttttcctctctgaggcctttaggggaagccagtttcttcctcagattctctgagtctccccgcacaaagcccctcagccctttcagctgccctcctaagagttgggggatcatgacttggcctcacagaattccatgccatcctctctggtctgggcagcctctccagggcaatgggagtgcagcccaccgggtctgcagagccccagctgaggcctgagcttccaggcaccgcaaactctcctgggctgcagggccagagtcagccccagtgcacccccagggccagaacaccagccgtatccaagtctctttccccctaggaacttaaggaatttttcttaagggttgtttcagtttcatacctttgaaaagaacttgcttctcctttgacaccttcgctgggactggggccagaccgtggagcagataatagttttgccacgtgtagtctcccatctccccatttattcaaggacatttattgagcacctacttgccaagccttgtgcctggagctgggaataatggtatcacttcgtcctgagggagttcctgggttggcataagcggacactaccactctaccagcagccacaatggcaaaagctatgtggtgagtcctctctgctacacagtgctttatgtgtagggacacatttaatgcaatgaacagtgatggcttccattttctagacactcacccctctaggctctgtgctcaggacagtcccatggcacccatggaggaagcactcgtttcacagcaggggtccaagtctaggacctcagcttccttggggaattgagggaatctgttagaggctgcgtgtttgtagctgggactcaggttccgtctgtctggcccctgctctcagggtgtgcacattcccctcacctggcatggggtttggggattctgtgagccacgggaggaacagccgcccacaaaaggaaggccccctttggctatcctcttgctgcgaaggccaggccccgctcccaggaagccctcgccgctccccacatgtagacccatctgtggcttgcaccaccttgttactcccactgttgtccaaccgaccttcaccgaccctgtacctcgccggccgtggcaggcggctttcaggctcgcacagcatggctcctctcaccccacacgcccctgccagtgccactccagattgttctctttgctgcctgctacaccatgcagtttagaacacagcctaatggagggctcggggcacctgagcagctgcctgctccatttcttcgcccctttaatccctcccttccccaggtgaaccctattcagcaggcttccggcagcaataacaaagctgggcacccagcccaccagctgctcagtgctttataaaagtttaaccttaatggtgtaatgaactcccatcataaagcagctggagcagtgcatcctgggatgtataaattataggaaccctctgaaattgtaattggaaatggcaacaacaagaaggttgaaagtggctggcctcattgggctgagcacagctattctctgtctcctttcaaaaggcacacaaaactgagtctggctgtgaagaaagaatatcctcagcccaaatcgagctcctggttcttccgcccgagttcccacttcctgcctccaactgtgtctgcagagcctgcagcctttggaggtgggaccccccccaacccaacctggccctgtgctctggctctgtgcccgcagacagagtgggctgagagggaacaaacacagccacaggggcaggctccaccatgctccagggagcgctttggagcagttgatttgacctcctcgagtctccataaagtggagtgaacccaccttggagtgctggtggtgattgaatgggaaaccgcagggggtgttgggatgtagggttgagaactcaggccagacggtctggctgcctgttgcagctcctgctgggggtagtcttgagtccttaaccaggtcctttcacctctcagctgcagtttccacctgtaaaatcagggaataattggcctctgaggagtgttaggaggtgacatgagatgatgctggcttgtgacagactcagcatcgtgcttctttgatgggcacacagatcactggggagcttgccaacgcagattccagtttaggctggctgggcccagatgtgcatttctaacaactcccaataatgctgctgctgcaggccctggagcacacctcaccttgagtctggagggcagtgtttgacccatagtcagtgcattagagcctgctgtgatcgtacgtccaggcagaacccagggcctgcacaggtgcccacgtggcccatgagccggcagcttcagcatcacctgggaccaggttagaaatgcagcatctcagcatcccttcaccaccaccctcctccacatcagaatcgctgggaggggagcctgcagccagctctggaagttctgcttatgcacacttgagcagtcctggccaggactcatccttcagagcaggatttctgagtgtagattggttaactccagcctcagagtctcctggggttggccatggtagaacttggaacctaaaaatataggttcctgagccctgccttgggcttactgattcagaattgctgggcggggcctgggagtctgcataagtttgagagttactggcgaccactcattgcctgagagatgggaagaagggcagaatccccgctccccactcccaccctttatgcataaacctttgcatctgccagggggagaaggaacaccaggctggggtcaggagttccgggttcctgcaggatcctgtcaccaaagcccaggaccccagagccactctgcctggggcccagctgtggggttttctcacaccgagaagagggaaacaacccaacatccccgagtagagagttggttgaatgaacttccgtacatcttgtatgtggactactccacaataatgaggaaagatggcggtaggaaaatgtttaaggagaagtgctcaccttttagttcagtaaaaaaaaaaatggtagatgccgaatggtcccacaattagatggaggaaaaaaaagactagaaggatgttaatagttgatagttttcctagagggatcatgggtgatttatattttcttctttttggtttctattttttttttttttggtgagattgagtctcactctgttgcccaggctggagtgcagtggtgcggtctgccttctcagttcaagccattctcctgccttagcctcgcaaatatctgggactgtaggtgcccgccaccacatctggctaatttttgtatttttagtacagacggggtttcaccatgttggccaggctggtctcgaactcctggacctcaggtgatccagcctcccaaagtactgggattacagatatgagccactgcacccagctagtttctattttctatagagaacttgtatttttgtaataaaaagataagtctttttctttttctttcttttttttttttgacatggagtcttactctgttgtccaggccagagtgcagtggtgcaatcttggcttactgcaatctctgcctcctgggtttaagcgattctcctgcctcagcctccagagtagctgggactacaggcgcccaccaccatgcccagctaatttttgtatttttagtggagaccgggtttcaccatattggccaggctggtctcgatctcctgatcttgtggtccgcctccctcggcctcccaaagtgctgggattacaggcatgagccaccatgcccggccaaagataagtctttttcttatgcataagtcagcgtgtctggtctggggtccccggtcacagtgcacctgccctgcctgaggtgaggctcctgcagccaggggcagcccagactcccccactggggtgactttcaccatcgcctccctcacctccagggtatggctgatgatccccagggcttcacaccgcttctcccgctttcttacttcctctctgctttgagtcttccctgatgatgcccagcactcctcccattttacataagaggagagggtggggaggggacagctgagaggtgggaagcccccagcttgcaaacctctgaggccaagtttagtttggcatcacctaggtgactaaatctaaattccagagtctaggcacataggatatgctcggagagtaatggctgcatgaatgaggctgggaaggcagccaaggatggggcagaggcccaaagctgtgtgaccttggcacgtcagcattcctctatgagcttagggtactcatctgtaggattcggggaatcagggaggcgtggcatctgagttccctgggcctctccagctctgaacttctggggactgtcacatgtcttcagtcctgcttccttgcctgtttttttctaagcaatttttgctgcccaagaagacctcacctgtgtgttccagctacccagtgagtttgcgcgtaaatggctgctcagggcagggctctccagtcaagggcttgagcaaggccactgctgtccccacagccaggcttccatgctgtggcaggaggaagggagaccaatgctgggacatgagagcgatccaccacccatagcagagggccggggtgcctgggtgtgcttggacctgacattggcctcacgtgcaccctttgtgcctctgcgccggctgcctgtcagttgtcaggtgtctgcctttcatcctttcctggccaaagctgcctttattcaagtgccccctgccaggctttgtgtctgataccccatttccggcagccctgaatctgtggccctttgagctgctgttttccatcgagtggctccgtggggaggaagggtgggagaaatccattcaagtcatttgttttaaagacattgaagtaaacccatgggattcatgcggtcacatgttttcagtcttctttcaaagtaatagttgggtttctggatcgctcgcattacccacttccctgcctgggaagagcgagaggcctggtcttcaggaagaaccatggagaggggaagcctggaagataaaagctgggggcctggcaaaacccaaacatgtgcacgtctccccgccagtggaggggctctgcctggggagcaccaagcacctgtgttctggtgattccaggaagcagccccacgggccctctctgtgtactcgcaagcgtgtttttcctagcccagggagcctgcagaaactacctttgccagcaactgagaggcagggttgggagctaaagtggtgcccagcctccctgctggctggaatctggccctgcacaaggtgcatctgcccacaggctctggggaaccgggtgggaggaggggcaagaggaggggagccagctttgctttccccgctctttctgttcaaccatcaggcacctctaggaagctttctctgtctgcctggggctgagcagtggtccaggcatcagtgtcggagctctgtgctcactgacccgccccggtttccttgttattctgcactgtgagctacttgaggatagggcttggcatcctcgagttcatgtccccagaagctcctgcctaagggcctgctgagtccaacccactcccacttcccagcggggaggagcagtgggagcttcttgtctgggagctttcaggtcctaggtccactctctggccctggtctgagcctcccaccccgctccagccaactggtctggcgagtttgtggggacctggccacaggcgcttctccagggacagaatgtcctgctgtaaggaggctttgtgcctggctttctgttcttcttggctcctctttgctcctcctctctctctttcatcccagggagggtactgacttctggcttaagtctgctctctatcttgcctttttggggtccaggacagcatatagtgggggtgctgggctcaggcagagcagtggccttgcctggaaggagggcaggggcagggcccttcaggaatgaggtagggtgtgcatccctgcgtgccccggtgagaccctggaaagccagatacccagagtgtggatgacaggctccgggccagagcccaggggctgtggtgaccgttctcccacctccttccccgctgatgttcaagggtgagggaccagaggcccaaagacggcagcctgcggaggcctcgctccaggactccgcccccactgagactcctccctgtccccaccaccaggcttgctctcagggagcaggaaatgagagtgggggagcctgggtgttcctctcaccctctgcgggaggggctgggcaccccgttccgtaggtgtcagcggaaccgtcaccagcggtgggcgccagtgccgggatttccctggctgactcaccctcggcctggctgtgcctcagcctaggcatgagttctctgtgaaggtgtctggatagtgacagcgattcccatggagtcctgggagcgggagagtgggggtggaggtgcccactaccctggctgcctgccttccactcccagtggacctgacgcccagccgtccgtccgtcaaggacaccacccccacttcccagcggggaggagcagtggggccggggcgctccctgaaagatccctccaggggccacatgcctcccctccccttcccctgtgggagaggcaggagaatagggaagccattgattccctccatccctcccagagtaagaggcatttcacagactgggcgacccggggttgggggtggggtggggtggggtggggagctgtgagaggcaggaagtggggtcagcacccggatccaaagaccccttggagaaaaggggaaaactgtagtcccttcccctagcaaggtttgcgtgaagcacatctttgggccatcccagcctccttggcagcgagcaggcagcggcaggcactgtcagtggggtggaggtgttgcaattaccgtgtgtagggggctgggggaggactgagcagacagaaatgtggagtgtgcggcttgtgagctggcctgtgggggcagtggcagcagagctgcgtggggtgggatgggaggtgtggatctgggtggtttgccccaagatcctcaccttcctatcgccaaggggagggaggtcacccatgacctccctgggatggcatagcaggggatggtagcctctggggactggcctgccagggctgagggcacagggcgacattcaggaccctggcatggttcggtcttggcaggcagacttctcagccccctacctgctcacctggccagtgagaaatgaagcggtttctgtgccccagtgccatggacagctccagtgactctgatgaggctgttggctgtgcaaattcctttgtgggtagccccagggtaaggtggccctggaaaggaatgtggttggtaggcccaaccctacccagcctcctgagcttggcccgctgctgtggtcaggagcatagaagccgggccagggcgagggaaggcctggcctaaactgagatgggccctccaggcaaggccagcattacctcagtcctcggaaatgcatcgctctgcttgggggaatggccacacgtggctgagccccaggtggtgccaaggacaggaggacagcagccattcctgcgcaggagcacaccaaggccccaggagcctgggctgtggggcagggttccaggttctgctcccagcctgctgctgacctcgatgtggcctggggcagctgtctacatccttcctcaccttcctccctcaaatgagcatttgtgactcagtggctcagaggttccttcccactcagatattctcctgtttttttttatttttattatttttttattttttagacagggtcttgctctgtcacccagcctggagtgccgtggtacaatcatagctcagtgcactcactgcagcctcgaattcctgggctcaagtgatcctcccatctcagcctcccaagcagctgggactacaggcatgccctgccatgcccagctaatttcctcctgtgatggccctgggtagccaggtgtctctgcagtgaggagcagtgccagggccctttcttggaccctccatttcctcctcccctgggagtcatggggcaaagtgagataatgactggaagttcccagtaccaggtcttctggcagctagttgggctctcagtgagcaatggctggtactactgcccttatcacccttatgtttacattatcatcagccttattgtggagttgccttctcagagcctgttgggggctccctggaaaaggcagtgtgactcttgtcctgggctggcatcctggcccccagtctgctcaagaatcagaaggtcagactgggccagccagagggtcagggcaggcaggcagggtccctgacatctctcctgtggtgcctctgcagcttggctgagctgcaggctcccatctgcagaggggcggcccagctctctgcaagttggctgggagacctcagaatgaggagcgcatgttctccaaacatcttgctcacagcagatggcagccacaactgcctttctctctgcagttccggtgcacttccctttcctttgctcacccccctgctaactttggtttctgcttttggagatggggaggcagcctgcaagcctccagagccacttctgatagtgggtgaagcttggtgcacgtagcacggacagtttccaaaggaaaggaaacctcgtaccccacctgcttccctggggaagctcactcttaccctgcttcccacatgccatctctgagtctctttggccaaatgtgccggcagcatgatctgagaggagcaagggagctggcccgggggccttgtctgacatttcttgagcagctgctaggcaccaggcgtggtgctgggtgccaaggacacagagatgcagagtgtagccctgccctcctggagctcccagcccagtggggagcccggaatggagggggcactgattaggtctgcccttgggggttggcgggccctggcagcttcacagaggaggttgtgtttaggctgagctttggaacactgaggagttcccaggggagcaggattggaaaaggccttttgggcaaagagaacagactgtgcaagggcacagaggcatgcagaccgcctgcagagcacgctcaactgtggtgcacagcagagcagagaaagcaggacatgctatgcaccctcagaaagacagggcctcctctggctgcgtatgggtgggggccagcctgaagctgaagccctggatgggagccattgggggaacaggcctttctcagttggggggaattctgccctgagtttggggccagtagacgcagcagcccctgctggtagaatagaactggaccatccttccctcctggctggccctgcagccacaggccagaagtctggtgttggccttactgccctggagctaaggccagggggtcacagatcagccaggtgagcatgccctgggagagtgtgtgggccagacctccatggcactgcctctcctactgcgacctgccctggctccaccccacacccacaggtggcactaagctgagcacccacatatccagaccctcttctgtgccaaatcctttctcagtggtcccacatgggcctcatcccatttaaccttcacaaaggccatgtgcggtgggcatccctggccctgaggtcctttgacttgctccaagtcacccagccaaggcatggcccagcagagactccaggcctaggtccgcctcaccctttgcagactcatgccttgcctgttcttccctgcgctgcttctgtcacctcacagtcaggcccctccggggagtacagtggagggaaggccaaagcattcatcctggaagaccctccaaatactgtaggcagagtgctggggacaccaatggcagctgtgggcagggccacccgaatgccaccccatagggcagcgggcccacagcatggaggccctccgtgtttgcttttcccagccctgcattagctgtgctgctcacacctggctgactgtttgcccaaggatttctcccctggaaggagggtggggctggggagggtggcaggcaggtggccggctgcctctgggcactccgtttttctgcagacccacactgcctgcgaatgccacaccaccctgcatccccaaggctgccccagcagtgcccggcctcgcccgcgcagagcatgtgacttggcagtgcctgggcctggcatgcctggcgtgccagggcagcggcagcagcagccggactgtcagtaaggagctggagaggcccccagagccctcctgttggggcactggtcctgggttgtgggggtgacgggatgcatcagtgagacttttgtatggcaggaggcagaggagcacataactgaatctgggagtatttatggacacgtctgcgccttccttttctgcagcagcctgtctgcaggccctcctgcaaggagagcctgtcttgattcaaccagtccctgccctgaccttctcttcaccctctttctgatgagtcagccccaggaacttgaacttggacttctccagcctctgggccagccctggaggcggaagccctggacctgcctccccaacacctgccctcctgagggtgtggcctgcaagcgtccttttctgtcagattcagctcatggccagtgactccttgagcctgtgatcgtggtcctcaggccaaggggaacagattagataattagctgctgatggatctggcatcctagggaagagggagccctttctctcccacagctgggaccccaaagagaggcttgcattagccaggcaaggagccgggtgcctccctccctgcagtcctgcacagccccttccttctcttgctgctgtgggtatctgcctaaggagagctggcccagcatacccacctgggacacacccagagagtgccagcctgaacggcactgccaatagcccgatcctcaggcctttcaccctgcacctccctgctcctccagcaacgagaccccctgcatgtcactcacatgtggccccgggccaggcacttggccacctcacagtgagcgatgctgggaggctggtgttcttgcaatcccactgacaggtgaggaaatctgatttgtgtcatgctttctccagcatcgctcagatgttgttcatcccctttttcccggaaccggggcccaaagaggttgtgacttgcccacacctcttgaatggccaggccccatgtccagcctggattctctgacaccaagccccatgtgttttccactgtgccctgcagtaaacagaagtgctaataaagaagcgtgctaatacataattaatcccacctccatcccttgggccttttctctctcagacgccctgagcaccgcccagacgtgatctcatgtgtcctaccaaggccccagaagagcagagaggaggctgggctctgaggggccatggggactaggagccagcctctccgctgccaggcccagccctactgcatgcctgctgcccgcctctccctctgctctaggtagggaagctgccgaggctcgggcatgtctcaggcacctgctgtcttcctctggtctcgtggattgtacgaacctggaggaggaaagcagccgggattcgatgagcccccatgtggtggggatgtgtgcgcgcaggggcccaaggctctgcttaaagggaaggagtattgctgaggcttgttctagtgccttcctctaaggaaccctcagtatatcttgtttgttctcacattcgagggaagttggcaaagggcagttctgtgtcacagggaagggggtggatgaggaccccgaaaacctgccctttaccgagtctcacccccgagcctgctgaggtcacacagcggcagtcagtggggggttaggttttcttgttttgtttttagagacagggttttgctctgtcacccaggcttcaatgtagttttgcaatcacagctcacagcagcctggaactccccagctcaagtgatcctcctgcttcagcctcctgagtagctaggactacaggcatgtgccaccatgcccagataaatttttttttttttaataaagacaggttccccgtatgttgcccaaactattctcaaactcctggcctcaagtaattctcctgcgtcagctgcctgagtagctgggactataagcatgcaccaccacatctggctaaattaaaaaaaattttttttgtaaaaatgggttcttactagtttcgaactcctggcctcagtgatcctccagcctcggcctcccaaagcattgggattacaggtgtgagcccccacagctagcccatgttaggttctctctctctttctctctctctctgtctttaactctgataattacaagctgaacatgttaggtttcgaacttagttctgacagatttcaaaagtggggatcatcaaagcactgggccatggtgtgcaaattcctggcctctctacctccaggacaatgttggggcccagaagaaagtgggtgagaaagatgatagcaccttaaggctccgagtcttctgtgggattatattcctgagccagaggctgcagacccttataaactgagcattgggggatgggggtaaaagtggatcctagggaaattagagatcatctggtcaaccccctcatcctccagatgaagacactgagtctcttagaagagaagtcatttccccaggtccttccccttctcacttatagccaggccatggctgaggtgccctctgggcccccggttgggagagggcttcagtctcctggctgcatcctgagaacgtagctttctgtgctctttcctggaggtgcgccctccctcccacaggatgctgtacagaggtggacgcaagtcacacggccccagatgcatagggaggtagagggaagccaggcttgtcaatgctagggagccctccagtagcaggaccactcactgcattaccacaggcaaatcacccacagccccttcctgccacagttgcctcatcagtaaaatgaagatgccacatttcctccctgcctcgcccacagcgtggtcgttggtagccagtgaagttgcatatgtgggcagttcaggatagggctttggatcccaggcatggccagcagatggtgtggaaagaggccagggctgggagtcaggagccctgggttctgggtgcagctctgctgtggctcctacgttctcctgtttctgtccttctcaggccgtgctccgaaatggtttctctttcaggcagcagggacgtggtgagctcccccaacctgccaaacctttactcagtgcagggaacctggcaaggaagaaaacaggcgagacccctcccctgagaagccacaccctggtggagggagccagatggtaaacacattcaccagaactttagatggtgagaagtgctgataggaaaactgagtcctatgatgggggcgcttggggtacctaagatttggcaggcaggtcccaggaggggatgtttgagctaggagctgaatgacaggagggagccagccacgcaaagctctgggggtgggggtggggttggggttctctccaggctagaggaggagtgaggacaaaggcgttcggcacgcctggcctgttgcaagaacagagagaaggccagggtgcctgggaggctggtgagggcaggcagaggccaggccacagggctggcaggccaacgtaagagggagagggctttctaagtgtgatgaacagtgtagaatgactggaaatggtgagtgggtagatggaggatggaggaatggatggatggatggatggatggatggatggatggatgaatggattgtaggtgcagctatggggtgatcccttttctccccatcatgagggtcataggcaacactcctgtaacaaaagacaggttaacaagaggaaagcataacaaatgtatttaatcaaagttttacgtgacatgggagccttcagaatgaagatccaaagatccagggaaactccatttttatgcttaagtttgaggaggaatgggcaactatgaagagctatgattggacacaaagagtaagaccccatgggagcagactgagtggggaaacccagcaaggcctgctctcagatccttcttggcctctctgtgctgcattccttccttcagggtatggggcaggattctgagtgggggtcttatgatctactatcaaacaaagtaggtcagagaatttcttttttttttttttttgagatggagtctcactctgtcacccaggctggagtgcaatggcacgatctcggctcatggcacctctgcctcccgggttcaacagattctcctgcctcagcctcccaagcagctgggattacaggcgcgtgccaccatgcccagctaattttttatgtttttgatagagacggggtttcaccatgttggccaggctggtctcgaactcctgacctcaggtgatctgcctgcctcagcctcccaaagtgctgggattacaggcgtgagccactgtgccctgcccgaccaaaggatttctttatggccagctcttacgcagaaaggcaggagaaggctaatacttttaggttttatgggtggctttaggggaaaggagttctggtttctgtgacctgccttgggaaagaggaattctagtttctatggcttgcctctggggagagtgaggggtggggaagagaattctagtttctgtggtttgtgtcgggagagtaagggatagagacaggaaggcaggagatgttcagagaaaagctttgcttctgaggctgtttgtgaggcgttcactttggggtaccattttctgagccccaacatgtggttgggagagtggatgactggcatacagagaccctctttccattcccctcctgtagtaggttgaattaactctgagagctcctctgcgtagtcctattcatggtcgggcccggatggcaggaagagtggggagctgaatgttcaggagaaatgcctcaaaccccctcaagcacatgattgggaaccctcagcggtgggagcagagcccactgactgctcctgagtgggactcctggactgacatcctgacctgccgtgcccgggctcgcctgagctcgggactgggctgagctgagactggggggagggggaggacacagacttcacctgtgttcacagagcccagggctgactcccggagctgttgctctgagggtgggatgggcagccccaggcctccgttctcaaggcgttcctctgggatccagtgccccctctgcccgcccaattgcacgggccagacagctggggtcgtctttgacagcgccagtgttacagcgagcagtaaacatccttaatacctgccctgtctgtccccattttgtctgctgaatttccatctgggccacccacttctcttcaccctcgcacccaccttggcttgtcattcccaggctcagagtccagggcctggccctgccagcctgcctgctttggcctcctctctgctggcctgactctggccttttctccatcctccaggcctccactgtcctcacatccaggccctgctgccgagggtatcctccagtgcttgttccgctctgctctctcctgtggttgcttccctctgctagtccttcagaaacagctccagctcctagttctataggcagcctccccgcctgagcacgtgtcagaggatttttctttgttgtatgtgaaggttcacttgaagtttctttccttctggtctgcaggctccataagggctggcaccatgtcggcttttgtcaccatccacccaatccctggcacatagtaggcactctggtgatttgtggatggatggagaatggctgcatgcactaacttgactttaaccagatttcacctgtgttcacaccacccagggcccaccctcagggctgtttccagccttttctactctgagagcctgcccctgccctaaaccagggactctggaaccaagccctggccatctgtgggtgttggtgtcttcacacctgccgaggccaggaccacctcctgtccttgctcctgggccagcccagcctggggtttgaggcctgggcctgtctgggatctctggaggagggaagggctcactcagaagcgtgctaccaaatggaagaatgaaatcgtcaaggactcatctgagcaactgcagaacagtctaacagggcccctttcgaagtagagtacaccccagggaggcttccagggtggtgacaagtttggaaaccaggctgaatcaagaatcgaggacaaccgtaggactgagaagttgggggcggggaagggactcaggatcaaatggctttggagccttcacccttgagctgggctccagagggcagtgggcatggaggagaatgaatggcagcaggtctcaggctgagccaatggccctgggtgccatgtctctttcgggtcttgggctggccagggctctgctcccagggacctggtgtctgcaccccacccatgaacatgtcgaggtgcaagttggaggaagctctaggtttggaagccatctccctcagtgttggggttttatctgctggccgagggccctgctcgtggttgggggtgggctctaacctgtgaggattttctggtcgtcaggctctgtctaaaacaggcggggggtgcacccaggaggcctcagagcccatgattctaggtcacctcccacaacatccagagacaggagtggtatttatagcagccggcggccactgaaggtggaggagtcagcatgagctgtgacgcaggctgaccccgccgaggtcccctagctctcgctgactcccttaccaccacccccaccccagagtcttcctaggactgggcctgctgaggaagcaggcattatcagattgcctccccaaaccctggaggagacgaggtgccactttctgcctggcaggagccttggcctctgccggtctcaccaggaccttgtctggcttgacagccccagctgggcatcccattagcactgctggtctctctcagacgttgccgtcagctccttcacggaaaggttcatcccctggagttacagcagcttcactgacctcccctgggccagcaggggttagcgggagcctgccttttccccactgcggatagttaggggggccgagggcaccagcccctggttgacagggatgaagccctgccaaactcccgccccctccctgccgtgtcctcgtgaagtgggagtgaagtgccactggggccagaggggctgtgccgagcatgtggccccagctccacctcccaccacaccctgagcaggtcgggaagcagaggccgcagaagtgacagcgtgacaaggctgggcgagtctcttgggaaggaaagtgatgccaaattctggggtcagaggtcgagcagatgggcacttacctacccagaacagagtgggtcagtggccttgctcaggcatgggcaggcagaggctggcacttgtcaggggcctgatggggttcccctcatcgtggaggcctgttctcccctctcctttccagtctctatgttgcccagagcctcctggcctattcccccacaggctgggagagaggcagatggaggccagggtcttcttgggaactacagtgtaatggaggaggtgaggcagacacaccagaagcatgcaggaaagtgggtcacgggcttacctggtcatttgtgggctggtttgccagggctggggctgaaggccagctgggacaggcactgagcaggcctcgcaggctgtggaggccatgtcggggcggagtgcccaaagcaagcggggccatctggagaggaggaaatgcctgggcatggggtgcactcagtggctgagcaggtggaaagacaggagctgggagtgggcgtgcccggccggcagggacagagtcagacaaggtggagggtatgggtgctggtggcagggctgggcagggcggggtaggggtgtggttggtggagagctttatagctaatggttgggagttttaattttatttaaagggcatttaggagtcataataggctcttgagaagggaatttatttatgtatttatttatttatttatttattttattgttttgagactgagtcttgctctattgcccaggctggagtgcagtgacgcagtctcggctcattgcaacctctgcctccctggttcaagcgattctcctgctttagcctcccaagtagctaggactacaggtgccccccaccatgcctggctaatttttgtatttttagtagagatggagtttcgccatgttggccaggctggtctcgatctcctggcctcaagtcatccgcccgcttaggcctcccaaagtgttgggattacaggcgtgagccaccgcgcccgacttgggggttgatttaattaaagctctatgtcaccaatctcctcctctgagccagagcctgctttcaacactttacaacttttttttttttttgagatggagtctcactctgtcgcccaggcttgagtgcagtggcgtgatttcggcgcactgcaagctctgcctgctgggttcacaccattctcctgcctcagcctctcgagtagctgggactacaggctcccgccatcatgcccagctaattttttttgtattttttagtagagatggggtttcaccgtgttagccaggatggtctcgatctcctgacgtcgtgatccacccgcctcggcctcccaaagtgctgggactacaggcgtgagccaccacgcccagcctcacactttacaacttttaactcgctttgtcctcccagccaccccaagagggaggcactgtcatcatcctcatcctattttatagacgaggagagggctgcgttgtatattgaaggtcacaactctgtggccgtttgagtaaatcaaggcactgggaccaaagccgggtccagtcctgtcctccacccggcagcaggggccttctgagcccctgccccttcctggaggccttgtgcttgggtccagctttgccctgcctggggtgatgggaggggatagggaggtctgaaggacagaatagtcagctgtaggcccaggtctctaagcttctgggtcagtgacttttttctgtggccccttttgccctcctggctcaggcgaggggaggaaatgctgtgatcattgtgtgagctcaggcacctgtatgtagcccccaggctctctccttggccattctgcaagtaaaactctaaaagtccagactagaatggacctgagagcatatcctgcttagtggctttcaaactttgtttgtttgtttgtttgtttgttttttgagacagagtctagttctgtcacctagagctattttgggaggccaaggctggctggagtgcaatgtcgcaatcttcgctcactgcaacctccacctcccggttcaagcaattatcctgccatagcctcccaagtagctgggattacaggcatgcaccaccacgccccgctaattttttgtagagacggggtttcaccatgttggctaggctggtctcgaactcctgacctcaggtgatccagagcagctgaaagctgctgtggttgacattgcctgcaagcccactgaagcctgcccactatggccacctcccctcatctggggtccctgagggcttctggaaacccactgaagagcactgagatccccctcattgagcacagaaggagaggagggtgacagagggaggggacggggctgcagcctgtgtgccattggtggtggcaggtgccacctccctctccagtctctgtgggggcaggggatgttggcccttcctgtcacatactagagctctgcagaacctcttcccctggggaaagagctcctgttacgaagtcacttgatccctgcttgcttccgagatgcccggggtacagtcgaagggaaacccaatagcccagttggccagcctgtgccctagatggccatgcagcttagggaggtggcccacgaagcctccccacctttgagcagcaggcacccacaccagccagaccccgagggccaacccacagcctgaggagaggaggcagcaggaccagggctcagggtaggctgggcaagggggcgggggccccaagaggggaggcatcaggctaggtgtgcccacttagcatatcattaacagcttcattagggggcccctaatgaagtggaaggtactaattcttcactgaggcgttgccagcacccagacggagtctcctctcaaggaagttctgagaagccagagcgctgggattcgtgctgggagctgatgaactgcctggcaggggggccatctggggagtgaggtcccagcaagtggctcctaggagagggggtgactctggggggaggagcagagggtggggccagtggaaagctggaagggcagatgggcttaaagggaggggggaccgctacctctcagggcatcctgcgtttgagctgggaaggggcctgcaatgagacaccctgaaactcaaacatgcaagctgatagatgcggggcatcctggcaggatctcaggctttggagtgttctagagtcttgtggccttgggcgagaactctgtggctcaagctgtcccaggggtgttgggtcccctctccctgggtggttgtggattaaaggaggcagtgccagtgcggccgtgctgggctcctaggagttggagctctccctttccaagaaggcaagtcagaggattatgcaggctggaagggtgagggcaggtgtgggtcagcctgctcacctgtctgtttgggaagattgacttagatcgcggagagttattgcccctgccatgcaaggtgaggtaaaggttctgcgcacactggggagacatggttactaaatcacaatgatggcagctcctgttttctaagagctgagcactttatgtgcgttatttcgttaactcctcatgactcactcactatgaagtgagtaccttcattattccatcttacagatgaggagactgacgctcagtgaagtgacagtcatagacaactagaagtgatggaactaagattcaaattcgggctgccctgctctggggccagaaggcaggcctcggtcagctcattggatggccaccccctccaagtcgatgcctttgagagagtcgcgttcccgggagagtggggtaaagacgtgttagggcatgaggggactgaccaagaagaccaccggggcaggtagaaaggacgaaaaccacagacacccttccccacagacaggcaggagaaaacagcctggtgccacccagtgtggggcggtgtcggcctttgcgtgagggcttggagatccaggctgcccggccgcacccatcacagaggccagcagaacccgcctgtctgggcctctccagaggggatgtggacgtgtgggacaagggcttgttctgagtttcagaaaaatgaataatctccaaggaagaatccagaagccagacctggtctggccagagcctgggggactccttccactgttggaaaacattgtcggagcacaggactgagtgggctctgatgtgaatccccctgggaagagaggtcagaggaaggctgggggcaggaggagggcccagcctggtcgccagggaagggtgctgctgccctcctggccctcacttcccgctccccagcagccagccatctttccaaaataaccagcaggaaacgaaaggcctcaattgattcccagggagttggctggtgtcagtagcagggctggtggcagatggcaaattctgctcattgtggatgagtagaaaataattagcgtgagaacgagtagctggagccttggtaataaatggagccctggtgaagccttctggggagaggcctggagcacaggccctgcaacctcaggcctggctctgccgctgaagagctgagtggccttgggcaacttatttagcctctctgggcctccatttcttcatccataatacagggcataagaggttgttaaaaggattacattaaaggaggtaatttttgtgaactgcttgttaaagtaaccagcatgtagtaaatgctatataagagtttgtttttaaataaacacgatcgagtaattgttggaactatttctgggtccggcccaggctggcattgcccccaagtcactggagcttctctttccgtcctcctccctgaactctgtgcccagctccctgactgctgttttataggggaggggtctctggccaagaagcacgaggagggcacagagagaacacagcaggtagacctggcttcagagcctgacttggacactcacttgctagcttctttaaattcttggagcctcagtttcccgatccatgacatgcgaacagctagacccacccctggggttgtagtgaggatggttatgtggctggcacatggtgaggggtggaggaggtgcctcctctggtccttccaggccatcctgggggagagtgggaaaggcgtttgttagcctaagaccctgggcggcgggtaggaggggacaaatgtcagtggcctcccactcctgcccctggctgcacaaggcacactgttttcatccctaggcctgggcgtgtgaggacctatctcatgctgaaatctggccccagtcctgggcaggctccgctctgccttctgctctagcgcagctgatgtgtgaaaagcgacagctttcaggcccctaacttgggttgcacacacccaggtacaggctggtggcgcacgtggcccccagcccacacgtgctttctctccgtcgtctcccttgtcacctctcccctcctgtgctttcagaggccagcctctcggccactgggaagaaggggaaggtactgtagccccgggagcctggggtgggacctgtgggtcctactgtctctgtgtttgtgacaataaggagtcagactgacaggcagagagggtatttttttcttgcaagtagttcaaggaagctacttgaaatcccagctctgcgatgtcctcgtggagggatcttcgtgcaaaccattttgcctctctgagccttggtttcttcatctgtaaagttggggtaataccctgtggcctgatgaggctggaggtggatgacacatagtgtttctagtgccttgctctctcccgactccacagcctgctccgtggaattcccctgggctcagttttcctcatctgcagaatgggtcccgtgctatcccacatgattgtgagtctgaagctagatgaagacccagagagctcctcagtctgtaagaagaggcttagagccagcttttgagttcagaaacaggcatttagctgaatcctgcttctcagaaacagcatgcagaggtaaagacctgggttctgggcctaggctgtgtggctgtgggcaagtcacttcagctcatctgtcaaataaggggaagggtagtacctacctcacagaactgttatgaggactaggtgagttcatgtttgtaaagggcatagatgtgcgccgagaccttgtaggcaattcataaatgttaggagaaccgaagcagcccagtccccaacttataggtggctgagatcattctgtccctgtcactacccaggatcctggagcctgcagtttcaccagtgcagagaggttaactcgctaccacagtcctgcagccacagtgaacagctggaatctcaccacgaccaaagcctgtgctaaagagagcaggacctgtctgccagcccagcgaggccagacagcgacctgctggtgagcccaccctagctggggtggagcctctgaacacaacgcctctgctggggggcgggccaccagtgtcctgcggggcaccactggggggcccagcctcactgtgctgagtcccgcagatcagatgcccacccccagaccagataagctccagtgcccaacaaggcacattcaaaatcggatggaccacgagagcatagcaggcagtaggcatcagttcctctccactattttggaccaccttccaatttcaaagccctttcacataggaatcccattcgtcatggaaatgggagtcctgggctctcccttcaggacaccaagggtcaaaaaaccctgcagagcgaaaaagagcccttacaaacttgccagtttccacatttactttggcaaccaggaagtgtggcgtccagtgctagttttacatatagcaaccgtgggggcccttatgtctcacatgtgtgcaatggactcatcctcccggccctcaattttgatttactggggcctagaggggttgggactttctgtcctggggacactgctcttcattcagcaccaggcagctctaggatgtggctggacctggtccccatcaccagcccccagaggcaggagtaaaatgggggcccagggaaggtggctctctggatctgtctgagagtctcctctctgtcaccacagctgctgcagagcaacagggactccaccgctggaggcaggagagccagccgcaggtgactgaagtaggcacatggttgatgcctccctgcaggtttatctcctgtgagggagcttctgtggatgttgctggcttctaggagggttaggcatcttcaagatcgtgaaagagaggatctcagcccaggctccctgtggtgacacgctactaatgctgttgtcactggggagtttgagtggggtatgtagtgaggtagaagggagcaggctggcttgggggcttgggttgtgtgtccagcacctggcagtgacgctgctgggatggatatcacgggaagagctagggcctctgtgttctttctgaacctcagtttcctcgcccatgaaaggggacagtgggactgttctgagactccttttaactctgacctttgttaggtgtgggctttggatggcagcaggaatgacctgcgcctcctgcctgcctggcctcttgatcctcggatggtgtcaggcagtctctgcatctcagtctcattcttcagtagtaatagtaatggcagtggcagcatttgctgagcagttaccagatgacaggcgctgtttgaagtgttgactgatttaaccctcctgataattcggaggtaggtactcttcttatccctggtttagaagtgaggagactgaagcacagagaggttaagtaccttgtccaaggtcacacagccagtaagtggcagagccaagactcagatgcagcctgttttagagtgcagggtcttaaccaccccttgcacacactgtggaatgagagcgacactgcgaccctgtgttactgctgtgaggactgaagccggttagtccaggacttgggacacagaaggtgctcagctaatgtcagatggatccctatggctggacctggctgtcatcccctccttcaggcacaacctctatcccatccccaggccaatgaccaaagccatctctggccagatgggaaatctcatgggctggaggtggcactcgtgggggttcccaagctcattgtccagttccctgtggacactccagagggctgagccagtaccttcttcccccccatccccctgggagctcttggagccccatctgctgggagtcttgctgccaagggactctgctccttaaaatctgctcccagggccaagcccacagggtaccttaggacgagggggcgaggcccagcctggggtgcttttaccagcagcaccggagcactcatggtgggggcaggctcctcggtcagggcttctgtttgctcactccagccctttctgaccagctgggcaccagcagcaccttccagaccccagcacccagtcacaggtcacatcacaggaggtccccacaaagcccctcaggtgtctgctaatgcaacagcagccatcagcagatccttggggtgtgcaggacctgtgcagagtcctgtagtgacatcaccccagtctgttctgaccacagccttgagagggatgttgttagccccattttacaagagaagaaactgaggtcccagaacagttcatctagccagaggggggggagagggttctccctgagctgtcagggaagacactggggtgggaacccagcctgacagtcaggaagggagggacgtttccccagaagggaagggtgtgagctcagagggggaaggagccactgtctcagcccttgtgactgggaggggagctgtgctgaggaggccatggggtgggactgaggtgctggagccaggcactgcagctggcacccagaggtgtggcgatgggtactgtgagaccctggccccggggactgttgagctggggtggggatgggcagcaaggagtcagcaggttaaccgtaacacagtgtgaccagggccatgctgggggaaggggtctagggttcccataagggagcagcctgtttcccaggaggagagtgggttgcatgagggctgtcagggagggcttcaaagaggaggtgacttttagctgacctagagagatgagttggatttcacccatcagaactggagtaagcaaagcatggacccttccagtgatgtgtttctggggagcagcatgtttggggtgtcgagaaagaaggatgtggcagtgtaagaaggtgctggagagcctctccagccagaggatttgtcagctgagggtgggctctgtgctggagtctgtctgcaccaggatcgctttctgctcaggtgataagggaatgcgtggattcagagagggcgaggcatatgcctgaggttgcaccgcctgtcgctgccgcccgaggggcttggactttgtcctgcaggccatggggagccaggaaggtttttaaagtagggggcagcatatgcatttttaaaaagagtttgcatttttagaaagaggaactcccagaatggttagtacttagtccaggggcctgaatcaccagcaggaaaattgggctgtgtgggtgggggaagaaggaggcttccttgggctgcttaagtcattccatccatgtgagaggggtcctggcaccccattcacacttgcctgtgctgggggtccaaccagaggcaggaggagcccccagcagtgcccctgtggcccctgctggaaggtatgccgtgcctgccctggaagccccactggtgtgggataggaagggcaggcagcgcctacccccgccccactgtggctgttagaggggaggaccctatgccccaggggaggagagccagaagaggtgctttgtggcagccccagaccaggaagtagcctctgccctccccgctcctgagacatttcctccagatgaaatcacatccccagcaggggaacaggcccttattgtgatgggccggggtctctagagaaagggcaccattcaaggcccttaaaaatagccccaagagatgtatgaattggcctggagagtggtgcagcccacccccaacccttatgcagcacaggccctgccacccccaccccagaccttgacttgttggtgaccagccggagattccaccagcccaggcgggaggggtggctggtccagcaaggggttccttgcactccctccgcctcgcccgccccagctaagacagctagagcctctgcagacctctcatgtgattctcaccaggactttaggaggtagggataatcgacattttacaaatcgacattttacagttgaggaaactgaggcacgactaataagtcacacagtgggtacgtggtagagcccaggttcaaaaccagccagcctggcacttgtgtcccagcctctgtgcctcggattctatggtggtgggccggccactggtgcaggcctgtcactgggtacccagcagggtcggcccccaggagccccgcctcatactctaggtaggtactgctgttgaccatggcaattggcctcaggctggtcaccctgaggtgggggcagtggttaccactggtcatatccctccagcgtcttgacagtccttcagccacctcacctctgcagggcccagggccaggttcggctcactccttccagcctgagagctgaagcgagcgggcattgttcgggcagaggaggggagtgcagagtgagtgtgtgtgttgggtggatggtgtgtgatctcgaggagtgttagctatcctgggttccatgggtccaagggtgggagtgagaggagggacctcccagggtgactgagaggggccatccatggggtggacctgagaaggagatattcttggctgctggcagaggcaggcctgggggcaggctgggtagggccagaccctagccctccagccagcccctctgggacagcactgctccctcctcccctggtctggccagatcagagcaggatgcggctctacagcacctgcgggggcgtactgcccccccagcctctagattcattccatttcattctgttccattcatgtgaggggctcctggcagccccgacagccccctgagcccgacccagcgctgcaccttaccctctgtgagctacttggagacagggagggggcggcaataccagctgttggcagctctgttctgccccagcccaactgccacccacggtgccccagccccccctcctgtcctatcgtgtccaaccctaatctgaagctggtgctgtcagccacatgtcacaggcactgctgacgccccggacccctgcagtccacagaccaccccccacccccaaagcccagccaccccaccaccatgctccctcactctccacccttctccctgcctcccagaagctgagctccgactcctccttggagagagagtgggatgatgtcacttcctgagggtggggggaggagtaggcacgaccccggcaggctagcccgccagcccgccaggccacagctcgccaagtggctgcaccggggatagggaggcgggccgggcggacatgcgggctggccacctggccccacgccctctcgcccaccctgggggctatgcccactggccaagggagacttggctgcttcctccccgaatgatgccgggctcctcggacacacattttccctggagccgccactggggagaggaggatctgccgcctgccccggaccaggtgccatgtaagcctctactggcccccggcgggggacagctgcccaccaacttggtccccagccccctgcagcagtttagtgcagagctaccctggagccctttatgggtatctctggggacctagctccctgtggggtcacctcccacccatgctgcttcctttctctttgggatgctaaggagtgagggccctgagttcctgggcactctttcctgagcttgcttggggctgatttgaattcagctacttcagagagttgaaaatccagctggaaaagctgcatggctcagggtgggcttgggaggtatggttgccaggaggggtgtgaccctgcagggcttaccccatccttccagcagtgtggggtggaaggtgtcccaagccctactcctgaccctgcacctcaaccgtgctcttccctccctggaggcatagctgtggtggggacttctgtctgatgggttcaaaaccaagtcatagagcacgctcttggcttccagcaaagcaggaaactgaagccttcattcaagaaatacttactgagcacctgctctatgccaggcactcctcaccttccatgtttgtcagtcccagctgccaaccatacagggtcccttgcccccaccttcccaaggccttcagccttcctcctgccctgctgggctttgtgctgttgggtgggcttgttcttggtctgggaagcccctcccttgactccaaggacagtgtgcactgggccaggtctaaagattatagggtttgagggctgggctgagggtcccactgatcccatgaaggaggaaacggggtctttaatagagctcaacagtgactgctggggtaaccccaggtagaagccgatccctagtggccagtaccagtctcgggggacaggagagactccagggggaaggctgaagtctgtgtcctgctgctaaggtcctttgtgttggctcctgcccggaggtgggtcagcacttccagtggccagctccaaaaatgcctgtgcttctggccacaccggggactggtcccgtggcccaaggaatgcagtggccctgggtgccttcacctcctcaggcagctataaggtcctctgctttctttcaggaggtgagcaccaggcccactgagcctctgcagagccaccagccatgcccgggatcgtggtgttccggcggcgctggtctgtgggcagtgatgacctcgtcctaccggccatcttcctctttctcctgcataccacctggtgagtccccaggcccggggccacaggcctgggtttggagagaaaggtctggaaggacgctttctggccatttgttcctccctgcttgggcccaagtcccaaccctgtcatgcccccagctgcccggaggaggtgcctgaaacatctagccccttagggcaatgacacccctgctaccattgctggacctgaccccaacactggggggagttgctgctactgtctccccatggctgaccctgagtcttttactggccgcccatgcccttctaggcattcgatgccaggtggacaatggtcttatggaggaggtgcctgctgccagccctccttccactgaatctgggctggggaagggcctgcctgctagtagcatctcgaggtacaggggccacctggccttgctcacacgggcgttcctgtgacaggtttgtgatcctgtccgtggtgctcttcggcctggtctataacccgcacgaggcctgctccctgaacctggtggaccacggccgcggctacctgggcatcctgctgagctgcatgatcgctgagatggccatcatctggctgagcatgcgcgggggcatcctctacacggagccccgtgactccatgcagtacgtgctctacgtgcgcctgggtaagggccacccaccctggggtgctgccccagacaactcccacctctccattcactcagccagtatttactgcgcacatgttgcgagccaggccctgttttagcactggggtacagcagtgaactaaggccttctgtagcttacattctagactaggggccagcaaactgcagcctgagggccaaatccagcctgctgtatgtgttattaaataaggttttaggctgggtgtggtggctcatgcctgtaatcccagcactttgggaggccgaggcaggtggatcacaaggtcaggagttcgagaccagcctggcgaacatggggaaaccccgtctctactaaaaatacaaaaattagccaggtgtggtggcacacgcctgtaatcccagctacttgggaggctgacgcaggagaatcacttgaacccaggaggcagaggttgcagtgagccgagattgcgccactgcactccagcctgggtgacagagcaagtctccatctcaaaaaaaaagaaaataaggttttattggcacatatccattcagtaaggtattgtctccagctgctttgcccctacagcagccgagttgagtagttactacagcgactgtaggactcccagagtccaagatatttgctctctggccctttacaggaaaaggtgctgaccccatcctcaaccatgtgcatctcttcaaagcatatcttccttgtgatccttctcaaaacaggccttctgcttcctgggaaccccctcaggagtctgggccagctccccagaggaccagcctgtgtcctcttcttgggcttaggttgcagccccttctggtcatttgtagtgaacactgctcttgtgcttctgtgcactgggctaggccctttttcctgtgttaactcacagggagtgggtgttattggtctccgtttatagatgaggaaactggggcccaggcctagctctcacacaactagtaagcgtgtaaatgtcggagctgggatttgaacccacgctgtctggctccaaagtctggtctctgagctgccacactgctgcccgtgcagctggggctttccaggctgcccccatgaggccagcagatctccttctcagccaccactccatacccctcccctccagtctcagcccctgaggggcctgagctggatgcagaccagctgctgggcccttcctctctcctccatcaggttccagaggcctcttgctgggaaatagtttccatgaagtgaacacgctctcatctaatttttgcacagtcctatgacataaatgttgtcactcccattttacagatgaggaaatggaggctcagagagattaggaaacttgcctaagatgtgtctgattccacagttcagacatgattctgagatcctgatagaatgaggaaatgggccaggcgcggtggctcatgcctgtaatcccagcactttgggaggccgaggcgggtggaccacttgaggtcaggagttcaagaccagcctggccaacatgacgaaaccccgtctctactaaaaatacaaaaattagctgggcctggtggtgggtgcgtgtaatcccatctaccctagggactgaagcaggagaatctcttgaacccaggaggcagaggttgcagtgagtcaagatcacaccattgcactccagcctggacaacaagagcaaaactccatcagggatgccccggggacttgagagcacagaagctaggagaggtggtgggcacattgcaagcggtcattcaggggccaacaggaccaaatggtgacaggacgggcttggggcctgggaggcggggggtggggggtctgctaatggcccgctgcctctgcctttgctactgagctggctgaaagcccagcgataggaaaggccaggccggggttctaggcccttccctggcatgcaagtggcagccatccttcagccaggcctgctctccttgcagccatcctggtgatcgagttcatctacgccatcgtgggcatcgtctggctcactcagtactacacctcctgcaacgacctcactgccaagaatgtcaccctcggtacgtctgggtgaggcctgctggagcctcagcagccccgggggcacaggggacgagatcagtttagagaggaagaagcttgggcattgccagagggcagtgccttctgtgggggcaccagcaggttggctgggcgagactgcttccctcacccttgaggcctgccagctacctggtctggggtgggctgcagcaggcacagagctgctcaggtcaagccgaggctcctcagcacctccttggaaacccacagagctgcctgctctgagccaagagtggcccttggggttgtgggtgggcaatagggtggccacgtatgtggccagagactgggaccaggggctttggagcctggcttttgtccccagaagcatttggggttagggaggctccaatgtccctttcttcagagcgggtgagccagagaggtgtccccagcgcccctacctaatgcctcccactgctgcccgcaggaatggttgtctgcaactgggtagtcatcctcagtgtgtgcatcactgtcctctgcgtcttcgaccccacgggccgcacctttgtcaagctgagagccaccaagaggaggcagcgtaacctgcggacctacaacctgcggtcagtcagcgggctgggtgggcagtcccagggtgggctttgctgtctggtgagcagaggtctccattcttcagaaggctaccccaggcctcccagactgcatgccaacctcgtgtgagccgtgggcattagtcaaagggcttaactgctccctgcctcagtttccttgtctataaagtgggaataataacaattcttgtctcatgttgttgtgagatttaactgagctaatacctgcagagtgactaacacagtgctcacactgggtaagtgctcggttaatagtagttgttgtcatcattgtccactgctgataataacaatggtaataacagtgaagccaagcattgcgtgtagtaagttacaagtccaccacacagctgtcaacttccccataatatgggtggagaaactgaggtacagagagatgatgggacttgcctgaggttacacagctagaaaatggtaaggctgggaactagcccaggcagtctggccttagagtcctcgcttaactagctattaaattaggctaggctgcctctaggattcagagattgggagaggcaagtcaaggaaagcttcctagagggggtgagttttgcatgatgttttaaagatgggggaaagtgtgccatggcagacaaaatgagggagggcatccaggtagtgtcacaataatttgtttgttgaaagaaaaagagaggggcttccagggtgggtcccagtacctcctgttaatggggcttctacagtgcattatgtaaggagctccccatgccaagccctttacgcaattcatccatttaatccctttgtgaaccccggcatggttgtgagatccattctacagatgaggaatccaagtcccagagagggcaggtcacctgccgtgggtcttgctgctggggtgcagaactggcaccacacctgcagcccagagcagctggctcaagcacctggggagcaggctgtctggacccccgctgcccggcaggaattctcaccgtcccaccctcctgcactgctgtgttcggctccccgtggaccttccacgtcagctcagcactgcagccagagccacacccgtgcctgctgtggccacgtcccagcccaaaatgtcaggtctgggagccaaggccccaaagcccatattccctcccagcccagctggccaccaccacccatcccacagtgctctgggaaccctgcttggccagcacactgtcccttcatgccccagaaggtgggacattggtttaggatgtacagctgtccaagtccctaagagccagcaggtccccagagtagcaattccctgcacccttccctacctgcctcccgtagccctggaagaccctgttgccctccttctccttgtggccatttgccttatgaagccagggttggagagcgggaagcggtccttagacacacggaggagccaagaggctcaaaaagggcctggcctgtcactacagattgatgttaagtgccttgaatgcatatgagggccacccttgccttcctctcctgaccacccagcatcaggcttttaaggggccgcacatggcacaaaagcaagctagccccttcttgctcggtttggaggtctgcacttttaatgttggatctgttatctttatgctcaacacactgactgcagacatccagcctaggaggaacctctgtgaataactggcccattgctctgcctttgggtacagactcctggagaccctgattctccatctgagcagccagacccactggggatggggttggggggtgagaatagacaagggcaaccatgtgggtgaggggtagagccctctccctacctaggtatcagatccaaggaattgggaaatgcagagccttactcagccccatagatttcctgtaagtagagtatgtaagtatgtaagtgtctgaaatcctttctggggaaaagcaggtctttctggaaggtctgttccaggccttagaatgagacgacagggaggcccaacaccctgctgacctcccagggtttgagcctttggacacctgagctgcagggtagcccccacttagggctcccagctctgaagccccagagcctgcctgtgttcagtcttccaaaagccaaggagcctctcaactgctccccacctctctcttccacccacccacccttggccaacggcacacaccatcttaggctagcaggagtctgtcagggagggcccctgctggccagcagccaggccactggccaccagctctggcagggcctgggccctgttctcccccagaacccactgcgggaaccctttggtagggtcctgggaacagcctgccctgtttccataacgtctgggtcccagctcttctggtccagccctctgacctcacacataccgcctctcctgctttgcaggcaccgcttagaggagggtcaagccaccagctggtcgcgccggctcaaagtgttcctctgctgcacgcggacgaaggactcccagtcagtaagtactgggaggtcgctcccctctggctcacatcctgtggtcaggtgattaaggggctgttggctcctttggcaaagcaggatggggcagggctggtgggaaggagctgggtttccagcgtgagcaagtatggcctgctcacacagggcctgttattcactgagccactcgctccagcacgcaggaccacgtccacttgctttgtcaagggaacagaaagctgtgaagactgcatcaactcccttggaacttatactctagtttaaggagaagaaatatgcaaagtcagggtgacctgaagacaaagaaaagtagcgtttcaccagcagcaaattaatcaagaaggcctggcaaagccgataggcgtttagcacggtcctagatggggacacatagccttcagcacctgggagctcagaggagtgaccagagggccggacttaatgccagggcactgcagaaggaagacagggccagctgggggcggcccccaaggggagggaagggaggcaggccccgggatcatccaggggtgccccgcagcgggcagggaccttagagatcatctagtcccacccctcattttacagatcaggcagctgaggcccagagaggtggagtgacttgctcagcgtcccacagctagttagtagcagagccagtgaggtcaggagaccactcctccctgaggcagacagcaaagtgccttccacggaagccaccgggaagcctcgagtggctcctgcccaccagcgtcccctggtgagccgtagagtgagtaatcaagtgtaagaaagcccccgaggttccctggtgggcggggagcacccccttgggtctctctggggcggtctgaggggtctgggctgcaaggcaggccatgcagagggcagagagccggcccctggcggatggaggctggggctgctgtgtggagggcacgcctgcccctctgggtgcacgggcagagctggggctgttgtcagagtctggggaaaagatagcacatcacagcagagccccacggcaaaggtcctgttagacactgatggcctcagggggcaggtctggtcccaagcatgttttgatcagcgtgtgttgtgttgcttacacattttaattggatgccagcatttaaaaatcaggggtatttccataaacttctgtatttctgaatctggtgaagtgggccctggagggcctccggtcagctggagccgagcagtatctggctccgtttggctccattcggcatttgaatttgcagcccttgatttagtcacttacaagtgccaaacactcaggggcgagacccagtgagacagacttcattgccatgtggttgttcccacctcagcgtctcctaacaggttagggaagaggctctgggctgcagcctggggccaggaagggaagactaagagggcaccagccagcagggctcgcctcctgccctgaggcccagacatgcactgtcttcaggccaagggcctggagagaagccatgggggaccactgggccagagagtacacccccttctagggcacattgtgggggtcactgagccagcagcctgtgggtagctgggggaggggccctgagacctggcaggctccacagaggccttacgagggacttccaaggtcccagctggtgggtcagaggcagccaggagcttagtttggtttctgtgctggagagaatggctagaggagaaatgagccagagccacccggccttgattctagcgtctgggaaagcaaaaaggagtggctcaagttggcgcctgctcttggtagacagtgggcaccatgcgaattccaaggagaggagagggctgggtggctactgccaggtctaggagccctgggcagggccctcagggtcacagggccacatggggtcaggctcagtgggcgctgtggaggtgctggggagaacctgtccaggggaccccgagcagacacctgcttctgcagcctcccagccctgggggatttactcctggcctctcgtcctctctcctgctcccctgccactgcctcctgccttcctggacctcgtaggatgcctactcagaaatcgcctacctctttgcggagttcttccgggaccttgacattgtgccatccgacatcattgctggcctggtgctgctccggcagcggcagcgggccaagcgcaacgccgtgctggacgaggtgagcaccaccagccccttctccaggtcacctctccacaccacccttctttcaggccccttccctgtggcccctgcagcggagggctcggctcccacgcagctccccagtgaccacgcactctcttggaccctggaggtcacctttacctctggctccccctgccttcctgagcttgtccttcggccaggctttccgtgactactactctagggactttctgggtcgtgcatggctgcctctggggctggccctcaaaggacttctaaccacaggcttagtggacgtggtgagctcccgagtcggtcttctgcgtggccgctccgcccaccccacatccccaccagcacaccaaccccagttagggtttctcagtgtctcatacaaaatacctttcgcctgctgtgggccaggaatgtcctcaggggcttgatgttttgggtagaaggggagcatctggaaatatggggaaacctcagattttggaaaagtggctgaatcttggaagaactagaagctgcatgctcgtttgggcttctcggcctttgggaagcaggcggacgccagggcctgggccccctttcccagccatgcagccgggcctgggccagtgattgtccttcttcacctgccggtcttacaggcaaacaatgacatcttggccttcctgtctgggatgccggtgaccagaaacaccaagtacctcgacctcaagaattcagtgagtcagacatcaactctcaccccaccccgtccccatccctcccactctgccacaatgacctaagcaaactcctcccagctgcccttgcagtgccagccacattgcccctgcccggtctccccccggctctccagagagcctctctgctcagatcatgcccctcacgagaaccacccacttcacaccggttcgacagacaaatcccctgaattcctttaccaagttcagaagtgtctggtcctggcctcttgagatgacagagcactttaccagggtgagctgctagcatttttgctgctgctgctgctgttaatgaaacgcaatgggcgtagtacttggtttccaagcttttttagtagtggaaccttttctcaatcgcctttcgtagaaatccagtgtgtaatagggaaaggtggtgccagtaacatggtgggagaaccccagcccagggcccagcacacagcccagggcccagtacagcccagggcccagtacagcccaggctgaaaccacagctggcagccgggagaaacaggccctgcctcaggaagcaaatggctggagcgtgcatctgctctgatgcctgtcgctgcgacctccagcaggcccctcatcccctctgagctggatcctgaatctgtgaaatgacactaggcacaccttctaccagagctgtgctgagaggacacgagccattcccatcacagtgccaggaagcctcggtgccagccaggatgctgatggaaaggattccgtctcttagaaatctcagtcctttaggccacgtgtgctgccttgtgcctgcaatcccagcactttgggaggccgaggtgggaggattgcttgaggccaggagtttgagaccagcctgggcaacatagtgagaccctgtctctacaaaaaaaaaaaaaattagccaagcatggtggcacatgcctgtgaccccagctacttgggaggctgaggtaggaggattgcttgagcccaggagatcagggctgcagtgagctatgattgccactgcactccagctgcactgtcccttaaaaagaagaaaaaaaaaaaaccaacactcagtcctctagaaaagcctcagtcctccctgcctgtccctactccccactaaagcaggcatttgtatcctctctaaaaatagccacatccatagtaagtgccccaaaccagcccatttctgcttgccaggctctgccctggctgttctcaccaccttctccctcccactcctcacagggagcggggagggcaggcagctgtgactcccatcaagtgactcccatcgaggtgccagggtcacacctgccacctggcagaggctgccagggcccaccccgcccccagggctgcagggagcttctgacagggagaggataattacctctccactctcgttcctgaagagcagctgagctggccagggatgtttccacccctccgggccctgatcaaggtgccacctatttcacttcacaaggtgactaaccaccctccttaacttttacaaggtgactaattccctctcccggtgcctggggcactcgggaaagactggaagctggcagacactttgctggggcacccctgcctcttcctccctccaccccagcagccaataacctcctcagcatcaacagtggctgctgggcctcagacacactggctttcaaactggtgcctttctcccaagagatcccagtctcccaccaacgcagcccctgcccggagccctgggagcctgcagctggctgagtcaagttgaaggctcccaatatttgcagtcaaagaacccaagggccagagatttggtgattggtctcctggcctagcgtggctgccctgttgcccaaggcccacacacgccgcccagctggagggctggggcctctcagggctacattttcccagcatcaagggcccttctcagggctgattgccgaggtggggggattactactcacatccctcaactcttcccttctctggaaaacaggcaaggaaatggaccaagtgattttctgtccccaaatcattaattctgagactggagcaacaggacaggtctctgaggattcgtgtcctggttgcatggagataattagggaaatgcaattatcacctggaggagtgtccttcctccaaggcctgggccccacacctcaacaggggaccagcaacccctccctgccaggggttgggtccgcaggctcccaccctggggaactgctgggccctgaggctgtaggcaggaagggcaggaggtgaccgccctctgcctcctctcttctagcaagagatgctccgctacaaagaggtctgctactacatgctctttgccctggctgcctacgggtggcccatgtacctgatgcggaagcccgcctgcggcctctgccaactggctcggtcctgctcgtgagtacccctgtcccatcccccagcgattgcacctctcctcccgggtggtgtgtgaggaagggctaccgggctgcgcctactgctttgccctgaatggcttcttttctacaccttctctgggcctcaacctttctagttctgtgttatccctgagcagtgaagttgtaggcttcggagtcacacagttatgggttcgaatccagatgttgtcacttgcagcctggggcaagtgggtccacctctctgagcctcagtttctttatctgcgaagtggagatgttgatacatacctcgtggaattttttggagagggctagatgagatattgcataacacccacactgctgcctcccctccccttctggcgttctctctctgccccctcagccattcccttctgcccacatcttcccttctctcggctcccctcatgtgctctgcctttctagaagaaaggactttcctagtagagaggcccaatccatagaggtctttgaaaaggcaccaagaaggcctgttagttaaggctccaaccttcttcataggatctaggaaaggccttagccccagacctggcctgcagcctagctctgcgctcagcccaccgcttgggggctgggtggactctgcattcctaagtgggccagagaagggcgcctgctccaggaggaacccctccctgtcctgggtgtctccgccctcagctcatgccaggcagaaggaggacagttccctgggctcccgttctggaaaggctggcatgctgggcagcagcttctttccttgacacccctgcccttgggacccacagcagccacacccactctgcagcgccctccctgtcctcagaaagctgggtggctctcggggccttattctcaccatccctccagcgactgatcagagaggactagagcacctcatgcccccttcccatctttgtcagctgcatgtgcctggcattcttgcctgcatccctgggagtcccagctgtggcagagaactcttcaaaatgagcaccaggctccattactcactggtggtgtggggacagctcttagagcctttgtttcctaaactgtaacaggtggtatctgtcctgcctgcccatagggtgtttcagaacccagggtatcactggcaggcagggctctctggtgctctgcagacaggaggggtgctggcatttgtattaggtgccttagtgttgcagagagagcagagtccctagacctcatgagggcccagccaggcccctgcctggaagaaccaggtgcctgtggggcagagagaggcaggcctgcagcccagggtgttgggaggaggccagagtccagtgccccagcctgtccataacagcctggccagagggagaagggctgcccatctgcctcgggcccaggcctctcccctggcagcagttctcagcccatgcagagcacagcgagccaggcctgcttctggcttggccctagccctgccctggatgagccccagggccctcccatccggggtgctggccctgctcccctgactggtcctcctggcccacacatcactgactcagaggcagccctgtcaccggagaagcgaggagccactcgttattaagaacctattataggccagaccatttctgcatcttggacccttgatctcacaccagccttgtgaagtagctgtcaccacctgctcttacagaagaggaaactgaggcttagaatggctgagtgacctccaggcccttgcggtcaggaagtgatacagcaagggttcaaactcaagcctccagtctccaaaggccacactgttacagcctcatgctcagctgaggttggagagggaacagctgccgagcacaggagctcagcccctagaccctggcccatcaccacttgacctgcagtgtgggggaccatgctctcccattgtacatcggctttgtccccccagcaagcactgtggctttctcagcaaagtctctccccattggaaagtgtgtaatagtcactcaggtgatgctctgagtgaagacaaacctcctagcatcaccagaatccaagcttcttaataaaatctcagctgtcatcccgtgacagctggcaggcccagtcacgtgggctccagcgtctggtgccttagcagttggatgctggctccctctggtggcctgaggtgccgctgcacctagctgggtgcccagctcccaggctgcctcattcatttctgtggggaggctactgtgtacctggccctgtttgggtgctggggatacagctgtggacctctctgtggtgctcactgcccagcgaggaggcggacagcgcatagacaaggcaaatagggcacatggtggagcggatgggcactttggacccacataaagccaggtgcctgggatggggagtgctgggggcctggggagccctggctgttagatgaggtggcaagagagacctcactgtgacaggacgtttgaacagaggcccagaggagcaagggccaggccacgctgtctcaggtgctgctgaacacgctggcagcaggtcagagagaccagagccaggtggggtagacagggcgttgctgtagggtcttaaaaagaaaatgatgtggctcaacttatcttaaaagggccactctgttgctgagctgagagcgtaggggcaagtgcaaggaggccagtcgaggccaccatgacagtcccaggcagagctgccagggcaggggtaggggaggtgagggagtgcctggagtccagctctgagtctgaagggaagccgagtacgtgtactgaccgagtggcatggccgtgggggtgagggctgaggagccacagacagttgcaagccagaggccaagccaccgaggggccttgggaagacctcaggagggttggggtacacaagcagggaaggggtttgagagctggcagggtgtcaggtgtccgagagaggtgctggctaggccattggatggaagcatctgggtgttggggcaggcctggggtggattcctgagcatgcagatggtgtctaaaacacaagactgcatgagtgcatggaggagccagtgcccccagagggaccccagggcttcagtgttgggtgcatcgctgagtaggccctgcccggaggggagatcccagagaggagggggccccagccaggtggggagagggaagggcccacagggtcaggtgccgccaagagctcagttaagaggaaggctaagagtggccagtggatttggtgacgtgggggtcactaggacttagcaagggcaatttggtagaggcagtggggctgaatgcccaactggaactggttccagggacagtggcaggagacatttgttccctcggggactccctggccctgaactctcttgtcaccccaccctaggtgttgcctgtgtcctgcgaggccgcggttcgcccctggagtcaccatcgaggaagacaactgctgtggctgtaatgccattgccatccggcgccacttcctggacgagaacatgactgcggtggacatcgtctatacctcctgccatgatgcggtgaggccgggcagggctggggcctggtgtcaggagcaggcagctgagggcctagggtgctgaggctatccttccaggccggcaggagcccttgcttggctggtgctggctggctgcagcttccaggcatccctagctgggcagaccagaggtggcccccttctcttccccagaccctggcttgcctgtaccacctctggggctgggaaagcagacatcaaccccacacccagtgtttgggttgccgagccctagccctttagggaaaggaattgagggcagaagcagggaggggcagccatcacctggactcaggggcaagtggtggcactcagggctgccagagccagcaaggagcggggagggcagggcaggcctgtggctgggatcgggaggagatccccagtgaccctgggagcccgtcagcctttctggcggcagaggctccgtggctggtggagccagagttcctggccaggaaggagacctgcctaggtcactttccctgagtgtggccccaccagggccgctcaggctcacgagctgcccgcctcctaggtctatgaaacgcccttctacgtggcggtggaccatgacaagaagaaagtggtgatcagtatccgggggaccctgtcccccaaggtacgctgcccatggctcccagcccccgggggtgcctgcctccctcttcctgtcctctttagccgccccctcacctgtctcctctctccccaaggatgccctgactgacctgacgggtgatgctgagcgcctccccgtggaggggcaccacggcacctggctgggccacaaggtaacccacgtcatggaccccagggcccctgggcttctttcctgccctgccagtgtgcagaggcgtgtatggttgggggttcctccctgctcgctgggctcactggaagagattggtcagagaggcatgaattagtctggaaggcccgttgcggcccactgctgcgaccccactgccctgcacagcccagagcctgaccatggaagaacctgagaggcagctgcggagagatcataccagcttcattagccacactgcccctctgagcctcagttcccacctgtgaaatggaagtgacaggatcagcgtgtctgccagcccccacagctgggttgtcacgaggcccaaagggaaaaatggatggggcagggttcctgagctgcaggtcactgtgggtttgctggtcactgggaggcctcccaccaacacctgcttctgttcctgcccacccagggtatggtcctctcagctgagtacatcaagaagaaactggagcaggagatggtcctgtcccaggcctttgggcgagacctggtgaggaattttccatggcaccaagccttttcacacctgggtccccctcctccaacgcagcacagagaggagaggatggatgggtgatggagcctcacaactcccacacaagccaggctcctgcaatcccttccagcctggctcccaacccctcctcttttgtgccaggtcctgtgggcatcctgctccgccccacctacagtcattgggcacctgattcatgccagacactagaggcacaaagatgattcagggcagacggcttttaagcctcatagctgcagaaccgtttgtcagaaggaaacatggagaggctcaaaatacagagcagagagaaggggtgctgctctacctaggggggaactgagtcctgcccactggccacggtctgtgcaggtagctcctgaggtgccaccagctgccctttccaaagcaaagcaggctctggcctcaggagacttcagtctagtagtgagggtagagagatggggtcaggtaaccacatgtttatagtgataaaaagctccatcccaggtacagatgcaatgactagagggagtgagccactcctggaaaatcagaagggcttccccaaggacataacctctgagcaaggtttggaagcgtaaataagagtttattagaacagtctgcctaagcagtcgctctgtggggccctatcttggttctctgtgccctagcattcacacagcacagacaagatcccaggactctgggaagatgggaagaccctctgcctcccttgggttggctaagacagtcgcttggcgggcattggggcagggctctcaggcttctctcggtctccagggccgcggaaccaaacactacggcctgattgtggtgggccactccctgggcgcgggcactgctgccatcctctccttccttctgcgcccacagtatccgaccctcaagtgctttgcctactccccgccagggggcctgctgaggtgagccatctggggcttcagagttggctggggcagttgggaccagtggaggctgagggttggctggtgctaggggctggactgggagtctgacttctggtcacatggaggtctgggagtggcctggagggtggagggtgggggctctgaaatgccatgcgccccccaggatctacctagcaaagccttaccagtgggaaagacagagcagggagcaggcaacccagcctgccaccagccagctccccgggagccatcccaggagtgcaggagcagggcttgcttgtggctgggccccccgattccggaacaccaccaccccgcccccttggccttagcttctgcttcggcttcccttgcagtgaggatgcgatggagtattccaaggagttcgtgactgctgtggttctgggcaaagacctcgtccccaggtgagtccttggccccgctccatggtcccttgccaggctgttcctccctcctccaggcctctccccacccccagcccccgcatctctctcagtccgattcctgtctctcaagggaccccacgcccctccccacccttagttgcccagtggtgagaagcccaggtgaacgcacgtgctggcgcccgccctgcctgtcctctcactcctcagctctgctctggggagctgctctgtggacacctctccaccccgtgaccctggctgacgtgtcttcttgttccaggggctaggcgtgtgcctgcccctccgcccctggccccatacctctcatagccgctgaccaggcctggctgacggccctgtctcgttccctccccaggattggcctctctcagctggaaggcttccgcagacagctcctggatgtcctgcagcgaagcaccaagcccaaagtgagcccccacctgggcaccctgcctctgtgcagcctcatctgtccctgcccttgacccccaccggtttcttgggacaaagcacaagaggccctgccatggaaggccagggcagggtgtggctggtgttgtgggaacttcaggaagtcagaccctcagcatccccaagctcaacccatccatcccctgtcattgtgcagatggggaaactgagacccagagtgggagggacttgcatttgctcacataaaaagttagaacagaatcaggacaggaaccgagaggctcccatcacacagagctgggagctgcccacagtcaggagaaagcgatctggaggctttgagcggtgaggaaaggcctctgccgaagcctctgagattccctaggctcagggagggctgggaatgacctgtggagaggatttgggtacagtttgttctgattttctgctgtgaccaagaggagagggtcagcccttcctaatccgcatcaggtctctggaggacactggcagacggggtggccaggtgggggtggggacatggtggccaggcacactgaggcaggccagcgcaggaggagagggtcctctgtgtggtcacccctcctcaccccctgccccccgccccctgccccgggcgagccctcagcccattcaccatctcagccccgtctggaccgttcccagctttggtgccctagaccctgtggcaggcagggccctgggccaggtaccaggtgccaggcagtgagcagggcagcaaagctttgtgggactttgcctgcctggaggagcctggttctggggaggtggaactgctcccaccagattagtcctgggcttttgtcaggccaggcctggcaggtccagctggactcaactccagggtgtgtttggcctcggacttgtggagtgatccagaataagtcccttcccctcactaggcctgtctccccatctactagatgaggggttggctgggcttccagccccttgccagccctgaaattcaacaattccatgtcatctgtccttggcaccttattggccgtctggccaccgtgcacctcagccactgcctcttcaggtgggcaccgacctttaatgctctggccactgcccttcccctgcccctttgccatcttactgcccacctctcacctgctgagccccccttctcggtccccctgcccctgccccccagccagtgctacttagctctgtccccatctctcccactccaccccgcgcagtggcggatcatcgtgggggccaccaaatgcatccccaagtcggagctgcctgaggaggtagaggtgaccaccctggccagcacgcggctctggacccaccccagcgacctaactatagccctctcagccagcactccactctacccgcccggccgcatcatccacgtggtccacaaccaccctgcagagcagtgctggtaggttctgccagggtctgctgctgcagggggtagtggccagggcaggggcagtggagagcagggccggccttggctcaatcaccgctcggggctgggggtggaggctgggagaagatggcccagggcctccatggaggggtttccccagcatcgggctctggaaatggaacaaaaggccagccctgagcaggactccaggcgtctctctccatagtctggctttgcctccagtgtcagcccttccctggtgtgccccagggcagctctccccactggtggtccatttaaaagtaggtgccctggagggctcacccctcaggccctggccagctcacacctcagttgtcacttggtttcaccaagggaattcctcgaagacagctgtgagcaaggtgggggctgcgccaggagagagaataggagcaggcaagtgggtagacctttcccactgtgctccttcagacggctgggccctggctcctccctccagggtcggcttcctcccctgacacagctggtgagctgggccgtgcagcaggtggagcaggtgtggcccaggccaaaagcaggtcgaaggctgtggagggaccatggctgaggctcgaggtcagcctttcccaggctgagggcagggcaggagccaggccagggaacagagccctgctgccaggcaggccaggggcctccaaaccatgccagctctgctgagcagggcagagaacagagccaggaggccctggcaccgagggccaggccaccaccccacccttaactcccctctgtccatgtccctctcagctgctgtgagcaggaggagcccacatactttgccatctggggcgacaacaaggccttcaatgaggtgatcatctcgccagccatgctgcatgagcacctgccctatgtggtcatggaggggctcaacaaggtgaggcagctcccggcagggtaccaccagggaataaggcactgtcaccccatcagaaccccgtaagcaccatcagatcactgcccgattttacagacaagggtgctggggctcagagaagtaggtagctgggccagaaagccccactcaaatacttcaacctcacacccctggctctgtccacatcaccacgttgccccatggtggggaggagataaggagactcccaggggcctgtccctgaggcaggctcagctcagaggcccggaaggccacctggcccttaacagatgaatgggcaagcagcgacagccacagccatcccctggctgcggaaaggctgaaggcaggtagggcaggagcactcgccgggctgtggggcgagtcgtgaccagatgggcaagtctcaggccttggggagtggtgacctcaggaggaggagagtgggacccaagtgactccatgaggctttgcttggcctgagaggcctgggccctggctccacatcggccccacgatggggcctgatgtccctccaccacccccagcctcctctgtcctgtcctcaggtgctggagaactacaacaaggggaagaccgctctgctctctgcagccaaggtcatggtgagccctaccgaggtggacctgactcctgagctcatcttccagcagcagccactccccacggggccgcccatgcccactggccttgccctggagctgccgactgcagaccaccgcaacagcagcgtcaggtgagccttggccactcccagccccaccccagggtgagtgtggttcagagcacatagacttgtgtgcacatgcattttgtgcatgcactgggctcagctctgcacacgtgcacaggaggggtcaaactcaccctctgtgctctagggctctcttgctgtgctccagctgtcccacagcctgctgtccctgaatcctacatgagccaggggaggcacacagacccacaaaccctgggccacaaaagcacagattcactctttttttttttttttttttttgagacgaagtctcgctcttttcccccaggccggagtgcaatggcgcgaccttggctcactgcaacctccacctcccaggttcaagcgattatcctgcctcagcctcccaagtagctgggattacaggcgcctgccaccgtgcccagctaatttttgtatttttagtagagatgggatttcaccatgttggccaggctggtcttgaactcctgacctcaggtgatctgcccgcctcagcctcccaaagtgctgggattataggggtgaaccaccatggccggcctgcacagattcactcttacacacttagacgcaaacagatggacacccatttacttacatatttgtattgaagcttacacacatacatgtgcacacaattattagttataagtacacaggtcaccccctacagacatgcacatgtacaagacacacaccaagacaaaggtggagacacatatacaaggacacatgtggacaggcaggtgctcatggaaatgcatgaatacacctgtgcacagacccagacacacaagccagctgacatacacagacgtctggtctacacactcatacacatgaacagaggcgtgcacacatgctcacaggggcacgcacatgggggccacagcgcccttgctattcacacactctttgaggggtgcgaggctcttaagtggtagtccttccaggggaggattgtcctgcctttctaggaccttcccacacaggccctgtgtgcttggtcacagatctggtcaagaggctgcttcctggcccttggtagggacaactggacgtctctccctgccatttgtgcatttcctgtggcagctgcacaacccgatgaagaagccagtgtccatttccggctgcggtgactgctgcaagccacccactccctgccctgtcactcattccctgcaggctggtctgcggagccaggggcactaggctccccacccagcagagggctgcggcccatgggagacaggaggagacccggatgaggaaggaagtgatgagatccctgggagtggcacccagggttgctggctctgagattggggtggaaccagttgggcagctatgtgcagggctctctcccttccctgtctccctgctgccctctgtccctccctccctccctcccttcctccttccctccctccctccttccctccctctgtctctctcattccactgtggcctcatgagtgacctggggcaggctcatgagtgatctggggcagccagtctatcagagcctcattctcacattggtacaatgacaggggttctggtgcagagaaccccagcagcactcctgaagtcctagtgctgccagcagggccttagcccctcagggaccccgcggctcaacccagcatcaactcttttgtcttctatcttgggttcttgtgagttgtttttaaaaaataatcattcctggctgggcgcggtggctcacgcctgtaatctcagcactttgggaggccgaggcaggcggatcaccaggtcagcagattgagaccatcctggctaacatggtgaaaccccatctctactaaaaaatacaaaaaattagccaggcatggtggcgggcacctgtagtcccagctactcgggaggctgaggcaggagaatggcgtgaacccagggcggagcttgcagtgagccaagatcgtgccactgcactccagcctgggcgacagagcgagactctgtctcaaaaaaaaaaaaaaaaaaagaaaataagcattccctgctgcacatcatcaacaactgctaaatgaactgtaccctttattccctgcaagttccttttagccagggagctggggttcagtcccctctcccttctgagtcttataccccctgctctcctctccctctgcaggagcaagtcccagtctgagatgagcctggagggcttctcggaggggcggctgctgtcgccagtggttgcggcggcggcccgccaggacccggtggagctgctgctgctgtctacccaggagcggctggcggcggagctgcaggcccggcgggcaccactggccaccatggagagcctctcggacactgagtccctgtacagcttcgactcgcgccgctcctcaggcttccgcagcatccggggctcccccagcctccacgctgtgctggagcgtgatgaaggccacctcttctacattgaccctgccatccccgaggaaaacccatccctgagctcgcgcactgagctgctggcggccgacagcctgtccaagcactcacaggacacgcagcccctggaggcggccctgggcagtggcggcgtcactcctgagcggccccccagtgctgcggccaatgacgaggaggaagaggttggcggtgggggtggcgggccggcctcccgcggggagctggcgctgcacaatgggcgcctgggggactcgcccagtcctcaggtgctggaattcgccgagttcatcgacagcctcttcaacctggacagcaagagcagctccttccaagacctctactgcatggtggtgcccgagagccccaccagtgactacgctgagggccccaagtcccccagccagcaagagatcctgctccgtgcccagttcgagcccaacctggtgcccaagcccccacggctctttgccggctcagccgacccctcctcgggcatctcactctcgccctccttcccgctcagctcctcgggtgagctcatggacctgacgcccacgggcctcagtagccaggaatgcctggcggctgacaagatccggacttctacccccactggccacggagccagccccgccaagcaagatgagctggtcatctcagcacgctagcaccccagttgcgtggccagccgggcccaggcaggagcaggtggccctgtgggcacctggtgcctgccccctgccgggcagctttaaggacagacccccaggggcagtttagcctcaggcacaggcatcgctgctgagctgggggtccgcatccctacctcagcttaggacccccagagccaaggtggctgggatctggccccacagatggggaaagatggggaagggtgtggagtggggaggagcctgggcagcctgctgggtgggccacactcagcctgactgccctccatgggggcattctggcaccccctgctccaggacaggccatgggcaagctgcctcccatcactgcctgctggctgctctcccaggggccaggtggagagcagtgccccccgacacatgtattctcatctgtggtccaggccggcatcgtcctggccaccccccagatctggtgcctgctggccggccccctggggtgcccctgccgaggtggcctgcagtgctgtacatgtttacagaagctgctgggcttggctcaggatgtgttctgggcttgcaagccccccgcccaatcatgtgttcagtagccgtcctctgagcagggcccaaggcagccaggggcctggaggggccagaggagggtggggtcagggccgccccttctctgccttgtgcctctcatgctgcctcctctgcccatgggtcctgggcacccaggcctgccctgcctgctggctacttcctggcttaccttctacccccaaggatcctcaccacccaaagggtggtgggcactgctgtgaccaccccagctgcagagtcagtgccctgggtggaaggaaggcactgagagcccccttcctctgagggccccacctcaccccttggtgtcacccccaccacgcctaggcagctctgggccctgggatctggaaccaacacacccctgttcccctcagctttccctcctcgctggcctgggcaccctcctgggagcaggccttcctccctcccacccccaatgtcctgttggtaggaggtggggccaagagtggggtatggtgggccttggctggagacctctgtccactgcccagggaggggcctggggctgggagcagtcccggtttagcctgaggtccccatagggcttcctcccctgctgggtttgggaagcagttagggagatagcgacccggagtttccccagaagcggggtgggagggtgtgcatgctagtgttggcgcgtatgcatgtgcatgagtgtgcaccgttcctaaggaaggggcctctggggctgcccaccctacctgccctgcctgcctgctgcccctcccagcctgccaagaaaacggtaggggagcatgatggggcctttgaggcagggtcgcagggacaagctcagctttaggcaccatctgttcccatcgcgcctgctgctgtgacccgttttggaaaactggtgtgtaccgaggcgctgactgcacggctgaccgcctgctcgtgccttcattctgcagcggcatggtccctcccattctggctccacctgcagcctccctgggtggcctaggctcccccgaccaagagacctccctctcatgatcactggtacctgggggcctgaattctggcccccggctccccacacagctgggactggcctggatggctgtcctgggagcccctgcccaccctgacagagggagctgggcctcccctcatcctctgtaactcccgccttcaccagactcaaggacaccctggccctgctgaggcatacagagcttcagcccagcacagaagcaagacaaaatcagtggctcttagagtttagaaaacaagacagactctcagatgaaagatctgacaagcaccgtggccagtcacagggagagacttgatgtctggccttttaattcctcctctgccagggtgggtcctgggacctctaatgtgggcatgtcgtccaccccaggacgagccatcagggacagaccccccacccccaaggctgcagccacaccatgtttcaggcttggggctggggcaggcttgggctcaatcctgggcacccaggggcagcccacccctaacctggctcctacccacctcgcccttgaaggatgggcctgctgcacgtctccctcctccaccccataccacactggggggtctgagccacccccctcagccccgttcggctcagaccgacccccactccatccccagacctgcagcacaagtgcgcgggcctgtcctcccaggggcctgggcgactccatatgcaatcagtagcgagcagccgggccccacagaccctcatgcactctcttacgtgccattctccccagactttttttgtacttaatgtatgaaagatccaaactaatattgctgtaaaaaggagagacaaattaatatagcttattctataaatatatctgtatataaaggtttctgtatattgtatagagctgtgtataaactggatgtagaagcac

SEQ ID NO: 149 - DNA, 7619 bp, Homo sapiens
tgcttgggatattttaatacatattcaagagaaaatgacaaatatatcttaatagaaaaggatacaaattaaaaatcagaaggcaagaccaccaggattaaagatgcaacttagatcaaatattgaccaaagtaaatgggttgaattttgaatatagcatagatcatacttagtgagaggctttcgaactaacgacttacatttaataataattagcatgtcacagaatatagtttatgattattagaaaaatgaagttaaatcaatacttgggagattgtttattaatgtgtgaattatgtctttttttaatattcataaatagttttaaaattttaaatgtgttttagaaagaaattggttactccttgggaaaaaaataagtgtgcattacaacgtctagtggaagagtttaaaggatagattttcatttatatttaggaaagaatgtttctcttgccttcctggatttgctccatagcaaaagacataaatacatattgtaattataaattgtgcattgtaattataagttgtaaattctactacaaaggtcagctatggttagattcagtgagttttaccttaaaatattggcttaaaacaattcaaatcaaatggataaaacaactttttgctttccaatggcattatgattttgggtggtatgggaagagaagttctcaaaccaatagtcttcaaggttgcagagagaagcttctgtctgccactttcctgatgtactgaatggcccttggtatatctttataaaaatgttaaaacccacagagctatttaaagataaaaaaaaccttacataactttatttttcaaagactaatatgtctcaggtacatttagctacagtacaaaggataagaaaatagcacctaggaattttttaggttgtagagaatctcaactgctttaccttttgtattttctctccacttctctagcaaagaagacagagtgctcccattcccacttcttcagcctattgggtcacaaggggcctaattttcatgcgaacagccctgagggaataatctgcccctctaaaggaaacccagaccactccattctcaatctcataaggactgttattccttgggtcataggagcccccagggtagtagattccattgagattggctgcttggcagttattataccaccagcctcccccatagacttctgcacagttctcttcccactggtctgcatccctgtcaaaggtgctgaactgcatgttgttgtgagaggtgtactctgccccttcctctacggaaccctcaatcagagcatcacccgcagtgccttcataggaggagacttggagggcatagccttcagcctcagagcctacccggaagtgatattctgcataagcttcattcccagcccagtcctctaattcaaccctaagaacagagcccctttgggttagtaagtggaggtagtcattgcctagccagaattctccttccccctcgtcattcaggctgccgaaacctctcttgtagtcttgccaggtccggttaaaattcagtgatccatccattctttgctggatcaaaagccatcctcccaaactggtctcttgatcgcaataaacagaaaaaatcttactggatcccggtagcttgatattgaaaatgccactttgggtacctgaaggatgtgtttggaggacatcatcacagtctaaaaaaaaaattaagctggttggaagaagttattctcatttaactttacaaagataggcacggctcagattaaataaggcaaatactgtttctttcccttcctttctttcttcctcctttccttccctccatagggaaaggatgcacttacagtgggatagaacttatgcaaataagcggttatttatacctacaaattgcaaaggggattttcctcaaatgtatttggaattttacttgcacaaactaatagcaagtaaccagtacaggtagctaagcatcacttaatactaacacaacttgtatttagcctgacctaaatgtcaactgagacacatactaaaaatgtgattaatcagttgggtgacaattctaatagcacacactttgaatagtgaaagaatttgactaaataagctcaaatagagtttcagaggaattcattcatccatttaacatgtatttattgagtcatggctctgtactgttaggcatttgggaatacagagatgagacagacaaaggccctgcccccaaggaacttacagtctagcacaaaaacagaccaaaaaagtgtagtttcaatgacgtgtaacagagagttaagaaggaaatgcaaggggccatgggaacactgtgcagaaatatttaacttagtctagggggacagggaaggcttccccaaaggagaagtgtggatacctctgacagggcgagatttagcatggcctctcttggtgctatgtgttccttcatgatcggcttcacttccggcctcatctgccattttatagctcttgctttcaaatgtggagtctcctctgttgtaactcgtgctactagtaaattgtttgctgtaacttgaagatttaccacgggaagggaattcagctatcccagggtgatgagaactggattcctttgtatttgtgaagatgccagattctgagcccctagactcagtctcactgacaaactctcctaacataggtgagaagaaacctgggaatgtttttccagttgaggcagtgtcgaagaaggcagcttcatcagggtgcctatggcggaacccatccagagtacctatgccagacaatgtgcctaaatccattgcctcgggacagtcagaaccatcttcggaggtcaccacttctttggtaacttctttgtgaccatcaggaccaataacagtcttagtaacggttttagagcatgaacgacgcgtggtggttgtgctaccagaggtgaccttctctttaccagtcctgagctctttatctcctttagaagtgaccagtttttctgtgtggtactctctccttgtccctggacttacatttcctgacacctcttcaaatgtgccccagtctgggttgttaggcctcgcgttcccagagcctgggctatctggcctaaaacttccagattcagagtgccattgtccagtactaccagatacagagctctcagaggtccagtgcccagcacttccgcgttcagagctgccaggattccaggttccggtactaccaggtctagggctcccagggttttggtttccagtacttccagttccagagctcccagagttccagcttccagtacttccaggtccagagctcccaggtttccaggttgcagtccctccagtcccagagctcccagggtttcggtttccagtacttccaggtccagagctcccagagttccagcttccagcactgctagggttcctggggctttccgtctctgatccggttccataagaggtggagcctcctcgagtaatctcatttccaccaggtctctctaactccattctcatctgcggcatgtctgttaatgccttccactctgggggtaccttctgaagctggctcttaaaatttccgggaaccaagtctggaactggtttcatttttatcagtggtaagtgttgcctatctctagagggaagtaagtctttggcaatgacctgttcaagttgcttctgctgatcttcatagtccttcagatctacttcacgagctaaagccctactgcatgaccctcgacaagatcggatcttaatatcaatgtccacctagagagaggggagaaaaataaagagaaaatgtagatacaaatacataaactacgtctattgagttcctggtagttaattttccttctggaaactggtttcattttttttgactcggagacctaccacttaatattctctgttttctgcctatcgagcaccctcagtggaagagatgttgggtattgcagggctagccaggataagcaatggatgctgtttaattcatcttagcctcagaatggatcaagagtaaggtgctattccctctcaaaggaaacgctaattaaatgatccttggtgaaactcaggctgagggctcagaggtgtggtgatgtaatgggctttggaattagacagggactgaacatttgcttttgaaatttactatctatgtaccgttggaaaatttacttaatatctctgaattttttttcttcaactgtggagtgaggaaaataatacctacttttaggtagatgatggatataacacttttctctgcatatagtagacactcagtgcataactatcgccttccttttccctctactcagaaacaaggacatctgggaccacagccacatacttacctccagtcgtttcatatcaaccaactgagctctaacatttttctgcagaagctggatatgctgtactttttctatgactttgcgcttcaggacttcaattctgcttctcagatcctctgacactcggttgtaggtattatcacggtctgaaatcgaaaatatggttattgaagtagctgctgagtgatttgtctgtaattgccagcaaaaaagaaaggaagaaaggaaggaaggagaaagaaagaaagaaagaaagaaagaaagaaagaaagaaagaaagaaagaaagaaagagaaaaaagaaagaaagaaactagcttgtaaatatgcctaattttattttggttacagtttaatctgtgagttcaaaacctatggggcatttgacttttggataatgttatgccctgcagccttccatgaatgccagttaagatgtcctaatagcaattagtaatcccaaagaaatatagaagaagaactttctttggaattttaaaggtgtaatttggagttaaaatagttggtttgattgcatttcaattattttataacatccttaatcaagggacttgaacatattggattttcttactgatgagcttttctttttaatctatagatttgaaatggttcctaagctgttttgggtcaacaggatcactcacttgccagctagtgttgcatcactgattttaaatgtcaagtgtttgtgaaggtgtaaaaaggcaaagcaaaacttgagaaactgaggactccctagactcgctgtccatgcccagagtgaatgcaatgtttcctaaccctaatgagtagactgtgagaatgacgtagcttgaccctatattttaaatttaaaaatctacctaatcagctcagtggagtctgggagttgaattcccagctctgtgtctttgaacaagttccttgacctctcagttttcacctttacaaagcagaaacaaaaatatcaactcaaagagtctgacccatcctactttcagtatatactgttgaaaagaacacatttaaattcttgtttttaatccaaaattctgacttattttgtgaccttaaacaatctcagttaacatcttttactttgaaaaaataacgaaaacaaaagctccctcttaaaattttcagggatattatgaaggtatgtgtttctacactaagtactttgggatgaaattgtcatagatataagcggatatcatatttatttaggatttttgttgtttctgttataaagtcaaagcagtaaatatgtaatacttactattggctgaggaaaaatcgcctctcaaaatttccattatattagtggtcaacgaatgagaatccttattgttcttctgatattcaaatagtgaatttttgagcttatttattctgtttgtaaaatcttgattgacttcatcaatcaaccctttcatcctgcagccagaagggcatttgtagttctgaaagtgaagggagaaaattacagtaaggatctatctctcagattcagaataattttgcatgtttccatgcagcccccatttcttcctaccctatctcttccagataagttggcttaaaagtaggtaagaggactagttagaggtcgcagagaaactctggaatgagggtccacttagccataaattaggtgccaggaaattgaggccacaatactcaggagcctggttttgcctgagcatgcaactgaaatcctgtctgttcacccactaatgatccagagttggggaggtaaataaacagtgctcttgggagtaggttccttttctttatttgctatgtaggtaactattcaattattttctatttaaaaaagtttctgggaccaatcaggtcagcctgtgagcccctctagcatcagagggaaggaatctcctgcttcccccgctgactgcttacccagtcttcatcagagcagaagggccagtctgaatctttgcaggcagattgatgtctttccacaacccttgggccacgcacgcctcctccttcagctagaaagtcaccttcaccactatctgcagtctttaaagattcattcacatacacaaaagagagcaacagcaatgttagccagaagaggagacagtggcatgcctacaagtccccaggaagagatggcactctcacagagattaaggagagcagacacagggcttcggcaagcttcaggtttcttatcttcaaatggaaatcctaggacccattttatggagttgttatgagaattaaaggagacaaggtgtacaaatttcttaactgtgtgtgacacttaaataagcatttgataaatattaggagttttaaagaatccatcctaaaaggaaaattatttgaatctataaaatcagttaaattttaccttttcatttttactaatgactgcagacagaaagttgaaaactactgtagagctctttctcctgtaattgctgcttcagtagaaaaacctagactatcttaactgaatgttcctctctccttcaagtttctatgtaacctttagagatggattcataatttaaaagaataccattactgcggaaaagcgtattgccttactaactaatctcttctgatactgcaaagatatttccaaagataattcgtttgctttttcttctgtcttgacaaacacaacaataacctttcagcaaaactgtactaacactaaaagttctgcttattatggacaagtagcaagaaattaataactaaagaaaacaaatcttaccataaaatgttttattccattaactagcattataatgcaccaaggctttataggtacaaggatggcaaataattcttgccctttttaaaacaaaacaaaacaaaatgtggtaagactgaatgacagatgctaaagtttcccttgtgagtttgtacactctcatccatctaagatcttcctcttggtgtcatattaccctgtattcttgaggtgtcaagcccacccaggaaatttcctcccaggcctggggtcataaagctaagagtgtgtcaggacatagagcaggtagactctgacctccaggctctttgtggaataaacaccagagagaaagcaagaagaaaaaatgaaaagggccatacccatgctgtgcccaccacacttaggaccaggcagacgatcctcatggaaaacatcttttctaagggtggggctggctcctgaggagcactccagctgaaagaaaggattgct

SEQ ID NO: 150 - DNA, 5470 bp, Homo sapiens
tcattcatccatttaacatgtatttattgagtcatggctctgtactgttaggcatttgggaatacagagatgagacagacaaaggccctgcccccaaggaacttacagtctagcacaaaaacagaccaaaaaagtgtagtttcaatgacgtgtaacagagagttaagaaggaaatgcaaggggccatgggaacactgtgcagaaatatttaacttagtctagggggacagggaaggcttccccaaaggagaagtgtggatacctctgacagggcgagatttagcatggcctctcttggtgctatgtgttccttcatgatcggcttcacttccggcctcatctgccattttatagctcttgctttcaaatgtggagtctcctctgttgtaactcgtgctactagtaaattgtttgctgtaacttgaagatttaccacgggaagggaattcagctatcccagggtgatgagaactggattcctttgtatttgtgaagatgccagattctgagcccctagactcagtctcactgacaaactctcctaacataggtgagaagaaacctgggaatgtttttccagttgaggcagtgtcgaagaaggcagcttcatcagggtgcctatggcggaacccatccagagtacctatgccagacaatgtgcctaaatccattgcctcgggacagtcagaaccatcttcggaggtcaccacttctttggtaacttctttgtgaccatcaggaccaataacagtcttagtaacggttttagagcatgaacgacgcgtggtggttgtgctaccagaggtgaccttctctttaccagtcctgagctctttatctcctttagaagtgaccagtttttctgtgtggtactctctccttgtccctggacttacatttcctgacacctcttcaaatgtgccccagtctgggttgttaggcctcgcgttcccagagcctgggctatctggcctaaaacttccagattcagagtgccattgtccagtactaccagatacagagctctcagaggtccagtgcccagcacttccgcgttcagagctgccaggattccaggttccggtactaccaggtctagggctcccagggttttggtttccagtacttccagttccagagctcccagagttccagcttccagtacttccaggtccagagctcccaggtttccaggttgcagtccctccagtcccagagctcccagggtttcggtttccagtacttccaggtccagagctcccagagttccagcttccagcactgctagggttcctggggctttccgtctctgatccggttccataagaggtggagcctcctcgagtaatctcatttccaccaggtctctctaactccattctcatctgcggcatgtctgttaatgccttccactctgggggtaccttctgaagctggctcttaaaatttccgggaaccaagtctggaactggtttcatttttatcagtggtaagtgttgcctatctctagagggaagtaagtctttggcaatgacctgttcaagttgcttctgctgatcttcatagtccttcagatctacttcacgagctaaagccctactgcatgaccctcgacaagatcggatcttaatatcaatgtccacctagagagaggggagaaaaataaagagaaaatgtagatacaaatacataaactacgtctattgagttcctggtagttaattttccttctggaaactggtttcattttttttgactcggagacctaccacttaatattctctgttttctgcctatcgagcaccctcagtggaagagatgttgggtattgcagggctagccaggataagcaatggatgctgtttaattcatcttagcctcagaatggatcaagagtaaggtgctattccctctcaaaggaaacgctaattaaatgatccttggtgaaactcaggctgagggctcagaggtgtggtgatgtaatgggctttggaattagacagggactgaacatttgcttttgaaatttactatctatgtaccgttggaaaatttacttaatatctctgaattttttttcttcaactgtggagtgaggaaaataatacctacttttaggtagatgatggatataacacttttctctgcatatagtagacactcagtgcataactatcgccttccttttccctctactcagaaacaaggacatctgggaccacagccacatacttacctccagtcgtttcatatcaaccaactgagctctaacatttttctgcagaagctggatatgctgtactttttctatgactttgcgcttcaggacttcaattctgcttctcagatcctctgacactcggttgtaggtattatcacggtctgaaatcgaaaatatggttattgaagtagctgctgagtgatttgtctgtaattgccagcaaaaaagaaaggaagaaaggaaggaaggagaaagaaagaaagaaagaaagaaagaaagaaagaaagaaagaaagaaagaaagaaagagaaaaaagaaagaaagaaactagcttgtaaatatgcctaattttattttggttacagtttaatctgtgagttcaaaacctatggggcatttgacttttggataatgttatgccctgcagccttccatgaatgccagttaagatgtcctaatagcaattagtaatcccaaagaaatatagaagaagaactttctttggaattttaaaggtgtaatttggagttaaaatagttggtttgattgcatttcaattattttataacatccttaatcaagggacttgaacatattggattttcttactgatgagcttttctttttaatctatagatttgaaatggttcctaagctgttttgggtcaacaggatcactcacttgccagctagtgttgcatcactgattttaaatgtcaagtgtttgtgaaggtgtaaaaaggcaaagcaaaacttgagaaactgaggactccctagactcgctgtccatgcccagagtgaatgcaatgtttcctaaccctaatgagtagactgtgagaatgacgtagcttgaccctatattttaaatttaaaaatctacctaatcagctcagtggagtctgggagttgaattcccagctctgtgtctttgaacaagttccttgacctctcagttttcacctttacaaagcagaaacaaaaatatcaactcaaagagtctgacccatcctactttcagtatatactgttgaaaagaacacatttaaattcttgtttttaatccaaaattctgacttattttgtgaccttaaacaatctcagttaacatcttttactttgaaaaaataacgaaaacaaaagctccctcttaaaattttcagggatattatgaaggtatgtgtttctacactaagtactttgggatgaaattgtcatagatataagcggatatcatatttatttaggatttttgttgtttctgttataaagtcaaagcagtaaatatgtaatacttactattggctgaggaaaaatcgcctctcaaaatttccattatattagtggtcaacgaatgagaatccttattgttcttctgatattcaaatagtgaatttttgagcttatttattctgtttgtaaaatcttgattgacttcatcaatcaaccctttcatcctgcagccagaagggcatttgtagttctgaaagtgaagggagaaaattacagtaaggatctatctctcagattcagaataattttgcatgtttccatgcagcccccatttcttcctaccctatctcttccagataagttggcttaaaagtaggtaagaggactagttagaggtcgcagagaaactctggaatgagggtccacttagccataaattaggtgccaggaaattgaggccacaatactcaggagcctggttttgcctgagcatgcaactgaaatcctgtctgttcacccactaatgatccagagttggggaggtaaataaacagtgctcttgggagtaggttccttttctttatttgctatgtaggtaactattcaattattttctatttaaaaaagtttctgggaccaatcaggtcagcctgtgagcccctctagcatcagagggaaggaatctcctgcttcccccgctgactgcttacccagtcttcatcagagcagaagggccagtctgaatctttgcaggcagattgatgtctttccacaacccttgggccacgcacgcctcctccttcagctagaaagtcaccttcaccactatctgcagtctttaaagattcattcacatacacaaaagagagcaacagcaatgttagccagaagaggagacagtggcatgcctacaagtccccaggaagagatggcactctcacagagattaaggagagcagacacagggcttcggcaagcttcaggtttcttatcttcaaatggaaatcctaggacccattttatggagttgttatgagaattaaaggagacaaggtgtacaaatttcttaactgtgtgtgacacttaaataagcatttgataaatattaggagttttaaagaatccatcctaaaaggaaaattatttgaatctataaaatcagttaaattttaccttttcatttttactaatgactgcagacagaaagttgaaaactactgtagagctctttctcctgtaattgctgcttcagtagaaaaacctagactatcttaactgaatgttcctctctccttcaagtttctatgtaacctttagagatggattcataatttaaaagaataccattactgcggaaaagcgtattgccttactaactaatctcttctgatactgcaaagatatttccaaagataattcgtttgctttttcttctgtcttgacaaacacaacaataacctttcagcaaaactgtactaacactaaaagttctgcttattatggacaagtagcaagaaattaataactaaagaaaacaaatcttaccataaaatgttttattccattaactagcattataatgcaccaaggctttataggtacaaggatggcaaataattcttgccctttttaaaacaaaacaaaacaaaatgtggtaagactgaatgacagatgctaaagtttcccttgtgagtttgtacactctcatccatctaagatcttcctcttggtgtcatattaccctgtattcttgaggtgtcaagcccacccaggaaatttcctcccaggcctggggtcataaagctaagagtgtgtcaggacatagagcaggtagactctgacctccaggctctttgtggaataaacaccagagagaaagcaagaagaaaaaatgaaaagggccatacccatgctgtgcccaccacacttaggaccaggcagacgatcctcatggaaaacatcttttctaagggtggggctggctcctgaggagcactccagctgaaagaaaggattgct

SEQ ID NO: 151 - DNA, 71968 bp, Homo sapiens
gaattacggccggattccggagtcctttccagctccctcttcggccgggtttcccgccgaatacaaaggcgcactgtgaactggctctttctttccgccaatcatttccgccagccattcatcaccgattttcttcatcttcccctccctcttccgtcccgcagtccccgacctgttagctctcggttagttaagggactcgggtccttccgaactgcgcatgcgccaccgcgtctgcagggggagaagcgggcaggggcgcaggcgcagtagtgtgatcccctggccagtccctaagcacgtgggttgggttgtcctgcttggctgcggagggagtggaacctcgatattggtggtgtccatcgtgggcagcggactaataaaggccatggcgccagcagaaatcctgaacgggaaggagatctccgcgtaagcacctgacattgttgttgagtgtggggctgtggacgagggctctgagggtgtgcaggtcccccggacccattttttgcgggagggacacttgtagcggaagagttaggcccataacacctgaagacctgcagccaaagaaagagaacccgggcacaacctgcgtttgcaagtggactgcctagtggctgtagccgctggctcctgtgcttcggggaaaagtcctgtgccgactatgctcccaaacgcgcagctgctggtgactttctgccgggagagtgggtagttgcggcttcctggagcccccctagtcagaactcagaaatccaatctacttaattcccgttaatttggaggtgagtagatggagactagtgaggtgacaaggcttgacaagactacaaggctgataatgacagagggtccttccagctcatagcttttcccactataccatagtcttatcatacgctaagtgaaatctaatacatttttcctttctcttcaatctcgtgcttctctctaacagccatctctctgccctggtcctagagttacttgaaacgtaatttggctcctgagtcctgagaatattctgcattccacttgacctctgcctgttctacccttgcgggacatctgaatgcttaattagtgggtatcgttgccagctttactcccaggaagtaacactggctgctttttgtctgggaggtgactggtgaggaaaaatgagagtagaaggaagagggaaaaatatattccctctagtagatgaaggagggaaagatatattctgtgtgaccttactgagtttgctcttgggacctttcacatcacccgttatgtaagtaactgttgccagccacagcagttactaaattgtaattgtcctgtaactcctaactttgtaataggtttttgagtgaattacaaagtcatcggtggtgaaaagtccgggcccagtggctcatgcctgtaatcccagcactttgggaggccgaggtgggtggatcacctgaggtctggagttcaagaccagcctatccaaaatggtgaaaccccatctctactaaaaatacaaaaaattagccgagtgtggtggcaggcatctgtaatcccagctacttgggaggctgaggcaggagaatcacttgaacctggggggcagaggttgcagtgagctgagatgcgccattgcactccagcctgggcaacaagagcgaaactccgtctaagaaaaaaaaaaaaagaaatcacaatacttactgcttagtgcttttcaacatgtggcttgctaaactgtatttctgctttactttctgtttttgtttgcttgtattcaaacttacttccttttccagtggctttttgttttaatataaaaatcttccttttagaaagactgattgtgaagagataatttagtgcataataatagtgcagataatttagtacaataataatgcatctgggccagtactgagaataggtgctcactgaatatactttcgttaattggagagcaaattaaatatgtttatcaactccataagggcaaatacatgtattgtcttatttttgtctatatcctaaacacctggaaaccctgtttcctgccttactacttgtgtggttttaagcaaattaattaacctttctgtgccaaagtttcctcaaatgttaagtaaaagtaatgtctaggtcattgggatgttagtagaattaaatgggttcctaacagatgatcatttataattcttcctggcacataataagtattcgatatatgttgtattaataatcagtaattagttaatgtatatatgaatgattcattatctttttttttttttacatggtagctgctgccttgagatctatttttttttttgagatgaagtcttgctgtgtccaatcttggctcactgcaacctctgcctcctgcatacaagcaattctctcatatcagcctcctgagtacctgggattacaggtgcccgccatcacgcctagctaatttttttttttgagatggagtttcactcgtcgcccagactggagtacaatggcgtgatctcggctcactgcaacctctgcctcctgggttcaagcgattctcctgcctcagcctcccaagtagctgggattacaggcgtccgccaccatgtccagctagtttgtttgtttgtttgagacagagtttcactcttgttgcccaggctggagtgcaatggcatgatcttggctcactgcaacctccacctcccaggttcaagcgattctcctgcctcagcctcccgagtagctgagactacaggtgtgtgccaccccgtccggctaatttttgtatttttagtagagacgggctttcaccatgttggtcaggctggtctgtaactcctgaccccatgtgatccacccacctcggcctcccaaagtgctgggattacaggcatgagccactgcaccggtcctagaatttcttaaaaatccagcccacttcccacattccatcctgcggattaggaaatcatttgaggccagaaaagtgatgtgatttgtccaagggtgaatggcaatggctcaactaaaactaaggtcttcacccagtatatgatgtttttcattctaaccagcacttactacttgctaaaaggaatttcgtaagcttttctttttcttttctttctttctttctttttatttttcagacaaggtcttgctctgttgctcaggctggagtgcaatggcacgatgttgtctcactgtaacctccacttcctgggttcaaacgattctcctgcctcagcctcccaggtagctgggactacgggcatgcactactatgcccggctaatttttgaatttttagtagagatggggtttcgccatgttggtcaagctggtcttgaactcctgacctcaagtgatctgtccacctccacctcctaaagtgctaggattacaggtgtgagccactgcgcccccgctggcgctttgctttttctttacagtcttcctctcattagcatgtttcccaccctgctgagaatgctatccctgactcgtcctcttctattattattctccttttatgccttcctgggagctcggacatcaacaaagttcagcattccagattccttctctacctgctctactctgtgggaaactgggtacttacatgatggatttagttgccaaattatctttctttggaagtaacagccccttttctccctcacggggaattctaagtttgcagcctgaatttgacaaccgggggaaggtctgagagttagagacaagtatctgttctttgtgggtatttattcacttactcaacaagtagctgtatgtgtcccctaagccaggcaatcttcaaagctctgagagtctaatagtgaacaaaacagcccaaatccctaccctcatgaaacttgcatactgatgggtagagacagacatttaaataggtgaaacacattgtgagctggtgggaagcacaaagagaacaccagagcagaaaagagggacaggagtttctgtggtatggtggctgcaattttaaatatgggagtcatagtctttgtaaaagtgacttacgggcaaagacttgaaggaggtggagccttaagcctgccaatgttgtgagggaaatagctcctgaccaaaaacacagcctgtgccatagacctttgtcctcaccagttactaacttactgctttggggggtcaatggcaatggccctgtgagaagctgaccgagtggaggctcctgagtagaggaacctgaccctgccctgggcagaagggtggtgtcttttaaaagattatgcaaagtgggagaaggatgtgcattagtgttggaagacccaccttgctttgtaggcaagaaagcatagttgttctataagtgggcctttcaaaggggggcttactacatttatatgatttgtttggtttttccttcccttagtttgctataattaagcctgctctctccattggtggcatttttcttgattaagtctcctttctaaagagactggttgtgaagaggcagatggtttgagtaggtgctgcgagtgtttgctggccaagtgcagggcaagttgggtatatttgtaagctcgctgtggatggtagctccagagcctaagcacggtgctgcctcctctgtgcatcactgggtcatgcaatttacctctgtgccttagcttctgtatattggggtagtaatgtcacctaactcataaggttgttagaattaaatgagtttaatacctataaagcatttagagaagttgttggtacatggtaagttttaataaataggtacttagaaagtactcattgaataaaaaagtgatgtttgtgtttatccaggctgtacctttgggagctggcttataatcttgagacttaaaattagaatttatcctagtgatcaaagataaaagtttggaaccttggctgtacatttagctacagggctagaagaactgtttttgtgaaaataatttgcttaccatagtgaagggcaggtcttcttggttactaagttaacatggataagacttttactttgtcctgtagattaaatacatgtaggcccttttgtgcttaaaaagatttgtctgggcagggcgtggtggctcatgcctgtaatcctaggactttgggaggcccaggcaggaggatcacctgagatcaggagttggagaccagcctgactaacatggtgaaaccccatctctactaaaaatacaaaattagctgggcatggtggcccatgcctgtaatcccagctactccagaggctgagacaggagaatggcttgaacctgggaggaggaggttgcagtgagccagtgagccaagatggcgccattgcactccagcctgggcaacaagagcaaaacttcatctcagaaagaaaaaaaaaaaaaatttgcctgtaatgaactccaaagtgcaggttgctcaaaagttacatggaaacttgactgtcatagctggattgattctggaagcctgtgcaggagaggtcggagttccagagaggctgggaccttcagctaggaccccagccaggctgttgggcaggttgcagcgatagtgcagcagagcccagagctggcagccaactactatggtcatggcacctgattggggatgtggtttgcaaataagtgtctgtccttgtccatcaggggagttgggatcaggcagtttgggatttgggtagtggggttttgagcagaggtctgtggttccctgttacatcccctatttgcatgaagaatcttctagaaggaaagctggcctagtacagaggagggtccttggagtggaagcaaatggctcccttctcctctaattgactcagtagaggttggtagaatagaggttaaggggcagggatgcttgtgtggccttggaaaagttagcttcactttcctttctgtgcagtagggatgatgagaactgtctacttcctgacgttgccccaaggattaaaagaatgtaagactctcaaaacaagcttctttgacgtcccatccacagtgcagaaggcccccattacccctgcactgtgcggttggctctcctttgcaccccttaattgaccaaaaagcagcttctgtcaccctgtaaatccttgaccttgaagaagtgggtggctaaaggtgccacagtcaagattcctcagccactcggctactacccttaccctcaattttgcagtttatgacactttagccagaagctaagtgacttgcccaggtgttccaaggtaggtggcagaggctcgatggtgcatttctttccctaccatgggcttgtcattggcttgctagaaggaattgcaaacttctaccctccagcaggagacaccctgggtttggttctccctgaggcctttccattgtgaggaaatcattccacccatcagtctggttgggaagcacccaaacagattctcttcaaaaagtcatttttgaagttatagtccaattttgactggttagagacaggtcagacctacttactttgctggctaagctttttttttttctttgcccctcaccacaagcctggacgggagacgtactgcttggtatctggtgcttgagaggtcccaggagataagggagcatttctgtgaaaggttttgccagagcctgtcaggaacttaatcttgactgcaatgaatgacttaacattataagtgatctttgggtttaggtgcccaaataccagtccctccttagtaagcagccttttagacctaaccttttctacctaaggttttgttcagtctttttgaaaagcaggaaggccaggtccttgtgaggcttttctcattacaagctcttggcaggttcttccctccaagtggagaacccttaccttccccattctttctaccttcccctctgatgatccagagggctgcaagggacctagagctgttcattggagccctagtcagctctagcggccagatctatggttaggtaatcctccaatagtgagactaattctcagtgttagaattaggggtctgcctgttctcaccagcagacccactggcatcaactctcctttgttgacatatagttaagcaccgcttcttacagatcctcatactcagagccaaccttgtcttgtctcataactcttgctactggcagaaggtgataaaattgtggcctagaggccaaatgttttttgtttggcttacagaattagattacttctcaacacatttattactttacaacattagattacttcttaacacacttatgcctgtagttacacataaaaatctggatgcttgactttttgaaagatgtgaacagtttagcaatactgtactgtctatcttcatgccatcaatttgttggatctgagtagatgctgcctaccccctcatccttgagtgggtgggggtgggggaggtgggacctcattgttcaggaatcctaccacacttggttgcctgtaccaggactccgaaggttctttcctctttgagacctttttctgaatgaacttatggtccacttttaaaatcctaaattttataaagccttaaccagtccaacctagtccgtttattgcattagatcagaggttgtcaaatggggcagttttttcctccctctacctcagggcattgggcatgcctggagtcttttgggttgtcatatggggaaggggtatgctattggcatctagcagtagaggccaggactggtgccgagcatcctgcagtgcacaggatagtccccataacaaaggatgatctggtccaaatgtcagtggtgctgagatcgaaaaaccctgatcaagaagcttaatgtgagttattgtgtcattgtgtgtgtggattaatgatggactttaccctcactaagaattataggattcattaaaattttacactattctgacttattttcatgtcataaatatcaagcagtttacctttgctttcttagggctttgagttagagacaattggatggaagaactttacattataaactttcaatgaagcataaaatagcttcctcacattaagctttcaaatacgtatttgaggtaactgtcaaatttggtaaatgtctgggttaaattataataatttttttagtaaatattcttatgtaataatagtactattgtcagttgactgtcttgtatactgatatagcttttgctatattagtgataggtgaaaatcagttttctttcaacaagaaggtaatttagtgttttaatttgacttaaatgactagcaatttgaaatatatgtatttcttggaacactaggtggccttacaatcacaattatttttacaaggaactacatattaagtttttaaaaattttttgaaggtttttttttttttttttttgagatggagtttcactcttgttgcctaggctggagtgcaatggcgcgatctcggctcaccgcaacctctgcctcccgggttcaagcgattcccgtgcctcagcctcccgagtagctgggattacaggcatgcgccaccgctcccagttaattttttttttttttttttgtatttttagtagagacggggtttcaccgctcaggctgtgtcaaaccccccagctcaggtgatccacccacctcagcctcccaaagtgctgggattataggcgtgagccaccgtgcccagccgaagtattttttagtagtataaaaattgttaatgaacaaatgaaataaatcaacaaatgaacaaaatgggaataaaacatattaaataaaacatttgtgttctgcattttaaaaatcttataatagctgggcgccgtggctcactcctgtaatcccagcactttgggaggccgaggagggcagatcacgaggtcaggagatcgagaccatcttggctaacacggtgaaaccccgtctctactaaaaaatacaaaaaattagctgggcgtggtggcgggcgcctgtagtcccagctacttgggaggctgaggcaggagaatggcttgaacccgggaggcggagcttgcagtgagccgagatcgcgccactgcactccagcctgggagacggagggagactgcgtctcaaaaaaaaaaaaaaaaaaaaaaaaaaaaaaaaaaatatatatatatatatatatatatatatatatatatatatatatatatatataaaaaacagtaatctattggggcaggggataaattgtgtccttgtttagaagaagacttttttttttttagaagaagccctgttgtttttgttgttgttatttgtttgtttgtttgttttgagacggagtctcagtgggtcgcccaggctggagtgcagtggcgcgatctctgctcactgcaacctctgcctcccgggttcaagcgattctcctgcctcagcctcctgagtagctgagactacaggcgcgtgccaccacgcctggctgatttttcgtattttttagtggagacggggtttcaccatattggccaggctggtctcgaactcctgacctcgtgatctgcctgccttggcctcccaaagtgctgggattgcaggcgtgagccatcatgcccggcccgaagccctgtattttgaaggtgaatgtttttgcttcttctctgatcagttactaaaagtgttttccctgtgccatttgagaattatttgagaactactctaagcttatggcacatttcagcatttttgttgtctaaaggcagctgtattttaatcatgtaaatttcatgctgcctcctttgcctaccatatagcttctgttgaaatgtccatgttatattttattttatttactcatttttctatatccataataagagttaaaggttatattttagcaatgtgtttttttctctgtcataacatgttaaatattttaaattcagccatgatgttaaacagagtgaattggaatttctaacggatttcggcaggaatgattatataagacttagggccaaagagagcctgggtgactgtgtaggggtattaggctatgcccagcaccacatctggttgtcattcaggggagcagctagggctggaactgctggggagtgcaaactgcagtattccctgttcccttgtctcagagcagaattgtggcctctatccaggtccaatcccagttaaaaaaaaaaattccaatggtctattcttcttttgagctatattattgtagagaatactgacttgaaaaaacaaagtcactaactagaaataaaatttgaactgggtgcagtggcttataactgtaatcccagcacttttgggaggccaaggtgggaggatcacttgagctcaggagttcaagatcagcctgggcaacatggcaaaatcccatctctacaaaaaatacaaaaattagctgaagtgtggtggtgtgcacctgtagttccagctacttgggaggctgaagtgggaggatggcttgagcccaggaggtggaggttgcagtgagctgtgattgcatcactgcactccagcctgggtgatagagccagaccctgtctcaaaaaataaaataaataaataaaaatcaaaataaataaaatttgaaaatcttgggtatgacttctttcttgtaccattcaacattcttgatgtttactaggccagtccaaataatctatttcttgtgtgcctgtttatgtcagttttttgtgacgtgtggagaagtggaactgggagtaaccaaatcagaatgaaggaagagctgtttgtgaatgtccatatgacaaatgacaaaactggttttccaagagggacagagcatgttcaagttgaacattgtatcatatatcataactgggcaaggttgagctattcagatatgtatttatggatgtaatttcatttacttgacatcctagtgtattgttgagaagttgtatgttggtaaattgatcatcttagttttgcaagaggttatactttctttcactctaataaggagactgcaggaggttatacttttagccttgtgttaaattctttgtaaagaaaattcttttgtgaattagaatataatttgtaagtttatactgaatttggagtgggattcattgatttatcattcaaccttatgtggatacgctgtggtcatcttactagtgcaggttgagcaaaaggtgtgtgcttgagtttgttcctgtaaaatttttcatgacagcacctggagagtggaaatgtgaaaaaagatgagcatcagcactttctagaagtgttggtctaagttttcatttatttactatatgattttgaatgccatcaactaatacattttcaattatccctgaaccctgtggctcagttagtgtcagtgggagtaagaaaagatccacgtgtccgggaacagtggctcacgcctgtaatcccagcactttgggaggttgagatgggtggatcacgaagtcaggagttcgagaccagcctgaccaacatggtgaaaccccatctctactaaaaatacaaaaattagccgggcgtggtggcacgtgcctgtaatctcagctactcaggagactgaggcagcagaatcgcttgaacccaggaggtggaggttgcagtgagcagatatcgcaccattgcactccagcctgggcaaaagcgagtccccatctcaaaaaaaaaaaaaaaaaaaagaaaaaagaaaaagattcacatctacttgaggcctggaaaattgttgggaagttcctgtacatattaaaccagataatgtccattcagtggtgtttttattttattttattttattttggagacagtcttgctctatcgtccaggctggagtgcaatggcaccatcatagctcactgcagcctcaacctcctgggctccagccatcctcctgccgcagcctcctgagtagctgggactacaggggcctgccaccactcccaactaattttttattctttgtagagatggggtctcactatgttgcccaggatagtcttaaactcctgttctaaagcaatcctcttgccttaggttcccaaagtactgagattacaggcatgaaccattgcctgctcctggccagtgtttttgatttaaaagagaaatacaggccgggtgcagtggctcacgcctgtaatcccagcactttgggaagctgaggtggggggatcacctgaggtcgggagttcgagaccagcctgaccaacatagagaatctccacgtttactagaaatacaaaattagccaggcttggtggcgcatgcctgtaatcctagctactcgggaggctgaggcaggagaatcgattgaacctgggaggtggaggttgtggtaagctgagatcgcaccattgcactccagcctgggcaatgagagcaaaacttggtctcaaaaaaaaagagaaatacaggccgggtgcagtggctcacgcctgtaatcccagcactttgggaggccgaggtcctagatcgcttgagcccaggaattcaagaccagcttgggcaatggtgaaacccatctctaccaaaagtacaaaaattagccaggtgtggtggcacagacctgtaaagtcccagctactcaggaggctggggcgaaaggatcgcttgagcccaggaggtcgaggctgcagtgagctttgattgtgccactgtactcccagcctgggtgacagagcgagaccctgtgttaataaacaaacaaacaaataaaagagaaatacatctaataatctgcatcacttatttgtgcttgaaacattcagtgttaaccccaccctttcctttttctctaggcaaataagggcgagactgaaaaatcaagtcactcagttgaaggagcaagtacctggtttcacaccacgcctggcaatattacaggtattatgatagtgtattttcattaatgttgtctttgcttgatttctcagtatcatttcagacctctccctctactttcctcctttttttttggctgttgtgtaatctcatgccttttcagtctctcttggcaggctcccccctttggctcagcttctaaatgttggcatatcctggccctctgctcttctctgtggataccctttctctaggccagtgtctcttaacctttggtcttagtagggcccctttacaatcttttttttctttaatttaatgtatttatttatttatttacttttgagagacaaggtcttactctgttgccaggctggaatgtagtagtgcaatcatagctcactgtagcgttgaactcctggcttcaagcagtcctcctgcctctgcctgccaaagcatgggtattacaggcgtgagccactgtacctggccccgtttacactcttaaagatgtaagacctcaagaagctattgtttatacagatttatccattaatgtttactatattagaaattaggaagttttggccggacacggtggctcctgcctgtaatccagcactttgggaggccgaggtgggcagatcacctgaggtcaggagtttgagaccagcctggccaacatggtgaaaccccatctttattaaaaacacaaaaattagctgggcgtggtggtgggcgcctgtaatcccagctactctggaggctgaggcaggagaatcacttgaacccgggaggtggaggttgcagtgagccaagattgtgccactgcactccagcctgggcgacagagagattccgtctcaaaaaaaaaaaaaagagaaattaggaagttttaaaaatgtttattcatttaaaaatgccaatagtgagctcatttattatatgttaacataaataacattttatggaacaaaaacttttttaaaaagaaaatttagtgaaaagaggggcattattttatatttgtgcacacctctttcctgtatggcttagtagaagagagctggagtcctatctgcctctgcattcagtcttttgctgtgtgctggtttgattgaaatatatggagaaaatttggcttcatacagatgtgtagctataaaagggaagaatttttttaacagtccttccaggtaattgtgggtatttttctttgatgttgtaccaggactcagtaagtaaattttaaaagattagttgcaatgtagaatctgaaactctatcagtgaactttgatactttgttacatcttctcagacttgcacactttgttacatcaaaatgttacatttggaatgaatatttaccccatgcatggttttgtaacatcctttgttcctcatttggaaaataatagttcccggaattatgcagatcttccaaatgttaacatttcattatgcaatatgaaagaattggaatcattaacatcaccaacaagctcatcagagaagttttcaagtattgagaagctgtcaagctcacaggggtggataaaaaattttaattttcacccaaaaactcacattttatcattggcaacaaatacaattaattgtttcccttgaaataccagtttcactttattcatttttgagaaaatatttgtcaaatactcaagcctgaataatcattgcttgtcagttgttatttcaagtaggtgtttcatataaaaatgcatctgtttcagctaacaaggcaaaaaagcacaagtgcagcctggacaacaaagtgagatcccatctccacaaaaaaattaaaaaatgagccaggagtggtcgtatagaggtgtggtcccaactacatgagagggagacaggagatcacttgagcccaggaagtcgaggctgcagggagttgtgttcatgccactgtactccagcttaggtgacagtgagatcctgtctcaaaaaaaaataaaaataaaaataaaaaagcactaatgctttagtaacaaccacaaccactgtacttctgtatatagcagaagtgcattatgagtgcttcccaattccttacatagactattaaaaacacatgcactcaagagttgaggtttatttatatatatatattttttacttttttgggacagagttttactgttactcagtgcagtggcacaatcttggttcactgcaaccttcatctcccaggctcaagtgatcctcccactcagcctccagagtagctgggattacaggcatgcgccaccatgcctaatttttttttttgagacggagtcttgctctgtcgcccaggctggagtgcagtggtgcaatcttggcttactgcagcctccgctcccagattcatgcaattctcctgccttggcctcctgagtagctgggattacaggcacctgccattgcaccctgctaattttttttttttgaaacagaatctcgctctatcccccaggctggaatgtaatgacataatctcagctcactgcaacctttgcctcctgggttcaagtgattctcatgcctcagcctctggagtagctgggattacaggtgccacgcccagctaatttttgtaattttagtagagatagggtttcaccattttggccaggctggtctcgaactcttgacctcaggtgatccacctgcctcagcttcccaaagtgctgagattacaggtgtaagccactgcgcccagccttaattttttgtatttttttgtagagtttttttttgccttgttgccctagctggtcttgaactctgggacccaaagtgatcctcccattttagcctcccaaagtgctgggattacaggcatgagctactgcgcttggccttaattttttgtatttttttgtagagacggttttttgccttgttgcccaggctagtctccaactcctgggctcaaagtgatcctcccgccttggcctcccaaagtcctgagattacaggcatgagccactgtgctcggccaagttgaagtttaagaaaattaataatgtatatttcttcatcaagggtggtcctagtgaaactggcatttagttttactgggagtgtgtggtagtgaaggataccttgactactagtccaaagccattgtcttgatttgtgctggttcactagtagtcttacacaccattgcttttgcaccatcggtacagacgttaacacaatgaaaaaggcaaacaacattgtagtggtattattatgaagctagtctggccctcataaatctttgaaaaggtcttggggtccctcaagagtgtgtgggccacattatcagaaccattattttaggcagtttcatctatcaggccagtgacttctaaatctagatttcttctgagctccaggctcttggtctgggacaccactggtttccttcccaccttcaagtctcctttgcttgttgttgctcatcaccctaatacctaaaccatttgaatgccttgggctcacccttgagatctcttccccatcttattctttccctaagtaacctcacccagtcccatagcttcatgagggaatgcttccaaatttaggtctctatccagtatttcttccctgagctccagattcacccagtagggagatattcaatacatatttttacggacaaatgtatgaaggaatgtttgcaatcttgatttggatgacaggaaactcacggctttcatttgaaactcccatcagagtttcacccaagttggacatagtctccttctcaatctctttatttgtatgtctccaatagatcatttaatcccttgctaaatttctatcccttgttcatcaagaatgtcaaggtgggcatggtgcggtggctcatgcctataatcccagcactttgggaggctaaggcgggtagatcacttaaggtcaggagtttgagactagcctggccaacatggtgagaactcatctctactcaaaatacaaaaattagccaggtgtggtggtgcacacctgtgatcacagctactcaggaggctgaggcaggagaatcgcttgaacctgggggacagaggttgcagtgagctgagattgtgccactgcactccagcctaagactccgtctcaatttaaaaaaaaaaaagtcaaagtgaatagtacttaaatattcccctctcctcctctgctgtttgtctaagagggcttagctgagaagaaaagcacagaaggcctgtcactctctgcctggcatgttctctgctgtggtggattttcccttttttgcaaattactaagaatcaaaagtatatattgtgggtgtatactggtacatttggtggctggttatttcttggcttatttttgcaaattgtttgttgtagaaagagtaaatgtcataggcaagaagtataccctttttaaagcaacattgggggtgttttttttcctccattttaaaaactgacttccaaccttgttttttaaatttattgattacaaatgtttttattacataaacactgttctacagctcgtctcctacgtccttgctgataaaacagtggtagaatcttttaattttgtactttagcaccagagtcaacagctttctgtgatacaaggtttatataatatgttgtaatcacatctccctgcctcagacctctagtctttttcgctgtggtgctggcaccaccatcttcccacattccctgagctagaagcctgaggccgtctccttaggagctctcttcctcactccctgcatccagttaggggctattgtcctattgattgtgcctctcatcaactcttggaatctgttgcctccccttgattcctatttctcccaaccctggggccactatagttacctgcttaatgatttggggttctatctatatacctcctgtctgtcctcctgactgcaattgcaatccttgttaaaatgcaagtctgatcacaatctatccagccacactcactctccatcctttaccagaatgatagtacaagttgagtatcccttatccgaaatgcttgggacaagagtgttttagatgttggaatctgtatatacatagggatgagatccaattctaaagcaaaatttatttgtgtttcattatataccttatacttgtagactgaaggtaattttatatatatgtgtgtgtgtgtatatatatatataataataattattattattattattttttttgagactgagttttgctcttgtcacccaggctggagtgcaatggcacgatctcggcgcactgcaacctccacctcctgggttcaagtgattctcctgcctcagcctcctgagtagctgggattacaggtgtgttccaccacgcctggctaatttttgtatttttagttgagatgagatttcaccatgttggtcaggctggtcttgaactcctgacctcaggtgatccgcctgcctcggcctctcaaagtgctaggattacggacatgagccactgctcccggccaattttatatatttttaataatattttgcatgaaatgcacttttaactgtgttttgactgtaagccatcacatgaggccaggtgtggaattttctacttttggcgttgtcagtgctcaaagtttctgattttggagcattttttatttgtggttttttttttttttttttttgagacagggtctcactctgttgtccaggctggagtgcaggggtgtgatcacagttcattgcagcctggatctcccaggctcaagctatcctcccatctcagcctcctgagtagctgggactacaggcatccagctaattttagtatttgagacagaatttctccatattgcccaggctagtctcagactgagctcaagtgatccacctgccttggcctcccaaagtgccgagtcaccgcacctgactgattttggatttttgagttagggatcttcaacctgtactacttatatagagtgtctacaataattcaaattgtttgtttatatttctaatcgttctatgttttatactaccctacgatgtaggagatgtccccttatagccatagtaactcatgctcaaagatcttgggtagcttgcccaaagccagtcaggaagggactgagtctgggaaatgaacccagatctgtctctaaaacccatttgttcttcccctttgttttcctaattccttagcaatgcattcaagaacattcatgatctggcccaagtatatatttaaaagttgagttttcatttttttttaataaagtggatgagtaacttcccaaataactgaatatttataggaaattaagacttgacttttcattataagagatactaatgggctaggcatggtggctcacgcctgtaatcccaccactttaggaggccaaggcgagtggattgcttgagcccaggagttcaagaccagcctgggaaatatagagagactttgtctccaaaaaaatacaaaaattagctggttgtggtggtgcttgcctgtagtccccactactgaggaggctgagctgggaggattgctcacgcctgggaggttgaggctgcagtgagctgtaatcgtgtcattgcactccagcctgggtgacagagcaagactttgtctcaaaaaaaaaaaaaagtttctggtaaggtgatagaaatacagcctcagccccatagcctcattagtatctctcactctctctcttttttttttttttttgagtcagaatcttgttctgtcatgcaggctggagtgcagtgatgtgatctctgctcactgaaacctctgccctcccctgtcccccaggggatcctcccaccttagcctcccaaatgagctgggactacaggcacaccaccatgcccagataatttttgtattttttgtagagatggggtttcgatatgttgcccaggctggtctttaactcctgggctcaagcaatccacacaccttgacctcccaaagtgctgggagtataggcatgagccactgcacctggccaaaaaactgatttttaacagtattcgggaactattcagagtgctttatgtatagtaactcattcagtcctcacaaaatacatggacagaatacagttaataaactcaactagcctgtatcttcataaggttttctgaaacagaaagaaaaatgaaccagtagaccaatacccaagatatcttacggtgtagaacacagattagtaaactgtggcccgtatccaaatgctgcccagtttataaagagttaaaaaagcaatagcagcagctgctgtgacacggtatgtgtcccacaaagcctaaaatatacaccgtctgcccctctacagaaagtttgcagactcctggtataaaaaaaaagtgtccctaacctgttctggaataggatcttttttggatgatgtagtactcagccaccttcaaggagaaatcagcattcttttttttttttttttttttgagatggagtttcactcttgtcgcccaggctggagtgcaatggcacgatcttggctcactgcaacttctgcccccggggttcaagggattctcctgcctcagcttcccaagtagctgggattacaggtgcacaccatcatgactggctaatatttgtatttttagtatagatggggtttcaccatcttggccaggctagtctcgaactcctgaccttaggtgatctgcccgccttagcctcccaaagtgctgggattacaggcgtgagccaccatgcccggccagaatacacgttctttaaacattctttttgcatctagtctatcaatggttctataaccactttcccctataaaatgcctatactggccaagtgtggtggctcacacctacctagcactttggcaggctgaggcaggaggattgcttaagcccaggtgtttgagaccagcctgggcaatagagaaactccatttctacaaaaaatacaaaaattggctgtttgtggcagcgtgtactggtagtcctagcttcttgggaagctgaggtgggaggattgcttgagcctaggagttgcaggctgcagtgagccatgatcatgctactgtactctaggctgggtggcagagtaagaccctgtctcaaaaataataaataaataaataaaacctatactaagagtgactctttgaattggcttttagatgtcttttccaataaaactttgacatacgctcataactataactattaagttttctttctggaactggttgtagttttagtgttttagacaaactccttcagaaatattcaggccgaaaatagttacatgtaaaggaacaacaacagcgagagacttcagacttctcctgtgtgacattagatgccaaagacaacatctccgaaggaaaatgctgtcactccaaatcaggcaaggccagtcaagtgcaagggacagcagaaaaatattttcagttatacagacttagaaacatgtccacctacctttcctggaaaactgacttataagttacatttcacttacttgaaacatgaatgaagataaattctagaacagagaagttgtggcttccttactggcagcaagtgataaaacaatttaatctcagagttaagactaaataactagtggtaggtataaatatgaatgaaattgtaaaaaaataatacttttgtatttagaaccacctcctttcctactttgatctaaaaattccggaatgtatcaaatctggtaactgaaccagtgagggttgggtggtggggcaaagaacatacatagaaagtgaccaaagaggaaacatgagaggcacgaaaagtctagggaagcccctacgagaagcatctaatgtacttagatacaaataacccattaaaaaaaaaggtagaattcccctcaaaggactcttctggctcttgcaattcaaattagcaccacaaaactgagaactgtctgtataagggacaactgaagctaagattcaggccatgtcctgagatctgaggagagcgtccagtaatagcaccaatatgacaagctcagaaaatcctgtgttacaaaagccggcttctttctctgccatggtcctgttaaaaggagctgtgcttcagttgtctttgatatgaagggaccaccacctttccctctgtgataccctctgcaattctgggagaaacacaacttatggtagcatgtatcaaccttgagaaggagaaataccaaccactggagcatgaaacaatattagtacaataaaattttacaaataaatggttataatgataaactataaatatgttcatggtcaaagaaacagagggaacatagtgagacactgcatggtggttcaaaggatttagcctctgcactacaagtttctccctgtctctctcttttttttttaagagacaaggtctctctctgttgcccaggctgcccaggcatagtaccatgactcactgtgcactggtgcaatcatggaaaaactcttgacctcaagtaatcctcccaccttggcctcctgagtgctgggactacaggcaggcaccactatgcctggctaattttttgtaaagatgggggggggggtctcactatgttgcccaggctggtctcgaactcctgggctcaaacgatcctcctcccttggcctcccaaagtgcagggattatagacctgagttgctgcacccggcctcctctctgtgttggggccagcagattgccctttgtcttgcctggctgtttattctgtgtaaactagagggaggtccttccaccctcctttctattgtctgtgtggcggggccagggagctttccattgcccctgcgggtgggggagagggtgtggaatgtgccctctgggtgctcctgcctctcaggcatttttcttgcctgatgacagtttctcagccctccatactctgtttttctggtatggcagcagaaatcccacatgtttctagtaggcctgcagcatccttgcttagtttccagtgcagatgcagatatcctctactttctgtttggggtttggcagtgggaaccaggtgggccttgtttaggggaggggctgtaacaccatctgtgttcacataatccctcctgcccccacagcctccctatactcctgtaaaagttctctgcaacaagagtcgcatgattaaacatttcttttattaaaactaaaattgtagaagcttttctgtgcactttgcctttccctaatcatctgatttgcatgcatttattattctaggttggcaacagagatgattccaatctttatataaatgtgaagctgaaggctgctgaagaggtaacgccagaagagctgtgccatcaccctccccaacctccacctgggtcctatcgattaccccttgccctttttggtcctccctgtgaaaacttttatcacccacaggagacattagtttatctattttgtaagtcagaaatgggtgggttagatctgtggcctctggtttgcccgtgagtttttgttttctcattaatgattttcttcccaaagagcaggatgtcaattgaggaaagtgacaagtctcgatcattttaggagatttatttgccaaaattaaggacacacctgggagacaggtctatacctttctccgaagatgatttcgagttctccaaatttaaagaggaaagggtgggttattgaaaagtacacgttttcatgtaagaggtgggtagggaaaaatagtcattcatgaccttctctggctcagtgaatctgcattttttacataagatgacagatggccggacgcggtggctcacgccagtaatcccagcactttgggaggccgaggcgggcggatcacctgaggtcgggagttttagaccagcctaagaaacatggagaaaccccatctctactaaaaatacaaaaaattagctgggtgtggtggcgcatgcctgtaatcccagctactcgggaggctgaggcaggagaatcgcttgaacctgggaggcggaggttgtggtgagccaagatagtgccattgcactccagcctgggcaataagagtgaagctccaaccagaaaaaaaaaagacgatatagacaagtggggcagaggaaaaatgcaggcaatctgcattttacataagataacatagacagaattgggcaggggaaaaatcagatatacatttgtgtctggtgggctggggggatttacattgccatggtgaaattttaacagaaacatcataaagatgttgcagctcactacgaatttctttgtgggcaaaatatgggggaggcatgtagcttttcatcttgtaacatcttatttaggaaccaaaaagggggaggcagatttgcatgacccagttcccagcttggcttttccctttgacttaatgaatttggggtcccaagatttaatttcctttctcaagaaatagcaagcatgacattgctgaagtgcagtggtggcaattaacaagtgaatgatgaatgggttgaagtgagggactcattcttcagaacatataagggtgaaatgatgaccaacacctccttgcttgttagtcatgtctgtaaaagaaatggttcaatatctcaagttgtcttgccatttacctgcttttaatgtctgttttgcagattgggatcaaagccactcacattaagttaccaagaacaaccacagaatctgaggtgagcttttatgagttgattgtgaagagggaaggtgaagtggtttcctctctggttttggtttacgggggctttggggactgacacatttagccaagacctccaggtattttttttttttttttttttgagacacagttttgctcatgtcacccaggctggagagcaatgatgcgatctcgactctctgcaacctccgcctcccaggttcaagcaattctcctgcctcagcctcccgagtagctgggattacaggcgcccaccgcctcacctggctaatttttatatttttaatagagacgcggtttcaccacgttggccaggctggtcttgaactcctgacctgaggtgatttacccgccttggcctcccaaagtgctgggattacaggcgtgagccaccacgcctggcacctccaggtattctttcttcacagactcccacagaggagatggtgcagggatgaacatttggtactcaaagtgtgactgcagtactgtttgcttccaaatcatctgttgtgtttgttaaaactgatccttggagccaggcacggtggctcatgcctgtaatcccagcattttgggaggccgaggtgggcagatcacctgaggtcgggagttcgagaccagcctggccaacatggagaaaccctgtctctactaaaaaatacaaaatttgccaggcgtggtggcgcatgcctgtaatcccagctacttggaaggttgaggcaggagaatcacttgaacccgggaggcggaggttgcagtgagccaagatcgtaccattgcactccaacctgggaaaaaagagcaaaactccgtctcaaaaaaataggtaaaaccgatccttggcctgtaattatctgcattctaaaaaccaaatatgtattccttttatatgaggttcaggactaggcagaacaaatcagcggtgattaaagtcagaactgtggttgcctgtaggtgggagattaatgctaaactgtaggaggataaagcaactttcttgaggttatggcaatgttccatatatgcgctgtccagtatgggagccactagccccatgaggctatttgaatttagttaaaatgaaataaaattaaaaattcacttccttggttgtactagccactttgcaaggattaagtagctgctattgtattgtaaggtgcaaattatagaaaatttctgccatcgcagaaaagatgattggacattgctgctctacatcttgatttggatgattgtaacatgggtattattgctgtaataagttattagagttcttagctctttttattttattgtattgtatttttagagacagggtctcactcttttgcctcagctgcagcacagtggtgtgatcatagctcattgtagcctcaacctcctaagctcaagtgatcctcccaccttagcctcttgagcagctgggactataggcatgagccaccatgcccagctaattttattttatttttgaggcagagttttactcttgtcgcccaggctagagtgcagtggtgcaatattggctcactgcaacctccacctcccaggttcaagcgattctcatgcctcagcctcctgagtagctgtgactacaggcatgcgccaccacgcccagctaatttttgtatttttaattgcccatattgcccaggctggtctcaaactactgacctcaagtgatctgcccactcaagcctcccaaagtgctgggattacaggcgtgagccaccgcacctgtccccgcttttttttttttttttttttttttgagacagagtcttgctctgttgcccaggctggatgcagtggcatgatctcagctcactgcagcctccgcttcctgggttcaagcgattctcatgcctcagcctcctgagaggctgagattacaggcatgcgccactatgcccggcttattttttatatttttgtagagacagggtttcaccatgttggccaggctggtttcaaactcctggcttcaagtgatccagtagctgctattgtattgtaaggtgcaaattatagaaaataattttctatattttgggaggcctgccttggcttcccaaagtgctgggatgacaggtgtgagccaccacacccagccctaattttttttttttttttttgaggtggagtttcactattgttgcccaggctggagtgcaatggcacaatctcaactcactgctggagtgcagtggcactatctcagcggactgcaacctccacctcccaggttcaagcaattctcctgcctcagcctcccgagtagctaggattacaggcatgtgccaccacacctggctaattttgtatttttagtagagacagggtttcactatgttggcccagctggtctcaaactcccaacctcaggtgatccacccacctcagcctcccaaagtgctggaattacagtcgtgaaccaccgcacccagcccctggccctaatttttaaaaagtttttgtagatatcacatttcactgtgttgtccaggctggtcttgaactcctgggttcaagtaatcctcctgacttggcctcccaaagtgctgggattacaggcatgagacacctcgcccagcctcttagctcttttatttgatggacttcttaccagacacctaggggatgcattctatgttaaagtacaggtgctctcaggattcaaggggaaggtacattctgaaaggactataattaaagtgttggggggaaatagggcaacctaatttttgccttagaaagtgtttcttcctaccttttgatttctgtgtgatatacaaattatatatggtattacttttaggtgatgaagtacattacatctttgaatgaagactctactgtacatgggttcttagtgcagctacctttagattcagagaattccattaacactgaagaagtgatcaatgctattgcacccgagaaggatgtggatgggtaagtgtggcttggcttcctatgtctcattgcatgctttcatttataatatgtttctatttggggaatacagcataaatgtttctaaagagtaaagacatctaattgcctttatttccttcttatttccatcacttttttaagattgactagcatcaatgctgggaaacttgctagaggtgacctcaatgactgtttcattccttgtacgcctaagggatgcttggaactcatcaaagagacaggtaaaaacaacaaaccaaacaacaagaaagcaccatttcctgaatcctggtcttgacatgtggtggcatagaggaggtacattgtgggccataaataaatggacttgattggcagaagggcctgtctactaaggatgttacctaaattttctctcaattttctcagcaactctgtgaagtaggtactgttattgttcaactgctaagaaaataggctcaggccaggcacagcggctcatgcctgttatcccagcactttgggaggctgaagcgggctgagatcacctgaggtcaggaattcgagaccagcctggtcaacatggtgaaaccctgtctctactaaaaatacaaaaaaattatccaggcagggtggcatgcacctgtattcccagctattcgggaggcagaggtgggaggattgattgaacctgggaggcggaggttgcagtgagccgagatcacctgactgcactccagcctgggcaacagagcgagactctgtctctaaaataaacaaacaaacaaacaaacaaacaaaaccagctcagagagagcaagtaacttgtctgggagacaacggaaccaagatttgaattcagagttatctgagttcaaagcaatttattttaacctatacagtaataaaaatttggatagtttaaaaggatatgaagtgaaaagccccacctccccccacccccaaaatgggcactgaatctccacagtagttccaggactcgacagatggctggaaatgggtctcctgcacagttggccatattgtcccgttactagttagcaccttgctattttaatttcattatgaatacttttagcagaggttattttttacaaggaaatgggtcctggtaaaaagaagtaggtcagaagtttcaagtggaaagttttggccagcataaatgaaaattttctgtggttggcaagaaaaggtcaaaggtcaagctttgacagttcatttctacagttaaatgtatattcttcagcatatttagcaaacattgtagtgccttgcttaaaagaaaaaaatcccacgaggacagcacctgaaggcctcccactgcctcttattgagtgatgctaccatttgccctgatgcagctttaactcttctgctgaatcctaaaaagtatagaaagttaccttttaaaactttgaggtctttacttctagatgttcatgatgttcacattattataagagtttatctttttctgaaaaaaaatgattttatgcgagaagcacaatttaaacccttgctgctttgagcaagggtccactgccctcagccttgactgccctgaggactctgatgaagtcgtcaacttctctctgctttcttctttgtggacagctcattttcgggctccactttgtggccacaaacacctacagcctggttccatcctcatgcctaacagtcatgggattggatcttatcagctgagggaagaaatatggtcccctgtccactactgggtactcactcaggctgtctttagtagagtatgagtcagccctgaaaaggacattggtatattgccagaaaaatggatgctgtgatagcaaaaagaaagctttgctgccacagttcaatttcccctttatcacttccctgcaagtaaccctatggctcaggccctaagccaaaagagaaatttgggtgaggaactgtataaacaaacttaccaaagttagaaggaattaccgatactaatctaatttcttacacatctctccagcctgttacatacaccctatttgttttaactttttttccccatgtaatttaatctgatgtcttcttccgtatggctgattagctgtatgtcagggtttcttttttctttgagtgtaggttttcttcccactcccctatgactcaatgaatgatcttggcttaagctgctcccaaaaacccacggccagaaggacacaagtacaagtcccaatttatagctgaaaccctagagttgagaatattattgccaaagaaggaatgcttttaggaaggtttctgtttgatgttaagaacctgtttttgtgcacttattctaatttctccacgtggcatgcgaaggagggcagcttctatcctccaactctgatgcaggctggcttttctttcaggggtgccgattgccggaaggcatgctgtggtggttgggcgcagtaaaatagttggggccccgatgcatgacttgcttctgtggaacaatgccacagtgaccacctgccactccaagactgcccatctggatgaggaggtagggtgtccagaggagaggtaaaggtgttacggtggggagggtgggtgtgccagaggctgccatgtcctttacactcatgacctcatttaaccccatcatctcatttttacaagatgaaaaaacaaattcaaattaaaggctgagtggggtggctgacacctgtagtcccaacactttgggagtctgaggcaggaggattgtttgagcccaagagtttttgagaccagcctgggcaacatagtgagacgctttctctgcaaaaaaaattaaaaattagccagatggggtgggcacatgcctgtagtcccagctactcgggaggttgaggcaagaggattgcttgagcccaggaggtcgaggctgcagtaagctacgatcacaccactgcactccagcctgggctacagagcaagaccctgtctcaaaaaaaaaaaaaaattaattaattaaaaaaaacataaaattaaaagcatgctgaagtttatacagagtttgttctgtgtactttctctcttcctttttcttttttctttatttattttttttgagatggagtttcactcttgttgcccaggctggagtgcaatggcgcaatctcagctcaccacaacctctgcctcctgggttcaagtgattctcctgcctcagcctcctgagtagctgggattacaggcatgtgccaccacgcctggctaattttgtatttttagtagagacaaggtttctccatgttggtcaggccggtcttgaactcctgacctcaggtgatccacctgccttggcctcccaaagtactgggattacaggcatgagccaccatgcccgacctttgtcttttttcttttgagacagggtcttgctctgttatttaggctagagtgcagtggcagtccatgagagcccactgcagctttgaactcctgggctcgagtgatcctcctgcatcaaccttctgagtagctgggactacaggcatgtgccaccatgcctggctaatttttaagctttttgtagcgacaggggtctcactgtgttgcccaggctggactcaaactcctggactcaagcgatcctcctggttcaccttcctaaagtgctgagattacaggcgtgacccaacatgcctggcctctcaccaagtactttctaccctaatctgcctcgtggtggacagggattagcagtacaggcactcagattgacctctggcagccagatcccatgtgtgtaaaagtggtggcctcagagtgaaggtgctccagaggcagtcgtgggcagtagtctgctaatagctatggcagcttgttctagatccctgcatcagattcctgagcccaagaatgcgcacacacacacacgtgcctgttgacagtgcagtctcttaaatgtggggagagagcaggagagaggcctagtactttctcttttaatcctcccaaagtagtgctctacattctgtaggagaaggagcagtgtctggacataacacgcagggccccaagcctgtttgcccctctgccttgcaggttgacactgatttccctattgggtaaaatggctggtgaaagggagctctttggcatgtgtagaaatgagcacggcatgtgaagggctgtcagaaacagtgtgtggcttacatttgaggccttaacccaatatcttatgaaatagcttatgacacttaagaatttaatacaaagctcagggatatccttttcatttctgggtttttttttggtgtgtatttcattatttcatttctgatgtccaaatcccctacccctaggtaaataaaggtgacatcctggtggttgcaactggtcagcctgaaatggttaaaggggagtggatcaaacctggggcaatagtcatcgactgtggaatcaattatgtcccaggtgagtgttgttggaggagtaaggtggctgctggtattgaggatggtatctaggtcatcaaaagaagcctgagagagaagcttgtctcattttatgcttgtagtactaaggtttaggagactgactagcccaagggtgcacagagttagtagatagaagagttgccacttgcaggcaggtctgcctggtgccagagcctttgattttcatcatgtgctgtacagcttccaagatgactttgtccagggagaaagtgagagggagggcaggagggatatatcactttatcttcatgtagagatcaccctttattttagcaaagttgatggatggatttaaaatacagtataattattgcaaagtgctatgagagtccagaagagggactcattctgccaagaggagggctttacaaagaagatatttgacctgggtttttttctaggctgagaggataaatctagccttttaatcatgtccaaaactgtactcggcatcctcatccccaagttaccccttactcccgtcttttggttagtatcaccattcttccttcccgcaagtctgaagccttttagtttccctcccaagcattccctatattggaccagtctctaaatattaggaattgttttctctctcctctgttctgagtgtcaccactgagtgttaccttctcagctgatgggctgtgataacttccttgcaggtgtccctccctccagctgcttcccactcagatctatccccgtgctctcgccttgccacgttcaccttctggcatggaactctgagcctcttccttcttacttgccagactccttagcctcacactaatttcagtgacctctgcagcctgtgatctcacttgcgcatggtgaatacctgtcttcaacttgtaaagtggaccactttcccttccctgcgcatgcctcgtttgccctttgtagttccctcacctgcattcttagtggagtgggctactctttcaaacagaaaacttcacagaacaatagggcaaaacttgcgtacgtcctcatagatccaagaaaggaacaatctttaacggagcaactactgtgtatccagcacaatgccaggccttgggctacacaactgaataaggttcaacttcaccttcaccttcagctgcttcctccccatctcctctctgtcatgtctgttattccttccaaaccttgtttgatttccccttatcaagggatgatctttccttctctccctccctcctctcccatagaacatgtgtattgtatcttttgttgcatgtgtctcatgtacggcgtcctgtgctctcctgcctagatagctcctcaagggcagtggtcactgtggcgccacatccagcttcctgccatctgaccactggcactcatatctattgaattgtcgaagggagttatagctggaagtcttttttctcccttcccatctcaagtttcagatgtagacgctgagctgccaggaacattagtcactgtcaagccttcaccgtttttaacctccctcccactctccctaccgtgcttttaagacagtagctcataattgatcactcattttcttgtagtgtaattatctaacaggcgataaagaaattgctctcctacaactcctcactttgaatacttgcgatatgacattcaagctcagtctttttatttatttatttttttaattttttttttttttcttgagacggagtctcgctctgttgcccaggctggagtgctgtggcgcgatctcggctcactgcaagctccgccttgcgggttcatgccattctcccgcctccgcctcccgagtagctgggactacaggcgcccgccaccacgcccggctaattttttttgtatttttagtagagacggggtttcaccatgttagccaggatggtctcgatctcctgacctcgtgatccgcccacctttgcctcccaaagtgctgggattacaggcgtgagccaccgcacccagcaagctcagtctttttaaaacctcgcatcttctgtatcatatttctgcttttggcattttttttttggattacatgtgagaaatggagaagaaaaacctgagtggggatcttgagtgttgcagataggtaggaaatgttgacttaaacatgaaacttgccatccttttcacattgattccttatgtagacaataaaatatgaataaaatcaaagcagtatcttcccttctggtcaacagtgtttttactgatcttgggcatataggcaaattaatgctgatacagctggatgttattgtgttccccaaaggatggcagaatcactcagttacagaccagcaaatgggctgcaggacctaaagactgatatttgcaaatgttcactttagaagcaaacttttctaccaccgagctacttcttggttcatattttgattatttaaatagtttgcatggtccactcagggataacattgtaagtcacttgccaaattaagaatgaatcaaggtgtgtataccttttacaaagaagtaatatttttaaagattcaagtgcagggcagaaagtattggccagagaaacacataaaagtgctcttcctgcttggcttactaaagataaattgagaagggccagatcaatagtgttttatttggaagggttaaaaagtgggaacagattccccaccctaatgcaatccagtctcaacctatccagtgtagctgcttctggactggcctctattattagggtccccaaattaaatgtagaagagtcagggctcagctggatctttagttgatttttgtacatgtgatttcccaaagaaagagaaattctagggctgggggtagataaccaaaaggtttgctcattactgaggtcatatgcttaggctgagtagtggtcactttttccactgaccacatcatcctatccacgaagcactgcatgtttagcagtgtctcgtcaaccctgacagtatttggtttaggagcaaaactgaactcaccagtgctgcgtttagtcatgtagtcaaagatatgtgtctcttacctgtgggaaaacgaaaatgactaacattaacacgtagaaatagatgcagcgggtatttcaagctaactacagtgtgaagacgattgaaacttgtacagagggcaaacctctatctatatttccttggcattttgaaatgactctaggggctgtaagaggaaatgttctgccagtttgctgctttataatcttctagaaacttgaaaccatcccaatgagttgtgttgaccagctccttttactccatataaaaaatatcttacgtatctgtggtggaaagagaaactcttgcgtttggaggctgctttttcaatttcagtaatgtacacattttctcattttgccctcagcaaatttgtgataggtagtgttaagccttctttgcattttggacttcagattaatatggagcccacaggagctgcagaactaacttttttttttgagacggagtttcgctcttgttgcccaggctggagtggaatgctcactgcagcctccgcctcccgggttcaagtgagtctcctgcctcagcctctgagcagctgggattacaggtgcccgctaccaagcccagctgattttttaatatttttagtagagacggggtttcaccatgctggccaggctggtctcggactcctgacctcaggtgatccacccgccttggcctcccaaagtgctggcattacaggtgtgagccaccacacctggccctaatttttaataaaagagctgatgctacagctaatctcttttttttctgagacagagtctcgctctgttgcccaggctggagtgcagtgacgcaatctccgctcactgcaagctccgccccccgggttcatgccattctcctgcctcagcctcccaagtagctgggactacaggtgcccgccaccatgcccagctaatttttttgtatttttagcagagacggggtttcactgtgttagccaggatggtcttgatctcctgatctggtgatccgcccgcctcggcctcccaaagtgcctgctaatctcttaattctggcttcttgcctccaccttggagcttcttctcagttgtggcgatctgatcagagagaagtggtgatgtcgctaaaactaccagatgcagcgcgggagccttattgcttcgaggtctaggcccgcccccagcccctcctggaagtgcactgaagccaagtgtaggatgttctttgtgtgagtgagcaatgatgcatcattgggttttgttctcttgaatagctattctttgctggtaagatttgtagttgttcttgtgtccttttaagggaagtgtaattatattctttgcctttagcatacatttaagtagctgtgtctttggaattggatgttgaattgttcctccagctcacacatggagctcacaaaatgctgacagttgctgtagaaacgatatctggcagctgtgacagagttggatctttgtgcacccaaaaaatttcctttgtaggctttagcaaattaacattttaaaatgggtgctcattatatactgggtagttggttttaagaataaaaaacagttggtattttatttgccacctgagagactacaaaaggattctccaggttctgtaaaaccacttatgcatcttgtgaatttttgcaggtaaaataattttctccctaagaaatagcaaacatctgtcattccatagcttttaagttaagtaggcactggagcctgatgggactaacacaccctacaattctgctgagtttttgtcgtaactgatcaccaggactgtgattctgagacttagttttgatttctcccccacttgaccagatgataaaaaaccaaatgggagaaaagttgtgggtgatgtggcatacgacgaggccaaagagagggcgagcttcatcactcctgttcctggcggcgtagggcccatgacagttgcaatgctcatgcaggtaattgtgaataaaagtttctataagagttctgaaaagctgatcgagttttggctgcttttctccccaagtagaaatgtcaaaaacctactcagaagtaaagatgtgaatttattgagaaaaagggaagggaagaatagagaaataagatcaggcacattaatagaggaaagtagggatggcataattccagtctgttttggaatataataactttgaaagaagaaaagtgcgatcacactggcttggccaggtctgttttggtttgccttccctttctttttttttttttttttttgagacggagttttgctcttgctgcccaggctggagtgcaatggtgtgatcttggcttaccgcaacctccatctccctgattcaagtgattctcctgcctcagcctcctgagtagctgggattacaggtgtgcaccaccacgcccggcgaattttgtatttttagtagagacaggtttctccacgttggttaggctggtctggaactcccgacctcaggtgatccgcccaccttggccttccaaagtgctgggattagaggtgtgagccaccgtgcccggcctgttttccctttctaacatgcaccagctgacaggggccaggcgagcagccccaaagcatgttaggtgcctcttgactcttagctaggattgaagcatggtaataagtgggtctgaagcagttcattttgtgattgaactggagtgacctggagcttgaaactgaggtgaggattaaaataaccacctcttctaagtttcatttatttcattttgcttagagcacagtagagagtgccaagcgtttcctggagaaatttaagccaggaaagtggatgattcagtataacaaccttaacctcaagacacctgttccaaggtaaaaataaagttttactgatttaaaactttgtgaattgttggtttttagttgacagatactgtgggttcacatatgctccctctgaaggtgccttcagtggttggggttgggttgggggcttgttactactgtgggattaattaaactcagtggataaacattaatacctattttctatgtttccaaagtgacattgatatatcacgatcttgtaaaccgaagcccattggtaagctggctcgagaaattggtctgctgtctgaagaggtagaattatatggtgaaacaaaggccaaagttctgctgtcagcactagaacgcctgaagcaccggcctgatgggaaatacgtggtggtgactgggtatgctttttattcatgttgccatccaaatcttagtatcagtcctgatactaaggcgttgcatttgcacttggcacatgtatgtagaggtgcctttaatttgattttagcattttcacccgtatttgatctcatttgatccttacagcaatcctgagaggtaggtaagaatagattataatcatagatgagaaaattggtcaaggttatccatctagtaagtggaagagtttggtcttaaaacccggtcttaagatagaatcaccttttgctgttgttgttgttgttgttgttttgagacagagtctcgctctgttgcccaggctggagtgcagtggcacgatctcggctcaccacaacctctgtctcccaagttcaagcggttctcctgcctcagcctcccgagtagctgggactacaggtgcaaggcaccacacccagctaatttttgtatttttagtagagagtgtgtttcactatgttggccaggctggtctcgaactcctgaccttgtgatccacccacctcagcctcccaaagtgctgggattacaggcgtgagccaccacacccggccagaatcacctttttgaacccaaaattcattaattcgatggatttactaagcattcatttttattgctgggctgaggttatattaaaaagctagtttttgagaatataaaatgagaaattaaaattatagccgtgtctctacaagataaagtatatttgcttcttacagcaagaagagctaaaatacaggaatcattttttttcttaaagttttttggaaattacaactaagacttttgaaaaagatatctttcagggcttttgtctttctttttctttgtcttttctttctttttttttctttaagagatgggggtttgctctgttgcccaggctggagtacagtggtgcagtcatagcttactgtagcctggaactcctgggctcaagtgatcctcttgcctcagcctcctatatagctgggactacaggcatacactgctatgcctgactttgtctttcttaatctttagattacgagtcattctctaggatctgctaggtatgacttagtgattcagatacacttaattctttaaacctttttctcttttgctttcgtcttgaagaataactccaacacccctgggagaagggaaaagcacaactacaatcgggctagtgcaagcccttggtgcccatctctaccagaatgtctttgcgtgtgtgcgacagccttctcagggccccacctttggaataaaaggtactagtgagactggaccatgggtggtgacaggggacctgcttctccttcagtcctcccaggcccacgcaacctatgatacttatggggtcttcaactcatttcaacaccaggaatgtcattctcacaaacctctgtagtcatgcttttgatgaaggctgtcattggatctccccagctcctgctgtcactgttggccactgcacagggattctctgggatgggtgatatgtagctggaggtgcttttatttgaccctcatagtccactgctacagtaaccataaaggtaatcatagctactgatcatcttacagacactctagagacaatgacaaaccccacagatgtttcaccttgttgggaataagaaaagcctacctttattgaatatatgctttgtgccagatattgtgctgagcagtttttgcatattattctatcatccagtacgagatagtattgtcaccattttaaaatagcagcaactgggacttcagaggtggcttggtcaaaggcacctgtattaagtaccagagtgattcttccatgtctatttcaagctctaaattactaccatactcgcactttaccttcagatttttattgctgcggtactaagaacatgtgtttttttttttttttttttttttttgagacagggtctcactcactctgtcgcccaggctggaatgcagtggtgtgatctcggctcattgcaacctctccaccttctgggttcaagagactctcctgccacagcctcccgagtagctgggattacaggcacgcatgaccatgcctggctaatttttgtatttttggtagagacggggtttcaccattttggccaggctggtcttgaacttctgacctcaagtgatctgcctgtctcagccttccaaactggtaggactataggcatgagccaccgtgccaagctgctgtcttaattaaaataatgtttattaattatgataggttcttagagttagctttctctgcttggtgagggtatcacattttgcttgttctagcaattactacaaatgttgacaccgggaacaccttcacccttccacctttttttttttttttggagacacagtctcgctctgttgcctgggctggagtacagtggcacgatcttggctcactgcaacctccgcctcctggtttcaagcaattctcctgcctcagcctcccaagtagctgggactacaggtgcgtgccaccatgcctggctaatttttgtgtttttagtagagatggggtttcactatattggccaggctggtcttgaactcctgaccttgtgatctgcccaccttggcctcccaatgtgctgggataataggcatgagccaccgtgcccagcccacccttccacctattttataaatgtaatcactttgttctgctcttgagcttgtcttaaccccctttcaacttcagcacgagctattccttgttctgcttattgaacccattattttccttttactcttactgcaaattgcctcactgcacggtctctgcctcacaaaaacaaaatacatattaatatatctctgggctgggtgcagtggctcatgcctaaaatcccagcactttgggagggtgaggtggtagattacttgaggccaggagttcgagaccagccaggccaacatggcaaaccccgtctctattaaaaacacaaaaattagctgggcatggtggtatgtgcctgtaatcccagaccattaccctccagcctgtgagacagtatgagactctgtctaaaaaaatatatatctgatttacatttattgcactgataatgtggtaacctggactttttttgtttgtttgtttgttttttttgagacagagtcttgctctgtctggagtcccagctcaggctggagtgcagtggcatgatcataactcactgcagccttgatctcccaggctaggactataggcatgagcagccatgcttggtgtcctgaacattttcaactggcttttggctaatacagattgagcatcagaaatctagaaacctgaaatctgaaaggctccaaaattctaaactttttgagtgctgacacgatgctcaaaggacatgctcattggatcatttcagattttaaatcctggatttgggatgctggatcagtatgatgaaaatattccaaaatctggaaaacaaaaacccaaatccaaaacccaaatccaagcattttaaataagggatactcaacctgtaatccaagtagcccaaaaaaatctagcaattaggctgctttctaacagcctaatctatttatctctatttaggaaaaattatagtctttttgttaggtgtatgtattttaaatatttctgttttaaaagccaaagtagctttatgagagtaggaaattgaacaggttgcctttatgtaactgtcagctgggtgttttaacaaatgccagtaattacaaggaacatatttctaaagataatgagtaggtatatatttgttcatggttttgtcatttaaactcagatttcaattgagagactagtattagaaaacacttgatcaaaactgtccaaatgattctaaaaaataaataaataaatgtgcttagtagttacaataatgcatttgcatttatttgatttctaagtcattggagaagcatgcttaactgagcttccacccttgacctgtcccctaggtggcgctgcaggaggcggctactcccaggtcattcctatggaagaggtaaagtattctgggatttggctgaattagatccccctttttttgtcgggggggagggtgctgaattagctccctttttttccccatgacggagtcttgctctgttgcccagagctggagtgcaatggcgcaatctcggctcactgcaacctctgcctcccaggttcaagcaactctcctgcgtcagcctcccgagtagctgggattacaggcatgcaccaccacgctcagctaattttgtatttttagtagagacggggtttcaccgtgttggccaagctggtcttgaactcctgacctcgtgatccgcccacctcggcctcccaaagtgctggtattataggcgtgagccaccgcacccagcctagattctttattatagctttttctctctggagattagccttttttgtagagctcttagcggacaaatgacttgtttctcagcaaaagcaacacctagggggaaaacaacttaatttgcagacttgtgatacagcttggtttcaaactttggctttcagtgggaatgattattataagcaaatgaccaaatgaagcatggtatcgggaagcaccaacacacagcgatttcagaattcatttatgtaactgcagaaattggaacattacatagacatagagtcggtgctgctcccgtgcactcctcctcgctgttttgaggtgtgtcctcagtaacccagtgtggctgttgatcccagtggtgtggtatttgtggtctctggacatctcattttggaaaaactgcaagttctgtatttgggaggagattcttctgtggacagataattagtcttttatgttttctttttctttttctttttcttttttttttttttttaagacagagtctcactctgtcacccaggctggagtgtagtggtgtgatcttgggtcactgcaacctccacctcccaagttctcctgcctcagccttccaagtagctgggattacaggtgcgcactaccacacttggctactttttatgtttttagtagagatggggtttcgccatgttgcccagggtggtcttgaactcctggcctgaagtgatccgcccgcctcggcctcccaaagtgctggtattatagttgtgagctaccacacccagccagtcatttatgttttcaagaactccctatattgggtgtttgtccactaactgggctgccttcagtattccattggctttaaaatagggattgagctttgcaatagaatgaaagttggaaagatacagagcagctgggagactaatgtggcttctgttcttttgtagtttaatctccacctcacaggtgacatccatgccatcactgcagctaataacctcgttgctgcggccattgatgctcggatatttcatgaactgacccagacagacaaggtaggatgccaaagccccatgaaccccattgaacagttttgaaagtattgaaccatctgaattagtgttggtgtcttgggtgctgaggatgcaggtagcaaagcagtggggctcctctcattttaaagcccctttcttttctttaaggctctctttaatcgtttggtgccatcagtaaatggagtgagaaggttctctgacatccaaatccgaaggttaaaggtaagctttttttcttccacattttttatattgtatggaatctggaatctgatcattgattaggacataaaagtcttcttggagtagcctattttagatgaagttacatcagtaatcatagtcttaaagtcatgatatacatagcaaagatggatggtagaggttatttctcatttatctatagattagaagtggctagtgtggaataaatagaacactgacaacctgccctcagctaagaaagaaacgacacttcctttataacatgaacaagagtcaggatgtcactgtggcggcatagcagcctttggagtttgcatcattgggaccttaagcaaatttgttaaatgacttgtttctccgcttacttgtctgtaaaataatacttgccttgccctgaatagataagggtctgtgttaaacagttaaaaccatagttatatctatattttatttgaatttctgtaacaaatacatagttagtaagcatacaccataccacctgacccagaaatctcacccaaaataaatgaaaactctgttcacataaaaatctgtacattaatgtttttagcagctctattaataatttccaaaaactgggaactaatctaaatgtctttcattggatgaataaataaacaaactggtacatccatccaataaaaataaatgagctattgatacaagcaacaacttggatgaatttcagtggcattatgctgggtgaaagaagccagtctcaaaagcttgcatattgcatgcctccatttatatgatattctcaataagagaaaactatagtgctagggaacagatcaatagatgttaagggtatggatgaagggagggtatgaccataaaggaacagcaaaggagaggtgttttgttttgttttttgttttcttttttgagacagcgtctctctctgtaacccggctggagtgcagaggcacaatcacagctcactatagcttccaccttccaggttcaagcaatcctctcatcttagcctcctgagcacctgggactataggtacacacaccaccacacctggctaattttttattttatttttttgtagagaccgtgtctcaccatattgtccaggctggtctcaaactcctggtctaaagcgatggtcctgcctcagcctcccaaagtgttgggattactggcgtgagccaccacgtctggccacaagggattttttgtttttgtttttctgttttttaatttttcaaaaatttattggttggttgtttgtttgtttgtttaagacagagtctcactctatctcccaggctggagtgcaatggtgtgatctcagctcactgcaacctccacctctcaggttcaagcagttctcctgcctcagcctgaatagctggggttacaggtgcctgccaccatgcccagctaattttggtatttttagtagagagaaggtttcatcatgttggccaggctggtctcgaactcctgacctcaggtgacccacccgccttggcctctcaaagtgctgggattacaggcgtgagccactgtacccggcctgtttgtttatgtttttgagaaaagcttttactctgtcacccaggctggagtgccgtggtgcaatcacatcttactacagcctcaacctccaggactcaagtgattctcccacctcacccaactaggtagctgagactacagccaggtaccaccatgcccagatttttatatattgtgtagagaccgggttttgccgtgttgcccaggctgatctcaagcttctgggctcaagcaatctgcctaccttggcataccaaagtgctgggattacttgcatgaaccactgagctcagcattttttttttttttttttttttaagagatgaggaggccaggcgtggtggctcatacctgtaatcccagaacgttgggaagctgaggcaggtggatcacctgaggttgggagtttgagaccagcctgaccaacatggagaaaccccatctctactaaaaatacaaaattagctgggcatggtggtgcacgcctgtagccccagctactcgagaggctgacacaagagaatcgcttgaacctgggaggcggaggttgcagtgagctgaggatgccccactgcactccagcctgggtgacagacagagactgtctcaaaaaaaattgggtttgtgttttacaacacttcttggtcactatgatactatgattatttaggtctaggcttagggaaatcttctggtgctcagttatagggacaaacatgttaataatacctttgtacatgtgtgagtaatgtgaatttgcagatatcgggataaaatcacttttgtcagacccagaaaaaacagggctgggaaaacatgaagaagaggaggcttacacttacgtgtctgtgataagaactgtttgcaaggcctgtaatcccagcactttgggaggccaaggcaggaggatgacttgagcccagcagttcgagaccagcctgagcaatgaagcaaaacctcgtctctacaaaaaaatttaaaaacgagccaggtgtggtggcatgcacctgtagttatacccagctactcgggaggctaaggcaggagcatcccttgaacccagaagttcaaggttgcagtgagctatcattgggccactataatctagcctaagtgacagaatgagacctcatctcaaaaaaacaaaagcaaaaattgtttccaacaactttataaaaccccaaaagaaatcccttcacgtccttcacacatctcctgctttgcacagcttgcacatttcaaatgtatacttatgtttccatgacaagacttatcactagacattcttcaggatgggagtaattcagataagatgctcttgaaagtacacttatccagcaacggcaactgcaccaatgaattgacaactctggctttgagcttctgggagcgatgaattctgttttttttttttttttgagacagggtcttgctctgtcacccaggctgtagtgcagtggcacaatcatggctcactgcagccttgacctgaactctctaagcagactacgtgaagctctccctcttttcttttttttttttttttttttttttttgagatggagtctcacccaggctggagtgcagtggcgtgatcttggcttactgcaacctctacctcctgggttcaagcagttctgctgtctcagcctcccaagtagctgggattatagtcacccaccaccatgcccagctaatttttgtattttttagtagagacagggtttcaccgtgttggccaggctggtctcaaactcctgacctcaggtgatctgcccatctcagcttcccatagtgctgggattacaggctcagccacaggctgagcttcacgcctagctgaagctctccttctttgctagtaaaatcttcccttccctcactaggcatatttgtggcatcccaggttataatcctcgttgctcattcctgaataaactcaacctacttggagataattttttgtaatgtctttctttaggctgacagtaggaaataacccccagctttcagtttttccttctgaatttaagatggtttgcatttcctagaggggatcccatttagaggtaggggtcaaaatttttgtcttacgtttattgtgcttctgtttgtcttattttatgttttcattttcctacactttcagagactaggcattgaaaagactgaccctaccacactgacagatgaagagataaacagatttgcaagattggacattgatccagaaaccataacttggcaaagaggtaccagagcagtatacaagccccgtttgttttggctatattgcacaccctacaccctccagaagagttgttaaaatgtgaggctcagaagcttccatgttggtattttaccagctaaggcatgaccaagatggtgacattatttctttttcttgccacctctctcagtatctctccttattagctatcatcaaatctctttgttggattggtcgaacattttgctggctattcagtgttgactgaaattagggtagttaaaccaaaaatcacattttacaaatttaattttatgcaaaaagttttagtgtcatgaagtagagaaattatgtttaatcacttcttgaatcatgtgtgacctttattcttagaactcttgtgtggcataaatgacttgatttttttctgtagttctctagcttacctaatctttttttttttgagatggagtctcgctctgtcgcccaggctagagtgcagtggcacagtatcggctcactgcaagctctgcctcccaggttcacgccattctcctgcctcagcctcccgagtaactgggactacaggcacccgccatcatgcccggctaattttttgtatttttagtagagacagggtttcaccatgttagctaggatggtctcaatctcctgacctcatgatccgcccacctcaggctcccaaagtgctgggattacaggcatgagccaccgcacccggcctacctaatcatttttttacctcattttattaaattctcttatagcatattaggtagccttcaaggtttaaatacttaccagttcagtaagtaggtttcctggcttcactgccatatgctacttttctcaatgcacaactagtgtagcttagatttcactttgcatcaacaatgcaaccttctattctgtatcactattgagaaagaatcttcatccactcatgcagaatagagctgaaggccagtttattgactgtttttgtgattttccttgactcaataaccgttgctagctaatggccttatttagatgacactctcaatgtctaaaaccacattggaatttctcttcctttgcttcaatagctttagacaaatggtataatattttataaggaataagctaaaagtccattttgaagatttagtatccgatttacttttcttttgcttcgtgtctcattcatgttttctaagcaactagaggcagtcatacctattgactagctattttttacagaaatattagttacatgaaacctgatacttttttcttttgaaaaataagggttggctttaacaacacattacagcaagagtggggggtgtgtgtgtctgattgctatataagacactgcttttggtatgaaattatgacagtctttatggaaaataatttggcatattatcaagtgccttaaaaatgcttctcctccttgactcatttagagtatgaactgggtttttttgttcattttgtgtgtgtgtgtgtttttactttgaaattattttaattttgaaatagaaaacatcttgaaaaaaaaacccacaaaatatataggcaaatttgtactctgtgagcttctcacatccttacactgcttcaccaatctctaagatgaaaaactctgttctaaaacatattcagccatcagcaatgatgttattagtaggaatatggatcaatttaattttgtgtttctttgatattgtttggcatttgatactgaaatggcaactcctgtttcctctctatactcatagtactctcagcacctcacttctgacaccagatgggtagtttttctcttccacaacaattcagctttcacttctccagtggatattgactgagtatcctatgatttaactcaattctgacactaactgtctggagcagatcctacaggtaaagggctcagtcctaaaagactgccccacttcagacacgaatcgcaagtccaggttgtcacctgtgcttctgaccaactggttataaactggagggtccccacaaccccctgctcaggttcatttgctagaatggctcacagaactcagagaagcatttcacttgtgtttatggtttattataaaggatacagctcagaaacaaccagatggaagagaagcgtagggggcatcactctcccagcacctggatgtgttcaccagcccagaggctcatcaaatcatgttgttcaagagttttttttttgagacggagttttgttcttgttgcctaggctagagtgcaatggagtgatctcagctcactgcaacctctgcttcccgggttcaagcgattctcctgcctcagcctcctgagaagctgggattacaggcatgcaccaccacacccggctaattttgtatttttagtagcgacagggtttttccatgttggtcaggctggcctcgaacttttgacctcaggtgatctgcccaccttggccccccaaagtgctgggatttacaggcgtgagccactgtgcccggcctgttcaagagttttatacacccctaacaccttacccagaggttggtgggtgggactgaaagttccagccctctaatcatttggtctttttggtgaccattcctttcctgaggctgtctaggagacctaccataagtaacttattaccataaactcaggtgtgatcaaaaggagtttgtaatgaataacaagacactcctatcacccttggaattccaagagctctgtgagccttttgtcaggaacccatgacaaaggtcaaatatatttcctattacactacacataccaaaagccagaactgagggtacactaaaatgttaacagtagttagtcctgggaggtcgttagttggttagttgcttggtctttgccatgttttttgtggttatataattggatagatattctgtcatcagaataaaaattctctctgctaagtgtgctatgtttcctaaatttccagaccaggcctggcacccagcgtgtttcaaaagatatttgcacttgccctgatttgatggctcctgcatttcttacggtggtggaaagtcaatgagtcatcatcccacagaacaacaacacaaacctcagtcttttgaaaaaatgtagactgctctgtttttcttatatgtggaatatgctttaaaatagattccagatttctagttaactgtttgaattctctagatgggataaaaccaagccattccacattcctttgctgtaaaaataactcctgtgtatttatggtatatgaacatcatttcttaactttaacacatattctagctttgccatccattttgaaatattgatagacaatcatgaaattagacttattgctttaaaactctgctgcttcctttaactttgtggtccttttactcaaaatcgttctatatcttgcctgtctgctgtagtgttggataccaatgatagattcctgaggaagatcacgattggacaggctccaacggagaagggtcacacacggacggtaacaatttgtccctttccaaggaaattagttcagaggcactagatcttgctgcttctctcctcctccatcctctctcatacgactgatactgccaggtgttgttctgccttctcccttttaaaatggaagtgagtaggtgtgtggcattgagcactcctgacagcttttgcaataaatcccatgtgtcacctgtgtgtttttcccccggcattttttcctggaggtggagagccccaagtgaatatccttgcatagaaattgattaaaattgcttcttttttgtggccatttcactgtatatctccttggtttaagaggtaccatattattcccttgtatatgaaagaaacaataagcgcatgattataagcggccttcatagggataaaatcatagctttttggtcctactataacatttattttaaaaaactgacaactcagggctgggcgtggtggctcacgcctgtaatcccagcactttgggaggccgaggcgggcggatcacttgaggtcaggagttcgagatcagcccggccaaaccccatctctactaaaaaaatacaaaaactagctgggcatggtggcacgcgcctgtaatcccagctacttgggaggctgaggcgcgaaaattgcctgaacccaggaggtggatgttgcattgagccaagattgtgccactgcactccagcctgggcaacagaccgagactctgtctccaaaaaaaaaaaaaaaaaaaaaaaatgacaactcagggtcttggaataattaattaatatatttttttgctattagaggattattttcattaagtattttgggtagtattctgttattctatccttttaagctatttgtttaagcctcagatgtaaaagaggatcacttttgcaattcacacttctggtttaacacaaagtttttgctagtacctcttttccctgcccacaggcccagtttgatatctctgtggccagtgaaattatggctgtcctggctctcaccacttctctagaagacatgagagagagactgggcaaaatggtggtggcatccagtaagaaaggagagcccgtcagtgccgaagatctggtgggtacccagacacgccaggcttggcgacatatctgtgtctgttgtcctagggtctttcagcagttattaataacaaaatgtaatgctgtacttaagacattgcaattaattcatcaatttaatcctattttgctaattacaagataattatgaaatgtttaaaaagtacatcagagtgaataatagctggtatgctttagtaatagatcacaagttccagatgatttgagtaacatcttcatcctgtgggcatctctaaaagtgggtgtatgacttcaatttgcagagaacatcaagagtaccattgctttatctttgttgctaggtagttcagctacactttgatggcttaatagagtgacctgatgttaaaagttggtattgaactcttgcgtaatattgcagtttcagctttggaagacacatattgagtttggtatttatagaaatttctgcccagataccagagttacaaataactgagtactctgggaacgagcattgtcgtgctctaaaatagtctagaatggatttctcacatcagtcagcagctgagcttgattaagatgcttgtttctagagttacatgtttttccagatattacatgtgaatgtcatttgtattctatctggcaactttggccaggcgtggtggctcatgcctgtaatcccagcactttgggaggctgaggcgggtggatcacaaggtcaggagattgagaccatcctggctaacacaatgaaaccctgtctctactaaaaatacaaaaaaattagccgggcatagtggcgggtgcctgtagtcccagctactcgggaggctgaggcaggagaatggcgtgaacctgggaggtggagcttgcagtgagccgagattgcaccactgcactccagcctgggcaacacagccagactccgtctcaaaaaataaataatttaataattggcaacttcatagcatatccagaaaaaaaccatgaatggtccaattcaggtgaaagtatcaattggtccaagatggctaacatgggtaagcctagaatgtcaaatattggtttcagaaggttgggtttttttgctggtgggagttgatgctgcacacatttgttttgtagggggtgagtggtgcactgacagtgcttatgaaggacgcaatcaagcccaatctcatgcagacactggaggtgagcagagtgactcctgccttcttgaattggttttggacagtcagagcagagtggttataaagcacacttgcaaggcgcggtggctcacacctgtaatcccagcactttgggaggccaaggtgggcagatcacaaggtcaggagatcgagaccatcctggctaacatggtgaaaccccgtctctactaaaaatacaaaaaattagccgggcatggtggcgggcgcctgtagtcccagctgctcggaaggttgaggcagaatggcgtgaacctgggaggcagagcttgcagtgagccgagatcacgccactgcactccagactgggcgacagagcgagactccgtgtcaaaaaaaaaaaaaaaaaattaagcacacttaacctgggtagtcaagaccttctccacttgctcatctctttcttctcattcttcctcacacctgtgactgggacgttactgaaataaaagagatgactttatattttccctctgggaagtattcttccttccgattccaaatcaattccataccgttgaatgtgtgatcccactttgaagcaggattggcagctcagctcacggtgtcctggtttccacagggcactccagtgtttgtccatgctggcccgtttgccaacatcgcacatggcaattcctccatcattgcagaccggatcgcactcaagcttgttggcccagaagggtttgtaggttagtgttttttgcaaaaccagtgaatagactgtatgtttcttttaacatcaggggaattgggatggcatttttactgttgctttcctctttacagtgacggaagcaggatttggagcagacattggaatggaaaagttttttaacatcaaatgccggtattccggcctctgcccccacgtggtggtgcttgttgccactgtcagggctctcaagatgcacgggggcggccccacggtgagtggtgggttgaagtatctgattatcggcagtgtgctgacggccaaaaggaagttggatgacttctgcctgtttcttcattgagttgctcttatcctcgtgattaacaggcagcaaaagcaagggacgggcagacagcccttgtgttggctgccttatcactcacaggcaccgtcagcgctcagcattttaagagggccaaaatcggctgcctggcctacctttcggaggacatctgacaatatctaaacccctccaaggacgtgtactcggctagccccacaaaaaactgttttacgttcagactgttctttttaaatctgcatccctctgtatagtgacactggcaaccagccaaccaaaccagttagctgagacagaggtcagccccttcttgagtatactgttcatgctggacagggcctccacaccctagggagggagtgggggagaggagaatggcagatctgcccagggctgccctgggtaacagagaaacaggtggagactggctcatcctcacctccagcctgaattttgtatttctctgaattcctactgcttagaaattcctactactttttatcctagtattttaacaccttttctttagggcctacatgaaaagacatggtgctaggttttctgaaatcatttgaaaaactattaaattcctgtccaccaggagcttgtattataacttaggaaataaggactccctggcctacaggataaaaatcaaatttgttttggtcagggtttgtcctaatgtagcagttctctgttttggcctcagaacctctttacactcttgacagttattgagagcctaaaagagtttttgttcatatgggttatagctattgatatttaccatattagaaattaaaactgagttacatgtaaacataaagaactttgtaaacatgaaaatgcattatcttttcccagcaaaatttaggcattgtacatttttcagatcttctctgggtctggcttaattgaagacagcacttgatctgttgtgacatcacatgtctcataacctttggaaaagtccattatatgctcaatgagagaatgataatgagagtaaaagggccataagatgttacagaatcttatggaaatagttttgacttcatggaccccttcaaaggattgggtccccggagcacactgggaatgctgccataacaaccccagcacccctatccagtcttagttatccctgagtgccaaaggcactcccaacccagcacactcctttctgctagtagcacaggatagactcccttttttttcccagtcacaactaacattcctctctcttacacccctcactcaccctcacaccatcacacctcctttccttgcttcctcctgacctcacagtcaggataatgtcccataatgctgtgcatggaggggaacatttgcacatatggctctgtcaagagagtaggcctcctgctctcattagcttgctgacgggaagctacctgtaaggtccttgcttcttgctctgcctccacacagccccttctggagttggagcacatagtctcactgcaatggaagagggcagagcttcttaatcactatccactgcccatggtggggcccatgaaatggacaccttcacccatttgctcatttctgtggatgcagcagggctgagccacggcatagatcaagactgggggctggggggcggggcggggaggcaccagacacctccatcctttagatatactctacaaaagagaaagaaaatccttctgtattgttttccctcttgtttgtattgaccctgcaccacggttcagctccaccaatgctaggttggcactgtggaccagttcatgaaaccatggcagggctcatcacgggctctatcgacagacatcccagggtgacttccgcaggcccgaccgcttcctctttccccacactccccttgacttccaaccccactgctatggccttcactcgagtcactgcacctgcttggtacacccctttccacctctcctgccatcgatccggtccttctcacctccttaattcaggtcatagaggtcttccacgctgcccaaagcagtcgattttgttctgtgctgtgtgattggtcacataccctaagtccttagggcaggaaataatcttatactactgtacagcctgcaagcattgcagcgtcttgcctttaacacatgaaaagcaccattttaagctaggagatttaaataggaaatgcctctgactctgtttcttttccttccaggtcactgctggactgcctcttcccaaggcttacatacaggaggtaacctgagttatttctcatcacgtgtcctagaaagcaccacaccttgaatcagcatttctccacctggcccatgtggaaatgaatgggttattgctgtgacccagggtgcagggtgccaaaaggcctgcagtgtgctgaggagttatattaaatgagtagatagggaagatgtacctcacaaaatagaattgtcccacatagggtgtcaataagccactgccctagaccagtggttgattctcaacagctgattttgaccccggggacatttggcaatgtctagagactttttttattattacaactggaggtggggagtgctactggaatctagtgggtagaaactggggatgctggctaaacatcctttaatgcacaggacagcccctacaacattatccagctcaaatgtcggagtgtgaggctgagaaaccctgtcctagactaatagcagttcccttccattgtcttccctgcattggctgggtaagttccaaatgccattcagatcagaagcaagtagagaccttttttgaaatggcttctcctctgccgatttaaatccatattaacgggccaagatatatggtcaggattctggttgtttttctagacaaagcttcctggatatttatagcatcaaacaggaggctagagaacaactgtgagctcaaatcttttcatatttatgtcatttaccatcaaagaaacatctctaaagccagtttggggtggttacaggaaagacaggccatcagataaggtggcaaggtcacctgctgtcactgctaattcaatttttctgcctttttggaaggcttttaaattatcaagcaatacagggtcactgttcaggccccaaatgaagtatttcaaaactggctagaaaaaattgctggtaccttcagtctgcctgtcttctgagttatggtttgccttttatggtcatttgtctgattcacgcgtaggaggggaattcacagttctggccctcctgccaccccacagcctttcctgtgtctaattacagtgactgcccctagctggcccagctggtgtcttcatttaagaaattctacttatttaaaactgttcttgatcagcgttacatattaattggttttcatgtgactagaggtaaagaattagcagtgttctttagaagctcaaataaatcataatctcagttttcaattattaaaggaaaaaagcataaatcacatttataatgaacctagttgttttccaccttttatcctacctatttctgcttttttgggatcaacaaacattagtgctgggttttgctcgatgattcagtatatgtatttttatagaagactcttttatttttaaaatatttaatgtattgttaagcctacaatagtaatataccctttgtaaaaaataataattaaacattataagaatgtaatatatgtgagttgagtccccttaacagttcggtgcatatttctcgacatttaaaaatttttcatgaattatatacatgtatttttgtgtttgtcctaaaatggaataattaagctctccatggttttgcacctttagtacatcttggacaggttccatgttaacacagatgggtctcactttcataacatctgcatgataaatatttattgagtgtatatgtcataattcattggcccagtcccccttggaggaggtttatgtttataattttccaatgctacaagcagggctgcagtaaacatacttaaagatacatttccttaattgcttccctttagtttgtagtacttggtttttggtgggtttttttgttttgttttgttttgagatggagtctggctctattacccaggctggagtgcagtggtgtgatctcggctcactgcaagctccgcctcctgggttcacaccattctcctgcctcagcctcccaagaagctgcgactacaagcacccaccatcatgtccggctaatttttttgtatttttagttgagacggggtttcaccgtgttagccaggatggtctcgatctcctgacctcgtgttccacccgcctcggcctcccaaagtgctgggattacaggcatgagccaccacgcccagccggtttttggggttttttttacagacagggtctcactctgtcacctaggctggactgcagaggcgtgatcatagctgcagcctctaactcttgggcttaagcagtctccccgcttcaacctcccaactagctggaagaacaggaacacgccaccacaccaggctaattttttaattttttgtagagacggggtctccctatgttgcccaggcaggctgctgtcgaactcctaggtgcaagtgatcctccgatctcagcctcgcaaagtactgggattacaggtgtgagctaccacatccagctcagttctttttttttttttttttttttttttgagacagagtcttgctctgtcaccaggctggagtgcagtggtgcaatttcaactcactgcaacctccgcctctggggttcaagtgattctcctccctcagcctcccaagcagctgggactacaggttcctgccaccacacctagttaatttttatatttttaatagatacggggtttcaccatgttggccagtatagtcttaatctcttgaccttgtgatccacctgcctcggccccccaaagtgctgggatgacaggcataagccaccaggtccggccctttttttttttttttttttaattaacttctcagttgtagagatggggtcttgttatgtttcctaggcttgtctcaaactcctgggctcaagtggattctcctgcctcagcctcccaaagtcctgggattacaagtgtgagccactgggcccagccactggcctgattcctaaagatagtatttatcttatttcttgccctcgttcacggtcgagttcattaaaacctttgaaaacatcactgcttacttcatatttcctggcagtatttacggcagccatataacgaatacctcttctgtgccagccactatgttgttaggctctgtcttctgatggaagggtctgtgctgtgcagagtagagttaatttgtattatcataaccctatgaatacataaaatctataaacacaattggtaaatataatttgggtaagggtaactaattcctttcaaacagcaaataagctataatgatgtggcataatgacaggaaacataccagctctttttttcttgaaggctgggaaacaagcagagctctactctagtgtcataggctggagtgaaagctgcagttctccatagcatccactcaccgcactggaaaaaatgcaccaagggaccttctctcttctttcttggcctccttgtcctgatagtgagtggctgctggctcaaggaggttgtttgcctttgaagaagaacctgcagtggttttcaactctctgatctcataggcctttcactgttgtttttacagaacctggagctggttgaaaaaggcttcagtaacttgaagaaacaaattgaaaatgccagaatgtttggaattccagtagtagtggccgtgaatgcattcaagtaagtgtagagtgtaagcgaaaaggatgaatgtggaaaatctcctggagctgattgtacagcactgcttttagctttattttgtttttcagttactgctattggttatagcctgtggttttagcctgcactgtgacaggcattgcatacgtcactgcgggctcaccacctcacccactgagggtcccaaagtcagattcagctcctatgggcccttttcctttccactgggggaagtaacacacaagcctgaagttcaatgttcctttttcatctttagaggccttttatgctaacagaaggtcataggcctatagtgttccattattttactagatctggtgggatgttgtcttgacaaagaattgggcatattactctggaaggggtcatgcaagaacttgtgtgggttgtttaggtattgcattggtggtcagggttttgttataatggcctcaccgtagtagaatgggaagcaaaaaatctttttttttttttgggggacgaagtctgtctctgttgcccaggctggagtgcagtggcacgatctccactcgctgcaagctctgcctcccgggttcatgccattctcctgcctcagcctccctagtagctgggactacaggtgcctgccaccatgcccagctaattttttgtatttttagtagagacggggtttcaccgtgttagccaggatggtctcgatctcctgacctcgtgattctcccacctcggcctcccaaagtgttgggattacaagtgtgagccaccgcgcccagccagcaaaattcttaaatgctagtatttactgattccttctggagtgctgggaattttccaagtattttacatggatttaccatctgagtctcataacgtcccaatgaaataagtgctgtgattattcgcgtattaccagggtggaaattgaggcacataaagattaggtaactggccaaaagtcaccagctagtaagtttcggagctgagattcaaacccaggccaaatttcttggttagtgttcgtttatcagtgggtaattcacatgaggtttaatggcaaaaagaagacaattctgtctctccagccattttccatgctttgatatgaaatgcttcctttataggacggatacagagtctgagctggacctcatcagccgcctttccagagaacatggggcttttgatgccgtgaagtgcactcactgggcagaagggggcaagggtgccttagccctggctcaggccgtccagagagcagcacaagcacccagcagcttccagctcctttatgacctcaaggtgggtgatttgctgtctgcaaaaaaagaaaaaagacgaaaagggcacagtgaagtttctgtgtggctacttctattagagccccatgcttcgcagcttcagccttgcggtttgattcccacgtaggtgacttacacaaccacagcctggactcccagctgtagacagccttctttttatttttgagacggagtcttgctcttttgcccaggctcgagtgcagaggcatgatctcagctcactgcaacctctgcctcctgggttcaagtgattctcctgcctcagcttcccaagtagctgggattacaggcgtctgccaccgtgcccagctaatttttcttatttttttagtagagatggggtttcaccatcttggccaggctggtctcgaactcctgacctcgtgatccacctgccttggcctcccaaagtgctggaattacaggcgtgagccactgcgtccgcccagacagccttcttataaacatatgccactgcttacttacagaggggatttaagcaggaataccccagggtggagggggaaccgttgctcatatcctaacttcgaaaagggtcaaagtacaggtggcagaagagaaggttacatatagaccaaatatgtaattcactgtagcctttaaaacaaggcaccaaccatgtagcagattggtaaggggctgcatcgagcttacaaaatttttctgatggcttttcagtaataggggaaagaagtgtgcccccacgttcacttcctggtaaggtgctgcctcaagttgagggccctcacatgcaaaaccaaagtactccaggaagcttcatcattttttccatcactaagcaaattaaattacacctggtctaagtagagccctgcttactctatgatacaataaagttagttcaggaaaaggttcttattatagggttgtgttttgttttcatttatctgtccagtgtatttcaggatgtgatttgacattaagtagtatggaaacaacaactggaaactttgttaggaatatgagatatatgctgtagttaatttttcctattctctaggctagtttctggcttgatttttttgttttgttttttgttttaagacagggtcttgctctgttgctcaggctggagtgcagtggtacaatcatggcacactgcagcctcaacctcctggacccaagtggtcctcccacctcagccccctgagtaggtgggaccacagacatgtactaccaagcctggctaatttgttttattggccaggcacagtggctcacccctgtaaccccagcactttgggaggccgaggtgggtggatcacctaaggtcaagagttggagaccagcctggccaacatggtgaaaccccatctctactaaaaatacaaaaaattagctgggtgtggtggcaggcacctgtaatcccagctacttggaaggctgaggcaggagaatcgcttgaacccgggaggcggacgttgcaatgagctgagatcactgcactctagcctgggcaacaagtgcgaaacttcgtctcaaaaaaaaaattttgttttattttattttatttttcttgtagtgactgggtctccctatattgctcaggctggtctcgaactcctgggttcaagtgatcctcctgcctcagcctcccaaagtgctgggattataggcatgagccaatgtgcctggcctggcttggtttttaatagataatcatagactttcaaaaacagccataaaaaagcagaaggaataaacttattactcttgagttttagtgttctcttatttctctttgccccttgcagatataatacacttacagttaattaacattgacattgacattctcctgttgagctttgattttataggcaagttttaaaatctgttcagcaatcatccttttagaaaaatgccataaacacaaatttgcacacaaatgcaaagcatttataggcaccctctccaggctccaatgcatagcacccaaggctggaagcccagtccttgaaaaccagcaggagacctgaaagagcagggacatatggactttagaacccatttctacttgcaacttttatccattctggcaaacaggaggctgccactttttgtcttactcagcgtctgctagtcttaaatcacccttcaaccaaagtgcttttgcttcagaagttctaaatgtgccttggcatttatagagctccagttatgagatgcatatgaaaataatctgtgtttcatctttataaagtccttattgaatgttcactttattcatgcccattatataaagccccttcataaattatcattgtttagttcaaaagggaatttttgtttttatagatagattattgctccttttaaaaacaaaacttggctgggcgctgtggtcacacctgtaatcccagcactttgggaagctgaggtgggtggatcacctaaggtcaggagttcgagaccagcctgaccaagatggtgaaactccgtctctactaaaaatataaaattagccaagcatggtggcccatgcctgtgatcccagctacttgggaggctgaggcaggagaatctcttgaacccgggaggcggaggttgcagtgagctgagatgacgccattgcactccagcctgggcaacaagtgcaaaactctgtctcaaataaataagaacctgcctaatatgttcttttagctttagttgctataaagacagatatattgcctaatttttgtaatttgctcatccaaattacccatgagtagctttgcttctgatttcctttaggcaacctctccgtatgctgttctctttgaatcttaatgccctgaactagtctacacagcatttaagaagccagctccacttctctgaaggctttgccccggaggaaacagcccatgggactgaggccctcaccagttagaccactggtctctgtccactgcactgtttgcttcaggtgccacagaaagtggacatgcccaatgcgtgttgatcatgtaaatcactgggttgttttttctaatacctgggtgattttgattttatgactatttcctaattcctggtgcttgcacttaatcaattgtgttaagggtggcatctgcctctcatatacagactgggagttatgtagatggacattggttgtcttatttcataaacagtgtccccaggtctggtttgacaggactgatctccagtattagaatagaacatctactttttaatttttattattattttaaaatttttattttttaaagagacagagtgttgctatgttgcccaggctggtttcaaactcctgggctcaagtgatcctcctgccttggcctcctcccaaagtgctgggattacagggatgagccaccatacccagcctgaacatctactttttatttatgaagaaataattattcttgggtagtcagcaacactgtttatgatgtacttagcgagagattttaaatatgtacttatgtaagtatatatttaaaaccttaatatatattaatatgtgtatctatatctatatatatatgtatgtgtgtatatgtatatctgcatatatagatataaaaactttacctctgtgggacattttcacttataaaatctgaggcttgatattaaaagaaagtgttcctggctgggtgcagtggctcacacctgtaatcccagcactttgggaggccaaggctggcagatcacctgaggttgggagttcaagaccagcctgaccaacatggagaaactccgtctctactaaaaatacagaattagccgggcttggttgcgcatgcctataatcccagctactcgggaggctgaggcaggagaatcgcttgaacctgggaggcaggggttacagtgaactgagatcgcgccattgcactccagcctggcaacagagcgaaactccgtctcaaaaaaacaaaaagaaagtgttcttaacccaatcatcaacctcaaactatttgcttatgtatatgtatataaaaaccatcttctgccccttttagggactctgacctagaatgtggctatgtcctggttaaatgtcctcacatgtgtccagtcatggtgtccccatctctttcttgtgcattagctcccagttgaggataaaatcaggatcattgcacagaagatctatggagcagatgacattgaattacttcccgaagctcaacacaaagctgaagtctacacgaagcaggtagatgtttggttagtttgtcctttcaactctttgcaaagcaggacttggagtcacaatctctgggtcctcccagccctgccaagtacccgttgcttcacttctctgggtggcagccttctctcctctgaaatactgagtttggattaggtggcacagtccctggttctttatttacccataggcgttatatgaatgtgtagaaatccatgaggaaatacagaatgtcttaccaaaatattgagaacgtctccagtttttgttattttgagatagggtctggctccattgcccaggctagagtgcagtggcacaatttcagctcactgcagcctctgactcctaggctcaagcgatcctcccacctcagcctcctgagtagctgcgcctacaggcacgcaccaccacacctggctaatttttgtgttttttgttgagatggggttttgccctgttgcccaggctggtcttgaactcctgggctcaagcagtccacccatctcagtctcccaaagtgctggaatttataggcatgaaccactgcacctgaccctctccaattttattctcatatctactccaaactattattttaaattagttttatgttatttccatagatggaaataaaatattcacttgtggactacagttgtgagtacctaactccctcacccaacagttctttttttttttttttggcttaataaataagctggaggacagcaagatagagatgtatataaagggagttggatgtttcgaataaattgaagaatccatgtaatcacagggcccagatggtcattgctgggttgtcatcttttcatttgtcctccctctcttcccttctttccccagggctttgggaatctccccatctgcatggctaaaacacacttgtctttgtctcacaacccagagcaaaaaggtgtccctacaggcttcattctgcccattcgcgacatccgcgccagcgttggggctggttttctgtaccccttagtaggaacggtaagtgcatgctgcaagggagtagtgggcgcatctgcacttctcgtctgaagtgtgttgccgaaaccatcaagcaaatgccaagtgagcagagttcactgcccagaagaaaattggaatcgggcctattatgattgctgtggatcataagctataaagcaggagctatatagctcttgctgtggaccatcttggtgtcaaatcaagaatgatgccaggactactcatactgaataaaaaattctgtttcccagggacagtatgctcttcactgaatctaggatgagcccagttgataggctggggtagtgctaacataatcacagttaatgtttattgggagccttacatagattaactcagtccccccacagccctaggaggtagggacagaggttttactgacaggcctagaacttacgtctgaaattcagggggttcattatttttaagtaaggaatttccccattaaaaaatgcaaatggacccttgagatatgaaaggtgaggttgcttatttacgcttcaaggtgaacaaggtgtccattgctttcttatcttacagattttatgcatattcaaagaagaatattgccagttgggaagcagaggggagggatgcttaaggacataatcatagtttgggctgacattgttccaaggttaacttggatcctgaatctaggttatcccctaaatctgccctgtatcctgtatctacagattgtactgccatgcaatacaggactgaaatattaaactaaatcaacacacatggaaaagaaaccaacatacatccttttggatttatgtcattctttcagtatagtaagaaagtggtaggaggtggcattatagagttgaaaacgtaggacattagagctgaattcattttcacctcttcagatcttggccttgggcaaattatgaaaggtgagagccctgctgccctcagctcacactgtaggcaacatcatcacatcacagtggtgcttagcacaaatgcctgcatctcactgcctccttagctctctatagagagcagaaggcttagacttgctatgatgtacatcagtctccaggatttgtagaaatcccttgtggtaggaattttccaccatttttacccagcaccttgaatagtgcagaaatatgtgttgttctttttggagaagttgtcagcagctaccagctgaaagacgggtagctgtactctttcttgtcacttttgatcttcacatgaagaaaagggtaacagtagaggtgaaagcaaatctggaagcagtcaggccagtgagagtcaggctgtaaggtggagagagacacagcctgccgaactcaagactttctcatttagaacaaagtatgtgtcagaggcttttaactttaagttggaccaaggcgtttccacacatgatcaaatggtttaatcactattctaacaccttccagttgccgttggggccttaacgagactcagattatttgaatattttctatattaattcaaagtgtgatggcttattttcagaactttatatctaggttcatacatgtgcgtacacataatattgtctttttttgtattttttctgattatcagtgaccagtgtttaggagggaaaatcctcttggggaatgagtgaaaatatcaaaaatcctactcatcactgtttagggaaccatctttagggttttctgctgacatgcacatgcccgtctacaacaatgggcatgtgtcttttatctttataatgtcatcttccggtttttctgctgtgtctaaggacccatcctttcctctctcctacttgtctcacacctagcacctccttacctcttacacaatataagaatataaaccagttgtcagatccctataatgtgttttggggaatattgattggtactcagaagtcagtcagaatgaggttttctaaagtattgatgatgttttgtgttacagaagatgactctttttaaataacctttttatagttaagttttagaagtaacctaagctgttttcctgtctagatttgatttggaacttgtgtgtattcattatataggacattgttacagataaaaatatacggagttttcacttgcaagccgtacatatttgcatctaagtagaaatttgtcaaagccgagtctttagaaaagtagtgagtacaaatataatttgtaagcattacaagtttagttttagaaggccattttgggccagtaagaatggtgattataaaaccatctagattatgtacaaaagtgtcttggcccaagttaaaggatactaactcctaccatcgtgttgctgaagcaaaaatcacatgggcagctcagctagcaagactgaacgaaacaaaatttaaaagcaggcaagccctgtacctccttttggtcttgcaaagcgtgagctgaggaggcgagtgagcaactcctctactccccagcactcattcttgtaaggtgaaggtggaaacacctcctgctactgcttgtgaccacatggaagatgatagtgaaggctggcatttggtttgcagaaggacatgaggaatcagtttcttttcttttccttttttttttttttgagatggagtcttgctctgtcacccaggctggagtgcagtggcaagatctcggctcactgcaacctccgcctcccaggttcaagcgattctcctgcctcagcctcccaagtagctgggattacaggcacacgccaccatgcccagctaatttttgtatttttagtagagatggggtttcaccatgttggtcaggctggtctcaaattcctgacctcaggtgatccatctgccttggcctcccagagtgctaggattataggcatgagccaccacgcccggcagggatcagtttctgagttttttaacaggatcagtgacttgatttttaatatgtaacaagagtacccactttattgacaactataaaatgatgttctatctttatgccttgggctttctttctgaaggaaaagtgaaagtaaagatgactttacgtttattttagacatggccttgctctgtcgcccaggcaatcggatgatcatggctcactgtggcctcaacctcctagcctcaagcaatcctcctgccttagcatcccaagtagctggaactacaggcacatgccatcatatccagctaattttttatttcctgtagagatgggggtctcactatgttgcccagggtggtttagaactcctggcctcaagtgatcctctccacctcagcctgggattataggcgtgagccactgtgcccagcattagtttatttgtaatgcttttttacatcctagatgagcacaatgcctggactccccacccggccctgtttttatgatattgatttggaccctgaaacagaacaggtgaatggattattctaaacaggtaagttgttactgggtaataatttggcttttttcctcatgtagcttatttatgaattatagggctcaaactgacgctataaaaattcacattctaatgctttcaaaacatttcttttcagacttccctgaggggagaggggatagtaatgagagttggcaataaccaatgaattgaaatatttatatttcaacacatttttggaagaagcgcagcatggcttgtcacaggttgacagtgtaggggagaaaactgctgtccaataaactacagaggaaactacaggagaggttagactccctctgctgaagccccaggaggcttggggttcagagttgatgacacattgcaggtcaggaacagctgacggtctgtatactctgaataggtagttagaaggcaagaattagcaaatgtcttaggaagtataatagaaaagagaaggaaacaggaccaatctggcagttcttagggccttaggtgaaagggccctgagtaccgactgcaatgagtgacattgcattgtttgatatttttgaaatttcaacaggacgtgtctctccttaggcagacccttggggctgaagcagcaagttgcagtgtgcacttatatccctagacacatcctgttgaaactgcaaaaatatcaaacatgaaaatcctaacatctttctccagagacgaaaaaagtggcttgcctatgaaaagaatgagaactagacttaacgcccgtcttactggcaataagaagcttttagacaatggaggagtgtcctgtaaggtcacagggaagatgactttcaacatgtgctcacacctagccgaatctatctggatattttcagacgtgcaagggtttgccaccccacatctcttcctaagaagttatttagcaatgtacttagcaaaatgaggaattaaccaagaaaaaaggaagacgtgagttttgggaaactgaaccctcatttggacattagcgaaggggcattctgataaccatgcaaatgacctgaagttacaaatcctgtgtggaacaggttgggggagcacctgagaaaaactagaaaaagctagaaaagacaaggatatcaaagggtcatagtataaaacaaaagctcttgcattatttgagaaagttaaggtccaagtagaagcaaactgtagtttgatgctagaacactattctttgagagggtatgtgtgatactcgaaatgcagtcatggctcacggcttggtctggtcttgaacagtattcacacagtactatggaaataccatgcatcattttcaagtccatttatggacacgccctagaagagctggtggcaggaaaggatgtaaatgttaacagctttggcaatgtgagtgggtaatggtgcagtatggaaggaacaggaaacatttcagtgcttgcttagagaaaacatttatttcttgtttttccttccagatcaccatccatcttcaagaagctactttgaaagtctggccagtgtctattcaggcccactgggagttaggaagtataagtaagccaagagaagtcagcccctgcccagaagatctgaaactaatagtaggagtttccccagaagtcattttcagccttaattctcatcatgtataaattaacataaatcatgcatgtctgtttactttagtgacgttccacagaataaaaggaaacaagtttgccatc

SEQ ID NO: 152 - DNA, 50101 bp, Homo sapiens
caacagtaatgccatttttcctggccctgggattaggtgcagccgtgttaaggagaggacattcgagagggcgtggcgaagtgaagaggaacctcacgccactgcctggagctccggtgggtctgggtctggtcattgtctcgctggctcctgtccactctgaccactgtccctggccccctgccctgtccagtccttccaggtccatctgagtgtgtgtgtgtgtgtgtgtgtgtgtgtgtccccaggagggatctgggggtacaggctggcacttgagcctggcactgggtcctgccttcattccagatcagaagcagctcccggaactgccccagggagaggtctaggctgacctggcagattcctgatggaggagaaggaggaggaggctgagggatgggaaggaagggctcagtttctcctgtggcttctccagacagctaggcatgtccacaaatccacctgaagccagcaggtccaagagtttaaagatttatttcagggccacgggggaagctgaaatggtgagatcccagggctctcagatgttgtgtttgtggctttggtcctgtctagactgtgagagccatggcttgtcaaagccagaggggcccctagagaatttccatgttcttaacttggcttttgatgggggccagtcacaaccactctgaatttgtgtgtctggggagagaatctgctaatagccatcattagattctcaaagggttctataacccccagaaggtcacagacttctcctctagtccatacccctcactgcagttgcagaaactgaggctcagagaagggaagggacttgcccagagactcacaggcggcaatggaggctgtggcaccccctgcctctgtcttcctgccagcattctgcctgaccttacaagctggggaagcttggctcattcaggggacaatgacctctcatcccctgatgagaggaaggggatgactgggagggaaggactgggaggctgttgtggtttccaggcccgcatggattttggcttctgcatccttgagatggaggcccctgagtctgcctgtgccttggaatctctcagggtgtatctgaggcctggagtcgggcatgcgggagggtgggggctagtggtgacccacatttcccagctcctctgcaggggaggcagataggggagaagctcagggtgtgataaaattgtttttacttcactgggcataaatgacaaataaatgaagtgagggttgggaagtgcttggtagagcgcctggcacatgccaggccgtgaggcgaggtgctcaccattgtcctttgcggtgccctgctagctgagatctcctgcttctgaccctcgctcctgcctcttccttagcatgaggcctctgcctggggcaggaggtggcccccctttctttattttttttgagatggagtttcgctcaggctagagtgcaatggcgccatctcggctcactgtaatctccgcctcccaggttcaagcgattctcctgcctcagcctctggagttgctgggattacaggcatgtgccacacacctggctaattttgtattgttagtagagatggggtttcaccgtgttagccaggatggtctcgatctcaggaccttgtgatctacccgcctcagcctcccaaagtgctgggattacaggcaggggccactgccccgagccgccatccccctttcttatattggggtgtctgatgggggcgtgaggaccctctggctgaagtcctgccttgctgggttccatggtgcacctctctgcagtgcaggctttcccaggaggctgaagctcagctagagaagctgggtcagcagccctgggcctggtcacctccaggaagcctctctcctgggctgcagacctggcttgggagtggtgtggaaagtaggactgcagaagggtaacgaacaggggctgtggggtgggctgggaggggcatcctagctccacctctgcccagctgtgtgacttcgagcggttgcttaccctctctgagcctccatttccttgtctgtaaagtgctcatagcagtgacacctctttcagggtgttaggattgagcgtgatggagcaggtaaggctcctggcacagccccacatgttcgcaggagcttaacgttggccgccagtaagggaggttatgatatgtgttgggatatgctgctttgttccttttgagtgtctgtgatctgagcctaaggaaaaaatagttctggatggatttgactctgtcataggcagatttggggatagggtgggcagagagccccattttgggaagatttgtggccactgcataacattctgtgtgatggacctgacagccttggtgtgcgtgaagagcctcagtgggactgtcaggactgtcccgtccttgggacgggagggtggcaggtgacctgccgtgttccccacacagccccacccccaggctgtctggtatgtttgctcggtaagccctttttttcagagctggtacaaaggtaaactcgcaactcaggccctgttggaagaaggacacattctcaacaagtgaggtctaagttcctgaggttttctgttgggccttccctgccagggaacccagaacagattcacaagttgagaaccagggagtgaaccagtagtgcttaatgctttgtttccttgttgattgacggatgatctgtgagctacttccaagaaagatcactagaggctgcttgtgatactaaaacacatataaaatggatgaaaacaaacacagacagaaaactattgaaaaggaatggagaaagggatgtgcagggcatctggcaaatgttagctgtcttaggtgatcacagaggggctgcggagatgggggatgaggggcccaggctctggagcccagcagctgtgtgctgaagttcccattcacccccttattagctctgtgggctgcagcaagtgactggcctctttggacctcagtttctcatccgtataatggggggaatctaggtcatggtgctgtggtaaggttgaaataatggcatgtaacgcagacatggcatgtctcataaatggaagttaatgttattaatgcatttagcttggagatgccgcgtagcagattcacagaggggaaggtaattggcaagggcacaaggctcttgagtacctgctgtgggtaggagatggcttgtgccttggaaagctttcagtgaagttgggagccccatgttctagttgcaagaacaactgatacctggtgttgcgtggtgggatgtggagcaggggagctcaatcaggactttagaaatccagagcaggcttgttcacctccctgctgaggctggcattggaggaggagggacagggttttaatggacaagaaaatggaccaaggtaaatgagagtggggcacaccagacggcacaagccaggaggtcctttcctctctctgggtctcagtgtccccaggggcttactgcagggtagactgtgctctctgtggccctgcgactctgagccagacctccaacagtctctttcccggtggtggtggtcctggactctggggtgactgacaggcggcagcttggctcctggccaggcagcactgtgggggtgatgggggatggggcatgtagcagattccagcagaggaagggatttgcttctggtctcggcctcccagggatgtaatcacgctggagaaactcccgcacagctgggaagcaaatgtggaggattttccttgctgagctggatgtggtgggtggggcaggctgtggtagggtggctggtggagctgggaagctgtggggtgtggctgggtgggggtgatgatgtgactgtgctgggggtgtgactggctgggaggggctggatcagctatggggagtggccctgggtgcatgtggggctacctgttccccaggcctgcagccactgctacgccctcccctgctcaggtccctgcccaagtccaggtacccacccattcacatccttctgaggttgctggcagagctctttctgcactgacctcctctcagcccccaccccatgtgcatgtggcccagatgcctatgatgatgccatttgagcctgtcatgtgcatgtgaatgtggtgtgtgtgttgggggggcagggagcagtgtgtggtccacagagggcattgtcaagagtgacctaggctggaaataaaatgtgggctgggtgagcattcaaggccctgggcaccttcccccattcactgcagccatgtcgtaccagagacataaaaccttgggttccagagacctctagaaacccttgtggaaaggtcatggtcgccactgcattttcagtgcctagtggcatgcttggcacctagtggtgctcagtaaatacaggatgaggaaacaggtcgtttgcttgttccgcactcccagaaagatctcgaacctccttcctggatcccattctcttgctccttccctctggcgtcagcctggcctcccttcctctctctttctcaattcactactaatttgatatgtggccttgggccagttccttcctgagcctcactttccaaatctgttactgagtaatcattttattagcttatattaccatgtgccaggcactgagctcagtgttttacatgcctcatctctctttgtcttggtagctgccctgcaagatagataagtagtataaaccccattttagatttagtgaaactgaggttcagagaggttgagagatttgctcaaaggtcatgaggctggtaaataatggagccaacattcaagccccagctgggagccactgcacccgggaattacctgtaatcccagcactttgggaagccaaggcaggaggattgcttgagaccaggagttcaagaccagcctaggcaacatagggataccttgtctgtattaaaaaattagctgggcatggtggcacacacctgtggtcctagctgcttgggagactgaggtaggaggatcacttgagcgtgggaagttgaggctgcagtaagtgtgattgtgcccctgcactccagcctgggcaacagagaaagacactgtctcaaaaaatgaaaatatgctgggcacagtggctcacgtctataatcccagcactttgggaggccgaggcaggtggatcacttgaggtcaggagttcgagaccagcctgggcaacatggcgaaaccccgtctctactaaaaatacaaaaattagctgggcatggtggcaggtgcctgtaatccccactactcaggaggctgaggctcgaaaatcgctcgaagcttgaacccaggaggggaaggctggagtgatcctgggcaacagagcaagactcttaaaaaaagaaagaaaagattcaaagattcaagctcaggcaggctagctccagtctcggcctttaactgttatgctagctgtcaccactagagtgaaatagaagggtgtgcacagcccttctaaggaggcctgctggcgcacagtaggcatggtgtacatgtgagttgggttactgggcacaattcaccatgaaaggcatggcttgctcagtctccatacctgcttttatggagctcttggtctcattcctggagcccacccattcatcacaggcccaagccggacccccttccctggtcccagtctctggacagcttgctcctgtaagaaggcccttgtacctctgccccttttctcttatgggtccggggcagcattttcaggtggggatgttagatagagtgacttcaactccagagcagtggccacggttaccgtggtatttcccgaaagtgcagcgttgccatggcgtctccatgacgaccagagcatctcattcattatcctcagcaccttggcagggaaagctgggactagggctaggggagtgcagtgggagcctggctgagggctgtgggccactggcctttgtggctgaggttcccctcatgcccctgcctaccccaagccaaggttcctctgcaggctctggagttatctcccacccatgggttctgggttcacatttcagctctgccactgaacagttgtgtgatgttgggcaagtgacaacctctctgagccttattttactcaactgtaaatgtggataacaatattagttgtaaggattacatgaaatgaggtataaaaagtgctggctgggcgtggtggctcacgcctgtaatcctagcactttgggaagccgaagtgggtggatcatcggaggtcaggagttcaagaccagcctggccaacatggcaaaaccgcatatctacaaaaattagccgggaatgatggtgggtgcttgtaatcccagctactcgggaggctgaggtgggaaaattgcttgaacctgggaggcggaggttgcagtgagccaagatagtgccattgcactccagcctgggtgacagagtgagactccgtctcaaaaaaaaaaaaaaaaaaaaaagtgcttagcacagtgccaggctcatagtatggcagtattcataatgatgataattataatgttgttggtgttatttttattgtaggaacccttgggtttcagggaggaatgaaagaccaaactcaaagtcaggaaggaaacccatttgagtcaagatttggtggtttccatgtgactgtggcaagtcacttcaccttgaagtctttgtctccttatctgtaaattggaaataataacagctgctcattcattcatatcctgagtattcaataaggacctgaccctgggaaaagtgggagcttccacgatgaatcagacttggttcctgcccttgagtggcacccgggcactgggggaggaggaagaaaggacactgttttgtgctgagggctgtgtgtgccgggtgctggtgagggcctgtgcagaggtcagtaagccctggtcctgccccacagatctgcaggctacaggaggtagagccatgtgcaggaatgcccccagtttactctgcacagaccacatgctcaggtgcacccaggggctgggcaggaagccagatgaaggaaagaggttggctgtgagactgtacatagagatgctgatggtgttaactgcaggatacacagcccatttgaggctggcactctaagtgcctcagctgatggtggcaggtgaggatgtgtgcccagtgtcaccagaacttgccctctttagagacaagttagaagttctgacttttatataaaatctcctgatttaaaaatgttgctaacgaatcccaaattaaagaaaaatactgtgcaagccaaagagcacagtctgcattttgtttgggctccagggtcctggttttcagcctctgcaccgtggagtggggatgaggcgggagcctgaggaatgagacttaggagtgggagagggggcagtggttggtgatgacttcagaggggtcatgactttggaacctggatcttgaaagatgagtaagtgtcccaaggggtccggggaggcattccaggcaatgggaatttcatcagcaaaagcctcaatgcttccccgagattggtgactggctgggtgaggctggaatttaggggaaactgctggtgatgtctgcaaggcccagcaggcccagggtggtgggggtcattgaggcctcagccccagctgtccttgaggccttggtggctgcagggggactagaagcccctcagttacttacctcttgagccacgggagttctggagtgcaggcgggtgaggagggccttgggtggagggtggcagcctctgagtgggttgcagaggggctgtgctggaagccccctttgccagccggctgagtggctggcactttgctacaaagcaactggcttccccccacccacccccaccccagggtatttggccttctctgaggacaggggctaccttgctctccctctgccctgggttttgccatggccttatcttcagcttcttggcttctatccaggcagccagccagctcccagtaagggccacagcctccaaagatagggctacttttcagacatgctgtgagaggaggacggcagccctggctgcctggccctctgtgtaataagtgtgtgtggtgcctgcctgcctcagcccttgctctccctctgtgaaatgagctgccctcccctgcctgagtcctggggctgtcagactctcaagagagggatgagcttgaaagtgcttcgtgagctaagctgtgatccacatcgtgagggattgtcataagtatgttaaataagcaacaggggtgcgtgataacagcagctgtgtgccaggcgtggttctgagcatcttatgtatcaactcatttaatgttcacaaccttgggaagtaggtagaatttccattttacatgctaggaaactgaggcactgagaagttaaataacttgcccaagattacatagctactaaatggtggagcttagttttgaatcgaagccacttggctccagtctgcacgtgtaaccagtagggtccatcaatctaggactttaggtctgtggatgggtggcagggaggctctgaactccttgaaattattatgatatatatttttttgagacagagtctcgctctattgcccaggctggagtacggtgatgtgatctcaccttactgcagcctctgcctcctgggttcaagtgattctcttgcctcagcctcccgagtagctggaattacaggtgcctgctaccatgcctagctaatttttgtatttttagtggagatggggtttcaccatgttggtcaggccggtcttgaactcctgaccttaagtgatctgcccacctcggcctcccaaagtgctgggatgacaggcgtgagccaccacaccattatgacattttctagtgtgtgtgtgtgtgtgtgtgtgtgtgtgtgtgtgtgtgtgtatggctttattgtttagatttttagttttacattcacagcaaaattgaaaggaagatacagatatttcccatatgccttcttcccctgcacacacacacagcttcccccattatcaacatcccccaccacagtggtacttttcttttttttgagatggggtctcgctctgtcgctcaggctggaatgcagtggcacaattatggccactgtagccttgacctcaggggcccaagtgatcctcctgagtagctgggtctacaggcacatgccctgacacctggctcatttttttttttttttgtagagatgggggtcttgctatattgcccaggctggtcttgaactcctggccttaagtgatcctcctgcctcgacctcccagggtcaggggactgcaggtgtgagccactgtgcccaacccagagtggtaaatttgttgcaacagatgaccctgcattgacacatccttatcacccagagtccatagtttactttcgggttcacctctggtagtatgcattctgtgggtttggacaaatgtataatgacatgtatctaccatcgtcgtctcatacacagtagtttcactgccaaaaaaattttctttgctccgctgattcatactctcaacccccaacctctggcaaccgtgtgcatttttttaatgcgcatattttttatgtctgaaaaatgtcagattcccacagggtttcgtggctcccacattcctgagactctgagctgcatcattcacactctgaaagattgttaatctgatagagggtcactgaccacagcactcaagcctgcgaggagtggctggtggctgctctcctccgcttccatgggattgggtggccaacgtgggcagggcgccatcagggcatccccacctcctatccactgtgcttctgtcctggccctaggccaaggggtggggctgggctgcggccacaggctgcccttatcaatggtaaatgggacacctgggtaccctgagtgtaaacaggaccagtcaccccagccttcctggctctgcccaggacacctgctccttcttgccctgctctcagctagaattgcagggagtccctggaaagtgccacacatgctcttatctccaagctgtggtatgtgccatttcctctgtctacccctgcccaacccttactttttcttctggtcagcttaggtacccttcctccaggaagccttccctgtcccctccttccccctgccagaagagttaaggacccctgagctctcccaaacccccatcccatccccgtctgtcacacttatccccctgcattgcagatgcctattttcttggctgcctctggttcctcagggtactggcactgaaatgtagaatatcagaggtgaaggagcccccggagatcacctgccccaacccccttgtaacatgcaggaagcccagagggagccacacagtgcatcatggcagagctgagaccagacctgttgtcccagtcacctcctcatttcacaaacaaaaagcggaaataaaaatcacccagagataatcactgttaatgtttctttttttgcatttagcaccagtttctagcctatgcacaaaaatatttaactaaattatgaccgcacgtacaaactgttttataaatgtttttgactttgacaatacatacggtaattatatttctatgtcagtacatgtccttctccaacatattgtaaatggctgcctaggatttcatcatatgcttgtattataattgcttttttttttttagatagagtctcgctctgtcgcccaggctgcagtgcagtgacgtgatctcggctcactgcaccctccgcctcccaggttcaagtgattcccctgcctcagcctcctgggtagctgggactacaggtgtgtgtcaccacgcccgactagtttttgtatttttagtagagatgaggtctcaccatgttgcccaggctggtcttgaactcctgacctcaagtgatccacccacctcggcctcccaaagttctgggattacaagcatgagccaccacgcccgacccttgtgttataattcctaaatacaatctcccattgtttgggatttgctgttataagcagcactaggatttgtgttcttgtggaaaaatctttacacacttctgcagtaatacctctaggataaattcctggaagtgcagctgtcgggtctggagcatgctgtacccatgctgagcacatcatatagtcttggagctggaagggatttcaaagatctttaccctctaggctgggcccaagccttgaattcccccctggcctctttagccctggctcttacaccttccatctagacctgggcaactctccttctagctttgagctgctgtgactgatagttgctccttgggggccaggcgtggtggttcatgcctataatcccagcactttgggaggccaaggccggcgaatcacctgaggtcaggagttcaaggccagcctgatcaacatggagaaaccccatctctactggcatggtggctcatgcctgtaatcccagctacccaggaggctgaggcaggagaatcacttaaactggggaggcggaggtggcagcgagccgagattgcaccattgtctagcctgggcaacaagagtgaaactccgcctcaaaaaaaaaaagtaagaagaaaagaaagttgctccttgggttgctgggaaatctcacttcttgtgacttcattactatttaagggagactggtagactgtgtttggggttgctgtttgggatgagacaattggggcctttgtgtcgtgtatgtacgtcttcgttaactctttccagtgagatgagtataggaggcgtggcctgggtgcaggcggtgcggggggttcaggctgagggggaggctggaacccagagttatggctgcctgggtggacagaaggtccagggcgggggaggcctcccctctgcatcctgtggtggcagtatggcgatcctcaggaaggctatttggtcatctgttgtcctgggctgctgtgtgcacctgtgggtacgtaccccgaggatgagagatacctggttgcattatgggcaaatatgacagctgccatgtttcttgtgccaagctcctcagacatatttacttaacgctcagctacagccatgagctacaggggtgctggtgttacagattagctcactgatgctttaaaggtgtaatggtcacctgaggccttctcacacagctaaggcacacatgccctgcagcctgctaatgaatcctggcttggcttcattctgagtcttcagaatgaaaagactgatggagactcagtcttttcatctatcatatggggctgctgggctcattcaaagagagcaacgggttaggaagggaatggaatatggtgaggatgtggtattcagtcgtgatttagaattctacctctagttcccaggctgtgcaaatgtttatcatctctccccatccgtcctgctcctggatttttcttggcctagtcttggactctgataatgatcaaaaatagcaactccaatttgtagataccatatgctaggtactgctttaagtcgtttacaaacgttgttggacttaatcctccaaccccttatgagatgggttcatattatttattgtctgccccattttacaagtagggaaactggggctcagagatattaaagagcttgctccaaatcatgcaaccttggttcggcagccgtacttgcatttgggcattcctaggtcagctcctgtgtgtccacagttagctgaaccctgaagcccgcactctgacgctcctgttctctccactctccacagccttagccccgtgggccccacggagtgagcggcatgcagcacccccgggcctgtccagtgtcctctggcctgctgccctgcacccccagaaggccctgacgccctggggcacttctgctctgcacaggaccacgcgggggtttgccatggtgacataaaggggcgcggaggaaggaaggagcgtgaccagcctgtggactgcgcccctggctgggaggaaggactgggggcccagatcctccactcccagtgccccacaagggcgtcgcttcctaagtctctgtgaatttgttggtcagtggacgattctcgtgtctcctcctgtgtggggccttggggtagccagggcaggccgggcctccggtggccaaggtctcggaggccaggatgcctgccctggcatgcctccggaggctgtgtcggcacgtgtccccgcaggctgtccttttcctgctgttcatcttctgcctgttcagcgttttcatctcggcctactacctatatggctggaagcgaggcctggagccctcggcggatgcccccgagcctgactgcggggacccgccgcctgtggcccccagtcgcctgctgccactcaagcctgtgcaggcagccaccccttcccgcacagacccgttggtgctggtctttgtggagagcctctactcgcaactgggccaggaggtggtggccatcctggagtccagccgcttcaaataccgcacagagattgcgccgggcaagggtgacatgcccacgctcactgacaagggccgtggccgcttcgccctcatcatctatgagaacatcctcaagtatgtcaacctggacgcctggaaccgggagctgctggacaagtactgtgtggcctacggcgtgggcatcattggcttcttcaaggtacacaagaagcagggtccccgagcagttcagagccccctctgcagctcagtgcctgaattctcatttgtgaaataggtgtaatggtagcacccgcctcctggggttgttgggagggttaaatgagtgagtatatgtaaagcactgggagcatgcggtgcccactgcctggcaagtgctttgtaagtattaggggagcgtgccagggggatcgcctgctgtgcgtggggtccagcacacagcaggtgcttgcctaaaggaggccacagagtaagtgtgaagtcagaggagcatgctctgctaggtgccccaaaatctgtcaaggcaatctcccctagggagggcgtgtgcacccatttttcagatgagcaaaccaaggctccgggtgttaagttacttatgtgaggttttgcagcctgtaagtggagaagccgagatttgaacctagacatagacagtttgggctctctatcccatgctcttccctcttggtggtggtggagtatggcgttaatatacctcctgacccagagccattttgcatgaggagaaagaggagaatgaaatcccactggcagatggggagctgctctgggctttatggggcttccagaatgaccgccgggattggggtccttgcaggaagggtgtcccagagaatctgtccttggcggggggaggttgggaatggtgggcgggggatccagaggctgtggtcagagaagtctgacctgcaagatgaaagcagacactagctgggactcttagttggatgctttggaggtggcagggaatttgttccttcattcaacaaatatttactgagcactcacagtgtttgtggtcctgtgctagcggtgatcgaagtggacaaagtccctgctgtcatggagctggcatttcagtgctttgggagtgggtgggtgacaggcagtgagcaaataaacacaggatggggcaggtgtgatcagtacaaaaagaaacaaagcagggaaaggacacagagggtagtgggggtgggagcttgacattattttaggaaagtcgtctttgataaagtgacctgaaataaatgaggggaggagccatgtggctttctgtgcaaagagtcttccaggaagaagggacgttaagtgcacgagtcctaaagcagcctcttgcttggtgtgagccaggagaggaggagcgggagatgggtcagaagtggcctgtgtccgctgctgggtgcccgtttgtgccaggccttcctggtgcacttgcgcactgggccctgtctcctggagggcttctcatggcgtgttctttcacaccctaatacagcaggaagctctgccactgaaaggtattgtgagccaagaatttgaaggcccttagaagtcctgcagtagagcaaccagtgagatttgttctcaactggcttgatcacaaaaccctttcttttacagagcaccctcaggggaacgctggcctggtttatggctttacaatgacatcaagtcagattatctccattgtctggttgtctcttttctcttggactctgtaccctttcctgccatgaacttcgttaagttctattcagagtcccaggcctgaaaagcgtcaagaggctgacgtttattgagtgctcactcagtgccatgcaccgtctacatgcgttgtgcagattcacgcacttcacacgaaggcaggtggctagcagcctgatttaagataggaggaaactgaggcaaaggaggataagcaatgtgtccaagcctacgcctctgatgagtataggtctgggatttgaactcaagcagtccggccccagaggccttagtcttaaccacgatgtgatgagtccaggagcctcacataccacttattcaggagaagtgacatcagaggccacacccagtgcacagagctcccacagtctttggggaccaggcggtgggctgtggccattgggcgtaattggtacaatggagcttgggcgctgtctggccccaattccttgctctgcagaaggtaaacaggaggcctagggaggggtgcgggcatgttcagagtctcatcgtggggccagtggtaattccaggacttggtgctcttcctaccctgttgcctaggacaagactatccttggttttgagcagaggcctgtgattttctgctcaaatgcatgccctctggtggtcaaggcacatctttccactctttctgcaagaccaacttccccgctgtgtgctgggcttgccaagtggggattgtctgtgggctccagggatctgaaaactcattttccagttcccactgatgctggattcccagggcagtgtgagagcagggacttaaaagtccagacaggttcaaatctctctgtcatttagaaacagagtgacttgggtaaaatgctcaactcatctgcaaagtggggctaattacagctgctgcctcactggtctgtgttgaaaacaagacagtgggtggggagcactgagcccattgcctggtaccggagccactcaatagatggtagctatcgtgctttgtcatctccaggttcagtaaacagcagtggtagcactgtgtccgtcttgtggccctgaccaatgtgtgcccctgtgagatcctggagggtggtgggaatagggtcatcctcatctggatccctacttcctggcactgtcgtgcctcaaccttgaaattccaggtgacctggggctaaacacaccctggcaggggtctggcaaggagtacctgacctctttcattgagcacttactgtgtcccagtcactgagctcggtgctttgcaggcatttcatggctaattctcacagctatcctgtgaagtaggcactttattttcagataaggacctgaggttcaaaaagttaaatggcttgtcccgaatgacatagctacaggttgagtgtcccttgtctgaaatgctggggaccgtaagtgtctcagattttggaatgcttgcattctacttaccagttgagcatccctagtctgaaaatctgaaatccagaatgctgcaataagcatttcctttgagcatgacctttagaggtcacattggtgctcaaaaagttttggattttggagcattttggattttcagattagagatgctcaacctgtggtaagtcatagagccaagatctgacagtcaagcttgttgtttctaacccagccacaggagcaaatgtgctgacagggagcctgaggctcagagaggagatgtaggattcccaaggtcccccaggtaatggtgaggtctgtgcttggcctccacctctgcgttcccgaatcagggctcctcctccctctgcctgggggaccccattggaagacttggtgtctccggagtgggtactcagtggtgaggagcaagagggatttccactgctgtggggtgaggcctgcagtgaggccagcctctcggtgctgaggccctctattcccttcttgcctggttcatttcattgccaatggataggccatcagtgacttggcttcctcccttcctggatggctgggcagctgactgagcctccagcacctggcagtcagctcagggtcgggactttgaaatgggatccctcagcacccgcggtccagtgtggcatcccaggcctcagcaggcgatggacaaggcctgaaatgtctctggcccctaccgcttttgtccccacacagcccaagtagttcccagccttggtcagggctgtcttaggagtcgtgagcagcctggagttggggaggtagctgaggactggtctgtgcgctgggcctcagcaccccaggctggctcaggacagggtggggaggtactcttgatgtttggagaatcacatgcaggctacttaatgtggtttacaaggccagggccctgcagagcctttttgggaattagaggagatgagtgaaaggcgctcttctggacaggtacagctctgcaacgggcacaggctcagctgagactttaccctgcccccgccactgacctgcgcacccctgtgtgtgctccctgagcagctctcctgggggccccacacatgaccccatctccccctccaaactcattttgctttgccctgccccactcactctccaggcagcagccacatggatctttttaaaatgcaaattagaacctgtcatcctttgatggagtctttgagggcttcctgctgctgcttcaatcctccagcaccctgcaggcctggctccagctgacctatctgcctcatctcctcctttccctcttggtcactctgctgtcttcttgctattccttggtcatgctgaggcctgtcctacctcagggcctttgcacttgctattcttggcctctacctttccctttgtttgtgcttgtttgttctttaaatgttagctcaaaagtccctttctccaggagacctcctgagcccactaactgtgcccagtaatctactgttccacaaatatgaacctcctctgtgtagcatgtgccacactgaagttttatatttattcctgtgatttcagtgaatgtctctcttccctccttgattttaaggttcatgagagcaggggccatgtctttgtttttctcactgtatcactggcacttaaaacagtgcctgacacagcaaatagttgtggaatgaacagatgaaacctgtattgagcgtctatctatgccaggtactagagagctggctgttcctcttttattccttttaaaaatccagttctgcattgaattgtgtgtgttcctgctgggtatcaagctgggcactaggggtccaaaggcgaaacatcatagcccctaaccttaaggggttgcaggctggtgggagatagaacgctgaaaatataatattgcagctgaggtgagaaatgctgcagctgaggctttaacatggtctcagggaggccagtgcagagaagagggtatatgcattgggtgtgaattatgagcaggagtttgtcaggccaagaagacggaatggaattggcacaggaacaaggacaaattgtaccatattcaggggcaggtggctgagagggtgaggaaggtcatgaaggaacaggggctgtgagcctaaggaagaggggactggggcacactgtcttcagacttccagggagctgagcagccacatgccttgagagaagggaggcagagacttcaccactgatggcagtgaccgggcaggcaccatagtgagggagtggcctctggggtgctaggggcatatggggcacccccagcagaaacctcctctttgaacatctgcattggcatccacataagatgtctcctgaagaaaaggttgcgtggccagaggcagtttggaaaccccaggcaaccacgcctaatggttaggtgtgtgggtgctagggctcgacctcttggcagcgattcatagctcctcccaaccactgtgctactgagggcagcatgcccctccaagcctcggttttcacacctgtgaagtgggatacgcaggctgatgtgaggactgaatgagcagtttctggtcatgccacaggccctattctgagcacgttgccggtattgatactgatcatcctctaccactcctggagttactttctgttcttagccacattttacagcagaaactgaggcacagagaggtgatataacttgcccaaagtcaggcagtctagcaggattcatgttctcaactgctagattttcttctatgtggtttagcctctctaggcctccgtctgctatgtgtaaaatgggtatgagagcagtgtctccatctggggtcattggaggattaacagcattcctgtctgcaaagtgcacagcacctagtgcctggctttggtaagtgagtcgtgtgtttgtgagtatattattgtgcagggtggagcgcagggccagggtggtgagccctccatgaatgttggtgaatattgataccactgttatggtccacatgtgagagactgtgtcctttggggttctggatgtgacagttctgttccccttcctgccctccattgactgcaggccaatgagaacagcctgctgagtgcgcagctcaagggcttccccctgttcctgcactcaaacctgggcctgaaggactgcagcatcaaccccaagtccccgctgctctacgtgacgcgacctagcgaggtggagaaaggtgtgctccccggcgaggactggacggttttccagtcaaatcactccacctatgagccagtgctgctggccaagacgcgctcgtctgagtccatcccacacctgggcgcagacgccggcctgcatgctgcactgcacgccactgtggtccaggacctgggcctgcacgacggcatccagcgcgtgctgtttggcaacaacctgaacttctggctgcacaagcttgtcttcgtggatgccgtggccttcctcacggggaagcgcctctccctgccattggaccgctacatcctggtggacattgatgacatcttcgtgggcaaggagggcacacgcatgaaggtggaggacgtgaaggtatggccgggggtgctagaccgggcaaggcaggtggggcctggcaagcttcagccttcaggtgccccatcgtgggtgtgccctgtctgcatctcccctatgctgggagttacttaaaagacagtcccactctgcttcctgtcctgccagttggttcttattaattgtcttattagaagcaagtatcatttaaaacttgattgaagcattggccaggtgtggtggctcacacctgtaatcccagcactttgggaggctgaggtaggcggatcacttgaggtcaggagtttgagaccagcctggccaacacagcgaaaccccatctctactaaaaatacaaaaaaaaattagccaggtgtggtggcgtatgcctgtcatcctggctacacaggaggctgaggcaggagaatcgcttgaacccaggaggtggaggttgcagtgagccgagattgtgccactgcactccagcctgggtgacagagcaagactctgtctcaaaaaaattaaaaaaataaaactttattgtattgaagtattgaatatgaggaattttgcatctggaatgtggagtttaagtttgtataatatgtatggaagaagacatccagacaaagatgggagctgtacaatgctgtttgtctgcctttaatttaaatatgatttttaactcttaaaaatgtttatgttaatgtcagagcgcctacaaaactcttaaaataaggatgagagcttgaatcatgcatgaggcagattttaactgaggtgtaagtagacagtggaatgcatgtgtttaattcaaaaaaggtttgctggccgggtgtggtggcttgtgcttgtaatcccagcactttgagaagccaagggaggaggattgcttgagcccaggagtttgagaccagcttgagcaacataaggagaccttgtctctacaaaaaataaaacattagctgggtgtggtggtagtagtcctgtagtcctagctatctgggaggctgaggcaggaggattgcttgagcttgggaggttgaggctgcagtgagccatgactgtgcatggcattccagcctgggccacagagcaagaccctgtctcaaaaaaaaaaaaaaaaaaaaaaagtttttactaaacaaaactgtgtaaaagtactttgcagaccacaagattttacacacatgtgaactgtcattgtgagaaacagcctacaaattaagaccattaaacaatctttaaaatacagttttcatctactcactattttatttaaacttattcgcaaaggagatggcatcctagtgtaaataggaaatccggatcagttgccataaatagagggcaaccataacaataaatccaatgaaaacaaaacagggggattaaattctagagacattctgctgcctgctgacagcctgtcctctcttataggagattagcaagtgttagaaacatattagcaccaaacccaggcttgtctttgatgttagcaggaggctttaaaaagagacttgtaagaggaattctgaaatctctggtaggggttggccctggggcctggaaggagggtcctggtggcattcatcgccctgccttggtcaggagtgaactttgctcttccttacacctctagagaagagcagaatggatgacattcgggagcaggcactgtctggggagttaagacctaatttgaatcgagtcctaatttgaccctaatgaactaggtgacttgggcaggtcccctcccatgcctgagcctcagctataaaatgatgaaatggggtgaatgggaagttttcaggctatttcctggtgcccaggggtctcccataggtgcctggatagctggggtgggggttagggggatgttttggtgccaggctcagccctccaggctccaccttagttgctccagcggtgctgctttgcgctgcttttacgcattgtgtttcctcctgaaattccattctcttaaaggctctcctgtttaaagaacgttttagccttccagtctaagtcttcatgcagtgccaccacctgcctctggcaaggtagattgctctgtgttctactcgaggtgttcttccagtggcccaagctcattttctcctgcaggaacccaggttcttgctgtctgtccagtgagttctggagagactgtggtccagggtcaggttgagcctgaggagatcaggttcctgggctcactgtgttcctataagccctgaatttctctctcttattaattttccgtattttaaattttttttttttttttttttttttgagatagagtcttactctgccacccaggctggagtgcagtggcgggatcacagctcacttaagtgatcctaagcacaagcaatcctcccacctcagcctcctgagtagctgggatcacaggcacatgccaccatacccagcttacccagctagttttttgtagagcccaggttttgccatattgcccaggccgatctggaactcctggagtcaagtgctgcacccaccttggcctcccaaagtgctgggtttatgagcatgagccaccgcacctggccctattttttctatttttaaagtgaaaggaatgatagcagtttgaagccatttctatagaacaatagaaatagaaaaataggatacaaaccaaaaatacaaatagaggcaccctctttcacacactcagctcagtccagattgcaaagtgcttctccagccacaatcctacttgccttaaacatttttgtgaataagaaagggcagagttttttttttttctttaatcccaagcacagcctacaacagagcccttctttcagagacatgaatgtcgcctcattagcttgtacagtactggctgtacagcgcaatttaaataataccaatagcagctgcctattcagggcttggtgagtccttgtgcttagccctttctggccgttgcttcattgggtccttacagcagccctgtgaggtgggtattgttctgagtcccatttaacagaggtgggcactgaggctcagggagttgaggtaacttgcccaaggccacacagctggagcatgcacgtccaccaggcggtgcacggccctggtaagatgctgatggtgactacattgcctggggagggccaggacttttagtttgtaaagtgttctgatagctggctcttacaggtttcttttttctttttctctctttttttttttttttttgagatggagtttcattcttgttgcccaggctggagtgcagtgacgttatctcggctcctgcaacctccgcctcctgggttcaagcaattcttctgcctcagcctcccgaatagctgggattacaggcgcctgccaccacacctggctaattttgtatttttagtagagacagggtttcaccatgttggtcaggctggttttgaactcctgacctcaggtgatctgcctgcctcagcctcccagggtgctgggattacaggcatgagccactgcacctggcggctcttacaggtttctgagctgctttgtggctcgtgtgtcctaaccccagagtacacctgtgtgtttgtttcacaagtgtcagtgtcccctcattgactcgaagagtactgggtgcacggtgcgcgggaagaccgcattgctgggcacacagtgtcccatccttggaaagggtatggccctttaaagtcagcactgcattccatcagcaaagagaaatcctccacatttgatagatgaagacacaggcttacagcggcagtgaccacagacgtagcattggccaccatttttcatcacttaccagatgtgaggcagttttacgtacaatatcttttttacaattgtttaatctttttagagcagggtcttacagttggacctgtgttggattctaactgctgggctcaagcaatcctcctgccttagcctcccgaatagctggcatacatgcggttatcttacttgattcttccaagagccttatgagggagatattatcatccctgttttacatttgatgaaaccaaggcctagaggaatgtgaagccttttcaaggacacatagcagagctgggtaggattctagattttcccttgccagaggcctggcggacggcagcatagggctggtttcaagagtatgtgatctgtgcagccacacagagccccacgctcagagggagcccattatgtggtttaatgcctgctgttgccttcttgacattcttttttttttgagacggaatctcgctctgtcacccaggctggagtgatcttggctccagtggtgcgatctcggctcactgcacctccgcctcccgggttcaagcgattctcctgcctcagcttcccaagtagctgggattacaggctcgtgccaccatgcccggctaatttttgtatttccagtagagactgggttttgccatgttggccaggctggtcttgaactcctgacctcaagtgatccacccacctcagcttcccaaactgctgggattacaggcatgagccaccacgccgtccttgacattctttataatttttgaacaagggatttccacgttttttcactgccctcagtgggaaaagcagggagctcctggctttccctcactcattcctttctcccctgcctgtcctaggccctgtttgacacacagaacgaactacgcgcacacatcccaaacttcaccttcaacctgggctactcagggaaattcttccacacaggtaagtgggcctgcccctgccctcactagcaacttccaggactcctcagcacccaaaccctcaaagcacccatccatgagggcagcgggtgggtttactggcccacattagaggcagaggtgacccctctgcccccgtggagccaacagcctacaagagcagtcacaacccaggcagaggccatctggggacaacagcagcggcagcaacagcagccgcttgtccctccctgtcctttcgggctgagctggcctgggtggggcatcttctccctcttgcctctccctcctatcttttacaattatgtgtattatttctgcttataaaagaagctggttgagttttaagaacattacagaaacatgtagcatagaaagtgaagatgccctgtaattgtacccaccttggatgaccagtgtcatgggtttattttagagtcctaagggttgagggtgagggctataggttgcttggtgcgcactttccttcctctttggggctctctcacttgctgtcctctcttcatctgctgtccttcagggactgggcagaacccctcagctggtcatctgcagtgaccattccccctagctgccttctgcccaggcctcagtgagacaacctctcttgaattctaagaaaaccatttattcaataattcagcagatggaggggtatatgcaacatagccccaaagccaaataggagtgatcctgggttgtctgtctgtattttttatattctttttaaaattttttatatatttttggctgggcgctgtggctcacgcctgtaatcccagcactttgggagggtgaggtgggcatattatttgaggtcaggagttcaggactaccttggtcaacatggcaaaaccccatctctacaaaaaatagaaaaaatagcccggcgtggtggtgtgctcctgtagtatcagctacttgggaggctaagtcaggaggattgcttgatcccaggagttcaaggctgcagtgagctatgatcgcacaactgtactcctgcctgggtgacagagtaagactccatctcaaaacaaaaagaaaaaaaattatttatttttagagacgggacctctctctgtcacccaggcaggagtacagtggtgcaatcacagcttactgcagccttgaactcctgggatcaagcaatcctcctgccttagcctcccaagtagcaggtactacaggtgcatgccactatgcctggctattaatattttaaaaatttttgtagagatggggccttgcactatgttgcctaggctggtctcaaacctctaggctcaaacgatcctcccaccttggccttccaaagtgctggggtttcaagtgtgaaccactgcacctggttgttttttatattcataacccttagcatatcagaggtggttatagtaatatgtctgagatagagggtcaaacatcctgtatatatacaaagagcttccatagataattagataaaagacaagtgacctgatttggatcattggaatagaatcagagcaggtatgtcagaggtagaagaaacccttgagatcattgactccagaccctgaattgtgcagatggtcccaaggatctagagagcagatagtcttggccaaggtcccccactgagtcaagggcacactctagactagaattcagggctctgggctggggctctgtctgctcctgtgctgtagcccagataactcttccaggcagctcctgggtgggctctggccatgctctcccatccccaggcacaggcccaggttagagggcctcatggcccagtgggtggttctgagctgcctgtgttgctgcaggtaccaatgctgaggacgctggggatgatctgctgctgtcgtatgtgaaggagttctggtggttcccccacatgtggagccacatgcagccccaccttttccacaaccagtccgtgttggccgagcagatggccttgaacaagaagttcgctgtcgtgagtaagattccttgcagggcagagcggggcgggctaagggctgggctggaggtccagactgctggcctcttgctgcttttgcagtctgctctgacggatttttactaacacctctgggccagggccaagggagagctgcctttatagccactgtctccttgaagccccaagagaataacccctttacagacaagaaaccaaggctcagggaggtcacaccagctactaagaggtccagctgggacttaaactcaggccatttgtttcctgtgcccaagctcttactagaaggggaggctctggaaagctggaagaggtggtcaatgaggagggaacgagccctaggtgctaggtagaatgaagagaaggtaggaaaggccctcgtccttgtccctcactacagggtacttgagtcctttgtgctagaggcatgtgcaccggaccaagagtcaggagacctgggttctaatcccagctctgccagttgcccacactgagattctgggcacattccttgccctcccaggcctcagcttcccatcttaccatgaagtctcagaccagcagccatgccgacctaacctctgatttctctctcccattctacaaaggggggataaggcccaaaggggaaggacccctatgctcaccctggcctggtcatcctctccctaggagcatggcattcccacagacatggggtatgcagtggcgccccaccactcgggcgtgtaccccgtgcacgtgcagctgtacgaggcttggaagcaggtgtggagcatccgcgtgaccagcacggaggagtacccccacctgaagccagcccgctaccgccgtggcttcatccacaatggcatcatggtgagtgggcccctggaagcccaggaggtgggagaatggagagcacagtctgtcatgtgtgtgcatacgctgtcctggtaagcacggctctggtttgctggcttaggggttgcagatcagcttctgctgcctcctctggcacccgaggctctctgccccagggaaggtgggctgccactccgacccctttcatgagctctttcttagcttttgtgacagaggatcaagcaataatcagcattcttgaaagaggtttctgatgaggatgtgggacagggctctgttacagtctttttgctgattaaaaatttttttcttggctgggcctgatggctcacacctgtaatcctagcactttgggaggccaaggcaggcagattgcttgagcctaggagtttcataccagcctgggcaatgtagtgaaaccccatctctactaaaaaagtactaaaaaaaaaatatgcctggtgattagccaggtgtggtggtgcatgcctgtagtcccagctacttgcagggctgaggcaggaggatcacttgaacctgggagatcgaggctgcagtgagccaagattgcgccactgcactccagcctaggtgacaaagtgagactctgtctcaaaaaaaaaaaaaatttttttttcccctggggcttctaccatgcatctatccctttttttttctttctttcttcttttttgagacagagtttcactcttatctaggctggagtgcaatggcacaatctcagctcactgcaacctctgcctcctgggttcaagcaattctcctgcttcagcctcccgagtagctgggaagacaggcatacaccaccatgcctggataattttgtatttttagttgagacagggtttctccatgttggtcaggctggtctcgaactcccaacctcaggggatctgcccaccttggcctcccaaagtgccaggaattacaggcgtgagccactgtgcccagcctcacatctatccctttccttggcactggggacacagaaatgcacagaacggaggaaagttcctgcccttgtagacctgacattctagtggcaggagacagaccatatgctcatgcatgtgtgttgtgggaagtcagggaccccgaacagagggactggctgaagccatggcagaagaacataaattgtgaagatttcatggacatttatcgcttccccaatcaatactcttgtgatttcctatgcctgtctttactttaatctcttaatcccgtcatcttcataagctgaggatgaatgtcgtctcaggaccctgtgatgattgtgttaactgcacaaattgtttaaacaatatgaaatctgggaaccttgaaaaaagaacaggataacagcgatgttcagggaacaagggagataaccttaaagtctggctgcctgtgggccaggtggaacagagccatatttctcttctttcaaaagcaaataggagaaatatcgctgaattctttttctcagcaagaaacatccctaagaagagaatgcgttcccaagaggaggtctctgaaatggccgctttgggaacgtttgtcttttacagttgttgataagggatgaaataagccccggtctcccatagcgctcccaggcttattaggacaaggaagttcccacctaacaaattttggtcagactggttgtctgctctcaaaccctgtctgctgataagatgttatcaatgacaatgtgtgcccgaaacttcattagcaattttaatttcgccccgtcctgtgatctcgccctgcctccatttgctttgtgatattttattacattgggaagcatgtgatctctgtgacccacaccctattcgtacgctccctcccctttcgaaaatcactaataaaaacttgctggttttgtgacttgggggtcatcacaggacctgccaacatgtgacatctcccctggacacccagctttaaaatttctctcttctgtactctttccctttatttctcagactgacagacacttagggaaaatagaaaaggacccatgctgaatatcgggggttggtttcccccaatacatgtgtaaaatatacagtggtcagatggtgatgagtgccacggacaaagttaagcagggaatggaaggaaggaatgctggcaagagaagctggtttaaataaggtggctaggtgggccttcctggaataagccacgctgccacatgaggaagagcactcaaggcagagaacacaagtgcaaaggccctgaagcgggctgtgctggctgtgtttgaaggccaaataggaggccgggatggctggaggggagtgagggatggtggtagatgaggtcggggtgggtgatggaccagatcgatagggccatgtaaggccagccattggatggccatgggcttttaggctgagatgggaaggttttgaatggagcatgatctgactcatctttgaaagggatttctatcattctggctgttgtgtggagcagagactgtaggggacaaaagtggcagcagggagaccagttaggaggcactgcagtcttccagaccagaggtggcagcagcttggaccagggcccaatgttgggatgtggccatactctgggcttagaatagttaggcctgtggttagatgagttagatatagggtgtgggaggaagagaggagtccaagatgactgcagggtttttagtctgaggtgctggaaggatgagttgtcatcagttgagctggggcagcagtgggtaggcaaggtttgtacatttgtccatcagtccatccatccatccactgacctcagcaccaggccctcgtgctgaactccaggcactcctttaggtcctcaaccctgaactccagggatgaggtggtgacaaggcaggcccattccctgctcccttggagctcacagtttcatgaggggagacagacgacaaatggctaagccagtgtgtgacaacgagtgtcaccaggtgaggttctaatgttgcaagggggcttgcagaacatgtctgggattgctgcttcagagagggccaggcaggggccgtggctgcagcagtcccaagtttccagaaacattcccactctgttactttgaggcctgctcattttgtgcagagaatagcagtgaagtttgtaaaatggcaagggcctgtagttcactggggggaacgctgtgctgtaggctgcacccaagggtaggggctgtgcgaccacatggagactgcctttctgaggagcagctgggccttcttcctctgaggaagagtcctcccaccaccctcatgccagaaggcaccatagctcctctcccccaccccctcctcaggttctcccacggcagacctgcggcctcttcacacacaccatcttctacaacgagtaccctggcggctccagtgagctggacaagatcatcaacgggggcgagctcttcctcaccgtgctcctcaatcctgtgagtgctccacagcccatggctgctggtgagaaggggctgctgcacagcctgtctgcagctgacacaggcttcctggagccaggaaagggtggagaggcatgagtgagtgcctggcagttgggagacccactctccagcactggccctgcctcggctgtgtgaccttggctaaagaatccgagcatgctttttttttcctttcctaatcatgtactttaatacaaaagtgttggcatttttatgcatgttcccttcagtctttgctcatgtgtgtatacacacatacacagatacacacacatatatgaacaacatttgagttttctaggtctcgctttccttatttgtaaaatgcaaacaattacctctgctttaataatattaaataaacttcaagtggtggttgttattcagctctgtgggctgagtactctttatcttccatgcaccccacccctaacatttacaaaataaaacccaaatagctcccacattgggtctgctttccatttcaggattgtaatatttggggtcagtcaggcctggttcgtctgtcacctcatccaagtactcgcagcgagtttgttgacagcgccagcgtaacttccactggtcatcaggagccttgcaagctaaggcagggtcagaagggtcagagttggcggtgagggtggctcagacactgatgggccctgcctctctcctcccctcccctggagcagatcagcatcttcatgacgcacctgtccaactatgggaatgaccgcctgggcctgtacaccttcaagcacctggtgcgcttcctgcactcctggacgaacctccggctgcagacactgccccctgtgcagttggcgcagaagtacttccagatcttctccgaggagaaggacccgctctggcaggtggggggctgggcagcctgggcaggttgctacagggatggaacgccaccactcacaggcacacactccagatatggactcaaggctcagccatcatgccttcacactctcgctcgaatgtaaactcaggtccccatctacttaccagcatgggtgcgttcactcctttgcacacatgcatgctcatacatgtacatacttccccacgcagacctacatgcatgcagtcatacatagccttggaaaaaacagtgttaaaaaaacgagtgggctggacgcagtggttcacccctataatcccaatactttaggaggccaaggtggctggattgcttgaacccaggagttcaagatcagcctgggcaatatggcgaaaccctgtctctacaaaaaatacaaaaattagccgggcatgatggtgcgcatctatagtcccagctactcgtgaggcagaggtgggaggatcagttgagcctagaggttgaggctgcagtgagctgtgatcacaccactgtactccagcctgggcaacagagtgagaccctgtttcaaaaacaaaaaacaactccaagtgaacacagtgcagacaaagtacagaaagtgaatgcgttgtcttggtcaggctcttagataatctcttgtatctcttctaactccagcaggctctgagtgggaaaagggattgatgggagggtttgggggccagtttttgggaaagtctgctcctacgggcttttaaaaagtggaagcagaagctggaattggtgacagtctcatagttcagaccaggagtccacaaaccgtgactcatgggccaaaaccagcctgagacctgtttttgtaaagaacgttttattggcagacagccacgctcattcttgtatctactgtctatagctgctttcatgctatgacggcagagtcgagtagttgcaatggaaacttccatgccccaaacctaaaatatttactaaacacttaccaaaagattaattaaactttataggaagcgtttcttgaccccctggttcagacgcagcttgtccagttaaattcaacaagtgcttatgagttcctgttacgtgctaaggggcattttgcgagctctttgggggacatgaaactgaccagaagtggagcctgcctgtcagtggctcagtgtctgggggtggggatgtgacaaggacacatgtagcatgtaggtatcatgcccattgggctgtaagggccacatatccatgtgcagtgggagtccactgactgggttctggggcgccccacacatcccttccactgttgttttaggacccctgcgaggacaaacgtcacaaagacatctggtccaaggagaagacgtgtgaccgcttcccaaagctcctcatcatcggcccccagaaaacaggcaggtctctctgctcttgaccgagcttccccaactgcctgctgtctcagccacagaattctgaggactgccttgccctggccccactcccggataatttgctccctctttcccaggaagtaggaatgaagttggggtgaacacaaattgcctgtcagtatggaggggaaagaggtggaggaggggcctggagttctcctatttatcctgaaccatagcctcagggagctctccctgcattatcctgggagtctccaagtccagtcagagaagcccagatcagttgctctgctagtttgagtaatgccaagcaaaactggtacaaagaggactgtgatcaattagctatgtctgccagaggtgcagtagggagaagcagtgacatgattgctaagcatttgtcatccatacaaccctgcaaggcacaaatgggcactcccattttgtagacagaaactcaaggttcagagaagtcaagtgacttcccttaacacattcagttaggcaatggcaattccaggcctgaactctgatctctgtgaccctgaaacatatactcttaattgccaaactctatagcctccttctcttctgggctctctcattatagcatgtaaaccatagacttataccacagaaagtgaatgaactcactgaggaggaggtagggcagggtgcatgagtgagcagagggtattgggaagaagagacataggaacaagatttcttagttctttaagaatttcacattaacagaactgcagggtgacaaactcccttttccctgagctcctaccaagtgccagaggacagaggcccagagctggaaaggaccagctcttctgggatgctgaggggacagcagtcagttaaacatggctaccagagtgcagtggtgaggcagattctgaggccacgtcctcgtttagtgaagagtgctgtgatagattagcgatgtccgtagtaggtacaggagttgcggtgttcacatgcatgccatatatttgccaccctggatttagtaattccttcattgcacagatgaagaagctaagaccagagaaaggcagagaccttcccaggagcccccagtgggtcgtggggagctaggcccagaacccagactctatcttttggctgggggctgggccctgggtctcaggtgtctaccctccccacaggcaccactgccctctacctgttcctgggcatgcaccctgacctaagcagcaactaccccagctctgagacctttgaggagatccagttttttaatggccacaactatcacaaaggcatcgactggtgagttggcctttctgtccacagcgggacgggaaggccatcctggggcctcccaggagtctgctgtggccacagcaggaagcagctggagcttgctcacacacagctgtcattcctgtaaacagggacaaagtgcagtgacccttgaatcatggtgtgacagcgttgtcatagacaggacactcgatgaggaggccctttgcccctttgctctaccgcctgtagtcagacgctgaggtcgaagtccacccctcccttgcttgcagagaaacatcctgagtcttggggaggagaagggtttgcccagggtcccaaggtcggaaatccaaatgttctggctctcctcactgcgtgtggctgactgtgaagcagaggtgttcttgtgggcccttcagggacaggtcgctggtctttgggcgtcacttggggaagtcattaagattgccacttcccaccagagcctgcagaggttacctttgtagaggttcccagcagagggtcctagtagaggttcccttaagggtgtgggggccagagcagagatggttttactctccaccttttcagttggcatctttctctatttgccttttttctttctttttaaaaaatgtttcatgtcaggtaggtaatgtgctgagatcataacaaggttcgaggtgggtacacctcacacgtgtgtgaacacccaatcatcacgtgcatggactgcaaagtttgcctttttaaaccttgtccatgtattaccattatttattatttttatgtcagtgggttccctgggtggagaggttatgggccttctgtctttcttttttttttttttgagatggaatctcgctctgtcacccaggctgcagtgcagtggcgcgatctcggcttactgcaacctctgcttcccgggttcaagtgattctcctgcttcagcctcccaagtagctgggactacaggtgcccgccaccatgcctggctaatttttgtatttttagtagagacgaggttttgccatgttggtcaggctggtcttgaactcctgacctcgtgatctgcccgcctcggcctcccaaagtgctgggattacggcgtgcgccactgcgcccggcccatctacctacatttctaacatctccacagtctcttgtctaaaatctagtgtggtcagatgaattattggaagtcaacatttttcaggttttagaaaggtaatgtggtgcgaaaccatatatttagtaacatcttcagcgacacctggggcagcaccctgttagcaaattcattaatatgtctgtagcaaagtatgtgaatatttacactaagtaagaggaataagtcaggttttgttgccaaatggctttgctacaaacctaggaaacaaagcctgtgttttcaaagctttctcaattgagatattgtaaacaaaggattgtggacatgcaaagaaaattcagaaagatgagagaagacgtaattccttggcccaattcccaagagcttgattttgtaggtaggtctaaagtggggtgcaggaatccagcaggcccccagaacgctctgatgaagcacatccttgggaccagcctggatcagccccacctcacaggataggatagggaccctgtacccttcatgagagtggactttgcttcccacaagccccagaagttggaccctgagtttgcataggtagattcccctgggagggtctggagtgttcctttggtttccagaggttccttcatccagaggtggccattgctctggtgggatatgggcattagtctggaaagccgtgctcacccacagcaggctggggaggggttgtgggtagcaggaggtcctggtccacagtgacggcctagaaggtgttcccccaggtcaggaaagaaagtccgccctctggaggccccctctgctctgtgccagcctccctggggcagtcctggagccactctgagccccagctcgccccctagaggcagagagagtgacagccctggcagttaagcctggagcagctgagggggcgggatcctagagtttaggattgaggggcattaccccctccccatgacctgcaactgccggcgcacccacaagtcttcagatcctcccaactccagagtcttctggaaaaggaacgaatttgaaacagggaggctgccaagaggccattcccctccagaatccccactggaggcaagtccttgtttggttgggagcaaagcttcccacttgctctctgaggacattctaccccagtgcctcgcccttgtgctgcattcccttagccccctcctcatgagttttgtctgtgagccgcctctctgggcttcctgcaggtacatggagttcttccccatcccttccaacaccacctccgacttctactttgagaaaagcgccaactactttgattcagaagtggcgccccggcgggcagcagccctcttgcccaaagccaaggtcctgaccatcctcatcaaccccgcggaccgggcctattcctggtaccaggtgagtggggctggggtggagtccctgtgtcgggaacacagggctccgtctgacactcagttactcactcactcaacagatattattagtaagcacctactgtgtgccagccctgagccaggcgcctggagcgtggtgatggctgagaatagagtccttggtggaggagacaggcggaaatggaaagccagccaccagttgactgtccacctgcctagtgtcatgcggggtcctgcctctacttctgacactgacaagaggtggaggctggttacgcctagaggaagcttagatttggtgaacagcaatgcaggatcatactgactatagcttcctcgctggacacgggtgggagtgggagctcatggaaggacaagacacaagactgccattcacagtggagaaggcaggcacctgaccaagtgaggcagttacctgggctgtgatacatggagagggtgtggatccaagcccctatctggggcatgtatgaaccagagctgtcttttttttttttttttttttttttgagacagagtcttgctctgtagcccaggctggagtgcagtggcctgatctcaactcactgcaacatccgccttccagtttgaagtgattctcctgcctcagcctcccaagtagctggtattacaggtgtgcaccaccacgccaggctaatttttgtatttttagtagagacagggtttcaccatgttggccaggctggtctcaaactcctgacctcgtgatcttcccgcctcggcctctcaaagtgctggcattacaggcatgagccactgcgcccagctgaaccagagctctctttaatgcctatggcctgacttaatttcctgcctgccagcccactgagcctgcaggaatgcttttaggccttccctggtggggtaggcggagtccctcccctggctgccagcattcctgtgattatgccacacagccaagcactgtgattcagaagtggcgccccagcagaaagccaccctgttgtccaggccgaggtcctgagcatcctcgttaacccagcagaccaggcctgtgcttggtgttggggagggggtggggccctgggtcttagcccatggttgccagagaagtgtcccctgtcctggctgggacagcctcttcaggcctggccactgtcatagttcccaccctgctttgaggctcttttctcagatgtgacagtggctgtctcccgcctgggaccttgcggtctcccgcagggctggcacctgcctcctctttgctcccatggaagtctctcctcctgccactctctgaggctggtgaggaagccccttcttactcttgttctctagggcttctgtttatgccctgatgtctgctttcctgtggctttttctttaggagaagaaaaccgagaaacacttgtcaagtgtttctgttttctgccgtgctgtgtgcccccgcctcctggcgctgtgcagggaatgggcagtctgctttcatgggggaacgtagggtagagagagagccgccacaggttgggtcagtccctgttctgcactgacactgctgtacatctgcaccttactggagagtcacagctggtttctagaaggcagaggaggggtttcacgtttgtgtccccttctcaaagattagaaaaccaagtttcagcaagtttcatgtggtggcatttgaatccaagtcttctaaatctaagaccctattcctttttctgtccatgatcaagaggggtaagggatagaaggagaagggagactcattctccccaggaggacctgggaagatgttggaggagaggaagggtgggggcctgtctcagaaggaggtcgggacgaggaggacgctgctgtgcaccatattgccccagccctgggctgtgtgtgatcctcaggggagggggttggcggctgggggatagtgcctgtcgcacaggtgcctgagctctggctttctggacttagtgaattctgcagattcggacctcccatggcattattttaagtgattcagaccagccagtctcccttttatagttctttcccagtccttctgatttccataaaggagaaatgctcactttagtgcaagtggtcttacgtcctttctaacactgtcaacctctgctttcaacaaagagagcatgttcagggcctgttgcacacatttgtgtctggctggagtttgagaacattgtttttattgccatttgtgagtggttgccttctatatatgacaacagtgcagcagcgtgatcttggctcactgcaacctccaccccccgagtttaagcgattctcgtgcctcagccttccgagtagctgggaccacaggtgtgcaccaccatgccagctaatttttgtatttttagtagagacggggtttcgccacattggccagctggtctcgaactcctgacctcaagtgatccacccaccccagcctcccaaaattctgggattacaggcatgagccaccatgcctggcatcaggaaaccctgatttcgtccagttcccgtatttcaaagatggagaagttggggctctgggaccagtggcttcccttgacactggacacagtgagaggcagagccaggactcagacccagagctcctgggtccagctgaggatcttctggccaccttgcgggctgctgtccctctcaggccacttcctttgtgtcctccaagtggcatgctgaccctctttccttgcctgcagcaccagcgagcccatgacgacccagtggccctaaagtacaccttccatgaggtgattaccgccggctctgacgcatcctcgaagctgcgtgccctccagaaccgctgcctggtccctggctggtacgccacccacatcgagcgctggctcagtgcctatcacgccaaccaggtagctgctgtccctgacccttgtgagggcagtcacagtactggcttgctgtggttagcggagagcctccaactctttctcaccagccgtggggacagatatgccctccttggagagctagacccttgggtctataaaaagattttattattattattattattttgagacagggtctcactctgttgcccaggctggagtgcagtggtgtgatctcagctcactatagcctcgatgtcccgagctcacgcaatccttccacctctgcctcctgagtagctgggactacaggtgtgagccactgtacccagctaattttatttttttaagaaataaggtcttactatgttgcccaggctggtctcaaactcctgggctcaagcagtcctcccttggtcttccaaagtgctgggattacaggcatgagccactgcacctggcctaaaaagactgtagacctgtttatcccaaggttgatacatgagaactccccaagcctgtgtcccatcaccacaggccctgtagccctaaagggacccagaaagccctgaggcaggcaggtgggagcaaggagactgggcgtggtgatggagggagagcctgatcataccaggctgtttatgtatttatttatttatttagagacggagtctcgctctgtctcccaggctggagtgcagtggcacgatcttggctcactgcaacctctgcctcccgggttcaagcgtttcttccacctcagcctcccaagtagctggaattacaggcatgcaccaccacgcccagataatttttgtatttttagtagagacgggatttcaccatgttggccaggctggtcttgaactcctgacctcaagtcctctgcccaccccagcatcccaaagtgctgagattacaggtgtgagccaccgtgcccggccatgcccagccataccaggccttttaggcaaacttgcggagtgtttgagcaggagagtgacatggactggaagctcagagagaggccagagagggatgtttgtagggacctgaggggcaggcagggtttggtgagagcttaaattctaggagaaatggcattgggcagcagaagctggtggaaagcaggcgtgagaccacagaggcctgagcttggggatacctgcccttcaacaggggaggaggagccagttctagagggtgcagggtcccatatttataagcaggcccattcctgctgccgtggctgttgcccttgtttgccaccgaagtcaaagcaggtcccgatcccctttctccctttccagattctggtcttggatggcaaactgcttcgcacagaacctgccaaagtgatggacatggtgcagaagttccttggggtgaccaacaccattgactaccacaaaaccttggcgtgagtgttgccttttcctttctgcaggttatttccctgataaggcacctgggccaacaaagccaaagtcttgaataattatgagagagagaagttagttagagtcagaaagtatggaaagttattaatatgacttaagtcatattaataaaggtatcaccttaaaaaaaagggagatgatgaatctgttctactctggtcagaccatcctggggtcttctctttggtctgggctgaacattttcagagtgttttatgtaagtaaattagatcagtaatgagcagccctaattcccacaagattttcttagcattagcttttttttttttttttagacagggtcactctgttgcccaggctggagtgcagtggtgtgattttggctcactgcaacctcaacctcccaggctcaagtgatcctcccacctcagcttcccgagtagcttgggaccgcagacatgtgccaccatgcctggctaatttttgtatgttttgtagagaaggggtttcaccatgttgctcagcctggtctcgaatgatctgcctgcttcagcgtcccaaagttctgggattacaggcatgaggcaccgcccccagccagcattagattttgacttacgatttcaggaaaaggaaacacaaatgttgttgacagttaataaccgtactcactcagaacctggtgcaagtgcgttgagaatgccctcccactatgagtaaaggcctgcccgcattgcatgggctcagggctaggaaaggctgctttcctgtgctatgtcacagataagtgacacactcagctggatgaggggaccccaagagaaggaggaatcaagtcaccctccttggctccattcttgggaaagttttgcaacaagaatattccgtcttcactgtcgtgggagttgaaggtggagaagggaagtcagtccttcaccttgagggagaaggggccacctgctgaggctgtgggccatggtgtcagagatgcctgggttagggccccacatccatctcttcagcctttcaagcctcgctttcctcatctgtaagttggggataaagataataatccctgcgtcctgaaggccactgaattgaatgaaagcttcatgtggggctcttagctgagagcttggcatgcactaagtgctaaataaacggtagctgctattgtccttgtcatcatcatcatcaccatcatcatcgtcatcgtctatacctatcctatgaccctttcagaaatctctgttctccttcgctattcatgggaattctgttttcttgatgccctcatgctcaagaatctcctcatagttcctcatccagggctaaattctgatgtcagtattcctcccttcccataacagcttcggatctcatatcccaaaaatgcctttgaagacaggatgatgttggcagtcttgctgtgtcatttctgaagtttactccaaaaaatgaaattctccagtgacaggcatgcttaagtgcagctgtggatactgcatgttttgataaagatgaaatttattaaaaagcaaaagaacctccactaaacacccctcttcccattgacgctgggaggggtaaagaaggcttcttgggtttaaaaaaaaaaaagagttactcagcattgagaatgctcagaaaagatttcccagaacactgaaggatgggaaactgttcatgttgtagattgctgaagcggctgtggctggtcgggctggaggagagaagactcagaatgtgcgagctgccctttgccggaagtaggacaggcacgtttagtgcagcctaggacacatttgatcccacagatggcacatagcttctgacagtccatgtgggttcaagagcagtagattccctggtctctgccattcctggggtccatgaacatggctttaaggtcggaagtgggtggctgagccagctcccatccaaagactttcccacctccacaggtttgatccaaagaaaggattttggtgccaactgcttgaaggaggaaaaaccaagtgtctgggcaaaagcaagggccggaaatatcccgagatggacttggatgtaagtggtggacacactacctgtagcacctgcataagggtaaggggtccctgtatggagttgagggggattctctttcctttaccatgcactcagcatgttcatggccttagcatttcttggacagtatttgtaagaggaggaaaatgggggctgggacatggtgggtcagacctgatttcgtcaaacaagtgttggttaccttctactaagggctgagtgctgtggggttttgaggatgagccagacatgttctctgccttcaaggaactcctggtcttggaggggtatgagtcccaacaccactaagtagaatacaggcagagagtgctgcgcgcagtcagagagggcacacaagtgctatgggaattcagaacaaggggatgtcacttgaacctgagaggggtaaaaaaggctccttaaaggagggatgggggtctctggagttgcgcctagaaggatgagatccattttgtaggatttggacatatggaatgggagggtaggtaagaacagcatgtgtaaaaccatagggggaaaaaagaaattttaaaaatatatagaaaaagggtcacagactgggggtcttgttacttcctccttttcctacttgcttctgtttttgttttgttttgttttgttttgtttttgagacagggtctcgttctgttgcctaggctggagtgcagtggcatgatcatggctcacagtagcctcgaccccctgggctcaatcgatcttcccgcctcagcctgccatagtgctggtattataggtgtgaaccaccgtgcctggccctggccctgcccgccttgggttttgattattaattctctctcctctccctatcagaagaattttgacttagtgagctatattttgatgctcctgccaactgggagttcactattggaggctaccatttagaaggagattgtggataaataagaggtgtatggggggtggtgccagcagcatggtgggttttttgtttttttgttttcttttgagacggagtttcgcttttgtcacccaggctggagtgcaatcgcgtgatcttggctcactgcaacctccgctttccgggttcaaaagattctcttgcctcagactcccgagtagctgggattactggcgcccaccacctcaccccgctaatttttgtatttttagtagggttttcccatgttggccaggctggtcttgaactcctgacctcaggtgatccacatgcctcggcctcccaaagtgctgggattacaggcatgagccaccgtgcccggccgagcatggcgatttttagaggaggtcactcttaagtcagtacacaaggtctgagctttccttcccgttacagtcccgagccttcctgaaggactattaccgggaccacaacatcgagctctccaagctgctgtataagatgggccagacacttcccacttggctacgagaggacctccagaacaccaggtagccgtggccaccacagccagactgaacgtttgtgaaagctgggacatcccaccacacgctgagccagacctgcagagtgggaagctggaccagggcagctgcgcacttatgagcaatactctgtggaggtctggtggggctgggggagcacccaggcggatctgcaagcacctcggagcacccaccgctgggtctgcggcctaagggacctccctcgccagcagaggtccattccgttcccagctgctcctggggaggccgcttcctggtaggagggagtccacgagactcttttctgtccctcactgtgttccgccgactgtcccctctcgtcacccatcactccctgcttccgcagggcgcccctcagtattcgctgccatatgtccctgtcctccaggctgtaggggaggagagcctggccgggggagacagactggacatttccctgtttcgagccaggctcttccaaggggccagctgggtccccggagtcagtcctaggctggatgggagggtggccccctcaagaggactcccagcctccacatctggttcctaccttcacatctcaccctcccgttctggggaagaatttctggttcctacagtatccactccatcctcaaggcttcccgcagggccttggggcactgccttgccatcgggcccagttctccgggccccacctgcacccctttcttccccctgggatatgatgtgtggtgtttcctgtggtaaaagactgaggcaggccaggggtctgccagtaacatgttcccatgtacagacacggtccccacaccctcccagcctcaggcccaggcagacatgggcgagctggtgagactgccagccacggctttgcttagccacctgtggccgagggctctcagagacccccttaacctcccaaatactaagaagctaaaatattttaatattttgtttttttttttcttggtgccagagtttataccctgggtgctggggtcgcactgtgttatatatatatatatatatatataatgtgtatatatatatattctattttttttggttgggttcgtttttaattcagtcctacaaaatggtggtaagccccagtctcaggggtcaccctgtcttagagctagagatgaggtggcagggagggaggctgtgtcctcagtggcctggggctgagcagaccttaggaaggggccctccccagtgccgtggctgctctggggctaccccaggtgaacagaggtggtgagatgcgcagggaagaccagctctctccaggacatcgggctgcgtgaagtccagtgaccctgaggggattttggccaaaggaaacagccagggctgggctaggagagctggggtcaaaagctgccccacccactctccctcacatggtgctaggctgggagctgccctgagagctgggatgcccaccaaggcccacagaactgtctccaggcccttgtagacagtgggatctctgggctgatttctggttggggtctgctcctaccccaccccatttaacaatgtgaagtgactgaggctggggtgcctctccctggccccctccaactgccaaattctgcttccctctgaaccccaggaaatactttctggagaggcttgtcttgttcagaagactctagcatcttggggctggaaggtcctttgacgggtatgaaacaggtccagaaaggggaggtggcctgcttggccgacgtcatggagccagctgggagcagggctgagcgttgaacccgaggctcccggttccaagtcccatcgtgctcctcttccaatgccacactgcctctgagcccatccttgggaccctactctgtgccaggttcctgtcccttcctccgtcacagcatggtcattccaggatatggggacaaaccactccttcccagccagggtgcctttgagccttctcattccgaggtctgcgtttgcatccctgtcgtgttctccctcgaggggtccttccccagcctgtgggggcctgggtctgttctgagctgattcccttttctccagttctctgctgggatgaagaaagttggacactcagtgggaccagctgcaggtggtttcactgtgtacacagcagtgtccccatcatgcctctcaatggggcctgcaagcctgggaacttgggcatcgttgggccagcaggatgagcagcaaagggtctgaggacagggtggcatgtctgcttgtgtgctcatgaagacatgcccacgccatggagccaggggcttatagagaggggcagtgacttccagagtcccatccgtcagtgaggggactgggctgcgggatgggtgaggatcttacagctcccaggttcggaaatctaccctctaggcctggaggcctctctcgcagagcatggaaggcaggagaggtgggctggcctagggcaggagctccacttctctctgcctctggctatgggaaggagcaggcggttggaaatcctgtgacagcagagatcttctggatttttgcctggacccttctgcaagcctggagactggacctgccacatgttccaagtctgtctgcctaggtcactgctgccacttctcctcccactaacagacctttcttgaagacccactaggtccagacactgccgggacttgcaggtatggggggtagaaggagaggcagataagctgcctggggggctgttagctaatgggtacaaggacaccccctcccgagaagagaagccacagatgagtgggccagcgaggccagtcttcaatgtccactaattcactctaagcatttggccaaaaaaaggagagagaaataactgaaattgttcaggtggctccatcgtctattctgtggtcccctccatgagcctttgccccagggtgggtgcaggtgcgagtgtcacctgcagctgcctcagtcattcagagttccagagccttctgtggtggagcatcctgctgcttggaggatgagtctgaagtttaaaaatgggccttttctgagcccccctgatgagcagtcagtgcttctgggcccagctaaggaagccatctgttcccagcagaggagagctgctgcgctgacctgcagaggttggtggtcccagcacagagctgtgcccatgggcttgttagtgggaaaagcaaatacaacaatgttttaccaaacatttaattatgaatgcccactccccagcatctagatctaaaattattaacattttgccacattctttttctctctctgtgtatgtatatgttttctctgtcctaatttaaaagtacattgcaaacatcatgaaacttgatccctgaaagcttcagcctgcatctcctaagagttagggcattgtcctacacattggcccagtatcacagccaagacgagaagtcatttcccagcgatgtctgctatctaatctgtattcaaatccccccaattgtctcccaggtaacttatgtgtctggttttggaatcagcatccagtcacggtgcacacattgcattttctaactatgtttttaaaacctctttgaatgctgaaaggtcttccctcagctcactttgagtttttaaatgacattgtttttgaggccctaggcctgctgtctttttgaagccccacattctgaatttgtcagattgtttgctcatggtgtcgcataaccacttcttctatcccctgtactttcaaggataatttaggctacatgagattttgccttttgtgctgacttgacagcttcacttctgcctaagatgcgcctccactgtcacctgtaccaagtgccaaaacagcagaggggccagttagagcaagagctctgggggggccggaaagtctccctggagaaggccgtaatatctgggccttggaaggaaggacacagggctctggaaggaggaggctgcatgcctgaaggctgggccttcgaccctggggatgggccacagggcaccaaacacatcatatgtctctctctttctattttggggtcccagggttttcatttcctggagacccgtggtctgtgtgcactggagcagagccaggctctcagttgcagcagggaaaagcctacatggggaactgcctcccgcaagctgtggtgtgagaagagccctggctggcagcaggagctgtgaagtttcatcccagccgggtgcatttagtagctgcctgaccatcttcctcccaggccctcagtttcttcatctgtagaatgagcagataggggccacagcagggattttcacacatcaaaggaggcagcctctgctctagttgatgtgaggatgagggggcggcctagaccccctgctgcccaggccgttgaggcaacactgggttcctggcttgacagctgtgggctggctgcccttgccagctcagacggctggcgagttttcagcttccctaagggactggcatagggttttgtggggtcaatgccaggaacctgggggaaactggatgcgttttatcctaagaagttcatccctcctgctcttactgtttccggccctggaggagaatgagggaggagagggttttctatgactgtgttagcttttattattagcaagagggctccttttgtaatttgtgcatgaaattcatgtcatttcctgggagaggagagggccgactggagagggtggggggcacactggggaagcaggcagaggtttccttcccttgtaggggggtggggagagtggggagagggggtgctatccagttcgcctgatgagggctctcgaaccagccgttttgggttgtgttaaaggtgagaccttcctccattaatgtacaatctcgaactaactgctaataaagtggggttctgtttgta

SEQ ID NO: 153 - DNA, 282752 bp, Homo sapiens
caatctctagctcgctcgcgctccctctccccgggccgtggaaaggatcccacttccggtggggtgtcatggcggcgtctcggactgtgatggctgtggggagacggcgctagtggggagagcgaccaagaggccccctcccctccccgggtccccttcccctatccccctccccccagcctccttgccaacgccccctttccctctccccctcccgctcggcgctgaccccccatccccacccccgtgggaacactgggagcctgcactccacagaccctctccttgcctcttccctcacctcagcctccgctccccgccctcttcccggcccagggcgccggcccacccttccctccgccgccccccggccgcggggaggacatggccgcgcacaggccggtggaatgggtccaggccgtggtcagccgcttcgacgagcaggtaaccggcccgtggcgggcgggaggtgggagcggagtgggggtggggacagagtaggtgaggggaggtaggagcggccgcctcccccgcggctgcctcaggctctggaggaaaggaagggaagggaagagaagggaaggggggataagtgggggtggccaaggcgggaggtgaggggtaggaggggacagctgggagcttgggcaccctttccctcctaagtcggggggtggggccttgtccctgaccagcctccgaccctccatcccctttatcccagcccttccgcttggaaatggggatgagtgacctgggggcgcctttaggggcgcgccatctggatttaataattacccccttacttttgtttttgagcagaggtgggtaacgtttaggggttctctcttcctcttccctccgtgaccctcctaactggggacgagcgaaccctaaggcctgtcttatataccctcaataggagaacgataacattccgcccctcccccagtttcttcagcttcctctcctggagggggaagagcagaagaaagcaaggaaggcacaggttttcttactttctgctccatcgtctcatcctgccccgagagcttcaagtgcacactcactgcacatctttgtgatgccctacaacgtcgtcccccatatcctgatgacacagactgccttttttttttattgccgtttgcagtggaaaccgtggttctgaaatatcttccccttccttgataattgcagtctcttccccccccccttttttttttgccagcggtctgaggatgtgatgcattctcgagtgagaatgttggggagtaaaggggagaagggtgaaaggaaagtgagaaactgcttcagagccaccgacaacagagcaaagccagctgggatgtggtcctggagcggatcattctgctagtgtttgtggttgtttttgactctctcctggttgacaagagaactttcattgagaatatttgggatgaaaaaaaagttttgtagcttgaggaggtgactttttatcgcctgagtttcacacaataaatcctggggctgattagaataaatgcacacatagccttttgtcagtggaaattggtttaactttgtgttgctgtaggtagttggggatggtttaagggatgctttctgcagctgtgggtgcagtgggcttcctgtgatgggggaattgtttaagattgagtcaacctattttgtttactggatataatggtaaaacattatgggagctgaaggggtgggggaagagctcttctgttatttgatgcataaacatttctttacgggactcagcgtttcagacctacctggaaaatatcttggaatagacagaggaagttgagaagaagctatgtagataaaatagagttatgaagctgtcagagacttgaaggaattgttttatccattcgtatgcttccagacccaaaggcatctaaactaaactactaatccatctgaagtataatgttactgcatataaaagattacattattgatagagcgttagatttaaaacttggtagaaaagactctgtaattttaagaaaggatttaaaaggcacatagaagacttccaaagctgaaccttgtggacagcagaatctggatgtaggaaattgaaggatccacgccgcaattctccttaaattttaaaaattaaaaatttttttcagttttttcttaattttatttttttacttcttacctgttcatctctaggcttatttgccatattggaaaaagatacttaagagaggaatgattttgggctgggcgcggtggctcacgcctgtaatcccagcactttgggatgccaaggcaggtggatcacctgaggtcaggagtttgagaccagcctgaccaacatggagaaacctcgtctctactaaaaatacaaaaattagctgggcatggtggcgggcgcctgtaatcccagctactcgggaggctgaggcaggagaattgcttgaatccgggaggtggaggttgcagtgagctgagatcacaccactgcactctagcctgggcgacagagcgagactcttgtctccaaaaaaaaaaaaaaaaaaaaaggaggaatgattttgattatatacccagtaaagcaagaaagtgtttctccttctgtccctagctttaaaagaccttaaggcttcgttgtttgttatgcatattgtggaatcaaactcaccaccatctgttaaaaattaaggacattagtttttaaaacagcatttttctgcattccttatgttgtaattaagagaaagatatataggagagattattcctcactttttttttttgagacaaggtcttgctctgtcgcccacgctggagtgcagtagcttgatgtcggttcattgcaacccctgcttcccacattcacgtgattctcctgcttcagtctcccaagtagctgggattacaggtgtgcaccatcgtgcctggctaatttttgtatttttagtagagacgggggtttcaccatgttggtcaggctggtcttgaactcctgacctcaggtgatctgccccccaccccctgctcggcctcccgaagtgctgggattacaggcatgagccactgtgcctggcctattcctcacatttttctcttagaaagttaaagtctctgaccttgagatacaaaaatgtaagggttttcagtgtttaacataaggtacttatatatattatatatagtatatatataaaataaattaatatattaatttattatataagtgataaatgtttaattcaaattagagttcaccttacggttgaaaatgtcttttagtcagaaaactgaggcatgggaaggttaagtgacatagatctaataagagcttcagtatgaaaagtagtgaatgcttgaccatcagggagatacttttcctaagtatcccataaaatttgttctaatccattaaatatatttagaagactttattttattttttttatttttgagacggagtttcatgattcttgcctaggctggagtgcaatgatgcgaccttggcttactgcaacctctgcctcctgggttcaagtgattctcctgcctcagcctcccaagtggctgggattacaggcgcctgccaccactcctggataacatttgttatttttagtagagtgctgagattacaggcgtgagccatcgcttacatttttattgaggggagaaaaagccctgcatgtactgagagatagttgtataagaatcttaagagttggccgggcgcggcggctcacgcctgtgatcccagcactttgggaggccgaggcgggccgatcatgaggtcaggagatcgagaccatcctggctaacacagtgaaaccccatctctactaaaaatacaaaaattagctgggtgtggtggtgggtgcctgtagtcccagctacttgggaggctgaggcaggagaatggcctgaacctgggaggtggagcttgcggtgagccgagattgcgccactgcactccagcctgggtgacagagcgagactccatctcagaaaaaaaaaaaaaaaaaaagaatcttaatagtttcaactgtttataaaacttttgaattttggattatattatctgtactttgctttactgggcccagggggagttaagctttccttcttattacagctaagagtttgcctgttggaccacttaacgcccccagggagcatgtgcatgtctaaagatggcaactctgtttatgattgctgttttggttggatttctaatattcggtgtgattaaagcagaaatgcatttctagccactgctgattacagacatattgcactctgatgggtatcgcttagcaacttagtgcagtagactcagttaaaagaagtggatgtgtgccatattgacattttgagctcacattcttgtgggtaatataaaattccttaacctgataatattgcagctaaacctagtatttagggtctaagttgaatgagtattaccaattttagaagtaatcacctccttggttagggaaatgacagttgcacaggtggacagccagaaagctgaatgttatcagttaaatcttacatctctccttaacctgccttcgtggtgccaaatagcaagtttctaattgaaactgacaaattgtaggtgtgtagcttttttttttttttttttgagacagagtttcgctcttgtctcctaggctggagtgcaatggggagatctcagcatactgcaacctctgcctcctgggttcaagccattctcctgcctcagcctcccaagtagctgggattacaggcgcccaccaccacgcctgcctaatttttgtatttttagtagagacgggggtttcaccgtgttggccaggctggtctccaactcctggcttcaggtgatccacctgccttggcctcccaaagtgctgggattacaggcgtgagccaccacgcccggccatgtgtagcttttaattgtggttcattaacccagtttctaagcaaattagaaccttctgtgtatctcccctagttctgtatgccccactggttcctgtagagctttatttctgaagggaagtatgggaaaactatggatatttgaactaaaaaaaaaaaaaaaagaattaaaaagaactccatcccaaaatgatttgttgtaaatatgttcatttaaagcaattatattttccatatctgatcaagcaaaagtagtacataaaagccaaaaaacccaatttaaagaatatgttatggaataaactctgattttagaggttgtagtagcatatttgttgttctcatacattgagtgttcatctgaatgtacgttgaatatgcggtgagtgattcacagtataaaatgattggcaagtatcttcgaaattacaaaccacatactgattagacaaatagatttgcaaaactgaagctttttggatttaaaaaatatctcctagcctcattcttcaagcctggtgtgtaatttttataaggccttatagtagttgaaaatgagtactcttttatggtgacgaattctttatggtgagtgagaaataatgcttattcttccaattttagtatatgtggtgctgaatcgagcacaataatgcttattctttgcttcggaattttttaatttattattattgttattttaaatttttatttatttatttattttgagatggagtctcactctgtcgcccaggctggagtgcagtggcgcgatctcagctcactgcaacgtctgcctcctgggttcaagcgattctcctgcctcagcctcccaagtagctgggactacaggcgcatgccaccacgcccagctaattttgtatttttagtagagacagggtttcaccgtgctagccaggatgggtctgaatttcttgatgtcgtgatccacctgccttgacttcccaaagtgctgggattacaggcatgagccaccgtgcccggcccggaattcatcctttagaaagatttcttccagctgttcctcagttctctgcactcccttacactttccaccttatctgtctgggaactaatttagtctttatgttggctgctttcttttcacttttcaggctaagatttcctttctcttggaaatcagacgtttacttggtcctgcagctctctctctgtggaccagtcttttttgttgttgttgttgccagatactcaccgcctctactgtttatccacccatttcctttataactctgaaaagtagctcctgcctctgcttgattgctgttttcttgaaagtgattacttctggcaaaacatagtggtcattgcttagttgtaatgccactgtgatgttccactccccccggaaaccaatctcttccagttcccaagacacaatacttttctactgaattggagttccttagcgggggtcttagttttgttctgctattcagtgcctttgtccctatcctagccattagctttcctatagatccttgatttcctcatctgttgaaaaagaaatggctagaaaatcttttagattctttcaagtttaaatattcgatgattttaatattctaacagcatgtctctgtgacccagcagtctattgggagctgaccccacttgatttaccaaactctttcccattatgcctctgcatgcacctatgttccaggcaggtcacctcagtctcttctgtgtgtatcatgcttcttcccacttcttggcctttatttctgccagtctctgcctgaatgctttaattcctcctttgtgcttttctaattcctgtccatccttcaatgttcagctcagatttcattttttttttttccccatgaggttgtttcagactaaactctgctatctcacttcttggtatccttgttacctggagttttacagaaccacacagtaagttttcttcctttaggaggattgtttgaacacagcttggctttgttttctttttttcttgtctttttatcaaatggagtgcatactttctgaaaagcaaagaacgctatttgaattctcttctagtcaccccagtgcccagcacagtcttaaacacacagaacattgatggaatgtttttcatatgattcctggttgaagggtagactggctaaataaaaaaagtggtacttttggctttgttttactgaattttacttccatgtttgcaatagcctaggtctgataagtgatattttaactaggaatgagtaagaaaattagcataaagaaggaatttatacatatttatatttcctcccatagagcaaacatgttttttgaatcaggtttcagatctgatcaactacttttgtaattttggatttgtcacttactgttaggatattttgcaatggtgtgatagaatatgaatgtgaagcactttgaaaagtctaaaatttttctaatataagatttatatgttttctttatagcttattattattattattttttgtgtgtgtgacagagtcttgctctgtcactcaggctagagtgcagtgtagcttattactgattattgtgttttcattaaataagggagagtaggccaggtgcggtagctgatgcttgtaatcccagcactttgggaggcccatgtgggaggactgcttgaggccttgaattcaagaccaggctgtgcaacatagtgagatgctgtctctaaaaaaaattagttgggtgtggtggcatgtgcctgtagtcgcagctactcaggaggctgaggcaggaagatcacttgaacccaggagttcaagcatacagtgagccatgattgtgccactgtactccagcttcggtgacagagtgagaccctgtcttccaaaaaaaaaaaaagagagcgtgactagtctctggatattcctttgtatgtaccttggccaatatataccttactttagtatccattgacaagttctcttttttcttcttcttcatttttttttttttgagatagagtctcgctctattgcccaggttggagtgcagtggcacgatctcagctcactgcaagctccaccttctgggttcaagcgattctcctgcctcagcctcccaagtagctggcattacaggcacgtactaccacacctggctaatttttgtatttttaaaagagacaagggttcgccatgttagctggtctcaaactactgacctcaaacaatccacctgcctcagcctcccaaagtgctgggattataggcataagctgtggtgctggtctaatattgttacattttattttaaatgttcctgttttttgccctactctttttatttgactttttaaccattaggaaattagattcttttctcaaatctgctttattattattattattttgagacaagttctcgctttctcgcctaggctggagtgtagtggtacaattttggctcactgcaacctctgcctcccgggttcaagtgattctcctgcctcagcctcccaagtagctgggattacaggcgtgtgccaccacacccagctaatttttttgtatttttagtagaggcagggttttaccatgttggctaggctggtcttgaactcctgacctgaggtgatccgcccgcttcagcctcccaaagtgctgggatcacaggcttgaaccaccgtgcctggccctatttttgtatttttactatagacggggttttgccatgttggccaggctggcctcaaacacctgcctcagcctcccaaagtgctgggattacagatgcaagccactgcacctggccttaagtctgcttttaaaaaatgttttggctgggtgcggtggctcatgcctataattcaagctttttggggggctgaggtgggaggatcacttgggcctcagagtttgagaccagcctgggcaacagagtgagaccccatctctacaaaaagtaaaaaaaacaaataaaaaaaaaatcagccagtgtgcattggttgaaagtaaagaaaagaaaaaaaacagacaaattagccaagtgtggtagtatatgctacttgggaggctgagtcaggattgcttgagcccaggaaattaaggctgcagtgaggcatgattgcaccactgcactctggcctgggtgagaccctgtctcaaaaaaaatttttttttttaatatggagaaagtatttttgtttttcgttttttatttgggtaccggccactgcacccaaccaaacattttgtccttaaacaaaagtttaagtcatataatacagtagtaagaatgccttattttttacatctttgttctttaaattactcagattgctatggggcatttttgttgtagctttcaaatttggtattctggggttctatgtagactctatattgttgcattctaacgacatacttttaaggataagcagcgtattaattaaaaatgtgttttccacttgtgttccttaggtctgcgtatattttggaggtgtgtgtgtatataagtcaagggacaggaggtatcggaaggctctaaaggaagtttaaggaggagaatattctatagaagtggaaggggagatttgtggtcagcttaaactgttaaaaggcttgggatcaataccgaagcagaatatgagcatcttaatctgtttctttgcaaaggattgacttgtatttataaaagcattggcttgtttcatctgacatcttttaaagtaccccattttcttgggggcgggaagggagagatgagaccatttgttttgatcttgaaggacagaaaagtggttttacgttgtagtgactgtgaattaagtttaaggtctcagcaagttgtaaatttctgtatcatactatgtggtagagccttcagtaaacagagtactctcaggtgtttaatgctataggatataaactataactgctgtttatagtaccctcgctaaattctcttaaaggcaatccatttgaccacttcaaatgttatatgcctgtgatatatagttatattctctgcatataactggtttttaaaaattgtttattattcatttattttagaagtgaggtctctctttgttcctcaggctggagtgcagtggtgtgatcatagctcaccatagcctcgaactcctgggctcaagtgatctcccacctcccgaatatctaggactatgggcgtgcgccaccatacctggctattattttaatttttttcgtagagacagtgtcttgttatgttgcccaggctggtctcaaactcttggcctcaagcagtcttcccacctggcttcccaaagcactggaattacaggcgtgaactactgtgctgggtcctgagtggcttttgagccactgactatatcatcaaaaagcttctgttgagacaaagcctcaagctagtgtggagttcatcctactaaaatgaagaattggcattatgttctaaaactttacatattcttaccataaatggtactaattactttgcagtagcagtaacttgaggtgcaaacttccagattgcatattttctttaaaccatagtctggcactcacggtttggcttagggttgccactgcagtccacaagctgtcgcctgcccttattcatattttatagctttgaatgtcttattccattgaacttcagataactttttttttttgagatggagttttgctcttgttgcccaggctggagtgcaatgttgtgatctgggctcactgcaacctctgcctcccaggctcaagcgattttcctgcctcagcctcccaagtagctgggatgacaggcatgcgccaccatgcccagctgattttgtttttttagtagagacagggtttcaccatgttggtcaggctagtcttgaactcccaacctcaggtgatcctcctgccttggcctcccaaagtgctgggattacaggcatgagccaccgtgcccggctgagaacttaactttttctgatgaaattctttcctgctccacctaactcccgtgtcccacccccaccagcagagtggtatatctagcacaagaggcatgaaattaatttagtaaatagcaggactactagaaacttttaaggattatttaacttatttttaatcaaaattttatactcagataatgaccttttgggaagttatgtctcttaatgatctcaagtggtgacacttttctgttgacacggtttctcttgggtagttctcatagtagtttgggcatgagaaaacaacttttaccactttagacttgtgagggcagcctactatgtagtaaaagaaaaagcttttgattgtgcaacttgcagtgtggtcttggggaagtctcttaacctctctgaacatcagttttctatattttcatgtgtaaaatgggcatgatacttacccttctcacatcatgggcttgtttaatgacttaggtatgaatcttatatgaaaggaagctgtaaacagtcataaaaatgtattagcatctgtgcagtattttttttctatccattctttataatttggtggttattatttctactctacatgagaaaaaagttacagaggcaaaacatgttcacaatcatatgattatataattaactgagttaaactagagtatggatgtcttgacccttagatcactatctttccaataaatagttttaaaagtctaaattttactaacaggtagtacaaatatgcaaaatgagggatgtatgattgcttcttcactcgaagatggtatattatgtttttccttttaagttcatgttagagtatctgaatcttttcaagttggttagatgttagaaatagatgtaaattttaagcattatatatccttgatttcattatgtattattctcctggtcactttatcaaaacttcttcagctgttagaagttgtaacattgtttcccttttatttagttatataatacacttattgtacattcttaagtgggagaatagaatttgtgagaataccaacagaaatacacatacagctataaatatgagattatgattctttcatgttggcattgcacagtctatttttgtaaagttggtttttatattctaagaacattttacttagagtttgattacatttgaggcaaacttttcaactttggtagtatttgaatgaagattcctggatgtggtttttttaattgttacatctactttttcagtttttctttttccctataacaaccctcaaatccttcatcttgtcttttggagtatttttttctatcctcctgtctttatcggtgccttctattcctgtcccaccttgggtctgggaaaatgtgcctttatgctccatgtgagtcttcttccttttgggtaatgagtgcggagggaaaaaaagcacagtatttctttccctgttatgtttcagtttttggcctctgataagtgaatctggagtagggaatgacagtgatagtaggttttgttttagtcatatattggcgacaaagatcaacgaagacctgaagctcttgttcctctcatgacacaaactacccacaggtgcatgccaccatgccgggctagtttttaaattttttgtagagacgaggtttcgccatcttgcccaggctggtcttgaattcctggactcaagcgatcttcccacttcggcctcccagagtgctgggattacaggcatgagccaccgtgcccaaccgagattctgtctctgaaaaaataaataaataaataaaataaatacataaaaataaaataaaaacatttgaagacatcttaagtacaccctagattcccacccccaccaaaaaatttcattcattcttcaaccatttctcaaagaacatgttttcaagacacctcactatcctaattgttttccttttggtgcaatggtggtcagtactcaggcataccattttttatctttcctcccaatgttgtatgagggcattatatgaaacttaaatggatttaaaaatgctgagcttgctggacatggtggctcacacctgtaatcccagcactttgggaggtgggggagggaggattgcttgagcccaggagtttgagatcaacctggacaacacagctagtatgcacaaaaaaataaaaaaagtagctaggcgtggtggtgcatgcctgtagtcccaggtacttgggaggctgaggtgggaggatggcttgagcccaggaggttgagcctgcagtgagtggtgtttgtgctactacactccagcatgggtgacagagtgaaactctgttaaaaaaaaaaaaatgctgagcttcaggtacagtatatttttggtatgcatttgattaccagtacagtatacctatcaaaaatgttaattcacatgttttaaaataaaaagtttccaacataaaagtagagagttttttttttttttttttttttttttttctgagacagagtctcactctattacccaggctggagtgtaatggcacgatcttggctcactgcaacctctgcctcccaggctcaagccatcctctctctcagcctcccgagtagctgagatcacaggtgcacaccaccacgcctggctaaattttttgtattttttgtagagacagggttttgtcatattgtgcaggttggtctcgaactcctgacctcaagtgatccacccgcctcagtctcccaaagtgctgggattacaggcgtgagccactgcacatggcctagagagatgttataaattaatccttttgtatccattactcaatttctccctagtcttatttcatccgtattcctacccatttcctgctcactacctctttattattttaaagcaatcctatatatcatttcagcgtgatttattcttatactgactttaagagctgtgtaatataaaaacaactcaattaggaatcagaagacttgactttaagtcttaactttctactggaatgagttaacaggggggcaagccaagctgtatgagccctgaattcctaatatgttgaagagagtaacacgtggtggaggggacataatgttacctgcactttttcacagggatctatgagaatcaaagataggaggtaatatgcatgaaagtattttgtctactctaaactcaaaagcaaaagtgctttacaaaggtaagattttattagtaaatgctgcttccctgtataagtgctaacaactcatgcctaatcagtcttagaattatctggatgctgacattaaattaagtccatagtattaaaatcaccctttcacctttacccactcttggattttgacaattgcaacaacattttctcattcccaatctggctcctgttacttttcatgacttctgcaagttcactgaccacatttctcttaccatatttctaaattttcatctgtatcttggattcatgtacacttgagctcaggtaaaacagggaggtgggctcttcatgctttatgtatctaagttctgatgactctcagcaatgctttttttcagatttgaagatcattttcttttttttctttttcttttttttttcttttttgagtcactgtcacccaggctggagtgcaatggcgcgatctcggctcactgcaacctccgcctcccaggttcaaacgattcttgtgtctcagtctttcgagtagctgggattacaggcacctgtcacgatgcccggctaatttttgtatttttaatagagaaggtgtttcactgtgttgtccaggctggtctcgagctcgtaacctcaggtgatcctcttgcctcggcctcccaaagtgctaggattacaggcgtgagccaccatgccttggcctcattttattttcaactagaacaattagaaataaaaattgagttgaatagttctgcttttaatgacctattggtgctggaatcatggactctagtgattcttgttcttctttcctcatctttttgatcctaatgtattttaaaagcctttacatatttttgtctttaacatttctagttattctgaacttttgttttaactcttctgttaatttatccattgtgtgtagtgtgtattttttcttaaatgtccttataaatactgagctgtgggggaggggagaggaggagcaactggtgcaggcacgctagtttctttagaaatgtcagctctgccagatcacttaagacttgttaaaagtacagatttcctggctctactaaacatcgtgtgatttctagaggtcccaggtcatttttgacataaagctgggtttgtaaaccactgctgtgtgatatacagggagaatttaatttctgggtggtatttaataggtcacagtacagtcatatatatcactgcaacaagttagaaaaccacaattggatgaactttaaaaatcaatactaaaaaaaatattggagagctatggatgtaatgaggactagatgaattagaattccagaaatagaagagatctttataggtgagcagaggattgctgacatttgctgattctggacacacactgaaggaaaaggaaactagagaggaagtgcattttactaaaactgcaacatatccctggcccagttcaattcctgattggactgaggtgatcagcctatcttatcccttttgcctaatagaggaaatagacagctcttactgaggagatatattctggggtttctatggttctttcgtttataatactatcatactattaactattctagagatgtgaaagggtggaaaaattcaagagaaaaataaaacttatagaagcagactcagaaaattgaagttcatcagacaaagacttattttaaaataactataatatacttaagaaaataaaggaaaatacggagaaaatggatgaaaattttcatagagaattggaatccacagaaagaaaccaaatgaacattctaggaatcaaaaacacaacgttggttgcttaaggtctttatttgtagtttaattagaaactttggcgcaggactctaggacactccacctccccctcattctttactgttcttaaaaaacaaaaacaaaaacaaaaaaaacccaggtaaatttaatgtatactatttaagttccacgagagcagggcctatgtctgttttgttcgttgttgtactcccagggcttagtatagtgcatgccacattaaaaaacaaaacaagacagaacaaaatcttccttaacaccaccatcacaaacccccccattaataattaattgacattaatctgaaattaattattcattgtaccggttcagtagcagactatacacagcagaaggcaagactagagagcttgtggacagatcaatagaaaatatctagataaaagcacagaaaaaaaaaaaagaatggaaagagtagaacagagcctctgagacatgtggaacattagtaaaaagtctaatgtgtaattggagacccaaaagtagagagattagcatggaagcaaatacttgaagaggtaatgataaaatattttcccaaactgatgaaaggcatcaacctataaattcaagtagtttagcaaaccccaagcaggatgaacacaaagaaaactacacttagcatatcttaatggaactgttgaaaaccagaaacaaagagaaacgcttaaaagcagccagaagaggggaaaaaaggcactgtgttcaaaggaacgatataatacaactgatggctgactttttaatacaactgtggaaactgggaaataacagacattttttaaatgttggcaaaaaaacctgccaagctagaattctaccttcagcagaaatatccttcagacaagaaggcgaaataaagacatttttagacaatcaaaagctgacaatttatgaccagcagacctgcactgtaagattactgaaggaagttttttaggcagaatgaaaatatctcaaatggaagtacaaaactgtaggaaataatgaagagcacacactcgggtaagtgtgtgagtaaatagacaagacctattgcctcttgtttttattgctgtttttaggaactttattgctttttgctattctagaataatagaatttccacagcttttaggttaaggtaaaattgccatccaatcaataaactgcacatatttaaaatgtataatttgatgagttttgatatacatataagcctttgataccatcaccacaatcaagatgaagaacatatattaccggcaaaagttttctccagcctccttataatccattcctacctccatcccatccctagggaacccttgagctgtttttgtctcagtggatatatcataagttgtttatccattcacttgttgatggataactgaagacaactcaaattttcaccattacaaataaagttgtcttgaagattcatatacatgactgtcatttctcttgagtaaatacaaaggagtagaaatgggtggatcatatggtggatgtatataataatgttacaggatattatattctgtaatattttaagaggccaccaagctgttcctaaagtgattgtatcatcttacagcagtatatgagagtttcagttgttccacatctttgccaacacttatttaaccttttcttttaaattacagccatcctagtgggtatgaagtggtgtctcattgtggttttgatttgcatttccctaatgactcatgatattgagcatcttttcatgtgcttatttaccatctgaatattttctttggtgagctgtttatctcttttgcccatttttaaaaaattgggttttactggagttttcagaattcataatatatgctgaatacaagttcatcagataaatgatttgcaagtcttctagtttttccttgtttttttgttctcaaagtctttcaaaagcagatgttcttaatttttctgaagtccaccttatcaattaaaaaatagatcatgttattggtatatctaaggtatctttttctaatataaggtcacaaatttttctcctctgttttctgtagaaatttaggatttatactaacgtttgtggctcatttttagttaatttttgtatttgtgctatgtgcctgttatgccaataccacatagtcttaactataaaagagcttaactatataaactataataaaatatcaagtcaggtagtataagtcctccagctttcttgtttctcagaattgttttgactagtctaggtcttttgttatccttgtatggtttcggattggcttgtcaatttctattaaaaagccagttttgatagagattctgctgagtccatggatcaactttgggaagattgccatcttaacaggtattgttttttagtttcaatttttgattgttgctaatatatagaaatacatggatgtttattgatcttgtttgtttttatttaggccatagatttttttctttttctttttaaagacagggtcttgctctgtcccctaggcttcatagctcacttcagccttgaactcctgagctgaagtgattctcccaagaagctaggactacaggtacatgccaccacgctcggctcattttcttattttatagagacaggatcttgctgtgtttcccaggctggtctcgagcacctggcctcaagctgtcctctcgcctcggcttcccaaagtgcatgagtcactgaacttggccaggccgtaaattgttttgagacagggtcttgctctgttgcacaggctagagtgcagtggtgcaatcatggcttactgcagccttgacctcctgggctcaagtgatccttccacctcagcttcctcagtagctgggactgtaaacactcaccacgatgcctggctaatttttgtagagacagggtttcaccatgttggccaggctggtctcaaactcctgaccttaggtgatccatctgcctcggcctcccaaagtgtttgaccactcagcctttatacagatatttcatcttctttacaagaagaaaaacactctaagctcttgcctaaaaagatgaaaatgttctttgtaaaaatgaggatgtccttaccctcttcccaaaatgaggagcagagtctcataattgtattgatttctgggggacattcacactatctatttctaggctgtgttaattatgcctcaaattcatagttccttctgaatatcctgttacctagggactaaattgtaaagttaacctttaataaagtttgaataacatagagaagaagagggaaggaattgatttataaacttgcccgtttccctgtaataaggaagaaaatatgtatagctgctgtagaccttgcttctgtaactggttgagagattgtagttcatatttataactacttctgctgtacattccatgtttcctttgttctcattcaagatctcagctggtggggtaacctaaatcttcattaataaagaatatggctttgggaggctgaggcgggtggatcacgaggtcaggagatcgagaccatcctggctagcacagtgaaaccccgtttctactaaaaatataaaaaattagctgggcgtggtggcgggtacctgtagtcccagctactcaggaggctgaggcaggagaatcgcttcaacccaggaggcagacgtggcagtgagctgagatcacaccactgcactccagcctgggtgacagagtgagactgtctcacaaaaaagaataaaaaaaaaaaagaaaaaaagaccatgggccggacatggtggctcacgcctgtaatcccagcactctggaagctgaggtgggcaggtcacaaggtcaggagtttgagaccagcctggccaacatagtaaaaccctgtctctactaagaatacaaatattagctgggcgtggtggcaggcgcctgtaatcccagctacttgggaggctgaggcacaagaatcacttgaacccgggaggtggaagttgcagtgagccaagatcacaccactgcactccagcctgggcgacagagcaagactctgtctcaaaaaaagaaaaaaaagaatacaaatctttggtggtcctgcttcatgtgtgtgcatgcctgtggctgtggttttccattaagttttgctcttatatatataggtttagaaaaacatttcagggaatcctcagggttccagacatagtcctctttgtccccattatgtagcaacagtacagtatcacctagtaataggactgaattacatcagctaatagaataacccccttctttgactgttgatgtagtgcggtggttcttaggacagttttacctcccaggggacatttggcaatgcctggagacatttttaattgttatgactttcgtgggggtgggggaatgctactggcatctagtgggtagagttcagggatgctgtcaggcatcctgaaatgcacaggacagcccccaagagtagagactgatccagtccaaactgtcagtagtgctaagattgagaaattctgatttagtggtatggaggcagtggtcatgaggtagttgttacttccagttcagtggaactgtgtggaatcattccctgcttgggaaccaaggcctccaatccagcagatatcaaagtcgtaggtacttgaaacaaaacttctgctaatggaatttttaggaataatagaggaactacttctacttgtgccccttgattctcaggcctttgtattctagctatggggaaaacaatattgtatattgctcattgatccactgtaactgagtgagtcttcagtagtccattctgttagaccagctgcttctgggtgatggagtatgtggtaagaccagtgatttccaagttccataacccattcctgcataaccctttttctgtgaaatgagtaccttgatcaaagtcttgttgagtagtataccttgatgatgaacaaggtgtcgcccatgtccttgatggtgatgctggcagaagcactgtaggcagggaatgcatattcatattcagaatatgttggtgccagtgaggacaaattcttgtcccctccatgtatgtagagtttttgttttgttttctttttttaaggtatggtattatccactgtcattaatattttggagcattttacttccacattaaaaaagatcaaaataggtaataattatctgaccaagaaatgttttaaataaattgtagacttatgacagctatatcatctatctaaaaaccttggagtaactgtaaaatagtgacttttgaactgtagactttactcatgcagatatctcactaattttgttgaaatctaccagatagaaatccattgttatgggttgtatggttgaaaactttttaggctgtcatttgtttcaagatacagattgactcggtatactttaacatttctcatagttggccaaatttaggtaaaactatttaatttcattgaacgttttagggaaaatgcctgaatattaatagagataggatgaattaaattaaagaacttaccctttgaaaaattgccagggttagcaatttttatgctaaccctgcataaaaattgtgcgtggtggtgtgtggagtggtgtatatgtttcagagaaataatataaatgttcagataagagtatctgcgtaatctaactaggacctgtctaacctacctgcttaaggatagaggaaatcttgagagacttgaaattgaagaacttaaaattttaagtcttccctttcaaggccctatcaaaacatcatgaccacatctttgaaatagttacttttatcactcaatatagttagaaaattttatttttagaactccaaaatcattttattttattttatttatttatttttttcgagacggagtcttgccctgtcgcccaggctggagtgcagtggcgccatctccgctcactgcaagctccgcatcttggtttcacaccattctcctgcctcagcctcccgagtagctgggactacaggtgcccgcccccatgcccagctaatttttttgtattttttttttttttagtagagacagggtttcgctgtgttagccaggatggtctcgatctcctgacctcgtgattcaccttcctcggcctcccaaagtgctagggttacaggcatgagccactgtgcctggctcattttatttttattattattttttgagatggagtctcactattgcccaggctggagtgcagtggtgctattttggctcactgcaacctctgcctcctgagttcaagcaattctcctgcctcagcctttggagtagctggtactacaggcgtgccgccacgcctggctaaatttttgtatttttagtagggatggggtttcaccatattggccaggctggtcttgaactcctgacctcagttgatcctcctgcctcagcctcccagagtgctgggattataggtgtgagctaccgtgcctgacctccaaaaccgtttttattaattatattctttattaagtatatgtttgataaagacaagcatttttccttttttcactgttacattctttctgtttagaatagtgatttgcggccaggcgcggtggctcatgcctgtaatcccagcactttgggaggctgaggcaggtggatcatgaggtcaggagatcaagaccatcctggctaacaggtgaaaccctgtctctactaaaaatacaaaaaaaattagctgggcgtggtggcgggctcctgtagtcctagctactcgggaggctgagacaggagaatgacgtgaacacgggaggcggagcttgcagtgagccaagactgcgcctctgcactccagcctgggtgacagagcaaaactccatctcaaaaaaaaaaaaaaaaaaaaaaaaaaaaaaaggaatagtgatttgcacatagaagggactcaataaatatttgttgaatgaatgaatatatgaaataaaatcttccatgctcttgaagagaagtatttgtcatgtgactggtcttatatggcagaatgtcccttgtttaccattcctattcccttctaaccaaatcatgatatgtatttttaggtattctttggcatttctttttgaacacctggaaaaatgctaaaatatggtttaaaactcaatgtttgtgaattaggctgttaggtgcagcctgacttaagggataagggctgaattatagagaaattgaattatgctttcaaatatggtacgcatatgaaagtaatacatggttgttttttaaactaggttaaatgtggtaaatgcactcttttaatttagtgttttattaaattttggtatatgttgtgttataagcataaaagtttctgaaagaatttttgtgcctagaaattgtgggaattgttgctttctttaacttttgatttgaaacaatcacaaattacactggattcttaaaaatgttgtaggatctttagggagctcaactgcagtccagatgctgattttttttttttttaatactttaagttctgggatacacgtgcagaatgtgcaggtttgttacatagctatactcgtgccatggtggtttgctgcacccatcaacctgtcgtctaccttaggtatttctcctaatgctatccctcccctaaacccccaccccgcaacaggcccagtgtgtgatgttcccctctgtgtgtccatgtgttttcattgctcaactcgtacttatgaatgagaacatgcagtgtttgattttctgttcctgtgttagtttgctgagaatgatggtttccagcttcatccatgtccctgcaaaggacatgaactcatccttttttatagttgcatggtattccatggtgtgtatataccacattttctttatccagtctataattgatgggcatttgggttggttgcaagtctttgctattgtgaacagtgccgcaataaacataggtgtacatgtgtatttatagtagaatgatttataatcctttgggtatatacccagtaattggatggctgagtcaaatggtatttctagttgtagatccttgaggaatcgccacactgtcttccacaatggttgaactaatttacactcccaccaacagtgtaaaggcatttctatgtctctctctcttttttttttttcttgagatggagtctcactgtgttgccaggctggagtgtggagtgtggtggcatgatcttggctcactgcaacctccgcctgccaggttcaagtaattctcctgcctcagcctctccactagctgggattacaggtgtgtgccaccacacccagctaattttttgtatctttagtagagacagcgtttcaccatgttgggcaggatggtcttgatctcttgaccttgtaatctgcccgcctcggcctcccaaagtgctgggattacaggtgtgagccaccgcgcctggccttaagagttcctgtttctccacctcctctccagcatctgttgtttcctgactttttaatgatcgccattctgactggtgtgagatggtatctcattgtggttttgatttgcatttctctaatgaccagtgatgatgagctttttttcctgtgttttttggctgcataaatatcttcttttgagaagtgtctgtttatatccttcgtccactttttgatgggttttttttttttcttgtaaatttaagttctttgtagattctggatattagcccttggtcagatggagagattgcaaaaattttctcccattctgtaggttgcctattcactcatgatagtttcttttgctgtgcagaagctctttaatttaattagatcccatttgtcaattttggcttttgttgtcattgcttttggtgttttagtcatgaagtctttccccatgcctgtgtcctgaatggtattgcctaggttttcttctagggtttttatggttttaggtcttatgtttaagtctttaatcaatcttgagttaatttttgtataaggtataacaaaagggcccagtttcagttttctgcatatggctagccagttttgccaacatcatttattaaatagggaatcctttccccattgcttgtttttgtcaggtttgtcaaagatcagatggttatagatgtgtggtgttatttctgaggtatctgttctgttccattggtctatgtatctgttttggtttcagtaccatgctattttgtttactgtagccttgtagtatggtttgaagtcaggtagtgtgatgcctccagctttgttcttgttgcttaggattgtcttggctctacgggctcttttttggttccctatgaaatttaaagtagttttttctaattctgcaagaaagtcaatggtagcttgatggggatagtattgaatctataaattactttgtgtagtacagccattttcatgatatcgattcttcctattcatgagcatggaatgttttttcatttgtttgtatcctcttttatttccttgagcagtgatttgtagttctccttgaagaggtccttcacatcccttgtaaggtgtattcctaagtattttattctctttgtagcaattgtgaatgggaattcactcatgatttggctgtttgtctgttattggtgtataggaatgcttgtgatttttgcacattgattttgtatcctgaaactttgctgaagttgcttctcagctaaaggagattttgggctgagacgatagggttttctaaatatacagtcatgtcatctgcagacagagacagtttgacttcatcttttcctattcaaataccctttatttttttctcttgcctgattgccctggccagaacttccaatactatgttgtataggagtggtgagagaaggcatccttgtcttgtgccggttttcaaagggaatgcttccagtttttgcccattcagtatgagtatacctatgtaacaaacctgcacattctgcacatgtatcccagaacttaaagtatttaaaaaaaaaaaaaatcagcatctggactgcagttgagctccctaaagatcctacaacatttttaagaatccagtgtaatttgtgattgtttcaaatcaaaagttaaagaaagcaacaattcccacaacttctaggcccaaaaattctttcagaaacttttatgcttataacacaacatataccaaaatttaataaaacactaaattaaaagagtgcatttaccacatttaacctagttaaaaaaaaacacaacaaccatgtattagtttcatatgcataccatatttgaaagcgtaattcaatttctctataattcagcccttatcccttaagtcaggctgcacctaacagcctaattcacaaacattgagttttaaaccatattttagcatttttccaggtgttcaaaaagaaatgccaaagaatacctaaaaatacataccatgatttggttagaagggaataggaatggtaaacaagggacattctgccatataagaccagttacgtgacaaatacttctcttcaagatcatggaagattttatttcatatattcattcattcaacaaatatttattgagtcccttctatgtgcaaatcactattctttttttttttttttttttttttgagatggagtttcgctctgtcacccaggctggagtgcagaggcacaatcttggctcactgcaagctccgcctcccgtgttcacgccattctcctgtctcagcctcccgagtagctgggactataggcacccagctgtgggtttgttataaatagctcttattattttgagatgctctccatcagtacctagtttattgagagtttttatcatgaaggggtgttgaattttatcaaaggccttttcttcatctattgagataatcgtgtggtttttgtcattggttctgtttatgtgatggattacatttattgatttacatatgttgagccagccttgcatcccagtgatgaagctgacttgatcatgggggataagctttttggtgtactgctggattcggtttgccacaattttattgaggattttcacagatgctgaatttttttctgggaagaatttactttgactttttcatcctacaaaaattattctggttctgaaggatgcaggtgtttcaatggtgtcccattaatatccccaggcttagcacagttcttgcttggttataataggcaattaagtgttgaatgaatgaaagaattttaactttattctgtgggttcagggagctgttgaagagtattaagcaagtgagtggcatgctcacatgttctgaagagtgtttcctggtagtgatatagaagatggatttgaagggacagtaaaggcaagaataataattaagaaattgttataatagggatgatctgagccagggtactcattataggaaattaggggcaaccttgtcatgagatttgtttaggagatgaaattggaaggcttcagatggatgataggggtaaggaggaaaggaggagatttaagtgaataagagttgaggagagggaggagttgtaaatgacaagtttcttgtttattgttttgaataaaggggaaaattgttttcagttattcataaaggacttaaaaatgggctttgatcccaaaagttgttttgaagttatttcctgctttatctttggagacccttcttcccacccccacatcaaagcaaatgccctcaactgctttagatgcagtcttgcattgaaataggtatcacattgttttattttgcttgaatgggtgctgttggcttaaacatctaattgcatctgctttgtcttctttagttgtgtctacttatgggccaaaagagcatttctacctctgtaatttcatttgcatattggttttcagataaattgaagattaattatatgaagtatatggtttgtaatctcaattgaaggtgaattttttattttcctggttgaatataatggaatcattttggtatggagaagaaatggttaaaaatagaccagtgggtcatctcagtgtgaaagtcaagaggacttctaggcttaagcctggtagctaaatttctgttggctctaccctcttcatgatgagtccaagtttattttgatctgcatctttcttttttttaatgaatgaaattctccttcattcagcctggtaagtaacctggccattagtacgtgactaaatagctgaagcttctggcttgaattaagttataaacttagcacagtggcaggtgcttgaactgccatgttaaaactagcgcatagaatctttgccattcaaaaactgttttctcaatcccatgaaggagatgaagcctacatgggaatcttcactgattgtgctgacttttcttctacaatttttagtttataacatgtatagtttgtcaattgtgctaggatattttgttaatatgttcttaaaaattcaaatcccaggggtaaacatcaaataatttaattgtgcctatttgactttatgggagagttaacaaccatatttatatatatggttaaatgtgtataatcttcattctcaatctttcagaatccttattttccattttcatttttagcattagctgcattatttctttatacaactaggaaaagggattattcagaaatttggttgatggctttttattttgtagagacagggtctgtctctgttacccagcctagtctctaacttctagtctcaagtggtctttccacctcagccttcctagtgttgggattacaggcatgagccaccgcactggccagatggcattttaaagaataatgttaggaaaataattaatttttgcaagtgaagatagttgaaatgttagctaaaatgatgacctagaggcagcttgttttggtaaatatcttagtcagtttaggctgctataacaaaataccatagatttggtagtttataaacaacagaaacttacttctcacaattctaaagtctgggaaatccaagaataacattcctttaagcaaggttgaatgtaccagcttgggcgatagtggcaagtagcctcctattccattttgttctagaaagcattttttctcttttctattatttttgtctctttatatgtttatgtgttagggggagaaggagagagaatatttttatatttttcttttggggggatatttttatttttaaattataaatacttctaatttgcaaaggatcccagaaatagttgaagctgtctttaaacccctctctgatcccattctatcctttctgttaactactattctgaagttaatttgtactctgtccatttttatccttttattacatatgtttgtgttcataaaaaaattacagtttaacatttttacataaaaaatgttcttgtaaatattctgcaatttgcttttttaaattttattttttatttttaatttttttttgcagagccagggccttgccttgttgcctaggctgatctcaaactcctggccccaaggaatcctcttaccttggcctcccaaagtgctgggattataagtgtgaaccaccactcctggccttgcagcttgctttttaaacctattctaagacttgctccctatttatacatgagtattaagttaactcattttaactgcacgtataatattctattatcagtatgtcagtttatccatttctggtatagaggaacacttaatttgttttcagggttttttttttttttgcttgtgtttttgttttattataaacaatgcttcaggaagcatatatttgtattcttgaattttttttttttttttttttttttgagacagggtctcactcttgtcgcccaggctggagtgcagtggtgcgaactcggctcactgcaagctccgcctcccaggtttatgccattctcctgccttagcctcctgagtagctgggactacaggtgcctgccaccatgcgggctaatttttttttgtatttttagtacaggcggtgtttcactgtgttagccaggatggtctcgatctcctggcctcatgatctgtccgccttggcctcccaaagtgctgggattatatgcgtgagccaccgtgcctggccttgaatttttatttgacttaaaacatactgtgaaacttgtaagattatgtgaatcatgtttgtacagtttatacttaaaaaaaaaaaaacatggtgaactcttatcaattcacagagtaaaaaacaacattcccaatgctgtggaaacacctctatggcccaaatcacagttcttttcttaccattccccctaccactatcttgaattgtattttaaaatttcctttcttttctttatgtctccatgaacaatgtattgctttgtttacttattttgattttcatgtaatggaataatactgtaagtattctgatttcttttgtaagcatcatttttcttttgagcgttaatctatggtattgtatgcagttcattcagttttactgctatacattagttcattatttgtatatattgtatatatatatatatctgggctattgatgcacatttggattgtttctagttttttgctattactaagaatgctgcttacgaacattgttattcatgtcttttgtgcacatgcaggaatttgaagtatatgtctgggagcagaatttttcattttatggggtatgggtttgtttagctttactaagtaatgccaaatttttctaatttttaaaaatttttaattaattttttttttgagatggagtttctctcttctcccccaggctggagtgtaatggcacgatctggactcactgcaacctctgcctcctgggttcaagcgattctcctgcctcagcctcctgagtagctgggattacaggagcgagcaccatgcccagctaatttttgtatttttattagagacggggtttcgccatgttagccaggctggtctcgaactcctgacctcaagtgatctgtccacctccgtctcctgaagtgctaggattacaggcgtgagccactgcgcctggccaccaaattattttttaaagtgattgaatcagttgacactcccaactgcaatatagaagtattcctattgctctgtgtccttgccaaagcttagaattgtttctttaaaaaattttatggggccgggtgcagtggcttacacctgttcaaggccagcctggccaacgtggtaaaacccggtctctactaaaaaatacaaaaaaattagctggacgttgtggcatgcacctgtagtgctagctactcgggaggctaaggcaggggaattgcttgaacctgggaggcggaggttgcagtgagctgacatcttgccattgcactccagcctgggcaacaagagcgacacttcgtctaaaaaaaaagaaaaaaaaattatgtatctggtgggtaagaaatgttgtttcattgtaatttgaatctgtatttccttgactaccaatgaggtttagtttcttttcggatattcatagagcatttgtgttatttattctgtgaaatgtatttgtgtttcttattctgtgaagtgtctgtatatactttttgcccatttttctgtttggattgtttaatttttcctgattgattcatagcaattttttatggttttagatctaattctcttgttttttgagacagggtctggctctgtcacccaggctaaagtgcaatggtgcaatcttggctcattgcaacctttgctaggctcaagctatcctcccacctcagcctcttgagtagctgggactacaggtacgcgccactgtgcctggctaatttttgtattttttgtggagatggggttttgccatgttccccaggctggtcttgaattcgtgagctccagtgatctacccacctcagcctcccaaagtgttgagattgtagatttgagccacagtgcctagcctagatctaattctagatttgtgttgcaaatatcttttccaatttatgattggattaaaaaaaacttcggtgattgaaattcttgatcttactgcagctgaatttatcagtcttctatgatttatgttttaaaatttttttgtgtcctatcattaagataattctctattttctaaaagttgtttgcttttcacttttacattgaagtctctaatccacatggaaagactttttttgtaaggatccacttttatttttttgccatatgataacagataactgattgttccagcctatttattgagtagtgcattttttctcctgtgatctcagtgcttgcttgggtgaatattaagtgtcagtatatgcacaggctcagtttctagactctcagttcggctctctcctctagtgccagtaatccacttgattatttgtcctgattgtggttgctttataataattcttagtataaagtatggcaggtccccaaaagacttataataatgcctttccatattggttttacagtcagtttattgatttccgcaaaaaatgatactgggattttgaatggtattgcattgagtctttggatcaagttgggaagaattgattgacattgttatgatattgaggcttcctatttaagaacataatatgactttctatttattttatgttttaaaaaatcattccagttaagttttataattttctccttatataaagaacttctacataaaatgtcagtttttcctagaatatttttattatttatacatgatatttaaaaagttatattttctgattgtatatagaaatgaaattaacttatattttgtctttatactttttttttttttttatttaaagaaacggggttttgctatgttgcccaggctggtcttaaactcttggcctcaggtgatcctctagtctcagcctcccaaagtgctaggattacaggtgtgagccaccacatctggcctgtttttgtgctattactgacttatatctagattctttggggttatctatgtagacagtggatgatctacaaatagttgtagctttgtttctttatcttcaatctttttttttctctgtgcatctgttgagggcttttaatgttgaataggggagatgacattgggaagctatgtgttgtttttaattaatattttttttgtacattgacctcttctgtaccttgcacttctgttttgttttgtttggttttgtttttggaatgcagtggcgcaatcacagttcactgcagccttgatcacctgggctcaagccatcatcccacctcagcctcccgagtagctgggaccacaggcgtgtgccaccatgcctggctgatttttgtattttttttttttttttttagagatggggtttcatcctgttggccaggctggtctcaaattcctgagctcaagtgatccacctgcctcgacctcccaaagtgttaggattataggtgtgagccactgcacccagccccagggttgttgcttctttattgagcttgtcactcagtgccttttaactggggcatttagcccgtttacattcaaggttagtattgatatgtgtggatctaattgtgtcatcatgttgttagctggttattatgctgacttgttggcatggttgctttgtagtgtcactggttatgtacttaagtgtgttttttttagtgtctgataatgttctttcctttccatatttagtgctgctttcaggagctctcgtaaggtaggtctggtactaacgaattccctcagcatttgcttgcctgaaaaggatcttatttttcctttgcttatgtagcttagtttggcccaatatgaaattctgggttggaatttcttatctttaagaatgttgtggctgggtgctgtggctcacacctgtaatcccagcactttgggaggccgaggcgggcagatcatgaggtcaggagatcgagaccatcctggctaacaccgtgaaaccctgtctctactaaatatacaaaaaattagccaagcatggtagcaggcgcctgtagtcccagctactcgggagcctgaggcaggagaatggcgtaagtaaacccgggaggcggagcttgcagtgagcctagatcgcgccactgcactccagcctgggtgacaagagtgagactccgtctcaaaaaaaaaaaaaggaatgttgaatatagacctccaatctcttctgacttgtatagtttctactgagaggtccattgttagtctgatgggctttcctttataggtgacatgtcctttctctctagccacctttaacatttttttctttcatttctgccttgaagaatctgatgattctgttttttggagattatctttttgtgaaatattttgtgggagttctctttatttcctgaatttgaatgttgacttctctagctaggttggggaagttctcatgaatgatatcctgaaatatgttttccaagttgctgcctttctccccatatctttcagggataccagtgaatcatatatttagtctctttatataatttcatatttcttgggggttttgtttgttccttttcattcttttgtctttattcttgtctgtcttcttatttcagaaagccaatcttcaagcgctgagattcttttctcagcttggtctgttctactgttaatacttgcgattgcattatgaaattttttttttttttttttttgagacagagtagtgacacgatctcagctcactgcaacctctgcttcctgggttcaagcgattctcctgcctcagcctcctgagttgctgggattgcaggtgcctgccactacacccatctgattttttgtatttttcgtagagacggggtttcaccatgttgaccaggctggtcttgaacccctgacctcatgattcgcctgtcttggcctcccaaaatgttgagattacaggtgtgagccactgcgcccggccatgaaattcttatagagtgttttttagctgtatgaggtcgtttatattcttttctatactggctattttgtctgtcagctctgtatcgttttattgtgggtagcttccttacattgggtttcaacattctcctgaatctcaatgattttcattcctatccatattctgaattctgtttctgtcatttcaaccatctcagtccagttcagaacccttgccggagagctagtgcagtcgtttgttttagaggaaagaagatgctctggctttttgagtcatcagagttcttgtgttggtgctttgtcatctttgtgggctgatgttccttcagtctttgaagtcgctgtttttttttgtttttttttttttatcctatatgatgaccttggatgtttgtggtacaaggtaggttcagttaactggcttcattactggaggggccagggctcatctcaggactcccggagtacatgggtcctccaactctgggggactggcattgggccccagctttgttctctggttctttaaggttaggaacctgctgcactggaggggccgaggtgctcctggacctctggtcacaatactcccgtgggttgtgccagccaaagtgtagggggtggcagtggaatcaattcttgttcgcatgtgccagtagcagtggcagcaaggccacagggtgctggcctccatgtgggcattggcagcaacagtggcagtaaggccagggcggggggctgctggtacacatgcactggtggtggtgttagcacaggggcagggtgctggtgggtgcaggactgggtgtgccctctgtgcacgttcatgctggcttcagtggccggtaaggggtgggggtgggtcctctgttttctctgcctagtttcatgttggtgcaggggctcagtgctggtggggatggcactggtgggctctgtacctgccagtgctcccttgacaatggccatggagggataggcagggtgtactcacgctggctgcagtggcatgggagggtgcttgcacgcatgtgtgctggcggggaagggaaaacaaggtacacctgtgcacacgtgtgggcaaagcatttggagggtggccatgggcgagtgcctgcaggcaaagcagcatggagcagccttcggtgggaggagggtattggcaggctcgtgcttttccacagggatcactgtggttggagcactctgcctgtcagcaccttgtcagtgcaggagctggtatgtggccccccccggcagtactgcaagcatcctggccaggctggagccccatgagagaccagcagactgagggtactcaggtcacaccacccccaccttatgggcaagactgccctgcagagttcaggtctggcagttcctctagggctaaagtctcctatgggagcaagtcgagccttgggggatgggcactcctggccctgttgcactacagatgctccagcaccaaaacctctgagctctgccctggctggagttctgcccctaccacttctctaagcagctttccctgccagctcaagtgtccttggtggttgaggggtctccttgtggtggaggagtctccttctgcagggattccagagtcccctggtgagagtgggttgctgcttccctgttcaactcaactgcctcttcaggagtcactgggggccaggaaaaagtcccggtgcgtggtagccctgtgcagggttccttacttcttccctcgtcagttcagcatctgtgtcttccctctgtcagcactcagtgctttccctctgaagatctgctaagagtgtgccagtcatcctgatcctctgggagatgttcctactggctgcagctagttggccatcttggagccccctccctgtggcttttcatgatttctaataattacattgatgttacattctgtgggctgttcttattgaaatgtataaatttaacaaatcagttgttggtgtaaacttgctgatattttgtttaggatgtttgtatctatgagtaagattggtttgtaattttcttatatagctgttgtctggatttcatatcaaggtgattctagccttataaaatcaattggggagtttatataatctatttaatctctgtgttaactgaagttgtgtctaatatttcacccctaatgtttatttctttattttttcatgtttttttttctgtttgtgtatttcgtttttatttttttgagacagggtcttactctgtcatccagactggagtgcagtggtgtgatcactgttcactgcagccttaacctcctgggctcaagcagtcctcccaccttagcctctcaagtagctgggactacaggcacatgtcaccatccctagctaatttttaaattttttttgtagagacggggtctcaccttgttgcccaggctggtcttgaactcatgggctcaaatgatcttctttcttggcttccaaaagtgctaggattacaggcgtgagccactgtggctggcctcagtgtatttttaaagactcatttctaggccagacttggtgggtcatgcctgtaatcccagcactttgcgaggctgaggtagatggatcacttgaagtcgagagtttgagaccatcctgaccaacatagtgacaccgtttctactaaaaatacaaaaactagctgggtgtggtggcagacgcctgtaatcccagctactcaggaggccgaggcaggagaatcgcttgaacccaggaggaggaggttgcagtgagtggagatcatgccgctgcattccagcctgggccacagagcaagacttcatctcaaaaaaataaaaagactcatttcttagctttttaaactttgttttctgttttgttaattttgttgttacattttctttccttgggtttattctgctatgcatttttcccctaactttttaatgttacttatttatttattttttgagacggagtttcactgttgttgcccaggctggagtacagtggcgtgatctcagctcactgcaacatttgcctcccgagttcaagtgagtctcctgcctcagccacccaagtagctgggattacaggcgctcgccaccatgcccggctaatttttgtatttttagtagagatgggatttcaccattttggccaggctggtctcgaactcctgacctcaggtgatccacctgcttcggcctcccaaagtgctgggattacaggcatgaaccaccgtgcctggccttaatcttatgtttaaatgtggaaaaatgcacataacataaacgttaccatcttaactgttcctaagtgtatagttcagtagtattaagtacattcaccttgttgtgtaaccaatctacagaactcccttcatctcaaaaaactgaaaccctttactcattaaactagaacttcccattcctccatgttcccagccactggaaaccaccattctactttctgtttctatgaatttgactaccctggatacctcaaataagtggcgtcatacagtatttgtctttttataactggcttgtttccgttagtgtaatgtcttcaaggttaatccacattgcagcatatgtcagaatttcctaccttttaaaggctgaataatattctgttatttgtgtaaaccacattttctttatccattcaggacatttgggttactttcaccttttggttattgtaaataatgctgccatgaacatgggtgtgcagataccacttcaagaccctgctttcagttcttttgcatatgtacctagaagtagggttgctggatcatatggtaattctatttgtaatatgttgaggaactgttttactgttttccataggtatatgcactattttactttcccatcagtagtgcacaagggttccaatttctccatatcctcatttacgtttgttattttgtgtctttttttttatttttttgagacagagtctcactctgttgcccaggcttgaatgcagtagtgtgatctgggctcaccgcaacctccgcctcccgggttcaagcgattctgctgccttggcctccctagtagctgggactactggcacctgccaccatgtctggctaatttttgtatttttagtagagatggggtttcgccatgttggccaggctggtcttgaactcctgacctcaagtgatctgcctgcctcggcctcccaaaatgttgggattacaggcatgagccactgcgtctggccttatttcatgtctctttttgatagtagccatcctaatgagtgttaggtggttttatgactttttggtttttttttaatagaggtttttgctctgtcatgcagactagagtacagtatcatgagcatagctcactgcatcttcgaactcttggactcaagcaatcttcctgccttagcctccccaaagtgctgggattataagtggaagccactgtacctagcacgttttctgacttttagagttatatttaagctcatcagttttgaatatttcatttgattgtaagtattcaaagttataaatttattaaatgctgctttaattgtatcctacaagtttcaataattggctttttatttttcaatttcatatttccatataatgttttcaattatgatttctcctttcacctagagtgtttcatatgaatatgaaacatgttatggtttatatgttaccagtaatttcaaatttgaacttagctttatgaccttgaacatatttattagttatttattgttatgttataaattattcccaaatgtagccgttttgtacaacaaacatttattatcacataaagtttctgtccatctgaaatccattagtggctgaactgagtgtttctggctcagagtctttcatgaagctgcagtgacagtcttggctgggtctgtagtaatctgaaggcttgactgggggtagagcatttgcttccaagtaaattcacttacatagcttttggcaggaggcctcagttctttgctggccatttgtaagaggtctcagttcctttctacttgggcttctccatctggctgcttgtaatgtggcagctgacgtctcccagagtgagtgatctgagagaatcaaaagccacattctttcatgatccttagaagttacataccttcctgcttgccgtataatattggttatgcagaacaacccgaataccagatgagagaggatgacacacgggtgtggatatcagaatgtaggaatacttgcagaccatcttggagtctggctaccataagcatacagtccatttttataaagttttcatgtcttcttgaaaatgatatgtagtcccaagttcttgagtgtgatttttacataggagtttgatcaagtttattaagcagttcaactcttctaaattctgattcttttttgtctgctagatcttactactgagaaaggtaagttaggaaatctttcactgaattagtatgtttatgcttttttcttgcagatgtgtcagttttgtgtgtgtgttattaggtgcatagaggcttacaatatcttacagttgatttgagtcctgtatcatcatgtagtgcccctcttgatctctagtcctttttatcttagtccactccagttttctcttgtttctatttgcctgatagatctttttccatttcttaactatcaatatttctgtgcctgtatgctttatgtttgtctcttataaacagttcatgggaaaccagtctgatggtttttttttcttctgcctggagagtttagttcatttacattcattgtgatgactgacatctttggattcctttctgccattttctttttaaaatttaatctaattattattacttttttgaaacaggggtctttctctgttgccctaacttgagtccagtggtgtgatcatggctcactgcaacctctgtctcctgggctcaagtgatcctcccagctcagcctcctaagtagctggaactataggcatgtgccatcttgtctagataattaaaaaacattttttttttttgtagggacagcatcttactgtgtttcccaggggctagtcttgaactcctgagctcaagcgatccacctgcctcagcttcccaaagtgttgtgattacaggtgtgaaccaccacccccagctctgccattttcttatgtgccttttattcaactgtttcatttttttaccccttgagtctcagaatttacctctgggttcattttacttctgcttgaagcatattctttagaatttcttttgatgagggtctgttgcagtaattgctcttactttcctttctttgaaaatacagggccagcgcggtggctcacgcctgtaatccgaacactttgggaggccgaggcgggcggatcacaaggtcaggagatcaagaccatcctggctaacgcggtgaaacccccatctctactaaaaatacaaaaaatagccaggtgtggtggtgggcgtctgtagtcccagctactcagtaggttgaggcaggagaatgacgtgaacctgggaggcggaggttgcagtgagctgagattgtgccactgcactccagcctgggtgaaagagcaagactctgtctcaaaaaaaaaaaaaaaaaaaaaggaaagaaaatacagtagtctccccgctccccccacaaccacttatcagcagttttgctttctatggtttgttgcccacagtcaactgcagtctgaaaatgttaaatggaaaattccagaaataaacaattcataagtttaaaattgcatgctgttttgagtagtgtgatgaaatctcacacagtcctgcttcgtcttacttgggatgcaaatcatccctttgtccagtgtatccacactgtgtatggtacctgcctgttagtcacttagtagccatctcatttatcagattgactgtcatgatattgtagtgctgtgttcagttaacccttattttatatagtaatggccccaaggaggaggagcagtgacgctggaatattgttataattgttctttttttaaaattagttattattgtcgatctcttactgtgtcttataaattaaacttttttataggcatgtatgtgtaggaaaaaaacatagtatatatatagggttcagtactatccctggattcaggcatccactggggctcttggaacttatgccccatggataaggggagactactgtatctttatttctcccttattcttgaatgatagttttgctggatatatagaattctggacagttatgtttccctcagtatgttaaagatactatttcactatctgtctgctatcatagccattgagaattcagttgacataattgcctttattttataggtgacattttctctccagttgtttttttaggtctcctttttgttgtttgttctgtagtttcaccaaaatgtttgtaggtatatggatctctattctgctttgagtttttggacttcttgggagtgacatttgttgttgtctaacagttctaaaaagccattaccttctcaaatattgtttcttttctgtatttctattagttttcttctggaactacaattagatgtatgtaatattgtttgaggctgagccaagtagtgtactgtgattaagtttactttctggtacaactttttgtgtctcctaaatgtaatgtctcatttagcctcatttttttcatttgcttcagtttttatgtagctattgttatttctttccatcattaacacgttctcagtacagtttttcacatagggtcaaacctgttaatctgttcagtgtgaccattttccttgaggatttcctcccatgctagtgtttagaattggctgcttgctataccaggtgtgcagctatcatcctgtgttctcccttcagcatcattttggaaattcctattgcttgtctcctgtgttgattcccttgttttgtggatctcattcatttacaacacaccttccactagcttgctggaaaaaaaaaaaagtacaaaggagataaattttgagaccttgaatgtttgagaatgtctttattctaccttttttgaaaaaaaaattgataatttgtctaggtcttaagttctaatatgaaataattttttttctcagaatttggaaagaatttctccattgccttttagtttatcactgagattattgctaaccccaatgccattctggtttctgttacgttgtcatcaatctgtttattttttcttttctagaatccttggaatttttttttatttgtccttgctattctgcagttcaataataacatgttgggataccaaatgggtcttacttagtttagagactcttcaagtctggaaaacttcttgtgttattctctggcaacgtcttcctatcttatttattaatttttttctttttttcacatgttggaattgattactcatgtaatgttttacatttttttctttcatggtctttcttttgttctttttttgtagaaaatatcttgactttatcttccaactctttaatgttttctttctttctttcttttttcttgagacagggtctggctctgtcgcccaggctggagtgcaatggcacgatctcagcactctgcaacctccacctcccgggttcaagtgattctcctgcctcagcctcctgagtagctaggattacaggtgcctactaccacacctggctaatttttgtatttttagtggagacaaagtttcactatgttggccaggctggtctcgaactcctgacctcaggtgatccacccgcctgggcttctcaaagtgctgagattataggtgtgagccactgcacctggcctgctctctctattttaaaaatagcattctttagtttttttttttttttgagtcagcgtctcgctctgttgcccaggctggagtgcagtggtgcaatctcggctcactgcaagctccgcctcccaggttcacgcaattcttctgcctcagcctcctgagtagctgggactacaggctaattttttttttttttgtatttttagtagagacggggtttcaccgtgttagccaggatggtctcaatctcctgatgtcgtgatatgcccaccttggcctcccaaagtgctgggatcagaggcagcattctttaaatttttaagtattttttaagatactaataatttaccgtattttgaagttttcttctcattcttcattatcttttttctcaaaattaattgtgtgtacttggttctttttctttcatgttaataaggtttccttatacctggtgattctgagctgttttcactttaaatatctaagttttgtttgtttgttttttgagacagtctcattctctcgcccaagctagagtgcggtggcatgatctcagctcactgcaacctccacttcccaggttcaagaaattcttgtgcctcagcctctcaagtagctgggattacaggcatgtgccaccatgcgtggctaaattttgtatttttagtagagatgaggtttcaccatattggccaggctggtctgaaactcctgtcctcaagtgatcggcctgcctcggcctctcaaagtgctgggattacagcatgagtcattgcgcctggcctactcttagatcttaaatgttttacacagacacacacacacacacacacacacacacacacacacacggtaactgtgatgatggatgtgtcagttgatcgtggtaatcatttcagaatgtatacatctattaaattatcatgtagaccttaaattattatttttgtcaattatacctcaagctggaaaaaaatgcagatctactcttaaatgtgagataattggaagctcatgtgcatgggctagggtaagttggtggagaactaactttattgttggaggctttctaaatgtatgtcttttctttgaacattagtttgttccagaaaatattgcgtggttggttgcctgggaagatgtatgtctgattttcggacttggaagcaagataaaggaaagaggctgctggtttatggtatagagattttcactcgttaagaaagtaacaaagtaaggaagtaggattattgtagaaatattattttacagttcaagtttgtaaaacacaggtgaaggtaatcgttggtgggtctcttcctctgagatcaccaaattatctgtagactggttggtagacttggagagaccacttgttcttggacaacagttagaagcatactgccctaagcagtaaaaaggtgattgttgagggcagcaagaggcggtgtaacataccagttcatttttcttttcttagcaagcatgtactaattgccttttaaaactcctgaccataggggataaaacgattacaagaaagataccttccctgctcccatggaatttacattctagcacaacagtggatattaaacaacgtatcatctggttatgtaattacagtaataagaatcatgtaggagaggtcaaggaagcttactgctgtggggttcaggatggcatctccgaaagtatgaataaggaaagtggtgggagaataaaaggagagtggcagagactcagactgagagattaattgagataatgacaattgtgggattcaatgaggtgtataatgtgtttagtgcctggtacttgtgctcagtaagtgctaattagtagttgtttatagcaatactgttatcttggatgatcaaatagaagatccctagcaagtaattttataaagacaaaaatttcgtgtcaactctgtaataaaacaatatatccttagaatcagttatcacttaaaatccttattttatagaaatttttgtgtttcaaaagtatagctagggcaagtcccccttcagggtggatacttaaaggagatgaaatcacttcataaaggtgtctgcactcccatgttcattgcagtgttatttacaaggtagccaagatatggaaacaacctaaatgtctgttgatggcaaattgataaagaaaatgtgtgtgtatgtgtgtgtttatacaatggaacgttattcagcctttaaaaagaaggatattctgtcatttgccacaacttggttggaccttatgctaagtgaaatagaccacgcacaaaaagaaaaatactatataatctcacttatatgtggaatgtttttaaaaagtcaagtatacggagacagagaataaaacagtggttaccttgggcaggaggaggaaggaaatggggttatatagataataaaatagcagatatatagaatgaagaagtctggagagcttatgtataacatgaagactatagttaataaaacaaaactgtattaaggatttttattaagtaatttagctgcttgtaacacttacacacacacacatagtaactatgatagatgttttcactgtagtaaccattttgctgtctatacacatcccaagatatcagcttataaatctcatatacacagatttttttttttaaaggtattgttggggcagggatcaggcttaactttgtggttgtatctgtagtacccagcacagtgcctgacacatagaaggtgttaatcttgttttttttttttttaggtatctgaaatacttaccagaaattctattctttcagatgagagacatctatgtgattttaggtattaataaaagaaatattcttccttttttcttactacggtgttggtagtggtgctctttcttcagggacatcattgatggccttttagttagaatttaaatgttatcctttctgtagccagcagggatctgttgggataaagtcttatttttcttttcttgggagtaattggtgctttctaacttttcagcacttagactcacaatgtattagttatctattgctgcaaaacacattacttcaaaacttagcagtttaaaacaacagacatttattatcccacagtttctatgggtcaggaagataggggtaccttagctggatgcctctggagcacggtctcttgaggttgcagtcaagctgttggctggggctatatcatctgaaagctttactggggcaggggatgatgtacttccaagttcactcccatgattgttgggaggaggacttaattccgtttcttgtgggcttcttcctggtttatgtttgttacctggtgtctagagctgatgtattgggtacttcccctctagcatggttattttctttgttttttctctcatttaggtgaaaacttaggtgaattttaatgtaaaccctacccccattatggtctaaggggccttttagaaaatgagtagaatgtacacagaggcaaaaattttagcctgtgaccttttgaagaattttctaagtgaaactagaaacaaattaaccattgttcacagagtgctttgcttaatgttatgccttcttttgctaaatcctcttgtttgttgaaatcttacatcttaagttgctgatagtttgttaatagagatcataattaaaaggtgattatatttcttcatgcagtttagctttacatttcttccattatacccaaagatttctataatatagcaagaaatgtttttaaaaagtgtttttcctcaattgtgtgaaagtaatgtatctaactgaaaagaagagaaactcataaaagtaaaaattttaaaaaatcaccttattcttacctctcaaatacaatgacctcatattttaaattttgctcaaggttttttcctcctcattctaggcataattattttcttatatgtgtttcagtattactttttttgtgaaaaatatggttacaaatgtggtctaatttcattttgcactttaaaaattattaatgaggccggaaatgaggccgggcactgtggctcatgcctgtaatcccagcactttgggaggccaaggtgggcagatcacgaggtcaggagttcgagaccatcctgggtaacacagtgaaaccctgtctctactaaaaatacaaaaaattaaccgggtgtggtggcaggcgcctgtagtcccagctactcgggaggctgaggcaggagaatggcatgaacccgggaggcggagcttgcagtgaaccgagatcgcgccactgtactccagcctgggcgatagagcgagactctgtctcaaaaaaaaaaaaaaattattaatgagatggtcatatttttatgttatttactgatcacttacctttgaattgccccttgtttcttgaagtttttccaataaatattcttattaataggcaagacaacctgatctgttagttatgtaaactttttggtagctaattgtatgtgcattcttttacctcccgtttgtttctttattagcagtgtctttttgttatagaatttatacattttcttgtaagcaaatatcagtgtttttattataggtgctgtatgtttgtcttgcttaggaaaatctttattactccaatattattaaattattctttagtatttgtcctaatagctttatggctttgttttttttaaatcacacacacacactcacacacacacacggacacacacactctttgagacgggtcttgttctatcacccaagctggagtgctgtggcgcaattatggctcactgcagcctcaacctcctgggctcaagatatcctcccacctcagcctcccaagtagctgggactacaggtgcataccaccacccccagctaatttttaaatgttttttttgtagaaacagggtctcactttgttgcccaggctggtctgaaactcctgggctcaagtggtcatccttcctcagcctccccaaagtgctggttttacaggcatgagccaccacacctggcagcacccatatattttaaaatttagtatgaattagtcttttctttttgatgtggcataattgtattgactaatccattctttaccattgatttgaaataccacctttattatattaaatttgtgtgtgaatatgaatatcttttctgtgattgcaattaatttgtacttgtacagattgtgctgtaagagcttaacagtatatttcagtacttggtcatgtctcttgttcttgtttttcttttcttttcttttttttgttttgttttttgagacagagactcgctctgttgcccaggctggagtgcagtggcgcagtctcggctcactgcaagctctgcctcctgggttcatgccattctcccgcctcagcctcccaagtagctgggactacaggcgcctgccacgacgcccagctaatttttgttgtatttttagtagagacagggtttcaccgtattagtcaggatgatcttgatctcctgacctcgtgatccgcccgcctcggcctcccaaagtgctgggattacaggcttgagccactgcgcctggccttgttcttgtttttcaaaaatttctttggtattctcacaagtttattcttccaaattaacttcagaatcagcttaccattttaaataagcaccccccttctaaatctattataacatctcactactttctcttctattcatattagcttaacttaagctaccatcctctcttgagtaagactgttttctaacatacagcaacaagagggttctttttaaaacataaatcagattatgtcattcctttgcttaaattcgttcagtgcctttttcccctgtcttttggttatctattgctgtataataagctactccaaagccttgtagcctaaaaacaaccattttattgtgctcacaatttttgggggtcaggaattcatgacaggttcagctgggcagttcttctgttccatattgtgttgctgacactggagaatcccttccattatggcttcttcagtcacatgtctggctcctcagtgtttcttggcctctctctccacaatggcgtcccattcttcagaatctctgcatgtggcctcggcttctcacagcatgctgatctcagagtagtcccattttttacatgacaactggcttctaggaagagggaaataaaaactgtcagaccaattaaggactatggcctggaactacacagtgtgcctttaagccgtattttattggtcagaatagtcactggacctgctagatgaaaggaggtagaaaaataaatttcttttcctaatgagggagtggcaaaatcttattgcgggaaagcatgtgggatgagagatacttgacagttggaaaatataatccgtgacatcgtcaaattcaaaataaattcagagttcttaaaatggcctataaggcttttcatgatctgactcctgcttcttgaatctctgaccgcatcccctagattttcctcttcgttccctttgggttaaccacattggccctcttgctaggctttgaacatgccacacccaacatcagatccattttacttgcaactactgccgtgaatgctcttctttagatctttgcatgggtcttcccgttctcattcattcattcattttgagacagggtctcactctgttgcccagactggagtgcagtggcacgatctgggctcaatgcaacctccgcctcccgggttcaagcaattctcccacctcagcctcctgagtagctgggactgcacgcatgtaccaccatgcctggctaatttttgtatttttgggtttcacgaggtttccccatttggccaggctggtctcaaattcctgacctcatgtgatccgcccgcctcagcctcccaaagtgctgggattagaggtgtgaaccactaatcccatggctggtcttcccatttttttacttcatttaggtctctgctcaaatgtcacatcttcagagagcttcccctgaacaccttatctgataaattcttggttacttagaactccttaatcttgatttttttttccttttcatagaatttggtgctgttagtaggagcctggggggcctaagtaccacttttcttccttccctgcctggcttctgagcaagttgagaaatgagtaaaggtggaggccaaaatatattttaaaaattcttctgactaaagggagatgaagtaaagggaacaaaagaagtatcatgaagattctcagatgtccgacatgggaaactgggtagattgtggtactatttaccaagacaggaaacatggtaggaagattatgaattaagctttggaaatgttgagtttgaagtgcctacaagttatccatgtggagaaaccaaatggacatttggataacacatctgaagctcaggagagaagtttccattacagattcaggtttggtagttgttctagttttctattgctgtgtaacaaactaccacaaacagtagcctaaaacacacaaaattactatcttacaatttctgtgggtcggagtcaaggcattgcttagctgtgttctctgctcaggttctcatcagcctgaaatcaaggttttggttggggcctcagtcttatctgaggcttggggttctcttccaggctcattggttgttggcagacggttcaggaatctggggagacaagatttttgggagcgccaacccagatgtttccattccatgtgtcagagtcttgttctttcctagccaggcccctgatctggacgtaggagacctgctgcctttgggagttcaacctttgaagcccaacacatacagatttagatatctaatctgtctgtccatccatccatccatccatccatccatccatccatccatccatccatccaatctgtatatctctgagatatataagtgtaataaatgggcgataatcaagtgctggttttggtccttaggtttctctgccctcctgctgcaggagaggagaatctctgtgttttcagagaggttctctggctttcaaacttagttttcaattggaagttaatcagcttttttgtttttatcttttttctttgaaatcaacatctgggagtgaggagcactgggcaaatgcagtgcaggcccagcaccagctttggccaacccccacggggagcctggagcgagaatgggagcctgggacaagaatggctcttctgagttgcccagaattgcggtggctgatgtgtccaggccttcatattgccatatcaattagtcatttgatgtgggttatcttgggaaggatatgaccttgaacagggttgttccttgtaggtgaggcaatccctgaaggggctgactgacagcactcccagcatttaaggtaagtccttttttgaaggaggaactgggtagcacctcagtgtctaccacgatttctctgtatccaccaaatggccaatttgtttttgttttttattatcattattcattcatggatttaaacatatatttagcaaactttctgttaaattatgtgtatagaaaagggcacaaattgtaaatatacagctcagttaaatgttcacaaagtaaacacaccagtgtaaccagtatccagatcaagaaataaaacaatactgtgaatctaggagtcctcctcgtgtttcctttcagtcactgttttccagggatctatcctgacttctaaaatcatgggttgaatttagcatggttttgaaatttatgtaacatcatacaatatgtcttgttctgacttctgtctgtcagtattgtatttgtgaaattaagctcacaattgtaagtcattctcttgctgtatattttttcatggtatgactataccagtttttaaaaaccatttctgctattaacatttggattgttccagttgttgggaattataaaacatgctgctgtaaaacattgttgtgcatgtcttttggtgaacatatatacatttctgttgggtatatatctagtgaaattgctgaatgtgtgtgtgtgtgttcagttttagcagataatgccagtttccaaggtaagtactgagttacatgcctactagtagctcctaagatttccagttgctgtaatttgctcctgtttgtagaagacacagccttcgagggcttatcactgagaactgtatttactaaggtctccactagcagattctgaactcttttgtcctctcgaagctgcaaggctttcaaattctgctttgcttttcagaagtttttagtttagcctttttaccctcttccactcactgaggcatttgagattccctcacgtcttcagttttgccaatctagccctcagtgaacaccagaatctctgatggtttcttcttccattagaggtacattgcctgggaaaaaagccttatttctcaatctgttttcctgaccagaatctgcaaatgccccaggggaaaagcagctgcagaagatccccttacctcattatagctcactctttttggaatcttagtgttgctaatccctattccttcagtagctctctgaattcttcaaacaggtgatttttatatttcatcttttgttagaaattaagtttgtggtgggagctattgttttgcagtaaattattctatcctacatggaaacagtagtatggatttaaatatatttaatatgtttcaataaattgccatccttaagtgttcaaattattacacttttggccagtgggggcctctttaaaattcattcctaaccatttttggcttgaccgttattagtcagtgctgctatctggtatgacaagatgttccggggtcattatgtcttttttttttttttttcctccagacatagaagcagccatttcctaaaggagtccagattccttttactgggaaatggtcgttcaagattacaactgagtgaggattactatgggattggtcattagtcattactatgggattggtcattgtttctaggcattttcattggacagaaatagaaatatgttttttaaagtacaaaataaaatatcttgacttcatatagatacttctatttcaaattcaagactacatttctttactttaccattacttttatttcccatgctgaaagtcttgggtttttagaggcactaggagtcatagaattaaaataccacagaattatttagttcctctctttataccattaaataattagatacatttataccattaaagaattagatacagttttcagttgatttgtttatttttgatttctagacttcttaaaattttaattttatgtttatgtaagttacgtagttctaaaatgaaatctacaaaaacaatatgtattccatatagaatatggattctatccttttcacttctactttcttttcatttcctaaaggcaaccactaatttttttgagcatttcattcttctactgttttgttttgtttcttaatataagaaacatatatttctatctcctccctcttcttagatgaatggaacatactgtgtatattttctccatcttgttttttttttaacttaagatgtgtcctggagattattctatcatttaatgaatttggattcattttttggttttacgttacattttatacatgtcttttatttaagtgtcactgtgttcatgttatttgctctttcagcatatataaatatatacacttatatacatgtacacacacacacatacacacacacacacacacacacattttttgagacagagtcttgctctgttgcccaggctggagtgcagtggggcttagctcactgcagcctctgccccctgggttgaagcaattatcatgcctcagcctcccaagtagctgggattataggcacgcgccaccatggtcaactaatttttttgtattttagtagagatggagtttcagcatgttggccaggctggtctcgattgcctgccttggcctcagcatatatttttgtatttagaaagatttattcagaccagcgttcatactgtgtaatgataaggaatttattgtagaaattagattgtatacagttttgaggggactaagtgaggtgagtatctggaatggggaattggaggatcagaggagtccactaaccagatcgtccaaatcaatgacaatgggtagataagttggagctgttggggaaatctgagaagtcaaatatatccagccactgaagtgagattatgaaggaggagcttgaggagggcactgtgggaagctcttgccatgtaaggtttgtcttacaaagccctgtaggtttgcacccaagcatctggtggtaggtttgggctagtattggtcagcaaagtgaccactggtccaaagaaagagctggacatggagtgaaagagagagagagtaaaagctggaactttctgggtgcctctgtatctgtctctcattgtatgttactgtgaaaccttcagaataatagctgctgcttcgcttccacatttcaaacaaattttatacaggtcgagtatcccgtatctgaaatgcttgggaccagaagtgttttggatttcacatatttttgggttctagaatatttgccttttactcaccgtgatcatccctaatctgaaatgagcatttcctttgagagtcatgttgttgatcaacaagtttggattttagagtgttgtaggtttcagatttttcaattagggatagacagcctgtacaaattaccctttagaccaactctaaccagaaccatatagtgagtgggatctgggaaagtagttcccagcttaacagttaacacaccacgcaccaccagtacaatttgtgtttttgttctggtggttaccattatattaatacctttatatggtattctaatttccttctcttttggggtggaggggtattatgtgttggttttttactctgagcaatattgaaatgaactagaaacctcctttcctcatctcctttttccctagcattttactctcagttaataacaagacaatcaagaaacatattctactatttatatgctctcaccaccctccctctcctcattttgataattgtattgtatctatattatcaagtacataaagcagtcacctaatatactttctcccttattgccaccattctcagttcttttagaaaacacagtgatgctccggctgggcacggtggctcacgcctgtaatcccagcactttgggaggccgaggtgggtggattacctgaggtcaggagttcaagaccagcctgaccaacatggtgaaaccccgtctctactaaaaatacaaaaaaattagccaggcaatggtggtgcatgcctttaatcccagctactagggaggctgaggcaggggaatcgcttcaaccttggaagcagaggttatggtgagctgagattacgccactgcactccagcctgggtgacagagcaaggctctgtctcaaaaaaaaaataaataaataaataaaaatacagtgatgctccacataatgacattttggtcagtgatggactgcatatgtaatgggagtccctcagtattataatatggtatcattaccttttctatgtttagatacacaaacaccatgtgttcaagttgccaagagtattcagtacaataacatgctgtacagttttgtaccctgtataccatatagcctagaggtgtggcaggctatactatctaggattgtataagtacactctgtgatgttcacatgacagtggaatcatgtaaggacacatttctcagaacataccccatcactaaatatatttaatgattcctattaatgtggatgtctttccaattattctggtcatctgaagcatattctctagtatatcctccaggaaaaggaaaagggaacaaaatttccagggttcttgccgtttagcacagtttgtcattgctataaaattgtctctcagtatctgggacattggttccaggaacctccatggacggtgaaatctgtagatgctcaagtccctgatatgaaatggtgtggtatttgcatatagcctacacacatcctcctgtgtactttaaatcatcccttgattactgataatacttaatacaatgtaatactatataaatagttgttatacactattatttagggaataatgacgaaaagtctgtacctgttcagtacagacatactaaaatttattttttgatctgcagtttgttgaatgcatagatggagaactcatggattcagagggctgactgtatttgaattcagtttggctagatataaaatccttggtttatgttttcttctttttttaattatactttaagttctagggtacatgtgcacaatgtgcaggtttgttacatatgtatacatgtgccatgttggtgtgctgcacccattaactcgtcatttacattaggtatatctcctaatgctattcctcccccctccccctaccccacgacaggccccggtgtgtgatgttccccttcctgtgtggtttatgttttctttaaatatcttaaatttattttactttattgttttctgacataaaattttgtcaaagtctgatgagagtctaatttttgggttttttttgtataaataatgtcctctttctgcctgtaagttcaaaagattttttttttcttgttcacggaagttcaaaatatgttaaggtattggtcattctgggtcacttttccaggtgtgtggtatgcacattaaagatacagtttcaagtttttaaaaatttcaataataatttcagcaaagttttcttgaattctagtttctaatatccactttattccattggtttggtttctttctttggtgactcctgttatatgtatgttgaatcttctttttctatctttttttgtcactttattgtaaatttttattatctcgtatgtaatttcttttttatattacaactttcctccttagtccccccttttttttcaacatttgtttactcttaaagcattatcttctgtgttaatttactcttatgtatcttctggttagttttcatttctgaaatgatttatcttctaattctttcttgagttctgtcaacttatttctatctgtaattcttatttgtgttattccacatcttttgtcattttcttaatttctcttggctcactttgaaataataatttacagttttcatctgttggtggatatgtctttttggaaactttgattttctgttgtttagacccttatttttatgtttttctgtttcttactcctttttcttaataataactttacatattatttgaccatagaacttttctgttggcttatttttatgtgaaattaatttttctgaattggtaggagggatttgtaggccaggatagctttgtagctttatgtctctagagcttattctttttttactttcatgaaataaaaaaaaaatggtctcattctttcagagatctcttgttcatctctctctttttcatttttatttggacctttttccttttctccctttacccctgttttcagtttggagttcattctcagcagtttcttctcagtgtgggctagaactgtgctgtccagtcagatctaataattacatgtgtggctacttaaagctaaatttaaataaactttatttaataataacttaaataaactttaaacttttgatttcttgtctataccagctatgttacaagtggttaatagctacatgtgacgactagtggctgttgtattgggcattgcccatgtagagcactatcattaccacagcaaatcctattagacagtgatgcttttgagtgtgctccattctcttgagacttttatcataggcctttttcattcatctgcaaattgcaatgagcataactaccctctgttttggctaatattcctaaattgggctgctgtgctttttattaaggatgcagtacattgggaatctcctcttgtcagatccattagacattctccttccacctgctttctcttgcatagatgcttataccacattagtatttttgttttttgttttccagacacaggatctcgctctgttgcccaggctggagtgcagtggctagatcacagcaactttctgggctcaagcagtcctcctgcctcagcctcttgagtagctggattacaggcacacactaccaagcctagattttttttttttttttttaaagtaaagatgaggtctcactctgttgcccaggctggtcttgaactcctggactcaagcagtcctcctgcctcagcctctcaaagtgctgggattacaggcatgagccattgcgcatgtccccaaccagttttgtaactataaatggtttgtttctatttgttcacttctctgggtttgggaatgagggaccttgtcccttcattttcatgtagatattcatcagtttgtgtttttactagagaagttctagtttctttgattttttttttttttttttttttttttgagacagagtctctgttgcctaggctggagtgcagtggtgcgatctcagctcactgcagcctccacctgctgttcaagccattctcgtgcctcagcctccctagtagctgggattacaggcatgtgccaccacgctcggctaactttttgtatttttagtagagacagggtttcaccatgttggccaggctggtcttgaacttttgacctcaagtgatccacctgccttggtctcccaaagttctgggattacaaatgtgagccaccgcacctggccatttctctgatttttatgggatacttagggagattcaccagctgcattttatgaaaccctagttcaagaaacatactggaaaaggagatatggtcacaaagaataggagatgtttctaagggaaataataaattaaaatgaaagttacagtgacttgtgctcactgaatctaaaacccagctgattaaaaatttggcaaaataaaattaaaaaggttatctgtgctcgtaaacaaaagtcccatttttggcctttcaggtttttttcctccataatctttataattaacattacgaagttctgtagtttctgttctgccccctcctttacactctaaaaatgctgccccaccccgccaatttcatttagtatttccttttttttttttttttttttttatttgagatggagtctcgcccgatcgccaggctggagtgcagtggcgtaatctcggctcactgcaatctctgcctcctgggttcatgccattctcctgcctcagcctcccgagtagcttggattacaggcacgtggcactacacccagctaatttttgtatttttagtagagtctgggttcaccatgttggccaggttggtctcaatctcctgacctcgtggtctgcctgacttggcctccgaaagtgctgggatgagccaccgtgcccagcctatttagtatttctttactatcaaaataatcgtccattattaactgatttagcaaacttgggcatgcccctcggtctctttccacctttagttgtactatgttaaaaatgagaaagttatattcaggtttgtttttttcacagaggaacattgctaggtttctctgttagcattagcagggtttaatattaacagtaagtatgtccatgatgctttaaatacagaatgctatttttgagcagagtagagatgaacttctagacagtggaacttaactcattcacagagaaatgtaaatgtggtcttctcatagaatattttttctcatgggatttgtctgcttgtgttctgttatcccttcaattgtgtagctgagggtgcttatcttactgagtgagtcttactgttttttccccaggttttatagtttgttcttgcttctgaacaatcagcagttgtttgccattattgacaagaagtctagggcatagattttcttgatctgtttttcttttaatgtttgagttcaatggataagggaaacggttgtatgcattttattgcagacattctctgaaataatttttagccacaagcaaatagctctgtttctgtgagtcatcatttcttcttatatagtgctggataaagaattctattttgtagatagagatttatgacttccagaaagaaagctgcaaaaatggaagtttccaaagaatttaagatttgctataataaatgctatcatatattggtgtttgagatgcaaatgtacatatctgtgtatcatatattggaggttgattgaaaatcggagtttgagatgcaagtataggtatctgtggttgatgcagttttcctaaaacgtcatgattttcaatggcaagtaagttatttatggtcgtttttaaggataagctgttaacgtgttttttttttctttttttttcagcttccaataaaaacaggacagcagaacacacataccaaagtcagtactgagcacaacaaggaatgtctaatcaatatttccaaatacaagttttctttggttataagcggcctcactactattttaaagaatgttaacaatatggtgagtatttgggttactgtgttttggggaatttgctttcttttctttttgattaaaaagtttagaacagcatattttgaagtatggaaagtgattttctgtggactttggatataaccattaatcttattttgtttacgagcacagataaccttttaattttattttgtcaaatttttaatcagctgggttttagattcagtgagcacaagtaactgtaactttcattttaatttattatttcccttagaaacatctcctatcttttgtgaccatgtctccttttccagtatgtttcttgaattaggatttcatagagcttttgtggcctacacgaattgaccacagtaatccattacacatatttttctttagcatcttgtttgaatttacttacggttgtcccagccctaagtagatgataaaatatgatctcatagtcctaaaatgtggattgatttttttatgaagatatgtgttttttcttccttctgtaacctgtgacagattctgtagtagttaccctgttgttgaaacagtttttctcaaataccagtttcatcaaataattccactgttaaaagctcataatttctttcttcttcccattttctaaaatcgattgacgtttcctagacttcagagtactccagctgtcctccctctgtacctttgaacatataacatcttttgtctttctcaagtgatcccttcctctctctaaattcctatttaacatctccattctaagctgtttcaaactaacatactcagttcatggcaactgatctggatttttcttgattaactctgaactctctgctggtgtttagcatttatttatttatttatgaatgaataaatgaatgaatgaatgaatgacagggtctcattctgtcacccaggctggagtgcagtggcgcaatctcggcttactgtaacctcccccttcccagttcaagtgattttgctgcctcaggctccccagtagctggaattacaggcatgtgccaccatgctcggctaatttttttgtatttttagtagagacgaggtttcactattttggccaggctggtctcaaactcctgacattaggtgatccgcctgcctcggcctcccaaagtgctgagattacaggtgtgagccaccgcgcccagcctgcatttataatcccagtttgtatttgtttgtattgagttgtgaaacaacttctggttatagattgtgaagattgttcccccttccttttttttgagatggtccttaggtttattagataatattctagtatgacattgaaaagacatgaagttacctttttgccttattcccatattttagataatttttctcttgttctattttatttttaactggcatacaataattgtacatgtttatgggtacatattgatgtttcaatacatataatacatagtgatcccactagggtaattagcatatccatcatctcaatatttatcatttctttgtgttgggaatattgaatattctcttgttatttgaaactatataatgttaactgtaggccaggcatggtggctcacgcctgtaatcccagcactttgggaggccaagacgggcggatcacgaggtcaggagatcaagaccatcctgtctaacatggtgaaaccccgtctctactaaaaaaaaaaaaaaaaaaaacttagcggggtgtggcggcatgtgcctgtagtcccagctactcaggaggctgagacaggagaatggcgtgaacccgggaggcggagcttgtagtgagccaggatgcgccactgcactccagcctgggtgacagagtgagactccgtctcaaaaaaaaaaagttaactatataatgttaacatagtcattctacagtagtacagaacactaagtcttattcttcctataaagctatatttctgtatcctttaacaaatctctacccaccccgattctccctacccgacccttcttacctctagtgtcctctcttctactttttactctttttagcttccacatatgagtgagagcatgtggtgtttaactttttgttcgcatcatccttggtgtgtttccttttaagaaagttgcttacacaataccctaaacttacaaaactaataaactggaggtgtagaaaatcatttaccttctttatggaaaaaattagtattttccccccaaaagcaggaccatttataaataggtaaagagatttacggaaagacatttaacattttttgtagctcctctgttgcagtgtgtggggcacagtttagtatttgcacatatgaatatgtggctgtgttcccagttatattgaaatattttaatatttgggaccctcttttcaaaacaaaacagcattgttatattggcgttcatttagtgcttattaaataagttttcaaaaccatagtctcttgttaataaatacatatgtagtattcattttgaggatagtgagtacttaaaattcactgtggtgctatagcatgtttttgctataaaaattaagactttgatcatttcgtggcataaaagtatagttaaatccccaattcaagattctggtacaggtctatatgtgtgtctaaatcctacatatttttaaagcatgaagcaaaacagcatcttttactgttacaaggttaatggcagactctaataaatgccatttctgtttgccttagactttagtttttatgaggattaggataaaatcagaaataatatatttaagtatagtataatctgggaggtaaaatggaagactattgttgatcttttagtctttcacttttcagatgtgtgttgattggtagcagaaagtgaaactaacttttatgttctgaatatcttttctgttagagaatatttggagaagctgctgaaaaaaatttatatctctctcagttgattatattggatacactggaaaaatgtcttgctggggtaagtaaattgatcttaagtaggcaggctttgtgaatttgatcttgagaatgatcttatgtcccaaagtacagatgtggaccaagaggacagtcctatggacttttgtctgagacatataaatatgagttttgttaatatagctgacctggtgacagacaatttttcatgagaaaattttctcatcttttgtaaattaaacagatattaagtttacttataaaatgttatgtttcagccacgtatctgtctctcaggtttttaggaaaatattttatgaagagatcactatttgatttaacggatctctcagagagttgtgggagagtgcgattcagaagtccaagagtaatcttgtatttcctcctatatgaatatgattttaatattctacttttgaaatttatgtaaatgagaacttaaaaattaaacctattaaggatagatgttaccttgagaacacttgttttatgtagacacacaaatatgcgataggtatgtggaggaggagagtaccaaacaattatttctctggtttcctgtaagttgttaccacagtgtatttcaaccatgacttaatttgaactttttcaagagtatttctattgtgtaaagaaagtatttctatacatcattatccttaattcttcctggaacatggtaagagtttatataaatatataaattaaatacctctgttttaatgatctgcctaatccatgtgtattgaaattaactcatttcttatgttctctcttcctttggctcagaattcagaattttgttttgattcagaattgcttccctcttcacatatgttgcagttctctatagtgaaactagttgaaagagaccttaatatatgaggactgatagtgtggttgagaagtgttggtggaagcattggggtagggcattgaaaaaaaaattatattgacacaactgtgtatccctagggaaggctgtaagcgaaaaaatgtaagcataatatgtatatatatttttcttttgagacagagtctcactctgcggcacaggctgaagtgcagtggcaccctctcggctcattgcaacctccacttcccgggttcaagctattctcatgcctcagcctcccaagtagctgggattacaggcatgtaccaccatgctcagctattttttttgtattttcataagccatgggggttcactatgttggtcaggctagttttgaactcctatcctcaagtgatccgcccattttagcctcccaaactcctgggattacagatgtgaaccactgtgcctgccctaagcataatattttaaattttcttattgaccgttgaccatattccaaaattgtggagacagtgtttataagttttctacttaaaatcgaaggtgagctagttgttttagcatggtattttccgttaacttgtgatatgctattgttcatgtgtaaaatggagtgaaagagcaaaagagctgttacataggatgatggaactgggaagatgggcaaattttaaacttttcttgaatcagttttttccagtggtcttattactttgactgcaaattaccagtatatcagccacacccatgactgaatggtggggcgtggggtcatatattgccttgttcagtttcacagcttttctccattaacatttgtaattgagaggtaataatgaatgtattttggagaatgattaccgatattattggcctctgtttgatttaatactctttgaagatagcctaattgaaatgctaataagtgggcctagtataacttatgtaatgcataaaatgtatattatcttgccgtgctctactgttgaaaaatgtgtatgctttttcattaaatttactatttaaaaagtaatgctatttatattattgaacaattgttttatttccttcagtgattttacagatgtttcttgattcttacttttaaatcaaagtaaattgaggcagtttaagaagaacggagctcacaagtatacgtttgttatacatagttggaatatttaagtgaaagaaaaatacttaccaatatgttatgagtgcaattttgtagaatttgaggaatcttaagtatttttgttcctgtgaatatgactattatttaaaagatttaatacttcttagatttttatttgttagagttaacatctgtattgtttggttagcctataaacaagaaataggcattgtaatgtgaattcacaggtttttgtgaagtctgtttatgtactgtccctatgtttcagtgtatttgcatctgagagtgcttggattgcagttacagaattgagcgtagcatacaattgtacacatttttgttctttgccatcttgctcagtgttattaaaattcttatccgcatgtagttatcaagactgttaggtgaaatagtaatgtggaacagcatacctacaggatagcttatccattgattgtgtgttaattgtaaagtatatatttacaaagtagagatttcactgttaacaccgaagttatcaaacttggtgtcaataacaggaccacctggccttatgttctcatggtgtgatgtaatataacctatagtgaatcccctaaactgtttaacctcaatctaatcagaccattaggtttaaattttagcttacagaaaatatacaggccgggcaccatggctcacgcctggaatcccagcactttgggagatcgagacaggcggagagcttgaggtcaggaatccaagaccagcctggccaacatggcaaaaccccatatctgctaaaaatacaaaaattagccagatgtggtggcacatgtctgtagtcccagctacttgggaggctgaggcaggagaaccacttgaaaccaggaggcagaggttggagtgagccaagattgcgccactgcactccagcctgggccacagagcgagactccatctcaaaaaaaaaaaaaaaaaaaaaagaacgaaaatatacaatacagtaactagaagagcaaatcaacctatgtcactggaaaataattaaatcaaggatatggaacattctgtaaggcagctggcccacttaaagtcatgggaaataagagtggtgaatatgggccaggcgtagtggctcacgcctgtaatcccagcactttgggaggccgaggagggcggatcacttgaggtcaggagttcgagaccagcctagccaacatggcaaaaccccgtctctactaaaaatacaaaaattagctgggcatggtggcgggcgcctgtaatcccagctattagggaggctgaggcaggagaattgctttaaccctggaggtggaagttgcagtgagctgagattgcgcccttgcatagaatagtgaaactaaggaaacatcatgttgtaatcggtgaacttttttggatccttattgaataaaaatgcctatgaaagacattttgggggcagtggtgaaatttgaattcagacttggtattagatgatacaagggaattgtttatttttccttggtgtgttaattgtattgaagttacattagagaaaattcttttaagagatgccaaggcacatggggtgaagtattctatttataatttactttgaaaagatttcaaccaaaataaaattactttgagtaggtagtgtctgttttggtcagtctgcacaaaagcaagtgtgatggctcacccaggaatttacttaaatgtcaagacagatgacacaatgcactcatcaatcaatatgaattaagtcgattctgtaattgtagaactcacagcaaactggggattcccagggaagggctcgtttggtgaacaagagagcaagcaggaatgggaggactggtaaggatggcagggggattgaactttaattgtgattatggggtcagagatggaaccatcctctttattaaactatctatagacagatgtagcaaatatgatgaaacgttaacagttgttaaatctaggtggtgtgtatgtaaggtgttcattatttttgttctgtgtgtgtgtttgaaaattttcataatagaaaatgtttacaggtaaaattaaagtttagaataatgtgattatttctattttagcaaccaaaggacacaatgagattagatgaaacgatgctggtcaaacagttgctgccagaaatctgccattttcttcacacctgtcgtgaaggaaaccagcatgcagctgaacttcggaattctgcctctggggttttattttctctcagctgcaacaacttcaatgcagtctttagtcgcatttctaccaggttagtgtgtaaatccacatgggactactgaagtaatatgaatattagaagttttgttttttgtctacataaaaataaaaagttaatggaaatgaggtttttttgtttttgagacaagttcttttgcccctcacagcagctttgacctcccaggcttaggtgatcctcctacctcagcctccagagaaatgagtttgtctgggcttgcgtagaaattttatgcattaatatctttgacattttaattgcgtaatattgtgatattgatatgtgcaattaaataagagcactgttatgaatgtgaaagtctaaatttcagataaaaatatctgccgtgagcaggctttaaaaaacaatactaggtatgaacttttggtttggctttttaaacatattatccctttaaatgaaactacccaattagatggaataattaatgagagtagtcagaattcaaatactttcacaactctaccctttatcacaagattttaggttaccaaaaaacaaaacaaaaacaaaaacaaaaaaacctaagtgatgtgaaaacacaaggaggtgaataattgcaaagtagaattctccagaaagtggactacattttaaatgtatgtaaaatactgccatttattgagtatttatagcatttcctttgctgtctcatcctcacagtaaccttgatgatacttccctcattttacaggtgagcaaactaatactcaaaaaagttcaggtgatgtgccaaataatggaggacccaaaatttctaagtcaggctggcttcagaatttatattagtttcactataccagattgcttccctatctattttagccacattttgatgaaatctgttttataaaatatacttctgtttttaaagatgtatcaaaaatataatttaagcttttattgatgactcaaaatcatcctgagcattagttgtgatatgctacctacaggtggagaaattagtataggtagtgctctatgggatagaattataagtgacagtagcaagtagctgcaaattgttgttatgcacatgatttgcctttctaaggcaagtaaagtcagatgggttattaacttaattagaaactatagcacaaattatttagtgattcgtgaatcgaagactaataccgaatagagaaaaacaatcctctttgttggtgcctgcatctttggctcgtcagtgttgtacgaacagtggactttgattattcagatttactgattcctttgttgttttccagcaggtgtgaaagacaacatacatcaccatttgagaatttgtgttacggttttttgggggaattgattaacttcagagtcctgcaatctttttaatcaacaatgacatttctataattaagatcctaggcagcaatatttttcaacctcaatgcaattcttgatccaaagaaaattaaagttttatttaatggtatattattgataatcttgggtaatatttacatgatagaaaaatgttttcatgaaatcttttgagcagtaacgttttatattatgaataataatacagtggttgagtcagcaaggtaacaaacacctagagagtaggagggtggaaaattgtatttaataaaaaacgcaaacccttttcatttaggtgactgctaggccggccttactatttgaaacacctgttaaattaaaggtagaaagtggtacaaaaaaacccaaatgtcttgtagtctatcaatgcatgaactgccttatagaacacaacaaatgtgccaccttggaaaattctagaaaatttctagtcaccaaaggttttactttatgggattttgcagcattagcacatgtaaaaataagcaacttttgtttatttcctgaatctagttcactgttgccagaatagaaaccaagtgtctaaaattttattagctttcagaggacagaccactcagaaatggcatctgtgaaataacattgtttcagacaactgcattttcagttccatttagcttgtgtcagaaataggagctgatcttactgaaggatcactcacctaaaagaccattatgatggtttagtttaggttggaacatcttatgctgtcatcgtcatagtattaggtgacttaaaatatgtgtgtggcttgaatggtagttctttctaaagattgatcttatgttttatatataatagatgaatcagtatcatgaagatgtttcgtgtttgtccattctccccgtcaatgtttctcctttaagattaagatttggtttttatatttctgacctttacttttctttaggggaagataggctatagatttatttattttatgtttttgagacacagtctctctctgtcacctagtctggagtgcagtgatgtgaacatgtctcactgcagcctcgacctcctgggctcaagagatcctcccacctcagcctcttgagtagctgggactacaggcacgtgccaccatgcccggctagtttctttaatttttttgtagagacggggtcttgccatgttgcccaggcttgtcttgaacccctgggctcaagggatcctcctgccttggcctcccaaagtgttgggattacaggatgtgagctaccatgcctggctggctataaatcttaagatagctttatttttctctgggagtataccattttctgtggcttatagtatttatgtagcggagtaactgctttctccacagaattactccacaaatgcagttgatctagttgttttgtagtgagaaggtgcttcagaatatctcatttgatataccaccagaagcagaaaactcaatgactttaaaagtcatttggttctttacagtttactatttggttccatacaaatctgttcgttatggtttcttactctttttttaaaaatagttttcagtttttttatatgtctctgatcatttaaaacgtattttacgttctctttagtattgtttaatattgatttgtttgtgctgattcattcatagtgaattgtttcatctcagttttggaatccttgattgcaaagttatctttagtgtggcctgtattttctttgagaatccttgtagccttgggctgagggagtgttctagtgatggttttgcatttgcatttgccaggtgcccagttctggagctatttttttcttaatttctcagtcccagcctgtatgggcagtataaatttgaaccctaaactcttagaaggtaaacagctctaggtgacttttttcactttatccaaagtttaggcagagcagttaagcttctttgtgctggtaggtttttttctttttttctttttgtggggagtgggggcggcagggggagtgcattgttctttctagttcatgttttatgcagggcccaagttagaatcctgaattattagggtacaaggcgtttatatccagtctccatgtggatgttaagccccaagctcctaggttaaggagatcaaaaacctcactcatctttcctttgttgcagggctgggtcatgtacttgtgcacttaactctctggttttcagttttcttcttcttttctggacctatacatttaaaatatctttcagtatgcctagactttctagctgttttagtgataggttttctactgttcatttcttttgctcagactacgctttatttgatttctctgcttcggaaatgatgtttaaccttcacaaaatacctgctctctataagggtaccagactataaaagggacaaaatttttctcccatttttcacaaacaaccacaagagtcaacttttcagaagttggtattgctgatctatgatgttgtgttttctgaggagccgtactccatatttctacgctctttgcagcagctgtggaatttttagcattgaggacaacctcattcccagcttgaaatgctgagcttttcttaccctgatgataggaagagagttcatgtaagtgcttagaatagttgtactgttagctgtagtctaattaaagctaaagtgagtgaaacgagaatttgagaaggaagaataggattgattacattcttatcaactgaaggtttagtgtgatgattaataactcctttgcaaattgcactaaatgattgaaattcaagttaatacatataaattataagaccatatagtatttgtgccttttcaccatatctctattgctgcatttataaaagtttacaatttaattgtgctgcttatattttttatgtctattaatatgaataatgagtatgcctcattaggtagcatgatttaatagattagcaataccaacttttgaaaatctgagtgctgtggttgttggtgtaaaatggaagaaaagtttaatgccttttattaacatttaggctaagtgaatttcttttatcagtttaaaaatatctacatatttgttaagtgttaaatgtttctacgtttgtgataacttcatattcaacataggagaagctggggtttaaacagatattcctgtccttataagcttatgttctgtgaagtagggatattaagcaaataattacataaatacatgtacaaactgtgaaaagtgcaatgaaaaaaggcttactcggttttcaaatacaaagtaaatgtaccctgtgaatataaagtttcattcgtgtttcaaaaatctagttgataaaagtagaagttagtaaaatcaagtttacttattatagttttagtcttaattcaaattatacttttacttgtaattggaaatatgaatttttaaaactattcattgtggaaaaatggaaaaatacacatagaatagtacttcaaatccccatgcatctcttactctgctttaactgtttctggcatgctatggtttctcttcttcccttttcagtaatttaaagcaaaccccagacatcatttcacctgtaaatatttcagtatatatctctaataaatagatttttaagcatttaactataatattgtcatacctatcaagaatcataattccttaatatcatgcattgccaaatttgtgggttttttcattatctcagaaatggcttttttgttttgttcaaattaagatacaaataggatgcgtactttggaattggttgatatttctcctgagcctctgttaatcagtatcatttcttcatttcttcaccttgctctccattttttcccatgctgtttatttgttggactgcgttatttgcctttctacattctgtatttgggtttcattggattcacgttcatttggctggggggggacaagaatactttactgatgatgctatgtggttcctaatgaatcacatcaggaaacatgtcctattattgacttttaatgttatgatcagtgattggatttcgatgttatcagcattatgtattcattatacagtttcccataaatttttcctaatgtttttagtaatcactgatgatcactgcctggattccacttcattgggggctgcaaaatgaaacgttttctattctgtcattcattctttattttaaaattgtgacttctatgaaagatttttgcttcattgtgtgtttagttatcttgcaatacagtccatgtagggaatgcaggatacagacttgacttccattattcgttatcagaatgagttggtaccctaacagttgcgaaaggttacccatgaagttttttctttcaatattataacaggcttgtgtgttttaatttattgtatgtgtttccattgtagacataattcttttgatcctcagattatcccatttttgacagttgagatgcctaaagtgcatacctgtgtgatatttgacatggttctgatagttgttgatagtttcctgttttcaagcccaaggtgacctgccctcaccttgtatatctcttgcccccatcctggaattaactaattttcccaaagaaccctggccgaaagtcggcaatatttagacacctcaatcttaaggataaggatgctacgatgctacgtttactgaattatcatggtttcttttatcatatcccttgtttgttatgttcctttaggtttttataagaaatatttattgccttatttttatatatgtctttactcttatgaactcatctttgggggaagaatctgttgaattcagaatttagggatacccgaagactttttttgtttttgttttttttaagagatagggcccactctgttactcaggctgaagtacagtggtgtgatcacagctcattgcagcttcaaacttctaggctcaagagatcctcctcccttagcctcctgagtagctgggcctataggtgtgtgccatcatgcccagctaatttttgtattttttttagagatgatgtcttgctatgttgcccaggctggtcttgaactcctggcctcaagtggtcctcctgccttggcctcctgaagtgctgggattacaggtgtgagataccacacctgtcccctaatacttaatttgataagttaattttggtttttactttttaggttacaggaattaactgtttgttcagaagacaatgttgatgttcatgatatagaattgttacagtatatcaatgtggattgtgcaaaattaaaacgactcctgaagggtaagtttaaatgtataatatatctgaaaaaaatcactgggtcaaaaactagtatcatgaatgtactaattatattaattgtgctgaactagaacaccaaactggattttataatgacatttccttgtgaaataaccagtaatacaaatgggtaattatttttcaatctttgaaaataatgcagtagagaaaatgagcattttaaatcttggcaatggaaagttttgcttaactacaatttttgttttcaatacagagaatgcaagggtgctattatttcatttttctggaatttgatctctcaagggtggctataggttatagaagctatctgtttagctattgtagcactttacaaagattgtctgtagtaggatatcaaagttttattgcagaatggaacgaggagattgtgatgttatggtgagaggatgaattgagccagagatttcatttctgacatttctgttttcagctctctactgactgactttatagcattacaaagtcccttaaccttccattgccggttttgtctccttgtagaacatgtcagtagtagttccacatggggatattataacacctaatatgtgactttaaagcttgggaagtactttacatgattatgtggattgaaataaacgatcagaaggaattgagatatgttctgtagtaagcagtgatgtgttaatgtaaatcagataccaatgagtattcataaactgagtatgatctgaaggaattgagataaattctgtggtaagcagtgatgtattcatgtaaatcagatatcaatgaatattcataaactgagtatgaatatctaaatttcattttacaaaaaaatgttttttagtttttggcattattagaccctggctaatttagatatgaaaccgtatacagttcacacatatttttatttgtaacttaaggaattgtcaaacaataatatttttaatatctgacctaaaacagattgaattatattagcttcagaaacatcagttctgcaatgtagttttcaaaatacgtgtttttgttttcttaatatttcctttaaactcaataactatctcaccagagatgtaaaaaggcaatacctatataaaggaataatataaagctgtgttctattcatattacccttgttcataatttatgattttaggtcattaccattgtgaaaccaagcaacaattaattcagtaactttaataaaggaaaatataggggtgattttagctgttatgccaagatacaaacatgtggacagcaattattttagattataataaaccaccattgaattaatagttgagatttgcaagattttgatatctattattaagcgttgagcagttgagaaactgaatggtaaaatttagagatctctatgaattaaagttaagaagtattagtgggattttatgatttttcataactattcagtgatgttttggaaacaagtctagtccaggttgcctgtgaatagctgtttaaaacaatagaaatgttcaatccgtaataattaactgaaatgtctcttctgtccaaataagagaaactaattgaatgtgtggataaatgactttcttttatactgaagtaactttcccatcgaatgcggctccctcatgaacataaatttagagtatatgctgataaatatataaagtataaaaccgatattaaataggccagcaaaatatggctcttggtgacagtggtaaaaggaatgcaccctttcagtaatgagtagtaaaggtagtaatgtgttttaaatacaactcaacaagcctttgttgagaaactatgtataagaagccatgctaagtgctgggattacaaaaattaataaaatatggaatctgtccctaaggagctcatggcatggtttatgagacaagtgatgtcattatcaagttatttgcagaaaaaaactatgataaactcaaatagggtgagtgtaaagtgagagaggaagtatatatttgtttgaggggatgagagatgagcaagatgtgaaggtacaagaataggtcagatcattttaataaaaatatggccaggcctggtggctcacacatgtaatccccacactttggggaagccgaggcaggaggattgcttgagccagggcaacatagagagacccccatatatacaaaaaaaaattagctgggtgtgctgacacgcacctgtagtcccagctacttgggaggctgaggtgggaggatcacttgagcccaggaagaggttgaggttgcagtaagctgtgattgtgccactgcattccagcctgggtaacagagtgagatcctgtctctgtctgtctctctgtctctctgtctctctctctctctctctctttctctctttctctcgatatacctatctgtatatagatatatcaatcgatatgtgtatatccagatctgtctatagatatatctgtatcttgatagatatatcgagagagagagagaaacatttgttatattttcagtctgcaccgggccttgcgctatgcagtttgcatgccttttctcatcaattcttacaataaccctgtgacgcaatactagtattaatattatcatctcttgtgtagatgaggaaactgaggcctcagtaaattttcaaagtcacagagctagtaattgttcagtaaagattgagttcacatctgctcgtctctagaacctagatacttgactgctgcactgttgtgcttatgagttacgaagctttattttagtggccctgggaagtgatagaaaggctttgaggtagagaataccttaatcagtattttattttagatatacccctttgcttgaaatttgcaggatggcttggtagagggttacctgaacttctgggacttggttatgcagtaatataagtgaaaaataatgagagttgtggagatccagatgatggattggggtagggtaaggatggggaccagtttgataggtatttaaagaagtggaggctgggcgcagtggctcacacctgtaatcccagcactttgttaggctaaggtgggcggatcactgaggttaggagttcgagaccagcctggccaacatggggaaactccgtctccattaaaaatacaaaaaatgggctgggcgcggtggctcacgcctgtaatcccagcactttgggaggctgaggcaggtggatcacgaggtcaggagaccatcctggctaacacggtgaaacactgtctctactagaaatacaaaaaattagccagtcgtagtggtgggcgcctgtagtcccagcttcttgggaggctgaggcaggagaatggcatgaacccgggaggcagagcttgcagtgagccgagattgtgccactgcactccagcctgggcaacagagtgatactccgtctctaaataaataaataaaataaaataaaaatacaaaaaattagccgggtgtggtggcacgtgcccataatcccagctactcgggtggccgaggcacagcagaatcgcttgagcctgggagatggaggttgtagtgagccgagatcacgccattgcactccagcttggacaacaagaccgaaactccatctaaaaaaaaaaaaaaagaaatggaatacatagcatttgatagtcaatttagatatatgaggttagagagatatcaccaaatattacagaataagctggttagagcagaaaagggaaggaaaggttgatggcagaagagagggtttgaccaggaaaatgataaattcagttttagatcttctgagtttgaggtatcagtaggatgtccaacaagaaacttgtagaactgaaagatactttggctttgagagtagattatggtatataacacatttaagatgtcataaaggtaaagttgttgctaaagagcactgtgaagagtaatgtcattatttggaaatcagtggagggtgagagcaaagagaattcaaaggggtacttttaaaaactgatttggagagttacttatttgcaagtccagaaaaaagactcatctctctcttagacacttacatagatgtaataaaaacctttatcccttcattaaaagtcaacaggagaagttctttgccgagggaccattgccagtaaaatcgcttatagacaggtcattttttccaaacataaatctttttctagatgtggacaataaacttaaagaagaagaaattaaaatacccaatatatttatatggagaaatgtttactgttacttgcgttaaaatgcagtctactattttgaacactccaattagcaaaataaagaaaatgaacatacttttatgatgacaaagataggatgaaggcactttcgtatgctgcttggtgatagcagcatttggcccaaccctagtgaaaggcagcttggtaatctttatcaagggccctaaaaatattcatctctttgactggacacttctagagattccttatcttaaataagcagtgatgtgggaaaagatgttgatatgaaaatatttgttaatgttatttataatagtgaaataacagaaataacctcagtgttaaaactggaaaacattaaataaccagtcacttaatacagtgacttaaatattatgaggggcatcaaagcatactgaaaagaccttggttttaaagcccaattcaatcatttattagatctgtaaccttagacacacagtttgttcatctgtaatactctgaaaacattaagattcaaaaagaattaagtgtatcatactaaaaatacatgatatgttttaatagtttgtgtaatagttactattgcatatagagccatcaaaaataggccaggcacagtggctcacacctgtaatcccagcactttgggaggcctacgtgggcggatcatgaggtcaggagttcgagaccagcctgacgaacatggtgaaaccccatctctactaaaaatacaaaaattagctgggtgtagtggcgcacgcctgtaatcccagctactggggaggctgaagcaggagaatcgcttgaacctgggagacggaggttgcgtgagccaaaattgtgccattgcactccagcctgagcgacagagcaagactccatctcaaaaaaaaaaaaaaaaaaaaaaaaagagtttttactgatacagaaataattagggatactatggaaaagaacaggtttgatacagcttatatgatctcagttatgttaaatatatttgttttctacatgcataggaaaagtggtagaagtaaaaccaccagatgttaactgtgattgtctctgaatgatagaatcattgatggttttaaaaatttcccataaacacctgtgcttttgctttttttttttttttttttttttggacagagtcttgctctgtcgctcaggctggcatgcagtgacatgattatagtacactgtagccttgaaatcctgggctcaagctatcttcccactcctgctttcgaaagtgctgagattataggcgtgagccatcgggcctggccctgtatatgttttccaaattttttaattatactttaagttctggggtacatgtgtagaacatgcaggtttgttacataggtgtccatgtgccatggtggtttgctgcacccatcaacgcatcatctaccttaggtatttttcctaatgctatcccttacctcagcccccaccccccgacaggcaccgatgcgtgatggtcctctccctgtgtacatgtgttcttatggttcatctcccacttatgagtgagaacatgtggtgtttggttttctgttcttgtgtttgctgaaaatgatggtttccagcttcatccatgtccctgcaaaggacgggaacttatccttttctatgtcagcatagtattctgtggtgtatatgtgccacattttctttatccagtctatcattgatgggcatttggattggttccaagtctttgctgttgtgaacagtgctgcagtaaacatacgtgtgcatgtgtctttatagcagaatgatttgtaatcctttgggtatatacccagtaatgggatggctgggtcaaatggtatttctagttctagatccttgaggaatcgccacactgtcttccacaatggttgaactaatttacactcccaccaacagtgtaaaagtgttcctatttctccacattctctccagcatcttttctttcctgactttttaatgatcgccattcttactggcgtgagatggtatctcattgtggttttgatttgcatttctgtaatgaccagtgataatgagcttttctttatatgtttgttgtcttcttttgagaagtgtctgttcatatccttcatctactttttaatggggttgtttgtgtttttcttgtaaatttaagttctttgtaggttctggttattagccctttgtcagatgggtagattgcaaaaattttctcccattctgtaggttgcctgttcactccgatggtagtttcttttgctatgcagaagctctttagtttaattagatcccatttgtcaattttggcatttgttgtcattgcttttggtgtttcagtcatgaagtctttccccatgcctatgtcctgaatggtattgcctaggtttctttctagggtttttatggttttaggtcttatgtttaagtctttaatctatcttgagttaattattgtataaggtgtaaggaaagggtccagtttcagttttctgcatatggctagccagttttgccagtaccatttattaaatagggaatcctttccccattgcttgtttttgtcaggtttgtcaaagatcagatggttgtagatgtgtggtgttatttctgaggcctctgttctgttccattggtctatgtatctgttttggtaccagtaccatgctgttttggttactgtagccttgtatagtttgaagtcaggtagtgtgattcctccagctttgttctttttgcttaggattgtcgtggttatgcgggctcttttctggtttcatatgaaatttaaagtagttttttctaattctgtgaagaaagtcagtggtagtttgatggggatagcattgaatctataaattgctttgggcagtacggccattttcacgatattgattcttcctatcgatgagcatggaatgtttttccgtttgtttgtgtcctctctggctggcatctggcaggtgcccctctgggacaaagcttccagaggtaggaacacgcagcaatctttgttgttccgcagcctctgctggtgatactctggcaaacagggtctggagtggacctccagcaaactccagcagacctgcagcagagggttctgcctgttagaaggaaaactaagaaaggaatagtatcatcatcaacatcaaagaccaaaggtagataaatccacaaaaatgggaagaaaccagtgcaaaaaggctgaaaaaaaaacgagcacgcctcttctcctccaaaggatcacaactccttaccagcaaaggaacgaaactggacaaagaatgagtttgacaaattgacagaagtaggcttcagaagatgggtaataacaaactcctccaagctaaaagagcatgttctaacccaatgcaaggaagctaagaacctggaaaaaaggttagacgaattgctgactagaataaccatcttagagaagaacataaatgacctgatggagctgaaaaatacagcatgagaacttcgtgaagcatacacaagtatcaatagccaaatcaatcaagcagaagaaaggatatcagagattgaagatcaactcaatgaaataaagcgagaagacaagattagagaaaaaagagtgaaaagaaatgaacaaagcctccaagaaatatgggactatgtgaaaagaccaaatctacatttggttagtgtacctgaaagtgatggggaggatggaaaaagttggaaaacactcttcaggatattagcaggagaacttccccaacctagcaaggcaggccaacattcaaattcaggaaatacagagaacactacaaagataatcctcgagaagagcaaccccaagacatataatcgtcagattcaccaaggttgaaatgaaggaaaaaatattaagggcagccagagagaaaggtcgggttacccacaaagggaagcccatcagactgacagcagatctctaggcagaaaccctacaagccagaatagagtgggggccaatattcaacattcttaaagaaaagaattttcatcacagaatttcatatccaggcaaactaagcttcataagcgaaggagaaataaaatactttacagacaagcaaatgctgagagattttgtcaccaccaggcctgccttacaagagctcctgaaggaagcactaagcatggaaaggaacaactggtaccaaccactgcaaaaacataacaaattgtaaagaccatctatgctgtgaagaaactgcatcaactaatgggctaaataaccagctagcatcataataacaaattcacacataacactattaaccttaaatgtaaacgggctaaatgccccaattaaaagacacagactggcaaattggataaagagtcaagacccatcactgtgctgtattcaggagacccatctcacatgcaaagttacacataggctcaaaataaagggttggaggaagatttaccaagcaaatggaaagcaaaaaaaagtagggttgcaatcctagtctctgataaaacagactttaaaccaacaaaaaagatcaaaagagtcaaagaagggtattacataatggtaaagagatcagtgcaacaacaagagctaactaccctaaatatatatgcacccaatacaggaacacccagattcataaagcaagtccttagagacctacaaagagacttagactcccacacaataataatgggagactttaacaccccactgtcaacattagacagatcaacgagacagaaagttaacaaggatatccaggagttgaactcagccctgcaccaagtggacctaatagacatctgcagaactctccaccccaaatcaacagaatgtatattcttctcagcaccacattgcacttattccaaaattgaccacataattggaatacaacactcctcagcaaatgccaaagaatggaaatcataacaaagactctcagaccacagtgcaatcaaactagaactcaggattaaggaactcactctaaaccacacaactacatggaaactgaacaacctgctcctgaatgactactgggaagataacaaaatgaaggcagaaataaagatgttctttgaaaccaatgagaaaaatacacaacgtaccaaaacctctgggatacatttatagcagtgtgtagagggaaatttatagcactaaatgcccacaagataaagcaggaaagatctaaaattgacaccctaacatcacaattaaaagaactagagaagcaagagcaaacaaattcaaaagctagcagaggacaagaaataactaagatcagagcagaactgaaggagatagagacacgaaaaacctttcaaaaaatcaatgagtctcctgacctcgtgatccgccgccttggcctcagtgaaaccccatctctactaaaaatacaaaaaaattagccgggcatggtggcaggcacctgtagtcccagctactcgggagcctgaggcaggagaatggcgtgcacccgggaggcagagcttgcagtgagccaggatcgtgcaactgcactccaacctgggcgacagagcaagactctgtttaaaaaaaaaaaaaaatcaatgaatccaggagctggttttttgaaaagatcaacaaaataaatagaccactagccagactcataaagaagaaagagaggagaatcaaatagacgcaataaaaaatgataaaagggatatcaccaccgatcccacagaaatacaaactaccatcagagaatactataaacacctctgtgcaaataaactagaaaatctagcagtaatggataaattcctggacacatacaccctcccaagactaaaccaggaagaagtcgaatccctgaatagaccaataacaagttctgaaattgaggcaataattaatagcctaccaaccaaaaaaagtccaggaccagatggattcacagccagattcagctagaggaggagctggtaccattccttctgaaactatttcaaacaatagaaaaagagtgaatcctccctaactcattttatgaggccagcatcatggtcataccaaaacctggcagagacacaacaacaagagaaaattttaggctgatatccctgatgaacatcgatgcaaaaatcctcaataaaataatggcaaactgaatccaacaagcacatcaaaaagcttgtccaccatgatcaagttggcttcatccctgggatgcaaggctggtttcaacatatgcaaatcaatgaaagtaatccatcacgtaaacagaaccaatgacaaaaaccacatgattatctcaatagatacagaaaaggcctttgatgaaattcaacagcccttcatgccaaagactctgaataaactagggattgatcaaacatatctcaaaataataagagctatttatgacaaacccacagccaatatcatactgaatgggcaaaaactggaaggattccctttgaaaactggcacaagacaaggatgccctctctcaccactcctattcaaactaatattggaagttctggccagggcaatcaggcaagagaaagaaataaagggtattcggttaggaaaagagaaagtcaaattgcctctgtttgcagatgacatggttgtatgtttagaaaaccccatcgtctcagcccaaaatctccttaagctgataagcaacttcagcaaagtctcaggatacaaaatcaatgtgcaaaaatcacaagcattcctatacaccaataacagacaaacagagagccaaatcatgagtgaactcccattcacaactgctacaaagagaataaaatacctaggaatccaacttacaagggatgtgaaggacctcttcaaggagaactacaaaccactgctctaggaaataagagaggacacaaatggaaaacaattccatgctcatggataggaggaaccaatatcctgtatgtgttttatacttttttttgaaaaagcaagttattaaaagaaaaagctcacaatcattgatgtccaaggcatatttgctgtttatggaatttttctttcctagcagacaactatcgagttttgggtttatgttaggtgtctttacctttcattgcttacagataatattggagcaaaagtaatacgtaaatggaaagttattttgctctgagttgtatttgtgttaacttattctagagttaatttttaaaaattgtgttttttccagaaacagcatttaaatttaaagccctaaagaaggttgcgcagttagcagttataaatagcctggaaaaggtaagttacaacctctctggtattaaaattttgtttttgatgtaaaatttgctgttgttagcatcctgaatcaaaaagttatgacttgagtgatagtttcacattcattttcaggaagaatacattgtaatattattatgaaggaagttagaagtttgtgacattttatttactgtattacaaaaaatcactgtaaagacatgtggttctttatttataggcattttggaactgggtagaaaattatccagatgaatttacaaaactgtaccagatcccacagactgatatggctggtaaggatacgattgattttttttttttttttgtcttttaaatgcctacttgtgacataaaaacctatcatcgttttccaagttatttttgttataaaggtgcttttacatcttctattgtcaactggtgtcaaataggaaatactgtttttctcttacatttctaaattaggcccaaccctcttcctttccttggagcaaacaaagtagtttgaaatgaaggtcagatctttagagctgtgataggatggggtgtttggctctttgttgtagagaagcatgtgctctgaagctttattttgtatttagggagatgtgtataaagtagtaatattctcacctataatgtaagacacaactgcaaggcagagaatacagactcctggagaactttggtaattctttttgggaagctgttcagtctttgttgcttgggtacatcacactttgcataaggcccttcacagtgagactgaatacatgatcatccattctaaaatgtgagcttttccaggatagatcaagatagctcttctaacacatagacagtattacattgcttgtctacttaccagaatgcatttgtgtagttgcttaaatgaagttccatgtttatcttttaaaaatgttgcccttgggtttttacatagtgtcagcttttactttaatgccagggattttgttcctatctaataatgtcatttaatatatttttcatgcagaatgtgcagaaaagctatttgacttggtggatggttttgctgaaagcaccaaacgtaaagcagcagtttggccactacaaatcattctccttatcttgtgtccagaaataatccaggatatatccaaagacgtggttgatgaaaacaacatgaataaggtaaggagggcaaaattatttccattatatctagatgtgaagcagtttattttactcaaggtgtgtattactttaggcttattatttaagcaaagtatttcagggaaccatttaaatgatcattttaggtttctttgtttgatggacttagaagagacatactcatacataattttatttggcagagggaaaataataccaggcaatgaacaaagatttaaaataatcccttagtttcattcttttgtctgagaagactaaacgatacctctgttattattaaacgtagtttctctaatattcactacaaggattgccctacttgagttcatcacttttatagtgtgttatttgcatgtacttagggtatgtgtccatatagtgctactgaaattatctagtaactcattttaagtattttagaacagttttcaaagaattttgccaggaaggtaaggctctcgcatataccatctatagtgaaattggcaccatgacaactggtaattctaggaggctcttaaaatttttttaaatatcacctaggtgattgaaaaaaaaaagaactgagtattaatcctagggttttactgaaatttcaatatgcagtttgttttgcaaatattttttttttcattttttgctgcttttggagaaatactcttagctggctgaacatgagatggtttccttcatggtttgcctgtagatggagatgttcagaatcagctgaatgatttattactttgtagaagtattggaccgggaatttatacattaaagggtaaataaatgaaccaggtaatccttgagagtctgtgattgcgtgttactccacttaggtgtatatctcaacttttccattatgaggacaccatttttcatggtagattgttttggagcccttcaaaatagtaggtttgatgataaatactgagtgtcaacttgattggattgaaggatacaaagtattgatcctgggtgtatctgtgaagttgttgccaaaggagattaacatttgagtcagtgggctgggaaaggcagacccacccttaatctgggtggtgcaccatctaatcagctgccagcatggctggagtataagcaggcagaaaaatgtgaaaagagagacgggcctagcctcccagcctacatctttctcctgtgttggatgcttcctgccctcgaacatcagactccaagttctttagttttggaacttggactggctcttcttgcctcttagcctgcagacggcctattgtgggaccttgtgatcgtgctagttaatagttaatatcccctttatataaatattctattacttctgtccctctagagaaccctaatagagattttggtacaaggagtgtggttctagaggaacggagtattaaggatggagtttcttagtttgtttgggggtttctggagtttgctgcttaatatgattagaccctaaaatattaaggactctacttctaatattgtggagaacactgatagtcgttgctgtgaactgtttagagagtttgcaaaataaatgcatttgacactcctgattcaccgctaatgagaggcaaggagtttagtgaccctatacataataatacctttgaccatatatggagaaccaaggaacataatgaagctggttggttgctcctaaattcagtggacaaagtggtgaaagaaaatgatgggccgggcgcggtggctcacgcctgtaatcccagcactttgggaggccgaggcgggcggatcacgaggtcaggagatcgagaccatcctggctaacacggtgaaaccctgtctctactaaaaatacaaaaaattagccgggcgaggtggcgggcgcctgtagtcccagctactccggaggctgaggcaggagaatggcgtgaaccccagggggcggagcctgcagtgagccgagattgcgccactgcactccagcctgggcgacagcgagactccgtctcaaaaaaaaaaaataaaaaaaaaaaataaaaaaataaaatagaaaatgatgagctcagggattctgtctcctgtcttcagaagcagatactgagcctcaaatctgctaagattgacctgagtgagacccttatctcctgtagaaaaagagctgaaattgtgaaaaaacaaacacaaactcttatcatgcaagtggctgacctgcaacaaaaggtgcatgtacagcctaaccaggtgtctactgttaaagtgtgggcattgattggaaaagaatgggaccctgcaacttggaaagggcatgtgtgggaggaccctgatgaagctggggactctgagtttgtaaactctgatgaaccttttttgccagaagaaacagcttccccatccccagtagtggcaacatcccctccctgagccatgctgccatcagcctttccacttttgtctgaagagataaaccctgcgctgcctgaggcaacaggaatggcctcccctgaggcagttgccaggcaagataatgttgattctcctcagaagccacccccaacacccctgtttgcttctagacctataaccagactaaagtcctagcaggtccctagaggtgaggctgagagtgtgacccatgaggaggtgcgctacactcgtaaagaactgcttgagttttctaatttatataaacaaatcttacttggagagaccttggtcatgtttcacttccacaacatatgacactggtctattacattaatgatattatgctgattggattctgtgagcaagaagtagcaaacgcactggacttattggtgagacgtttgggtgccagaggatgggaaataaatccgagtaaaacttagggaccttctacctcagtaaaatttctagggcttcaggggtgtggggcctgtcaagatattctttctaaggtgaagaatattgctgcatttggcccctcctacaaaaaagaaagaggcacaatgcctagtgggcctacttggattttggaggcaccattcctcatttaggtgtgttactctggcccatttatccagtgacccaaagaactgccagttttgagtggggtccagaacaggagaaggctctgcaacaggtccaggctgctgtgcaagctgctctgccacttgggccatatgacccaacagatccaatggtgcttgaagtgtcagtggcagataaggatgctgtttcgagcctttggcaggcccccataggtaaatcacagcggaggcctctaggattttggagcaaggccctgccatcttctgcagataactactctccttttgagatacagctcttgacctgttactgggctttggtggaaacggaatgtttaactgtgggtcttcaagtcaccttgtgacctgaactgcctatctatgaactgggtgtgttctgacccatctagccgtaaagtgggtcgtgcacagcagcattccatcatcaagtggaagtggtacatacacgatcgggctcaagcaggtcctgaaggcacaagtaagttacatgaggaagtggctcaaatgcccatggtctccactcatgccaccgtaccttctctctccccacctatactgatagcctcatagggagttccctatgatcagttggcagaggaagagaagactagggcctggttcgcagatggttctgcacaatatgcaggcaccacctgaaagtggacagctgcagcactacagcccctttctaggacatccctgaagcatagtggtgaaggggaatcttcccagtgggcagaactttgagcagtgcacgtggttgtgtactttgcgtggaaggagaaatggccagatgtgcgattatatactgattcatgggctggagccagtggtttggctggatggtcagggacttggaagaagcatgattggaaaattggtgacaaagagatttgaggaagaggtatgtggatagacctctctgagtggttaaaaactgtgatgtttgtatctcatgtgagtgctcaccaacaggtgacctcagcagagaaggattttaataatcaagtggatagcgtgacctgttctgtggatgccacttagcctctttccccagctacccctctcctcgcccaatgggcccatgaacaaagtggccatggtggcagggatggaagttatgcatgggcttagcaacgtggacttcactcaccaaggctgacttggctatggccactgctgagtgtccaatttgccagcagcagagaccaacactgagcccttgatatgacatcattcctcagggtgatcagccagctaccttgttgattatattggacctcttccatcacggaaagggcagagatttgtcctcactggaatagacacttactcctgatatgggtttgcctatcctgtatgcaatgcttctgccaagattaccatgcatgggctcaccaaaggccttacccaccatcatggtattccacacagcattgcctctgaccaaggcactcactttacagctaaagaagtgtgccagtgggctcatgctcatggaattcactgtttttgtttgtttgttttttgagatggagtgttgctctgttgccaggctggagtgcagtggcgcgatctcggctcactgcaacctctgcctcccaggttcaagcgattctcctgcctcagccttccgagtacctgggactataggtgtgcgccaccacgcccagctaatttttgtatttttagtagtgatggggtttcaccatgttggccaggatggtctcaatctcttgaccttgtatctgcccccctcggcctcccaaagtctaggattacaggcatgagccaatgtgcctggccacactggtcttaaccatgttcccaaccatcctgaagcagctggattggtagaacagtggaatggccttttgaagtcacaattacaatgccaactagaagacagtactttgcagggctggagcaaagttttccagaaggctgtgtatgctctgaatcagtgtccaatatatggtactgtttctcccatagccaggattcccgggtccaggaatcactcaccatcacccctagtgatccactagaaaatttttcttcccgttcttgagacattatgttctgctggcctagaggtcttagttccagagggaggaacgctgccaccaggagacacaacaacgattccattaaactggaagttaagattgccacctggacacactttgggctcctcctacctttaagtcaacaggctaagaagggagttacagtgttggctggggtgattgaccctgactatcaagatgaaatcagtctactactccatagcggaggtaaagaagagtatgcatggagatccattagggcgtcttttagtattaccatgtattgccatgccctgtgattaaggtaaatgggaaactacaacagccccatccaggcaggactacaaatgacccagacccttcaggaatgaaggtttgggtcactctaccaggaaaaaaaccaccacctgctgaggtgcttgctgaaggcaaagggaatacagaatggctagtagaagaaggtagtcatcaataccagctacgactgcatgaccagctgcagaaacaactgtaattgtcatgagtatttcctcctccttttgttaaaaacatgtttgtgcatgtatacacctgtactaagaaaatatcttcattttatttcctttttcttttatcatatgacttaagatttattgacttcacatcagcattttaagtattgttaacttttagtatttgggttgggataggtgtgtttctggttgtacgaaggataattgtattatgttaggcataattatgactttattgtctttatttaaagattatgtatgatctcaggagatatgtatgggttcaagttgacaaggggtggacttgtgatggttaatactaagtgtcaacttgattggattgaaggatacaaagtattgatcctgggtgtgcctgtgagggtgttgccaaaggagattgacatttgagtcagtgggctgggaaaggcagacccacccttaatctggctggctaccatctaatcagctgccagtgtggctagaatataagcaggcagaaaaatgtgaaaaagagagatgggcctagcctcccagcctccatcttcctcctgtgctggttgcttcctgccctccagcgtcggtcttcaagttcttcagttttggaacttggactggctctccttgctcctcaccctgcagacagcctattgtgggacctcgtgatcgtgtaagttaatgcttaataaactcccctttgtataagtatctattcccttaattctgtccctctagagaaccctgactaatacagtagggtgttttttgttgttgttgtttattggaaaaatagaaataaataaataagctatagattcagtagtactcgagtgaatttacgttttaataatcacaactgtagctttctaagtgtttactggttatttgtgtatcttcagggaattgctgatttttccattgaattgtttgtcttttgttgatttgtaagggtatatgtgtacatttttacttggtttcatttttaaactttatgagttctttttactatatagatatttaaaatttgcatgtagtcacctcagccttgttcctttttgtctcctagcttttttggtcagatctctcttcccagaagatattattcattttattgagatataattcacatatcataaaatttacgtttttgaagtgtaaaattcagcgattttagtacattaacaaagttgtacaatcatcaccattgtttctgtgcagaacattttcatcttcccaaaaagaaacccgttagtaatcactccctgttcctctcgcctcactcgcagcccttggcaaccagtaatctagttttttgtctatagatttacttaattctaaactagacatttcatacaaatggaatcattcagcatgttatgtttttgtctggcaggtgccaagatttttgaagtatgctttttaatttttttctggtattttctagatttaaaagtttagatttttaaatctttctggattaaaaagaaaagtattttttttttttttttttttgagacggtgtttcactcttgttgcccaggctggagtgcaatggcacaatctccgcttagtgcaacccccgcctctcgggttcaagcgattctcctgcctcagcctcctgagtagctggaattacaggcatgcgccaccacgcccggctaattttgtagttttagtagagatggagtttctccatgctggtcaggctggtctcgaactcctgacctcaggtgatctgcctgcctcgggcctcccaaagtgctgggattacaggcatgagccattgcgcctggctaaaaaatgtatttttaaaaatgtattacaaaaaaaaaaaaaaaaaaaagctggccatggtggcaggctcctgtgatcccagctactctggaggctgagccggggagaattgcttgaacctgggaggtggaggttgccatgagctgagatcatgccactgcactccagcctgggcgacagagcgagattccatctcaaaaaacaaaaaaacaaaaaaaataaaatagtattctcacccttttctactcacattccttctgagctggttagtgttattggctggtatgtatccttccagtcacatctatttacccatatattcaaatgcaaaatatacatacgtagggtggtggtggttgtattttaaaatgaaattattttatgcacattactctgcatcgttgtttatctaagaaaatattttagctgttcctcaaaatagttgatagagatctgacacattcctttcagtattaggtaacattctgttacactaatgagcctcatttactcagccatttcactgaatgggtggatattcagatgttttcagttttttgacacttagctaagccttaagtaaatatcttgttcatatatccttgttaactgatgctcttaattctatagactagaatctaaaaactaggggttcctgtgtcaagaacatttgcatttaaaatttgtaatagttattactagatttacattccccaatagttgcagcaggtcagagtttcatccccactgaattgcctattttcctgcatttttgtcaggattagctgttgttaaatctttaaaattttgccacactaataaggtgagatagtatctcatctcaggtattcttaccttctctttcagaggtaaactgtgtgatgtgatggatatgttattaccttgattgtggtactcattttagaatgtataagtttatcagaacatcatgttgtacaccttaaatatatacaatttttatttttcaatcgtacctcaataaagctgaaaaaatgtcattcagaaaggaagcaaacagtagatactagcattaaaaatatgttgtaaattttcaagcatagaatgataacataaggttaggaacaagaatatgtgtatagatttaaatatttatctctgtgaatattaatccatagatacaaatgttgaaggcaagttacaatcttgaagaaaatgaaaattatgttgtgtacctataatatgaaaataaaaaatcacacaaaggcatataccttcactcaaggatgtatactcgagtatacatattatttataatagcgcaaatttgaaaacagcccaaatgtccctcagctggtgaatgaataaaccagtggtgatgccttggaactgtggaatactattcagcaataaaaaggaactactgactcggcaacatgtgtaaatctcaaaaatattatgctaagtgaaagaagccagggtcaagagatgacatactatatgatttcttaaaacttccagagaagacaaaattcaggacagaaagcagatcagtggatgccaggagtgagagttaggggaggaaatttattgcaaaggagcagtaggggattgattgtggtgatgtttgaaatgttctatgtcatgatcgtggttgtagttacatgactattctgaaagttcatatttaataagtgatataaaagaaaaaagtattaatggcttaaacattaattttccaaatgagagcactaattaaaattctcaagtgttgagaacaaagatagtatctcattgtaatttttattctttttaaggttagtgaggtttgaaaacagttcatatgtttctttgccatttgcatgttttcttttgcaggtgcctgttgacttcctttacctattattctgttatgttgcttccagttccttatgaattcgcggaactttttgtatattcagagcagtaatcctacatttttagtctgtaaatgtttttccagtcacctgtttcttttgactatagtatctttttttaaaaagaaatatttgaaatgtacaaagaatgtaacagtttcccatactgctattaacatttttatattttgctcatcttttgagaaatttatatatgtgtccacgaaaagagtcaaactctataaaatattttaagagatttattctgaaccaaatacgagtgaccatggcccgtgacacagccatcaggagttcctgagaacatgtgcccaaagtggttggggtacagcttggtttgatatattttaggaaggcatgaaacatcaatcagatacatttaagaaatacattggtttggtttagaaaggcgcgacaactcaaagtgggggcttccaggccataagtaaatttagacgttgtctggttgacggttgagtttgtctgaagacttgggattaatggaaaggaatgtccaggttaagataaaggattgtggagaccagattttgttgtgcagaggaatctctcagcagacttcagagagagagaaggttgtaaaatgtttcttattagacctaaaagagtgcctggctcttagtcgattaatctcctggatctggaaaggaaagaaggaaaacaaagggaaaaggggattctctatagaatgtggatgttttttccccacaggagactttgcacggcaaatttcaaggtatggcaaggaaatatattttggggctaaatattttttccttgtctcataatgttatgccagagtcagattgaaaagtaagtcacgatatatagcgtcaaataaaacccatctgatgagaatttatggtttgtagggcatgacttcctagaccccttaggtaggagtttgggcaagttaaaaaatcagagctaagtcctcacatggcttttaaaaattgtgaataagtaatacttccataaattctgatttaattacgaatcccactaatttcttttttttctttcccagggacagccactgcaaagggttaaatgtatattcttccagtctagcttttatatttttatgaggatggggagatagacagataggtatatagttcagtgtttctcaaagtgtggtctttagaccagcagcatcagcgtcacctggaaatttgtgagaaatgccagttcttagtttctaactaaatacttagtttctcactaaaaacagccatttttattaagtccttcaggtgattgtgatgcacattgaagtttgagaaccattgttcatctaggtcattgtctttaactgctgtatggtgttccctaaattgaatataccattttttaaaaaagagactaagtcttgctattatgttgcccaggctggtctcaaacttctgggcttatgcgatcttcttccacctcagccttcagatagctgcaactataagcatgcaccaccgcacccagcttgaatgtaccatattttaaattccatattgtcaagcatttaagttacttttctttaaaaaattaacgttattgcaaaggaaacaattggcagagtgaaaagacaacctacaggatgggagaaaatatttgcaaagtatgtatccagcagaggattaatatccagaatatacaaggaactctgatatctcaacagcaaaaaacaaaacaaaacaaaacaaaacaacaacaaaaaatttaaaaatgggcaaaggacctgaatagacatttcttaaaagaagacagacacatgaccaacagatatattttttaaaaaagctcaacatcactagtcatcagggaaatgcaaatcaaaaccacagtgagatatcatctcaccccggttagaatggctactatcaaaaagacaaaaaatagcaaatgctggcaaaggtgtggagataagtgaactcttaaatgtggctagtgggaatgtaaactagtacagccactatggagaacagtgtgaaggttcctcaaaaaactgcaaatagaactaccatgtgatccaacaattcattactggacgtttatccaaaggaagggaaatcagtatattgaagagacatctgtactcccatgtttattgcagcactattcacaatagccaagatatggaatcatcctaagtatctaacaacagatgaatgcgtaaagaaaatatggtatatatacacaatggaatagtattcagccataaaaaagaatgaaattctgtattttgaggcacgtggattgaattggaggacattatattaagtgaaataagccagggacagaacattaaacactgagtgttctcattcatatgtggaagctaaaaaaaagttgatctcagaagtaaaaagtagaacagaatactacaggctgggaaggatagggtgcggggagggtagggaacgatttgttaaaggattcaaaattacaactagataggaagagtaagttctagtgttgtataccactgtaagatggctgtaattaacaatatgttacaaagtttcaaagagctaggaggaggatgttgaatgttcccagcacaaagaaatgataagagatgatgggtatgctaattaccttgatttgatctctgtatagctatgaaaatgttactatgttcttcataaatattaatacatcaaaaaatttaaaattaataattaacaaaagataaagggccctgaactctagttttagagctgaattgtatccagtcagatagtttctatgttatttaaatgttcactttaaatttggagctgaaatatatttggaaatctttacttttagtatgttcatttgtgtgtgtgaggtaaacttggttggctattggcaaatgtattgggtagctgcttaataaaacatttccttccagtgcttcagctttctgatgcttagaaaatatgtataattaacataatatgcattatcacttttgaaagtaactaattattcgaacagttatttgtgccaaattagtaatgtgaatttgggaactatcagtcttttctatggcccggaataatttaaataatagaaattatctgattagatagaaatcattgtaaaatcatcaaggttaggatttcctttgacttttgcttatcattagttttaaagaaaaaaaataaattgacataatggaaattttcactgtacatcaggaagggaattcagtggaaaagtaagcttcctattcactcttgaccttcagtttatactttttttcctaagtcaagtactgctactggtttcttatgctctttctagaactagcctgtttattgtctatttaaaataactcattaatcaccttttatttgagctcccttatggatctgtgtagtttttctgtctctttaaaattttgtatgcggtaaaatgcacgtaacatcaaatttaccatcttagccatttttaagcatacagtttagtagcactatctttcacatcgttgtgcaatcaatctccaaaacctgttcatcttccaaaacaaattctgtatctattaaacagctctccgttcttccctaccctcaactcctggcaaccgtccttttactttctgtctctctgaatttgactacctcatataagtggactcatacagtatttgtctttttgacatgggcttattttacttagcataatgtcctccagttccattcatgttgccttgaaagacaggatttcattcttttttttttatggctgaaatagtattcatccatgttgtagcatgtcaggatttccttcctctttaaggctgagtgatatattccattgtatatatataccaacattttatttatctaaattcatctgccaatggatttttcagttgtttccaccttttggctattataaataatgctactgtgaacatgggtgtacaaataacttcaagaccctgcttttaattcttctgaatatatatccagaagtgtaatttctggatcatatggttattttatttttgattttttgaagaatttctgttgtttttaaagtcacttttgatggtttgttctttgctagaaaatatatatttcagttttatcagtgcagagttgtatataatacttacatattttgtacaattatataaaggttatattatatttccatattctcatataattatctttagtatccatgtttgtaactgtttactcatttctctttcctcattcacgtttactattttattggtctttaaaacctaggctttgattttgtttcctagcatttaaatttttctgtttcattaattttagctttcattttatttatactgttatttcttgaggcaatggcttggttcatctattttcagtttttaaaaaaactgtaaagtatttgtaaggctctaaattttattttattttttagttataggaatttttaatatattctggttattcaccccttatgagatacattatttgcaagtattttctcccactctgtggattgttgtttcatcttcttgatagtgtcgtttgatacacaaaagtttttattttgatgaaatccagtttatctgttttttcttttgttgcctgtgcttttttggtatcatatacaagaaatctttgccaaatccaatgttgaaaatatttttttttcctatattttcttataggagttttatagctttactgttaagttttggtctttgatctattttgagttaatttttgtatatgatgtaagaaaagggtccatcttcattcttttgcatgtggataatcagttttcctagcatcatttgttgaaaagaccatcctttctctattgaatggtcttagcatctttgtcaaaaattggtcatatgtgtgagggtttctttctaggctctctattccattggtctgtatgactgtgcttatgctagtaccacattgttttgattactgtagctttgtagtaagttttcaaataagaaagtgtgagttctccaactttattctttttcaagatagttttgactattatgcggctctttgagattccatatgaattttaggatgggtttttcctttttttttttgagatggagtctcgctctgttgcccaggctggagtacagtggcgcgatctcggctcactacaagctccgcctcccagggtcacgccattctactgcctcagcctcccaagtatctgggactacagggacccgccaccatgcccagctaattttttttgtatttttagtagaaacggggtttcaccatgttagccaggatggtctccatctcctgacctcgtgatctgcccgcctcgacctcccaaagtgctgggattacaggcgtgagccaccgcgcctggctttttttttttttttttttgcaaaaaataccattgggattttgatagggattgcattgaatctgtatattgctttgggtaatattgttaccttaacaatctaggaacgtgagatatctttccatttatttatgtttaatttctttcagcaatgttttgtagttttttattaagtttttcacctccctgattaattcctatgtattttattttggatgctatcgtaagtggaattgttttcttaatttcctttttgtatttttcattgctaatgtatagaaatccagctgatttttgtgtgctgattttgtattctgtgactttgaatttattagctctaacagcttgtttttggtgtgtatgtgtcatctttagggatttctacatatatatcatctgtgaatagacatagttttgcttctttctgtccaaattcaatgaattttccatctttttcttgcctacttgctctgtccggaatttctagtattatgccaaatagaagaagaaaaagtgggcatcctcatcctgttcctgatcttaggggaaaaacgttcaatctttcactattgagtatgttgttagctattggtttttaatacatggcttttacgatgttgaggaaatttccttctattcctagcttgagtgtttttttatcataacaggtgttgaactttgtcaagtggtttctctgtattgattcagatgatcatgtggagtttcttcttcattctattaatgtggtatattacattgattttttcattgttgaatcatcttgtgctcctggagtaagtttcacttggtcatggtgtgtcatccttttaataggctgctgattttgttgagtttttcatcagtattcctagggtgtattagtctgtagttttcctgtagtatttttgtctggctttggtatcggtaatgttggaccatagaactaatgaagagaagtgttcccttctctttaatattctggaagtgtttgagaagcattctttaaatgttgggtggaatcaaccagtgaaagctatctggtcctagccttttctttgggagctttgtgattactgattaatccctttactagttatagttctatttagattttctatttcctcatgagttagtttcggtagactgtgtgtttgtagaaatttgtccattttgtccaggttatccaaattgttggcatacagttttacatagtatcgtctcataattctttttatttttgcaaaatcagtagtgtcaccactttttttgttgttgttgagggggtgggggggatagagtcttgctctttcgcacaggctggagtgcagtgacaagatcttggctcactgcaacctctgcctcctgggttcaagtgattctcctgcttcagcttccctagtagctgggactacaggcatgcaccaccatgcctgtgtaatttttgtcttctttacagtagagatgggggttttaccatgttgatcaggctggtcttaaactcctgacctcaagtgattcgcctgctttggcttcccaaagtgctgggattacaggcatgagccactgcatctggccgtgtcaccactttcatatctgactttagtaatttggtgttctttctctctgtctctcttttatttatttatttttttgttaacctatctagctagagttttgttgactttttcaaagaatcagcttctggttttgtaatttttctccattgtttttctgttctctcttttcactctaatttttattattttctttcttctgctagctttggtgtagtttactctttttctagttccttgaggtatatggttaggttattgaatgagaactttcttattttttgatgtcagtgtttacaggtttacatttttcttttagctctgcattcactgcatcctataagttttagtatgttgtgttttcgttttcatttatctcacgttggtttctaatttcctttgtgattttttcctttgatctattagttaacattcacaaattttcacatatttgtgaattttttagtttttttatctgctgttggtttttcatttccattatgatcacaaaacatactttgtatgatttcagtttctttaaatgtattaagacttattttgtagcctaacataggtctgttttggagaatgttccatgtacacttgagaagaatatattgtgctggtgttgggtgagtttagtttttgacatgttacatttgagcattcatttaggagaaaagccaaaggaagacatttgttaatgaactgtaaagaggggttgacatcacaagaataggtaattttttttgagaaacaaatttagagcaacagaacagccttgaatatattcttatttagaaggctgaaggttgaatataacctggagtgttagaaaagggtggaacagtttatcatagaccagagccaagaaagtataatatttagactttaaatatcaaaaagaagatatggtcagctgaattcaaagttgaaggctaggtgtggtggctcatgcctgtaattctagcactttgggaggctgaggcagaaggatcacttgagcccaggggttcaagaccagcttggccaacatggtgaaatcctgtctctactaaaaatacaaaaattagccaggcatggtggcaggcgcctgtaaacccagctactctggaggctgaggcgggagaatcgcttgaccctgggaggcagaggttgcaatgagccaagatcgtgcctttgtactccagcctgggcaacagaggaagacaccatcttgggaaaaaaaaaaaaaagaagttcagaaaacagcttgtttgggaaggactgttttttgtattcctttaataattcaataaagaaaatagaaaaaggattttttttaaatttgagaaacatttaaatgatgaccactacttaaattatgaaattgaaaaccacaaatataaattatgcattctttatagtatgagttttagaggctgttaatttgctataatattagctacatctggaatagaagaaacttcatatattatcttatcgctatatttgaattctgtagaagttatttctggacagtctacgaaaagctcttgctggccatggaggaagtaggcagctgacagaaagtgctgcaattgcctgtgtcaaactgtgtaaagcaagtacttacatcaattgggaagataactctgtcattttcctacttgttcagtccatggtggttgatcttaaggtaacatgcttattctttctctactacaaactttaagaaaattaaatgaattttctagcataagtattatgtcaaagataattgctaacattaaagttctgactcttcgttgataagttcataggacttgcttttgttgttactgtgttcatcagcctaaatggactgagaatatgaagaaaacaccattttcttaaataagcataaatatacagacttgggtttaaaataatgtggcaattagggcctgaaatgaacctatatatggtataggaagaattgtatcagactgatgaaccacagtatgggtgctttgtgcttcttctggcagctggattttactgccatttgtgtgggtaatgtgttgatgttattacatgttagtaaagaaatactgcatgggtatttaaaggcttttgttttctgttggggtttttatagaacctgctttttaatccaagtaagccattctcaagaggcagtcagcctgcagatgtggatctaatgattgactgccttgtttcttgctttcgtataagccctcacaacaaccaacactttaaggtgagagcattggtttttatctaactatatttactgatgctgttatcctttataaacaaaaagactatagagattaataggttcacttttatcggtatttctcactattatgtattgatgttcgtttcaagaccttaaaaacttagtgttttttttttaaactttctatttgctgttctttttggcttcatttgtattactgagtatttttctcatagaaataatctgcttttttttttctttttctatagatctgcctggctcagaattcaccttctacatttcactatgtgctggtaaattcactccatcgaatcatcaccaatgtaagtccaaaaggtattgctaaattactaaaaaaatttttttctttcttttctttgcgtatttctttttaagaaatgcactcttggttttcaaaaaggttctgaatttagatgtatgaaataggaaaatttctccatggtgattctatttgataattgataaatatttgtatttttcatattaagtcttgaccgaagggaccatattaaggaagatggagttaataagatgctttggaaagattaaatctaaaacgttttattcagatcagaagcccttgagaaaaatgtcactgaaaatacagtttaaaattttcatcccgaagcttttcaaacatattatttcagcatttgatacattgacttgccaccttaccatttaagttaaaagtaatagtatttatgttgtagtctagtatagcacattgacaaaatgatgggactatatttgatggtacttttaaatcttttgatcctaaattcattcatagtgtaaaatttcatttttcttaaacaaaatgaaatattaacatactttaaagtaggtattaacaagatacaaaagcatatcagacaaagtaagtgaaatcattaaaaggtacttgcgaaaccttcaactctgtctgatgtggagacattaaatagacagcaaaactatcagatttggactgtggatttttaaaattctgttcttgtaataatgaacaaccctattttgaaagttttcaagtgttattttccattgttccacttttatcaaatgatactcacatttatgggtaaattggttgatgctttccttccttaaaggaggctgtaatcattgataacttagtatatttgacctgtttataatcaaattccattttaagactgtgcctctggtgagttgaaaataacccttcacctcatttgccctggatgttgtatttatttaaaataaatactgcccatattctatccattcctgcagtggaaaattaactattgataaagctatttggtgatacatttaatttttctcagcaggtgtttagtgagcattttgggaggacagtcctttgttgtgcaggatgccttgggcattgcaggacctttaagatcgtctggcctcatttcattaaatgccagttgtgctgcatctccccatccctagtcattatgaacaaataaacatgcctgagggaatgatacctcctcccttagttgagtatcactgagttaaattgtaggtaaaagtaacattgaatatgctttgttccaaaagggaaagtttaatgaagattgtaaataaggtatgtttgtattaaaaacttaaaaaaaatcactgtacttttgtcagcgtaatgagccagggcattgtaccttcaaggtttactttcaaggccattaaaacaaaaagatgatttctcccctcaagtttatgtgtaactcagaaataagtcattattgcttttttccgctgtggctcagaacactaaaaatattcaaagagtggatagctttgcataaatgcttaaaatttgtatacaataaacccaaatatatacttttttgatactttgtggctagttactttaattgtgaaatatttttgtctacaactgactacatagagcactttcaagcatggacttggcactgctgtaagtggctgagctgctcctttctgggttccaagcatgcctggagtggtgcttcatgcatgcctcagtgtacttggtgaaagtggctgtgcatcctcttctactctaatgagcactgcatgtgtggagggtggagtgtgtctgtatcagagatcaagttatatgaaaatctgtttttataaagaaaaaaactacattgaataatttttaaacattaagtatcagtaacttttcaatgaaatagcttgaaaaggaacataaatattagttcaaagtatctttttaaattatgctttgggtagtgatactttattattatagatagtgtgggaaattgtttctcgttaggatattttcccccttggtttgaggctaatcgctattgaatctgaagtactcttttggttgaaaaggactatttataaagtgaatatagaaatttatgagattgactattttagagtttcatttgaagacatttattatggcaatatttttgtcttgaaaaatcacatgaaattattcttagatatttggacttctgatcttaaattcattcgtagtgtaaattttttttctaatgattcttggttcaatgtacctcataagttctcttctcccatggttctttagccagtccacacattttttttaaagcatcacattctcaaataagataaaagttttagtgatgtgtattgagggtttgtgtagaagtagtaaggtgtttggagttctacttttgtgaaacatactcatactcagttcataagtactgagtttagatctaaaatattctagtgtttcttcttagaaaatctaaaatatatccactatttgattcttattataatgcaggttcctagcagttactaaaatagtagttgtactgtcatcttttttattatgatgtgccataagagatgaattaatagttgtaagatctatgttatatgcataatcttcatagacttcctttaggttaaattagatatgtaattgggaaatttaaaaagtaatatacacacttatgaaccaattatcttagccatcactggtacatgctatagctggtatattacttatttctgttttttccttacgacaatttatcgtaatttacatatggatagttcacatactgaaaatgagatgattgctttctactgagaggttgtagttgaaaggaattgtttccaaggcatttgaaaattatttaaatctcttaaggaattgccacataatttgttcatattatgtaagtgttgccatttggctataaacatggtattttcaaggaaaaaaagagtaagtctactttaattgactggtgttcaggaagggcacatttagtaactgctcaaaatactaaacttttttgccaaccacatgatgtctagtttttcatacttattttatttgaaaatgtgtattttactttaaaatgaatatattatgaaaaatgaaaactatgaaaattactaaatcttaagcctaaagttattttatgtggtgcacctggtaccacaatacggtttcaaaagctattaaaaaaagacacagtaatttgaataggatgttatatgggatgcctttcttagtttatcagtttctgacaagatcttacgagatgtgttgggtaaggaagacccttcactcaatgtactttgttattattcagctttttgttactttaggctgattaacacaagctgtataatttagtaagtataaggaaatcaagttgcattggttgctttgggcaagtcaaaattgctgagagttggaggaatccattatactatcagactaaaaattgatcatttgtagaaactagattaaataaagtaggagttgagggaaaaatgtaaacaaccatactgtcccaaaaaagcatttcttccctcccagttttgggattcctccctgaatggagttcagtattcaaaatgtgtatcataagttggttttatattttactatccggcgaacaggatttgtaatccacagtttgggttaaggtaatataactcgatgctattcaaaatattctgagaattccaagtgaagaaattaaaatgtcgagacttcaattagcttagttttgaataagaaaaaatctgggactgaaatgtgagagatgtgaggctattcaatccctcttatctacaatttgaatgtattattcttccagattttttaaataaacatctggagtattataaattagaagcctacattttaggtcatttaatgcatagtctacatatgtagtgaaaattcatccagtcagttttttattaaatgatagactttaaagatatagtgattttcacaattgtcattttttaataatatatcaagtaattcattttaaagttaaagatacacttccaaataaaataggcactaaaaactagacatcagagttaaacagggtaaattgaaatagaaaatacataaaataattgtttaaaaaatatttcactaggatcagtttgtctttgtttatggtaattgttagtctcccatatatcatgtcatcattgcatatcaatttataggtttacttaatagttttatttcatttactaatttcatgttgtaattatcattgttgtctgtaaacatataagtaatggttttccacatacacttttaatactgtgttgaaccactaatcacttttaaagctttgataatagcattcttacctgggaaaatatatgccatgtatgcacgtgtgccagaaattgtaaaacattaaacttaaaaaaaaaaaaagaagattggctacagattagctctctgaagactttatttttcaaattcactggctaatcatcgagaaaagatgtctcacatgcacatgctcataaagtgggcaatttgtctcatgctcactattatgttttataatataatatgtatgagttagtgtttgaattaaagacgttgtttgaagactttggaaatcatggtgtgtgtttgcatggtcttagaaagttcccgacaaaaggataaaacttaaaactacagtgataaacagagcatacaactcacgtaattttgtactttttcttcctattggtctttgtttttctctagtccgcattggattggtggcctaagattgatgctgtgtattgtcactcggttgaacttcgaaatatgtttggtgaaacacttcataaagcagtgcaaggttgtggagcacacccagcaatacgaatggcaccggtaagataaatcacgaattttgaatctcacctcctttctattgcattttttttagtgtctttatcctattcctgctgctttggttattttagagaattgaatgggtccttcatttcctctaaatgttgtggtatgttgtatctagaatattgttgaatactagattatgtttgttttccactgtttccatgagttgaacttaacttttcttagataaattttctcacaaaacactgaaagtcttaatgaatgtcaccttttttttctgtttttaaagttttttttctccttaaaacttttgaacaaaaatattttgattagcctctcacgttttggggatgagtaagggaagctgactcctgggttagagtgaatgttgctgccaatgcacattttagctaattgaatggtgactattaaacataggaaatgaataaaatttagagtttttgtatttaaaataaaaatattttgtatttcaacaaatatgccttgaggttttacaactgataggaactttgatactgacatttgactctaaacttaataaaaagcagacttaaaattgggtattctcacagattattactcttaatatggaattttaaaactcctatggaatcaatttaaaaagataattataagattgtggaagtcatttttttggtgtttatgtatagcaagagtattatacaagagcaactcttgacattgattggtggtgctttgtcttctgcttcttattttctattattggctgctgtcgctcacatgatcagatgccaaccagtcactgttttgcatggcagtgggcttctgtggctgtaagtatgacccattgtaactacatcagaaaagtccttggtttctttgacttttctgtgtatagttaccattatagtcacatcttgtcatttcaactgaaaatatagcatgtcttcacctgttggttttatctagtaagttagtcatttcacagttaggagataatttaaacagctttctccctggcatgcttctctttttccaagtccccttagtcagtgaaatattttggttttatacagttgtggttcactcttatccagttgtcagtaattatttctgaggattgtttatcttagatgttcaaatagagaagttttttatgtcatatattttgggattattgagcctaaaaaatatagccaaaagatcatggcaatgatgtttccttaagtaaactttaaaatgcaaggttaccttttagttgactttttgtaatgccaagtacttcacttttttttaagttgaagaaattttcagtacaggtataagttaattggaggtaagcataaataatagctgtttaaatgtcatttaataagatatttttaaaaaatcttttaaaactacttgaaataagttgtttaaaagttatttattgacctgtttattccagagatctgggaaatcagaagtttatttgacttttttgctttaagtttactaccttttctggtagaaagttaatgacctccaataataggacttgttggggggttaatattcacttcctatttaacttcaatatccactttaccagctgcccataattttctgtgaataaggactaaaaatgaaactaaatgattattttgaacagaggtaaaatttgattggtagtctaaatatgttctctacacttagaagttattttacttcttagccctagttataagctgattctcagagctacatattattttaccgaaaagccataactagagaggatttcctcttttggctcaaggacacctgtaataagaatttagtttttatttctaattattttctgaaaatatcaatatacatttaattttcaaaatcattcctaagctgtttatgtttttgaaatgttatatgtatgtatatttgtacataatgactaaaggacagcttttgggctgatattaccaggagagaaaataaatagcaaatgtaatatgaaacaatttttagaataagaaaattttaggttttgaatggctgttagggtaaaatctcacccttcataaacttggtgagttaacagtcagataaccagtatggaagtattgaccttctactctttgccaggcaaaggtgctaatgccagggaagcatggtgaactaaacatacacagcacttcccctcaccgagattccaagcaaaaggtttatagcttttgcttgaaaatgtctaatgaagaactcaacaccggacacggtggctaacgtctgtaatcccagcactttgggaggccaaggtgtgcggatcacctgaggtcaggaggtcgagaccagcctggccaacatggtgataccctatatctactaaaaatacaaaaattagccaggcgtggtggtgcatccctgtaattccagctactcaggaggctgaggcagaagaatcgcttgaacctgggaggcagaggttgcagtgaactgagatggcgccattgcaccccagtgtggacaacaagagcgagaatcggtctcaaaaaaaaaatcaaacaaaaaaactcactacaggtggcatggagtctggcaacacaggcaaatatatataataaatggtttacagataatacctaacatcagagtttcctactgttggcactattaacattttggactggataactctgttatagggggctgtactgcgcattgtgggatattcagcagcatctctggcctctacccactagatgccaatattccctttaccccccagccctccaagtcatgaaaaccaaacatgtctccaaacatttccagatgccccttgggggacaaaatcacccccagttgagaactactgtattacagagtatgttcagtgggttgtccctcatttgtattgcctcaaatgatttgggactgataaacctgagccattagcttgcttcagaagtagcaatctaggagttctgttgcaaaacagtaaaagtaaaataatatctgcttcaaggctttactaacactttgtattttggagagacaagttacttgttggaaggagctaattatttgaaaattttctcttcgaccaagatagaatcatgtctctgtcacttacagccatcactgatcctctttctgttggagctctatagaatacttctgattcttccacaaggtggccctgcagatatttgaataaggttattctgtactcctagaattcgttttatttttatatcgttttggcattggaagggattttattcttttagctctctctctttttttttcttcttgagacagagtcccactccgagtcccactctgtcacccaggctggagtgagtgcagtgatgcaatcttggctcactccaacctctaccttccaggttcaagtgatctcctgctttagcctcccgactagctggggttacaggtgcccaccatcatgccagctaattttgtgtttttagtagaccatttagcaccattttgggcaggctactcttgaactgtgacctcaggtgatccacctgcctcagtctcccaaaatgcagggcttataggcatgagccactgtgcctggcctcttttagctctctttaaaactgtatgtgtgtttgttgggtctgtttttatagctaaagaaactgaagcttaaataaagttatattaataacaaatgcatggttaatgaacagtcaaccagagttagttctgaggtttcttgacattcagttcagtgtctttatcaggttctttagttgtccttcttcactagcaagttagcttgatgaaagcagtagctttgtctggcttaatcaacactgaatccctaacgtttgaacaacatctgatacatattgggcatttagtacatgtttgcagaatgaatgaaggaatgaatttcttacttgatgtggtttcaaaatcctcgtacaggccgggcacagtggctcatgcctataataccagcacttagggaggccggggcgggcaggtcacttgagaccaggagtttgagaccaactgggccaacatggtgaaaccttgtctctactaaaaatgcaaaaaaattaggcaggcgtggtggcaggcacttgtagttatagctactcaggaggctgaggcaggagaattgcttgaacccgggaggcggaggttgcagtgagccaagattgtgtcactgcactgtcagcctgggcaacggagcgagactctgtctcaaagaaacaaaaacaaaaaacaaaaaaccctcctgtttctgatttgcttctcttctggaaagaccaacctgacaaaaatttttaaaattaaaatgccatattaagatctgatgttagtgatacagatataatactatgatgtaataattgataaaagctattaaactgctgtgtttgtataccctgtttctattaatacaatctaagatagtattattattttatgttgactttttagttatttaaactctttggccctttttatatgaatgttgagccataacttctcctttgtacctttgtagtatttttttaatatttgaaatgtttgtcttagcactgattttactatttgcaaactaacatctcctgctttcataaaattcaaaactgccaataacagatatatgaattttcacaagtatttgttatttctcaacattttttatcttaagtggcatgctggctcaccagatctttcttacatgcctgttattcagtcacatggtctaaattaacaagtggtttgggcctttaatagatatctgaagactctggttcatgaatttcttcccagacatgattgcctctcatctttggccagatcacatgtaccagcttctattcctactaatacctgcaatatagaagatcaactaatgaatgaatgaatttttttcttacatttctaattaagaaacacattgcttctttagcatgtttttcctcactttctgtaacccactaaaattaaaaggtatttgagatgaattaaatttattggaatttctgaagtcatacatttcatattaggcaaccatgttggaacagaatttacatgttgatatttgggattaagaggtgacataattaaactaatatagtcatacatcacttaatgacagggacatgtcttgagaaatgagtgcatccttagtgattcagtcattgtgcaaacatcatagagtctgcttacatgaacctagatggttatatagcctgctacatacctaggatatatggtctagcctactgctcctaggctgcaaacctagactaaacagcatgttactgtactgaataccttaggcagttgtagcacaatggtaagtatttgtttattcaaacagaaaaggtgcagtaacaatacagtataaaagaaaaaaatgtataggacacttaacacaaatggagtttgcaggactggaagttgctgtgggtgagtcattgagtgagtgttgagtgcatgtgaagcctaggacattacactactgtagacttaaaatttttttaaatttattttacttttaatacttttgcatttttctcatactcaggatctatactgtagactttataaacactacacttaagctatatcaaatttataaaaaatatttttatatgataactttacagtagcttttaaaatataaacttttaaattttttaattttttgacttgtaataacacttagcttaaaacactttgtatagctagctgtataaaatatttttctttatatcctgtaagttttttctatttgaaaatgttctattttaatttttattttgaaaactgttttaagatctgggacacaaacatacacgttagcctaggcctacatggggtcaagatcatcaatcagtgttactgtcttccacctccacatctgctcccattggaaggtttttaggggaaataacgtgtggagctgtcatctcttgtggtaacaatgccttcttctggaatacctactgaaggaccttctgaggctgtgtttcatagttaactttttatctttaagtaggagtataacaatacaaagtatactatagtaggctgggcctggtggctcacgcctgtagtcccagcactttgggaggccaaggcaagtggatcacctgagatcaggagtcgagaccagcctggccaacatggcaaaacctcttctctactaaaaatagaaaaaaattagctgggcgtggtggtgcatgcctgtagtcccagctacttgggaggctgaggcaggagaattgcctgaacccgggaggcagaggttgcagttagccgagatcgcgccactgcactccagcctgggcaacaaagtgagacttggtctcaaaatatatatattataataaatacataaaccagtaacagttatttattctcatcaagtattgtatactgtacataattgtatgtgctatactttttttttatatgactagaagtgaagatttgtttacaccagcatcactacaaacaataacgcattgtgcttggacatcacgatggctatgatactaagtgataggaatttttcagctatgttacatattgtctatcattgactgaaatgttgttttgtggcatatgactctatttacgttttttggaaatgattcttaaggaaaaattctgatacctgctcattgttctctgatcttgtgttcctgtgcaatggctgcatcagggaagagccatttgatagttacacttagttacatcaaagtaaataaattcgtttaatcaaagtttcagcttgatctgaggtgaaacacctcaacttagagtgaggaaaaaaatacagttgaaagagagcaaacagtaaaaccagaatttattaaatcatttagtaaaacatttgctttggggtcagggggcagttataaaaagcaaactatttggaagttttgctatttctcttctgtagtgacattcttgagtataaatgtgtgcattaaatagctattcttccccgcaaggactaaaacccttcggtgttcttgggtataataacaaatgcatatttcacttaaacattgaggatagttcatttgtgttgtagatatgcatgtctgcttcttaactttgaaagacagcctgtttacctggacatttgtattatgggtccacagttggtacacagtcttgttatttctgtattatatatatgtttacataaagacattcattcagaatcagatagttttgtgttcttttcaaggaaaaaaggaaggagatgttttataataataggtgatgttagctctggaatataattgttggatttttggttgaaaaacatttataattattttaattcatcatatgtctctataattgaaacatattttctgtaagtttacctttctgagttctttctgttttacaaatgttcttcaggcaaaatgcatgcattctgtaacttaaaagaggtggagtgccgtcgaaggaaaaagcaaattttacaattaaactagtaaatacaaagattgcctacatgtttcattaattctaagaagcacttatttttactcttctctaaaattgggaatgtatcttattttaaatggtgtcttacaattgacagcagtttttcattccttttgggacatcaaataatgatgcatcttacaattgataatgttgtagagtctatgaaatacttgtatgtatgtctggggaatgtttgttaaataaattacccagtgtgtatatttgtgagaactataggccaaatcttttttcccttatgtttttacattttagaaaatagttttttacatagatgttttacaacctgatactaagcttttagtattgtaatagattttcattgttttattagattgataaaaaaaaatataaatggtgcaaaaacgattttcattgttttgttaagcttaataatactgaccttatgcttactattgagtgtttctactaataccacacatttggtagtataaaaaatagcttttttcaaaggtttttaataataaatttcttttaaaaggttggatagctattatcctgagtcttatgtctgataccatgtttttgttttgtttttagagtcttacatttaaagaaaaagtaacaagccttaaatttaaagaaaaacctacagacctggagacaagaagctataagtatcttctcttgtccatggtgaaactaattcatgcagatccaaagctcttgctttgtgtaagtatttttttatgaaatgtctcaaaattatcacactaagttaattgggtttagctgaaacgccaagaccttgaggataatttttagctcaagagcacttactgatcctttctgatcatacctgaaaactaagacgtctctaagaaaactaatgtataatgaatactaatataattagatcagattcttaattgcccttatcatttcctaacatttctctttcttcttaatttccctatcattaaactaacatactttgatgagatctctgttctcatcctattactaagttatatattattcaggtataatcctggtatgggggatagaagtgaccatcgatcacagtgtctacatctatactgttggtttaaaaaatctccagattgcttttgccagtttagcttttctatccccctttctttgtgttatcagctttctgttatcattggctctgcctacaaatactgtattggaaaaagaatgaggtgaaaatgggtgtggttagtacttgagttagtgtgattatcattattattattattttgagacagggtcttgctctgcttcccaagctagagagcagtggagcagtgatggctcactgccttcgaactcctgacctcaagccatcctccagcctcggcctccccaagtgctgtgattacaggcatgagcccccatgcctggctagtagtcagttattgtcataactactcttactgcctcagatgatattaaatttctgagaacatcactctggtacacagagtaattaggaacaacgcaaataataaaaatgagtcataatgaagtgattaacagcatggacgctggagactacctactagctatgtgatttggatgactatttaatctttctatgccttagttttctcatctgatatattgggatcataatagttcctatctcagagatactgttaggaaaattgaaatagtacatacaatgctttaggaacaatgcctggtgcataataagcactaaataaatgttagctattattgctattaataagatacaatttaacactaattaatgcaccaaatgtaatagttctatattgtgtctttcataggatgacatgtttaacctttgttgagcttcttcagtccctggagagcagcatcaagcaaggtttcttatcgttttgctcagtaactggctttttaaaaagtgttaaggtgctttcgattttggtggcatattttttaaattactgtaatacagggagtttgtaactacatgcctatgattccaagagttctatgaaacttcgtgaattttttaaaaatgtgtatttatgagtaatttttcttggagagtggagaggagagaagaaggaacattcccaaaggatcagtgaccccaaaagaaggcctgtgatactttaagcctgaaaaacccattcaagtttgaaagtctaattagaataaacagatctttggcatgaaaaaattccataaaacctgtcagtgaaactctataaaaaaatgaagttccctttctcttcattcctttgttatgtgttacaagctatttgtggcattatttcatcatgaaggtcacataatactagcagtactctgtttacgtggtgataattcacattcaaagcaggcaccaaactcaccaatgccgtttctactaaatgttgcttcaagaagaatttaagcaaaacttgccattttccaaggatcatttaaaatggaaattatttgctttgctgccatctagtggttaataagttttctcaaggtaaccataagtacattaaaatagaagattcgttgtaaatatttgaccattttgtcttttacataaaaaatctgagtcttagtaatttaggaggaatgtaggaataattattaaatggtctcaatcatggtatttttaaagtaatatgattttgtcttccattttagtactctcaatttctcaagcctcctaattactcagcttgcatcgtttcttagatccccctgatcatttctccacactgaagttatggcagtctctttaaaaagcaaatcttattatgccccctctcagcttgaacccttttagttgaaattgctcttgcttatgaagaccaaactccaaatagatctacagggtcgtgcaaaatctttctcccatctaccatttcttccacatgtagcattacattttttgtcttcctttactctattcatgatggtcttcctttcagtctttctaaccacatgccttcatacctcccttgcagttgcttttccctctgcctagaatctgcttactcttaacatagtaattcctactcattctaagctattgtcactgcactaaggaagcctccctgagtcggacacttttccatgttataggctgtcatagcagcatgtaccttaataatagctcttatgtgatttgcatttttatacttgttgatctgattatttcattgatgatatcttcccccatgagactacatgctcatggaggatgggaaacacatcttctctttttcattgttgtgtctttggcattcaataaaaatgatttggttttggatgaatttatatgaatgtcagaaaataagctaacggttttgaattacagatatattgcagtgagggcttaccttagtcattataatggggaaaaatctatagttagcaaaataaaatatgggacacaagttgcattggcttcatatattcttcttttttttttttctgagacagagtctcactatattgcccaggctagagtgcagtggtgtgatctcagctctctgcaacctccgcctcctgggttgaagtgattctcctgcctcagcctcccaggtagctgagattacaagcacccgccaccaaaccggcttgtacttttaggagagatggggtttcttcatgttggccaggctagtctcgaactcctgacctcaagcactccgcctgccttggcctcccaaagtgctgggattacaggcatgagccaccatgcctggccaaaccatatattcttgaagtgcaaatatatgcttccaagttaagagaaacattttagtctctaaataggtaggcattcggcagggcgtggtcgctcacatctgtaatcccagcatgttgggaagccgaggcaggtggatcacctgaggtcaggagttcgagaccagcctggccaacatggtgaaaccccatctctaataataatgcaaaaattagctagacgtggtggcgcatgcctgtaatcccagctactcgggaggctgaggcaggagaatcggttgaacccaggaggcagaggttgcagtgagccgagatcacgccattgcactccgtttcaaaaaaaaaaaaaaaaaaggtaggcattcacatttttacataacgttaattttctttgcttagtacactatatttttccacgatgaaaaggaccgaagtatgggtatctgccgatgcaaattctagcctttgctttgttaccagctgtgtggatttgggcaggacctttgtatgggtcaagagggctgtacaggataatcatgcaatccttatccaacatgtatgtcctttacctttgatcacaatcatgtataagctcaaaaccagtaagttccaaaccagagatacgttctttagccagtttactattgttggaaaaaaaattattcctcatattgttgatgtaatttttaatgggaattcgtggtttttgttttcattaggattttccctggacattattcacattaatgaacaagtatagatgtggattaaaagaatccctaacaaaagaagttttgatttaataaaatttttattttattgagataaaaatactatacccacataccataaaattcaccatcttaaagtttacaattcagttgttttcagtatatttacaaggttctgcaaccattaccactatgtaattctagaacttttttttctttctttcttttttttcttttttctttttttcttttttccagatggagtctcgctctgccacccaggctggagtgcagcggtgcaatcttggctcactgcaaccaccgcctcccagcttcaagcgattctcctgcctcagcctcccaagtggctgggaccacaggcgcatgccaccacgcctggctaatttttatatttttagtagagatagaatttcaccatattggtcaggctggtctcaaactcctgacttcaggtgatccacccgccactacctcccaaagtcctgggcttacaggcgtgaaccaccgcgtccagcctagttctagaacattgttatcacccctaaaagaaacttggtaccctttagcagtcactgtctatttcttcctccttctaatctctctcgatttatttatttttttaattgaagtttcctttttttccttgcagaatccaagaaaacaggggcccgaaacccaaggcagtacagcagaattaattacagggctcgtccaactggtccctcagtcacacatgccagagattgctcaggaagcaatggaggtaaggggaaaatgaattccatgttcttgaaggaaagattgtaactatgtacattcatgatgttcctttggtgtgtggtttctgtgagtaacaggtagatgtcatttctggaaatggtatgtttatgtctatacattgttttataaaactccatggagaaagaaggggtttacttgctttgtatcacatagcaataacattgtacaaattctgatgcttaataaaatagttcgagattttctaattgcagttgactttaaaatttttaaaaatattattattaaatattaaaaatactaatttttaaattgagacataattcacataccctcaatttggccattttaagtagttcttttttttaaattttattattattgtacttttaagttttaggttacatgcgcacaatgtgcaggtttgttacatatgtatacatgtgccatgttggtgtgctgcacccattaacttgtcatttagcattaggtatatctcctaatggtatccctcccccctcccccctaagtagttcttattcacacagttgtgcaactatagctactctctaatccataacatttttatcaccccagaaagaaacttgactccccattccctcatccctaccaactactaatctattttctgtctctatggatttgcttgttttagatatttcatataaatagaatcatagaatatgtggccttttatgtctggctaccttgacttaatgctttcaaggttcatttatgttgtggtatgaatcactattttcttcctttttattgccaaatatttcattgtatggatctgttttgttcatctagttatcagttggtggacgtttggtgttgtttctactttttagctattacaaataatgctgctatgaacatttgtgtaaaagtctatatgtggacatatctcttaagtatataggagtggaactgctaagtcgtgtggtaactctgtcgaacttttgaggaactgtcaaactctttttctgaagcagctgtatcattttatattcccagtaacaacatatgaaggttttaatagttctgtatgcttgctaacacttcttataatgtgtctttttgattgtagccatcctaatgtacatactgtacaaatgtttatacatacccagtaaaaatgtttataaaaatattttagcacttactacgtaatcattgcttccatttgtgtacattgctattggtcccgtaaattgatacatttcttgtagtctttttggaaggctatttggcaggagctatacaaacatttcatttttttatgcaaataattcaatttctatcactttaaaaatcttatgaatataactcaaaaggaaaaagctgcacacataggtacttattgctcttaattataatagaatattaagagagctttatttactgggaggagaatgggttaatattcaatagtgagaatgctattttaacttggtgagctgttaaacatttattaaaacttatatagatcacacagcaatatggaaaaatatgaaatgtcaagtgagtatactgcatttatggctttgttaaaacatggaaaatacaaaaaaaagaaggcaatatgaaaagaaaattaaagcctggaaaaggctaacacattttctttcaatatgtatttttaaagttttatcaaacaaaaatatagagaatttgtcacttaaaaaaactagtgccagtaaattgtaccacgtttttgtacaatagtagcaaaattgaattttaatttgtgttgtttttccttgatatgagagctataaattatatagctttttaagattctcaacaattaattgcaattttcattaaatatctcaaagtaattacaataaaaatgtttgaaataagataatatgggtctggcctttaaatgttgatatgttgaccaaggactgaaagaaatgtccagagcttcacagtttctgctgggttgggggtggagggatggtgggaggaatgtgaattgggattgtagaattggagttgagataagatcagttcgaaggaagagtttgtgttttttttatatctttgatggttttaatttatataataatctatttatatgttatatattgtaaatgaattatttaattcccgttagtgttctctgagccagattccaacttcagttctgtggtcaattgaaatactttagaatggataatctgctatgaaatactgaatccattttgcttcctctctcttgattttgaaaaataattgctcttttctgttacaagagactttgtggcaagtgagacagtttaagtaaaaacttaaaagataagtaaatcttttgctgtgtgtattaattttggcaagccttcttacttggggattagctttttgtttcatagagttctttaatatctattgaaattattttgtttgtttcttaaagcagtttttacagttatatattgttccgaattcatcatttagctttatatgtacatgccagttagagtcagaatgatgggaataaaatgatttcattctgtctgtattattccctagaggtttgtgttcaccagagtttctctctttttaccttttactatatattgaaactacaaatgaaagagctcaatttcttagcatttataaaataagtactccagtgttatgtttaccaaaaatgtttgagtgagtcttctctttgtctttctcttttttaaaaaattcaggctctgctggttcttcatcagttagatagcattgatttgtggaatcctgatgctcctgtagaaacattttgggagattaggtatatgtacttttattttttaaattcaacttttaaattttattttgtatttttgtcttgaaatattaactctgtagtacttagtacattgtaaaacttacacttccaaaggttttatggttttgtattttatttgacttcaaattattagaatttcttgttttaactgtaagaaaagtatcacagcaatttagaaaataaattttaagaatagtgctaaattttgtcaccctaacataagtactgttgtttggtatattacttttttcagatttcaatgtggttactactgtatttttaatagattttcatagttataagcctagaatgataaaattttgtaacaatactgttttttcagttttttgaactatgatctttcataaactttctgtaataccaatgctttcgatgaatgaattaataatggacacctgcttagaagaaaaaaatgtatgcagaattttgtggtctgcttcctagattatacaaatcattacattttaatgagcatgaagtcaccacacggaggaaaatgtaaatgtgtaaacctcaagtttgccattatcttataagaatgggtgtgctaagttacttggcagctgaattaaaccttactctagagtagtgctgtccactagtaatataatgagaaccccatatgttaaaaacttttttacttactacattaaagagtaaaaagaagcaggtaaaattaattgtaattatgttttgtttaacccggtgtatattatctataatttcaacatgtaatcaatataaaagttattaatgacatttcattctcttttttttaataaagtcttcaaactttggtgtgtcttttatacttacagcacatctcaatttgaacaagccacacttaaagtgctcaatagccacgtgtggctggctagtggctaccatgttagacagtgcagctctggagtagggatcaggaaacttttctctaaaaggccagatagtaaatattttagggcttgtgggtcatatagtttctgtcataaccattcagttctgcctttggagcatgaaagtggccacagacatgtgaatgaacgggcatggctgtgtttaactaaaactgtatatttacaatagcaagtgataggctaggtttggcctgtggatggtagcttgcagacccccactgtggagcactgggtttataggcagtctctgctgtgcatgtggtttattgtttcttcttatgtctactacaaggatgagatacatggatagaaacactgggagtttaatgaaacatagggggcttatagataaatacttgctttttttctataacctgtagacttatttcctttgattataatgctattgacactttgataactgtttctctaaaaccttacaagaaaaactaagcttctctaaacttgtattcattatgggagaatgccattcttatgtctggttatatctgcattaggttattgatgatgctagtaacaatgaactttatgttactgcagctcacaaatgcttttttacatctgcaagaaattaactagtcatcaaatgcttagtagcacagaaattctcaagtggttgcgggaaatattgatctgcaggaataaatttcttcttaaaaataaggtaagcaaaatgacatatttaaaaaatggaagaatatttggaatggtaatggtgagagattactaaagtgttttatagccaaattaggttctatttcagcttctccttcctcccaatgttctcaaaaggaaatatgtatgcagaggacaatgactggcaaatcagcattttaaaaattattctgaggctttggccttagaaccacactgttgatgaattctagttctagttgagttaaataggtctctatggggcaggcctaggaaaagtgggggctgctataaccagagtagcttgaggagcatattgtatctttactcttaagttcatacataagacataattcatacataaaatttattttaacatatagcttctgtaatttaagaattctattatggcgtagatttgggagtacttgatttaatgggtttttgtccagttctagaatcatagctctgagaaatcgtaaagacctagatctcatggctagactagtccagagaattatctatcaagaagcaaaagggaaacagttgagggtcctcaatctagatttatttcgattcctccaataagggtttcacctcttgaaaatatcaggagactttttcattggggtggagtgaaatgttttgattctgaactattgaaacatggtgaggttgtggaagatagagaagagccttaaatttcttttaacatatagtttctgtaattaatcaatttaggaattctgttatggcctagttttcggagtacttgatttaatgagtttttatctggtactagaagcatagctgtgaaagaccttaaatgtatgaaactcatatccttttcagtatttacagcttgttattaataaattgtctctttagaaatagactaatggtgaagtgggtttattcacatgtgacttatttgatatgttaatgtagtggaatttggcattattccaaagatacagaaagagattagacttcagactttcatggcctcgcctatggtataatctccagaatgtgagtatgaggaatccagtaatgaattcatagtgccctggtaggcatagtcactcttgtgacatacttggtgtatatacataccagagttaattactggtccagaagaacttaatctcaagagccaatttctggttatcccaacatggcacagtataaaatcttatggaaaaaaaatctttgtcattgagatcaaattatagttttcatacagtagatttatattgttgatgttttactcatgtttatgtcagacttaatttatatttgtagaatctactgtttctgatgatttagagaatgggaaactgaaagaaattttaaagaattaagtaaaccttgtttgttctaatgggtttctagtgaatctccttcaagttggggcatagagattgagaggagaggttttttaggagagtctcaaacaggaagacaactcaaataagtgtttattcctcttggttgtcagtgcttcagtaaagcttatttatttatttttttctagcaggcagatagaagttcctgtcactttctccttttttacggggtaggatgtgatattccttctagtggaaataccagtcaaatgtccatggatcatgaagaattactacgtactcctggagcctctctccggaagggaaaagggaactcctctatggtcagcttcttctgtactttttctgtatcattttatgtgctctgtttgttttctgaatgaaatttggtaaatttcatctaggtaatatagtgtaatagtgaaaaactgcttagaatctagttctattactgctctttgtggaactttgggcaagttcttaacatccttgttcctcagttcctcaactttaaaatggggacagtaatagttcctgccccagagttgttaaagagggttaaataaaaggatgtgtaaatagcacttgacacttacaagctatatctgataattataattattataaacctccactccataaaaaacccattcataccacagaagtatagaattcgtaccggctaacaaaggtacagatttacagggataaaaacaaagtattttgcttcatgttaaagataagtgtttctgtgatttgtgtttgtgtgtataatttcttttaaatataaatcatatttcaagtgaaaatatcacatcattacagaagagtttattttccaaaccaaaacttttttcattcctaatttttaatgcaaccttgttaaggaagaaacacctaagcagtatgatatttactaatgtctgttttacttgtagaatttgcatttattttatcaattattttctccatttcgtgtttggagaataagtaattcagaatcaaatgtatcttctacagcaatatttagttcttgtttatgcccttgtttcaatgagtgctgcagtgtacttattttattacttccctatagcaagtagatagaatttcctgttacttcctctttttttgtcatttctaattgactgggaggtacattatattgttactgcagtagatttacgttatggtgtttacctgtccatgttagaatcagtttacatttctggaatctggaataggataatatctatttgatttgaaattgaacagatggtagcattatgttggtccagataatctcatttctcatttggacaagatattttggggtttgaaaaattcctataatgattaaaggaaaaagctcttgtgagttattgtatgcggagacacacacacacacacacacacacacacacacacacacacagtttattgcattgttagattttatacataaaattacccaagttgcaaatatatgtcttccacccttgactctcaggatagtgcagcaggatgcagcggaacccccccgatttgccgacaagcccagaccaaactagaagtggccctgtacatgtttctgtggaaccctgacactgaagctgttctggttgccatgtcctgtttccgccacctctgtgaggaagcagatatccggtgtggggtggatgaagtgtcagtgcataacctcttgcccaactataacacattcatggagtttgcctctgtcagcaatatgatgtcaacaggtaaatgtgaatagtggttttttttactcagtctgcctcaaagcacatggcatctgattttgagaatgtatttaaggtcactactttgtaagtttacaggggaaattcaagtagcttacttgaaatccttttctgaacaaagtaagatgaaaataaaaagcatttgaaataaattgttagtcttccactgagttgttaatatgctatacattttaaaaataactggcagtagatgttactatcagttatgattatgtaatttactctgcctaagttgtagatagtgaagttttacaaacattggcgtatgttttgagtaaattgtaggtgggaatagctattttattctgtggacattgtagagtccaagataagtacctttcctgtgaggttagtgaaaggaagtttttggctttatcatttgaagcatttgctctgctcttcctactccttttgggtggagcttatcaggttctccattggcaggcagggctctaagtgcagtaacttgatttgctgttgtatttgcttaggaagagcagcacttcagaaaagagtgatggcactgctgaggcgcattgagcatcccactgcaggaaacactgaggtatgcccttagcaacagaaacacccctcccaggcgcccaccctcaatttggaagcctcttgttacatatgtgtgatcaggaatagcttttgaagtaaatccaagatacgtgcatattacaagtataatatctgagtatttaatatacatcaagtttgaaacttggctgtagctgattgatgtttagctctagactaagttgctttcaagtgataattgccttcattttaggcttgggaagatacacatgcaaaatgggaacaagcaacaaagctaatccttaactatccaaaagccaaaatggaagatggccaggtaagtctgtaaagttgacttttgtctgttaactgatctgctaaatatatgtacttcactttgataatctttcaagagtcgctcagtaaagtaaacatatagctgtgtgaagactgatatttagttgtggtttatctagacctgtactttgtaatgtggtagctactagctatgtgtgactatttaacttaaattttaacataattaaaattaaataaaatttagttcctcaatcatatagtaaccacatcgcaagtaccagtagccacatatgacaattacttactctattggacagcagagagagaaaatgttcctgtcatcacagaaatactgggcagcactgctagagactgtttgttgcagagaccatttctttaccttttcttgctctttctcccttcatcagggtgtttcacagaattttcagaaaaggagcaacagaggtagagataaattaacatggaaacaattcattttgctattttgttaggtattctaattaaggaatgtcttaggcagtagattgatcccatagagtaaatgaaattttaaaatgtggacagttcattcaactattactattgactatattatctgttactttggaaattaatgatcagttagtgtttgtgtgtatttgatttgtaatgttcatattgctctcattattaggtgatttataaaaactggttgttcctccatggtgtttttgtcatgcttaattacaataggaaaaagttatatttttacgaagcaaatgtgtgtacctaatacctttatttggaggggacatgtagctttagaatgaaagcttttggggggataactgttttatataattacataccatacagttcacccatttaaagtgtccaattcagtgactgtttttaatgtattcacagagttgtgcaaccatcaccacaatcaagttttagaacaatttcatcaattgagaaaaaaaccccgtaccctttagctatctctgcctctaaccaccccccacccactttcttgcctctcttcccccaacgtctctagccctaggcaaccatgaatctactttctgtctttgtagatttgcctattccggatatattctgtaaatggaattatagaatatgtgggcttttgtgattagcttctttcacttagcatgatgtttccaaggttcatccatgtgaaatcaaaactttttaaaagaaatttgacactcggctgattatattagtgtatgataaaaatagatcagtggctctttaaaaatgtatatggtaattttatgggttgattttaatgtatattttacattttttgtacttttgtcatggaagaaatgttggataaagcataatttgtcaagtctcaactaattaaggtttaattcatgctttgcacaaaaattttgtgtttaggctgctgaaagccttcacaagaccattgttaagaggcgaatgtcccatgtgagtggaggaggatccatagatttgtctgacacagactccctacaggaatggatcaacatgactggcttcctttgtgcccttgggggagtgtgcctccagcagagaagcaattctggcctggcaacctatagcccacccatgggtccagtcagtgaacgtaagggttctatgatttcagtgatgtcttcagagggaaacgcagatacacctgtcagcaaatttatggatcggctgttgtccttaatggtgtgtaaccatgagaaagtgggacttcaaatacggaccaatgttaaggatctggtgggtctagaattgagtcctgctctgtatccaatgctatttaacaaattgaagaataccatcagcaagttttttgactcccaaggacaggtaaagtgttctcttatttttcacctttctctatgaatagagtgacttgtttgaaataagcctttttctttcagattatttaaattaggtactcacagtttttaaaaatttccaaaaaattgcagaaagaagagtcatctcaatgtaggggtcagcttgcctcttaggaactctggtgtgtatgtgtgcctaagggtatacgtgccctgtgtatgggtacgagtgtctgcgtatatctgtatgcttatttggctctatgcctgtgggtgcacttactctgtgtgtttagatcagtcagtttcatctctctagggggtctgtcttctgggcattgatggcaaatcattaatgtatttgttctttctttaggttttattgactgataccaatactcaatttgtagaacaaaccatagctataatgaagaacttgctagataatcatactgaaggcagctctgaacatctagggcaagctagcattgaaacaatgatgttaaatctggtcaggtaagcattctactgaaatgtagcagaaacattttaagagataagaaaaacctcttacacactgatactggtagtaattgataaaataactggccattctttactgcacacaaactagggtgtgacagtaaggtagccagaagttgtgtacgttcttttctaaataaatatcttattgttttcaaacttacatttaattcgttttacttgatgactaaagtatttagaatgccttctcttttgtctatatctgataatttttttattgtttctatgtctatataggtatgttcgtgtgcttgggaatatggtccatgcaattcaaataaaaacgaaactgtgtcaattagttgaagtaatgatggcaaggagagatgacctctcattttgccaagagatgaaatttaggtgagttctcaaaagagcaatgtagggtcttgtaaatcttaatatgtccaatgaagtacagaaaaagagtagatatgcggttattggtagaaaggaggacatgaaaagagagcaatttacatgtttgtttttctctacatctcttctcaaatttccctaagctttgtgcctgtgacaatgctccctttttctaaaactgtgctatacttgagctaagaatttgattctatttccaatctgataccataactaagggccatgatggaggataaatatccatgttgcttgttcccttctggcttttatgtctgtgatagcagtatctcttttataaagtcgtcatgtcacttaggttatctggcaaattatttgcactataagaaatcttacgtgactaaaggtgtgtgtgtggcttcaaaaacattgtttgctgtttctcttttctccaccattctataggaataagatggtagaatacctgacagactgggttatgggaacatcaaaccaagcagcagatgatgatgtaaaatgtcttacaaggtaaaaaaagaatgaccttcaagtattagtgggttttactgtgagagttataactacttaattacagctttatacttgtattttgtgtgtatttaaacttttgagatgtcaaacttttgtgtttgaaatatgtaaagatgctaatctttattactgcttttttttgactgatagactttcagtaaaattaaatgtgaaagagtgatatgtttgggaagttagtgttgtcagtttatgaagaatagtctacagttattgggaaataagatacataaagcctcagattgcatttgtgttatgattagatagataaaggtattatttgaggaactcattgtgttgaatctttttaagaaataattgatttcctgattcaagcaccagagacagaaaaaaaaggaagtaatcaagtctgctttaatgatacttattgacacatatcagaaaatgattaaacactatggactgtataataagcattcacatatgtttctttgaccaagcctagctttataatacagtcttctctgtcagggattggttccaagaaccactccccaaacccctgcccacatcttactcccatgaacactaaaatccacagatgctcaagtccctgacttaagatgtcatagtatttgcatataaactatacacatcctcccatatatttttaattatcttcagattacttataatatctaatacaatataaatgttgtataaatatttgttataccatattgtttagggaataacaacaacaaaaaatctgtacatgttgagtacagatgaaaccctccttttttttcccccaaatattttcaatccatgggtggttgaatccatggatatagaactcactgatacagagggcccattgtacatgcttctgatttaaggtagccattttgccaagattactttgtagaaagtaagtattaccttctccccatttgagatgattttgtattctgggatctgcatattaactcaaattatttgggttgtgctaataatttgtttaatgaaataggtagttcctaaggtttatatctgttagtaagaggtttatttgaggggaagtgaaagaacttgaaagattcatggtctctaaattttttttttttttttttttttttttcagagatttggaccaggcaagcatggaagcagtagtttcacttctagctggtctccctctgcagcctgaagaaggagatggtgtggaattgatggaagccaaatcacagttatttcttaagtaaatttcagtcaccaaaaaacataaagcaaaaagcaaataaagccccccaccacacaaaaaaagcaaagaaataatacccatgacaggactaggataggaaaataactgtgttttgtgatttttttaaagaaagtaatatgatcagtgaaattttgcttataataaaacccagattgcttcattaagtcatttacaaaagtgacattgtctaagctgtttggaccactaattttatatactaacattaaaagtgacacatttaccaggtaatattgcatctatttgatgctaatgttatgaaaggtatactaggctatatcaggtaaaatcatgtccaacatagcacacttcataataagccaccctggctgattatcgcgagagaggagagaaacagttaacccagggccattcacaccatgcacatatgattgttttggaatgtctggttagctttctagttgatacggccttcactatgtaaaggtcagtctttttatttctcagatacttcacattatttatgaaccttttgaatgactgcagtgaagttgaagatgaaagtgcgcaaacaggtggcaggaaacgtggcatgtctcggaggctggcatcactgaggcactgtacggtccttgcaatgtcaaacttactcaatgccaacgtagacagtggtctcatgcactccataggtgagatcaaatgaaagtttcatatagaaatacaaaacctagagaactggcatgtaagagaagcaaaaattacttcagcaaggccatgttagtaaatttgcatctgtttgtccacattaggcttaggttaccacaaggatctccagacaagagctacatttatggaagttctgacaaaaatccttcaacaaggcacagaatttgacacacttgcagaaacagtattggctgatcggtttgagagattggtggaactggtcacaatgatgggtgatcaaggagaactccctatagcgatggctctggccaatgtggttccttgttctcagtgggtaagtgattagagtaagcggggaagaaaagtgcctggcacatagcaaatccttcagaatatatttgttcaataaatgtttgttgaatgaattgataaaatttcagagccagaagaaagatgtttagttaggtgatttttcagctgtagggaagtggttggcaccactagacctgactagtgttctgtatcatttcatcctactaaaaaattccatttaaacgcattaaaaatcactgatctactctggtgtcttcatatatttgataaggtaattaggttaaacctaattttagttagttgttgcaatgctggaattggaatccacgatttgtgcctgtttactacctccagtttgctattcttttccccataatgtctcatacagttttttaaaaatttaagcactatatttgcatttgatattatgatattgtttattttaaaaactgaaagcgtcatatggctatgtctctctcttaatttaatgaaaaattttcctaaaatcacatcattcttaatacatgctaaaacgttgagacgggttgttgttcctttccagtgttaaaaggctatttgctttttagtgtaccaaaactgatttcagttatagtaaattatgactaataaggtaatctgtccttgttaacaagcctgtatttgttatacctgtacttaaagtaaaattcaaactccttaccctgtcctacaaggctctacctgatctgggccctacctcatctctaacatcatcttatgctattttctttcttgttcaccagagccacaccagctacctttctgtccctccttgttagacttatttctgctttagagcacccttgctgctgccaccacctgaaatgcttctcttctggtattttattttggtgagaacacctggcatgagatctaccctctaacagatttttaagtgtataatacagtattgctgtctgtaggcacaatgctgcacagcagatctctagaacttaccttgtataactgaaattttatactcattgattagcaacagccccaaattattgaaacctccttgaagcctaaatttcagaaatgttcaaatgttttgaaaatggatattctgaattatcttattagcatctacctataattagcactgaaaatagtaattttttaaataaagaatcagttaagggccgggtgtggtcgctcacgcctgtaatcccagcactttgggaggctgaggcgggaggatcacaaggtcgggagatcgagaccatcctggctaacaccgtgaaaccctgtctctactaaaaaaatacaaaaaaatcagctgggcgtggtggcaggtgccaatagtcccagctacttgggaggctgaggcaggagaatggtgtgaacccaggagggttgcagtgagccaagatctcgccactgcactccagcctgggcgacagagcgagactctgtctcaaaaaaaaaaaaaaaaaaaaaaaaaagaatcatttagttcaagtagctttaattcgttgagttttatattaaatgactttgagaaggaattttctgttaggccagatctcacctaccacattattgtaatccttggatcaggcaagaattagagagctatgagccatgatcctggcctttgttgttactgcttgaggattgaggcatctttttatggctacccctattatctataaatttcttcttatcatgtgattaaacagtgatttaccattagatcattttttcttgagtgtaccccaaactgttttactacagagagttataaaggatgtcatttaggtaatagatagaaatttcagccctcatccttgtgaccctagctttgtatgtaaatctggctcatctctgggttctgaatgcccaattccttttcttcctggtttctcaaaaatcctatagtctttctgtttttgttgtgtctctgcctagtatatattcagtattcgctgagttccccgactgtatgagaagagagtagaactcttctgatcatcaatcttatttctgctctgtgcaaatgcttgtacaaatcaaactaaattctttgctgtcatcttctgtttctgctctctttcattttgtgatgtaatttgagctgaatcttggagattttgtctcctagtaaagcgtaggcctctcttaatagcttttaccggttaatccttggaattaacagctatcatagacattgtatatagtcatctatcataaacaatgtacactgttaaatctcaggataaatattaatcagtcatcatttgccttaatttagcaagtggttgtcaactttgggtttacatttttgctactctttagcttcctacctaagaataaaaatgggattgtttgcactaacctgattttgttttgttctcaggatgaactagctcgagttctggttactctgtttgattctcggcatttactctaccaactgctctggaacatgttttctaaagaagtagaattggcagactccatgcagactctcttccgaggcaacagcttggccagtaaaataatgacattctgtttcaaggtttgtatcattcattttgtgtgtatgtgtgtgctgaggtatgtcaagtaatgattatgtacagaatgtgcagggctgattgtcttcttttaaggtaaaatatatggagcaggtataataaactcctattcgtgcatttctgtaggtatatggtgctacctatctacaaaaactcctggatcctttattacgaattgtgatcacatcctctgattggcaacatgttagctttgaagtggatcctaccaggtttgtcatcttttcacatagaaccgctgttttttgtttttttttttttgtttgtttgttttactaacactgcatgaagcaaggcaccttctccccttgatcattaaaattagtttttaattataaaagttatatacaaatacacgtttctttaatgatatctgtaatttttttttaaggtatccttttatttgccttagatccagggacaaactagagaaaggtgtctttgacttccacctccagagactgttactagttaagtctgttcccctgtcctttttccatgcatttacatattcatatgcagtcacttgcatgcatactctttttctaactcacttcttctatgatgaggagtgacttaggagaagggaaagaggctaataggtaatgcaggctgcagtttatttatttgtcatttttttaaaaatttgagacagagtctcactctgccattcaggctggggtgcactggcgcagtctcggctcactgcaacctctgcctcccaggttcgtgtgattctcctgcctcagcctcctgagtagctgggattacaggtgtgcgccaccacgcccaggtaattttttttttttttttgtatttttaatagagatggtgtttcaccatcttggccaggctggtctcaaactcctgacctcaggtgatccgcctgccctggcctccaaaaatactgggattacaggtgtgagccaccatgcccagcccagagtgcagtttaaaccaccatttctgtgaagctttctctgcttgttaccaggtactacccacgaacaaagaaatatgctttgttctgtgctgtgcaccaccattgtaacaattgtgacgatttatgagtttctctctcctctagactgtttgctcttttacatttttacatctttatatccttccatgaatatttagcatggtgtctgccttatagtgaacattttataaatatttgttaagtgaatgaattttaacggaatatcttatgcttgctttttctaagccacatgttaagatgttcttgtctgtctttcagttaggactttattttttacttttaagttcagagcttcttgatgattgttcttcctaaataatcattatttagcaactgtgtatcagttgatatttttggctctgcatttgctgaagtatcaactgtaatatctattcagaactccagcactaagccaatttttgttaaaatagttaaaaacttaaaagcaatttttatatttttatttacttcttattttttgaaatggggtctcactctgtcacccaggctggagtgcggtggcaccatctcggctcactgcaaccttcctgtgcaggactcaagcgattctcccatctcagcctcccaagtagctgggattacaggcatgcaccaccatgcaaaatacaaaatttttgtattttggtagagacgaggttttgccttgttgcccaggctggtctcaaactcctagactaaagagatccacatgctgtggcctcccaaagtgctgggattacagatgtgagccaccacgcctggccaaagcaatgttttgtaaagccttgtattttcttgccattaagcactttcagtttttttcttgacaacttctcatgtctactttttttttttttttttgcaattttcaagtgtacataatacattattacggattttatgttaattttgtgccctacaattttactgaatcttattattaagcaattttactttctaaaggttaaagaattacttagagagtgaaccagctgcttcaaataagtttactatacaaagtgctgtggtccagataagagaactagatggcaaacaatatactcaggttgcttaaaatcaaactgaggcccactctgacatgtcaagagcttgaaagtcaacactcctgtgttcacaacatgaaaaaagctaaaaaactgaaaatcagcagctcttagatccatcagagaatttaagtccactccaaaaactggagagacaggtaaatgtatacagagaatcacagtttaccaggagaagaagctgctggagccagtaactggtaggaaagcttagatcataattgacgagttgctggaggctgagcatggagtgcctagagagttaaaactcctaggggcctagtcttgcagggacccctgcacctttgtaagttttacctccagaagcctcatcaggctctcatggtgaagataggagaaaaatccctttatgctttgggcaggggaaggggaaaagtagccatttttaaatatgaccacagtgttctgttatccctagcaaaggtttgccctcaggagaaattactttaccagagctttatttgacttagaagttagccacctccagccccctctagcgtttctgtaagaagagagaaaaggctaagaaactctttgagtctggcctggtggctcacatctgtaatcccagcactttgggaggctgaggtgggcagatcacgaagtcaggagatcgagaccatactgtctaacatggtgaaaccctgtctttactaaaaatacaaaaaattagctgggtgtggtggcacgtgcctgtagtcccagctaccaggaggctgaggcaggagaatcgcttgaacccaggaggtggaggttgcagtgagctgagatttgcaccactgcactccagcctgggcgacagagcgagactctgtctaaaaaaaaaaaaaaaagaaactctttgaaggtcacactttaaggaatttggcccaataaaacaatggagatataatcagattgtagagtacttcccttccccagtatcccagttaacggggaaacccagggacaacaaaagagacagaaataagagcactagaggaaatgggcgcctacagttacagcgaacattaaacataacctaacttctaggcagattaacagaatgcctcacactaaagtccaatttacctcagttcctatgacccaatacatcttgtctggctttcaacaaaacattacaatgcatgctaacaaaaaatgaaaaattagtctgaggagacaaagcaagcatcagaatcagactcagatgtggcaagatgtattggaactttgaaattgtcaaactgagagtttaaaataactaatatgctaagggctttcatggaaaatggacagtgtgtaagaacagatgggtaatgtaagcagagacatggaaattaagaaagaatcaaaagagaaggctagagaaaaaagctgtaacagggagaattcctttagtgggcttatcagtagtctgggcaccactgaagaaagaattggtgaatttgtagttatatcaagagaaacttcccaaactgaaatgcaaagacaaacagaagaataaatgaaaatgaaaatacatcaaaatttgtggggtttaataaaagcagttgcttagcagtgttaaatgtatgttagaaaagaaaatctaaaatgaattatctgagctctcaccttagaaaactagacaaagagcaatacctaaagcaagatggggggaggaatcagaaatcaatgaaattaaaaataggaaaaaaataatgaaacgcaaagctagatctttttattttttaatttttatttttttgtgggtacatagtaggtgtttatatttatggggtacatgaaatattttgatacagacatggaatgtgtagtaatcacttcagggtaaatggggtgtccatcacctcaagcattgatcctttcttttttcttttttgagacagagtttcactcttgtcgcccaggctggaatgcagtggtgctatcttggctcactgcaacctccgcctcccatgttcaagcaattctccttgcctcagcctcccgagtagctgggattacaggtgcccaccaccatgcctggctaatttttgtatttttagtagagacagggtttcacaatattggccaggctagtcttgacctcctgacttcaggcgagccgcctgtcttggcctcccaaagtgctgtgattacaggcgtcagccaccgtgcccggcctatcgtttctttatgttacatacaatccaattatactcttttagtgatttttaaatgtacaataagttcttgttgactgtagtcaccttgtgctatcagataaccagatctcatttatattcttttgtacacattaaccatccccggtctccccttccccaccccccactacacttcccagcctctgggtaactatcattctactctctatctccatgagttcaattgttttaatttttttagcttccacaaataagagagcgcacgatgttgtatttctttgcctggcttatttcacttaacatcataaccttcagttccatccgtgttgttgcaaatgacaggaatctcatgttttgtgtctgaatagtactccgttgtgtatatgtaccacagtttctttatccattcttctgtggacagacacttaggttgcttccaaatgtaggctattgtgaatagtgctgcaacaaacatgggagtgccgatatgtcttcaatatactgatttccttttgtttcagtatatacctagtagtgagatttctggatcatatagtagttttatttttagttttttgaggaacctccaaatggtcctccatagtattatactaatttacattcctgccaatagtgtatgagggttcccttttctcacttttctccttgtcaccatttgttattgcccgtcttttggataaaagcaactttagggtgatgtgatatctcattgtagttttgatttgcatttctctgataatcagtgatgttgagcaccttttcatgtacctgtttgccatgtgtattttgtttgtgtgtttgtttgttttgagacacagtcttgctctgtcacacaggttggagtgtagtggcgtgatcttggctcactgcaacctctgcctcctgggttcaagtgattctcctgccacagcctcctgagtagctgggattacaggtgcctgccacgatgcccagctgatttttgtatttttagtagagacagggtttcaccacgttggtcaggctggtcccaaactcctgacctcaagcaatccacccgcctcggtctcccaaagtgctgagattacaggcatgagctaccatgcccagccatggaatatcttttttctttgctttattttcagtctgtgtttttccttatagatgatgtctgtttcttgtaggcaacagattgttgggtcatgggttatttttgtttgtttttaatccattcaatcactcttacgtcttttgattggagaatttagtccatttacattcagtgttattattgacgaggacttactcctgctattttgttatttgttttctggtggttttgtggtcttctcttcctccttttcttccttcctgccttccctttagtaaaagtgattttcacagatgatatgtgttaatttcttgctttttattttttgtgcatctgttgtatgtttttgatttgaggttaccatgaggcttgccaataatattttatgagccattcttttaagctgatgacaagttaacactgatggcataaagcagcaaacaaagaagcaaaaagaaaactaataaaaactctacactttaactttatccccctactttttaactttttgttgtttttatgtataccttattatactgtctgtatcttgaaaagctgtagttatttgtaaaaggttcatcttttagtcttctcaagatagtagttcataccacaattacagtgttataatattttgtgtatttactgttaccagtgaattttgtaccttcagatttcttattgcttgttaatgtccttttccttttgattgaagaactccctttagcatttcttctaggacaggtctggcattgataaaatccctcagcttttgtttgtctaggaaagtctttatttctccatatatgaaggatattttcactggatactgttctaaggtaaaagttttttttttttctttatcacttgaaatatgtcatgccactctctcctggcctctaaggtttccactgagaagtctggggccagacatattggagctccattgtatgttatttgtttctttcctcttgctgcttttaggatcctttctttatccttgacctttgggagtctgattattaaataccttgagttaatcttctttggtttaaatctgtttggtgttctgtaaccttcctggacttgaatattgataaatatctttccctaggtttcataagttctctttttttttttttttttttttttttttgagatggaggttcactcttgtcgcccaggctgcagtgcaatggtgcaacctctgctcactgcaccctccgcctctacctcctctttaaggccagtaactcttaaatttgctcttttgaggctgttttctagatcttgtaagcatgcttcattctttattcttgtctcctctgtgtattttcatataggctgccttcaagcttgctaattcttctgcttcatcaattttgcttttaagagactcttgatgcatatttcagtatgtcagctgcatttttcgtctccagaatttctctctggttctttgtaattgtttcaatctcttcgttaaatttatctgataggattccgaattccttctccacattatcatggatttccttgagcttcctcaaaacagctattttgactcctcggtctgagaggtcacatatcgctgtctctccaggattgatcactggtgccttctttaattccttcggtgggtcatgtttttctggatggtcttgatgcttatggatgttcattagtgcctgggcattgaagagttaggtatttttgtagtctttgtagtctgggcttgtttgtacccacccttctggggaaggctttccaagtatttgaaggcacttgggtgttgttatcttaagtctttggtcactgcagctatatctgctttaggggacactccaagcccaataacgctgtggctcttgtacactcatagcggtaccaccttggtggtcttgcataagatcctggagaattccctgggttatcaaacagactcttgttctcttcttctcttcccttactttcctctaaacaaacagagtcagtctctctctctgtctgtgtgtgtgtgtgtgtgtgtgtgtgtgttgagctgcctggagctgggggaggggcgacacaagcagccctgtggacaccagcactgggagtgcactgggtcttgcccaaggcctgcagtactgctgcctgactaccacctatgttcactcaaggcccaaaggctctacagtcagcaggtagcaaacccagccaggcttgcgtcctttcgttcaggcagtgagttctccgtgggtccagagatgccattcaggagccagagcctagagttgggtacatcagagatctacctagtgctctattctgctgcggctaagcattaagctggcacccaagctgtaagacaaagtccttcccgctcttccgtcctcttttctcaagcagaggagtcttttcccatggccgccatcgccccaggcccatggtgagtgctgcctggctaccactgatgttcactcaaggcccaagggctcttcattcagctcatggtgaatgctgccagttctgagtctctcccttaaggccttggggctcccctctaacccagggcaggtccaggaaagttttccaggagccaaggcctggaatctgggaccccaggagcctacttagtgccctaccccactgtgtcaagctggtacccaagttgcaacacagagtcccctttattcttacctcttctttcctcaagcagaaggggtctctctccatagccaccacagttggtaatgtgctgggtcacccctgaagccagcatgtctccaagtctcacccaaggcccacagcaagtactgcctggctatccctcctggttgttcaggggccaagggctctttagtcagcaggtgatgagttctgccaagactgggtccttccttttaagacagcagatttccttctggcccagggtttgtttaggagtgttgtctgtgaggtagggcctgaaatgggggcctcaggactctgcctggtgccctctcctactgtggctaagctggtagttacaagacaaggtcctctttactctctccactcttgtatttgaacagagggaaggcatctctgttggagctacaagctgagctgagctgcctgggtttgggagaggggtgatgtaagcattcccttggttgccctggctgtctcactaggtccaccccaagtccactggctctgagcccagcacagcaccaggacttacccagaaactgcagtccttgtgggcctagactgcctttcaagtttatttaggacctcagggcactttagctcttggtggtggggcttgctggaactcaggtttcaacagctgggatgggtgatttacctctggctaggtctgttctaagttctccatccttgagcaccagctgagctctgccctgtgttgctttctgctatgacagggcagcatttagtcctaatgcaaagtcccataatcactgtgctgtccgtcccccaaatgcagattttctttgcacaccacggggccactgccaggaggtgaaggaagggtggtataggtaagtcaagacagtttttcctacccgcttcagtgcctcttccttaatatgatgttaagaccaggtattgtgatcacttacctgattttcagttcttatgaaggtgcttttttgtatggatggttgttcaagttggtgttccaataagggggacgatccctggaggcctccattcagccatcttgctccacctccagttctcaagctagttctttgaaaatcaacttgggaaaagttttatacacaggaacacttgaataattgaacacaaatgttcattgtagttcagaattagtagaatattcaacaggttaccattggcatgtgggaagcaagagagcactgtggctagaaggtattgttttagagggaaacctgaaatggactgcagtgtacctgctgctatgctgactcaaaaaaaaaatttcacaaagtaggcaattgtcagggtttctagcagtctctttgagccttgttaaagaaattgttaatctcattcatacctaccaactcctagacctccatatcttaagatttggattactgttgtagcttaactgttctccctgcatataatccccatatttaggctgtctcttcaattagccacatattgcaagttcattttcctcctctggcttcctaacaaccatcagccattctccaatagataccaaccaggtgtccttgtgattcagttcaaccgtgacactgtttacctggagagagcatcagatttcccataggataagggctgagtaagattgctaccacttcagatgccaattacaagccccaggttgttacctgtgcttctcacaacttcaccttgagttggattaatttgctagaaggactcacagaactcaggggcatactttacttttgtttgcctacttactataaaggatatcagaaaggatacagatgaacagccagatggaaaagatgcacatagggcaaggcatgtgggaaggggcttgcagcttccatgctgtctccaggtgcactaccctccaggcacctctatgtgttcggcaacctggaagctcttcaaactctgttcgttgggtttttatggtgacctcattatataggcatgattgattaaatcatgggtcattggtgataaactcaccttcagcctctctcctctccttggaggttggggagtggggctgaaagtctcaaccctctaatcgaaacttggtctttctggtgactagccccgtcttgaagctccctaggacctcccagccaccagtcatctcattatcatataaaagacactcagcacttccagagattccaagggttttaagagcaatgtatcaggaatcaggagcagagaccaaatatatatttatcacaatacccttgaattattgtattgagtacttagtgtggaatacctggtctatatgtctttctcctttttgaaaaggtcaaaaggcaattgttgaatcctcagcacctgatactaagatggcagatagtagatgtgcactaaatatttattggattgattacctgccgcacctactttctctttctgaaatacccttacttcttttgtctatgcaaattctgtgcctcctttagaactcacctgttcaatgaagtatttcttgctttgcagtccatgctaatttctgaactcttactgtattcatatgctgtgccacacagcaaactctaaggaatctacagcaatgacgtaagtgtccaaagcatttctgtaatacgttaattaatatagaaacaaaattactaattaacctgttaaaaacaaatatttactcagtacttgctgtggtaaggcactgtgctagtctttaaggggacataggtaaatacttccttcaaggagcttacagtttagtaagagggataaaacacacaacagataagtggtgagtttcataaggggtgtattttgagagttcagattaggctagttagagagtaaaggtttgtggatttgattactattgggtaaaatttaaactacataaagtaggcattattagtcctgtattattgatgagaaaaaatgacacccagagaatttaaggattgtgaccaactcataatgattgataactgatagagctgaaatttaaacctagtaagtctgcctgcggaatctcttcctttaatcacaacatcagagtttagaggtggtactgataagagttagcaacactgggccgggcacggtggctcatgaccgtaatcccagcactttgggaggctgaggtgggcagatcataaggtcaagagatctagaccatgccggccaacatggtgaaaccttgtctctactaaaaatacaaaaattacctgggcgtggtggtggtgcgcctgtagtcccatctacttgggaggctgaggcaggagaattgcttgaacctggaggcggaggttgcagtgagccgagattgtgccactgcactccagcccggcaacagagcaagactccatctcaaaaaaaaaaaaaaaaaagcaatactgattggatatggggaataatgaagtagagcaggaaaaagtgacatcagagatggcctgaatgatgtgattaagaaagtgatagtgctattgataacatagagcacatgataagacataagagtacgaggaaaaatcagttaatttggggcatactgatttttagataccagtggggaggggacatctagcagttagaaatgtcagactggatgtgaaatgcagttcaagataggggaaacctgaatggccacaaaatatctaaaagcatgtctaaccttagtaggaactgtggaaatagaagttaaaaacatgagctacctcatgttttactcaactgctagattggaggggaataagaattcttatacagtactagttttagagctatttggcaatatctagtaaagttatatctgcatatactcaataactcagaaatttcatttttaggtagctgccttagagaatctcttatgtgcaagaatgttcattgcaatggtgtttgtaaaggtgaaaaatgtttaatgttcattataattagagaatagataaatcatggtatacaatagactattatgcagtaaagtgaactatatcttcatctatcaacatggataaatctcagaaacataatgtagagtgaaagatgaaagttgccttttgttactattgatgaaaaaagtaaagacctacatcattcagccgggcgtggtggcttatgcctgtaatcccagcactttaggaggccgaggcaggtgggtcacttgaagtcgggagtttgagaccagcctgaccaacatggtgaaaccctgtctctactaaaaatataaaattagccgggcgtggtggcccatgcctgtaatcctaactacttgggaggctgaggcaggagaatcacttgaacccgggaggcggaggttgcagtgaactgagattgcgccatcacactccagcctgggcaacgagagtgaaactccatcccccgcccccaccccccaccaaaaaaaaaaaacacctgcatcattcatatgtgtgtgttaattttttcatatgggcatatacacatagaggattgtgaattggaaaaatacatgatattcttgttttatctgtcccctctctcccccttttgttgcttgggtattttaaagcatatctcagagatcatgtttctaacatatacagacttaaacacacatacacgtgcatgtgcagcctgagtatttccacacaaattaaagttaataatcctgaataatatatctaagactagttttctgttaaatttttttcagttatctcaaagttgtctttttttttatttttatttttgagattcagtcttgccctttcatccaagctggagtgcagtggtgcagtcttggctcactgcagcctccacctcccaggttcaagtgattctcctgcctcagcctcctgagtagctgggattacaggcacctgactaatttttgtatttttagtagagatggggtttcaccatgttggccaggctggtcttgaactcctgacctcaaatgatctgtcagccttggcctcccaaagtactgggattgcaggcgtaagccatccagccctgtcaaagttgtcttttttttttttatagttggttgtttaaagattccaatgaagtctacacgttgcacttggcttaatgtctgtataagagtctcttttaaggagtgatttttgttatttgttttaaacaaaagtgttaggattttatttttatttttttgtaggttagaaccatcagagagccttgaggaaaaccagcggaacctccttcagatgactgaaaagttcttccatgccatcatcagttcctcctcagaattcccccctcaacttcgaagtgtgtgccactgtttataccaggtatgcttacagttagagattaccattattaatctaaagttaaattatgaagaatgctttatcaaagaaggatctagctgctgatggtgtgtggttaactataatactgagtcagtttggatgaataatacattgagaattgttggaattgtctttgaaaaaaacttaaatattacttaggcaacagtttgaagtaagagaatactttaaaatactaaattttacttgcattgggagcaagtttaaaatgcagtgaatccattgggtatgatggatgtggctgaaatgaacatattatggatttttgttgttgtcatctattaacctaaattatttacagggtgtttcacagttgaggcgggtctcctccttgctttttgcattgtgaattgcttgatcatctgtgattttggtttcttcattaatgtataattagtttgtgtcaggttttcccaggatagactgattgttctgtttactttatgtagcatatttcttaaaagagatactgcatcatcattcagaccaaattattagaccttctaacactagcactgcaagtaatgcgtctgaactcagaaaatagccatagtcatggccttcttttttagggaattcggtctatgttcttttatgtcttctactgtgtttttgaattgcacattgcagttttaggaattatttattccaagggaggtcctgcaaatgcatattagccttttggaaactgtgattctggaagaaacattagtgggtctggaatttgggataggggtggatataagggaaatacacagttatcaaaacccatgtctttgtgtctctctctttgcagagtcatcgcagccatttgcttttttagcacacggcttcagttgcttagagacgttaacagcatcattgaaatcaccattttaaaagctgtttgaggctgctctatgtgaattttttcaccattgctatttttaaagatgtatctgttctatctgtaaaaaagcttttcacggtatacatagatgataaaacatacttaaccttgtctctcttaatttatcatgacttttctgcctttacaaaaaggctcaaggaaacttaggaaaatcctgtatagttttttcaactagttaagtctgagtctaaagggtagtttagttataatatgaaacttaatacagtgaatatcttctcaagtttgggctgtattcaggtttctctttaaattttatttagtaattgttctattgatgaaactaggcagacaggaaatagcacatattaaaaatagtctgggtcagcttcttggttggcctagtagtaactggtttcagagagcaagtgggtttctaaaatgacagaggctttgactttagctggttaaaagtgaatggggactgactacatgattacatggtctaggagattgtagtagaatttcttcatgtggttgtcatcctaaaagaaaaatctttttgtatcatgagcaaagttggagaccgttttgagaccatgattctaataatgtaaaaggaacaggtcttagcacttatttagtacttaggaaatatttaatgaagaaataaatttcccatccctcccacctaagtaaacaagattcttgccagctttcacagctaagaaaggaggaaaatagtgaaaatagatttttaaacactatatgtggtgattattaaacagtatgttatgctttttagagcacttcacagtaaaatatcctatattattttaataacaaacctggtttattatgttaaaatttcacataaaattattatctttaaaaacatgaattaaaggtggtatcagtgcattgtttaagtattgggtaaaagcattgttgaagagcagagacagcatgctgtgttgttattaaataaggctttattttttaattagtaactggtaacagggaatgttacatttactgattagaaagaaagataggaaaaaagctttggtctcaagatagtattttattgagtctgcttcccaaacctagtttatttcttttggtttgctcttttgtttttattcatcttccctcttctggctttttcttgcccctttgcctttggcagtaacagaaaggtaccttcctgctcttctgtgttctgcctggagggatagtagtccctttgggacctactggggaaatgttgaaagggaagtgagtatattgctagctaataaacttccctggactttagctccttttttgagttcatatcttggcctttaagccttttcaaatcatgtgttaaccagctctattactttatataccttccttccttagttgactggattaaggttatttaagaatagccaactgtgaacatgtgtcagatttataattaaatcattttctcatgtgttgttttcacttctcctgatggttttaggataaagataaaatgattcccaaagtggatattctcgtatggtgagagaattctaagaactaatttatgattctaaataaatctcaccctttttcagtaaatctgcttctccaaactgaagtagtttacacacagttttaaggctataaatgatagttatataccactgttactaatacatttgtatatagtctaaagtttgaaacaaagctctgtgagctaaggggctgtgtcttgttgttttactgctatttcccaatgcctagaatggtatttgacctgtaggtacacagtaactctttggatggatgaatgggtgggtggatgaatggatgtctaactaacttaaagcccaagttatgggttatggtgttggatgtccagaattcccagaataagatgccatctatttgtggattaaataattctaacatggttttaaaaatatttttaaaataattattctgcctaggctagtccaatcaagagtcttttaattttgaaagaaatctttggtctagaaagagctctgagagatgaaaccaatatgtgcctggagttttgggggttttttaggtggctttttttttttttttttttaagatattttgataaatggtcaactgtaatatgtgaaaagttttaagcaggcctacagttttgttctgtaattttctctgcagtttcttcactttaataatattaatgcttcttactagttgagctgataaccttcttctcccaaatgttgcagagcttttaacctcctctgattagaaccatttcaggaagtagcctgcaaacattgaaaaatatgtgaaatgttaagagtaatcttttttagagagagaggtctttaattcagaatttctaaagtgaatttttatatttatccatataatttttatttctttattcagtaggatcataattaaatgccaggtgttggaaaaagaacttaaagtcaattgaaggatacacagagaagaattttacataccaagaaaaaattatgtagacacaaatgtttttagtgtgtgatctacttgtaatgaatattttatattacatttctcaaaagctaggaattaaccaaaatgtaaatatttaatatcctcaaattcacttggagagagtttttctgtgattcatagccagaaatagtagacatgattgggtctcaacatttcttgctgttttagtgcttggcttaaaaatgtaataaaaattaaaacccagaattaaaattcattcctcaaaattcagttgatttctaattttttgttgattccatttgtgttacattttatggtgtaattttatgtacaagccaacattgtttttgttgctgtatgtagtcggtgctgtgacttgtttgtgctcatctctgttctgtaggcaacttgccactccctactgaataaagctacagtaaaagaaaaaaaggaaaacaaaaaatcagtaagtttggagaactttttattagctgtttctttcaaagcaaaacaaaaatcttttgctgtttgttaagaatatcttcacttcagcctatttgaccttcactgtaaaatcattctactaattctggcacaaaatagctttcatttcaattaaccctggaattaagttacattgaaacattctctgtgttcctttggtttgatttatcccaaaggcaatttgtgggcatttgttgcattggatatccttggtctaattttattattgttactttttaaattataaatgaatgcaaagaaacttaatttcaaggccttaggaaacgctgactgtcttcattcttgcttcttgtttgaaggtaatgtgagtggtttcttttcccagagatgacagtgtttcttaattgttagaagtatatggtgggaaagagtcactttctaaatcttacctaaaagttgctaaattttatttttttactcttcatatttttatctaggcagtctcaggcataatttagatatttgtgcatagattatagaaattttaatggtaaaactacttttacctcaaaaaaataagaggtaaatgataagatagtacttttgagataaaagaaaactgagttcatatttgtagaaaaacacatcattctgcaaacataatgtgaatatactatctgcttctatgaacttgccttgatttatttaaaaggaagaaaattatgagagtcgtaattattttcttccagtgaatggaatttgtccaaaatataatatgcattcattttacatttgccattatctgtcacagtgacttatcaggctgagccctgtctttgttcatataatccaaatgattgtagagtaagatgtaaagaaaactaagtaggtagttttcttaaaagggtgtaatttagaatacagtgttcatctggtttcatctttcatgccttatctaaactttacatataataaaagctttatggctgggcacagtggctcatacctgtaatccgggcactttgggagaccaaggtgggagtatctcttgagcccaagagttaaagaccagcttgggcaacatagcgagtcgtctctacaaataatttttttttttttttaattagccaggcgtggtggtgtactcctgtagtcccagctactcgggaggctgaggcaggaggattgcttgagcccaggtggttgaggctgcagtgagctgtgattgtatcactgtactccaccatgagtgacagagtaagaccctgtctcacaaaaaaaaaaaaaaaaaaagaaaacgaaaaagctttacatataagtttctaagctgtacatataaattatctaagctttaaatatagatttttaaaattcaaatcaaaatttaaatttatagacatatacttttgttgtgtccattgaagattttatttttgattatattaagtaaatttgcctagctatgatcaaattgattggattataaagacgtttctaatgcttcagccttctaattctcagcatatgtgagtttaacataatgtacaccatcattgttgaaattaatttgctgcttctaacactcttgttcagtgttatactaatgccattttgtagtgtatcacataattaaaattcaggctttctgtgtttctctagagcatgttttctagcctttctaacactgctttatttattaagattatgtctaaaattgtttcttgaaatgtttttttttctactagagttattttcaaaaaatttttttttaatttctgggtaacaccaagttttggaatgtatttctcagcacaggtaatacgagctcctcatggaaacaaggggaatctaattggtaattcgagatattttagagtacattccaaagtatgaagacagtatactcataaatttaaaatgttgttttatggagttgtgtgctttaacaaaacctaatgatatttaagagcaagctgactttctttttgggtgtatatgtcatggattggaatatgtaaaatatagagagaagatctggcttctagtatatagctgtgtagtcacattacaaataactgtttattattctcaaatatatagtgtataatgaggtttactttgaaagttaactgtctgcctaactcagggagaatgcagtaactaagcatatatgggtagtaatgctcttgctgaagtgtagtttatgactacatgcattcgcgttatgtagtcagcttttaccaagggaagaaagggtacatttggctgataactggtctcaacacacagactggcccaagtttgaccttttatgcagaatgtcttttggatccaaattagatttttatggattaaaaaaaacactagagcatgtatgtattatgaggtaaaattacattgatgtcaattagtggtgaatgaaaaaaaaacagtccttttataagttgacttacgaaacttgttatgtagcatttttattggtttttaaaatcagtttttagttccaaaattatattgattctgccatcagtgatacatatatttatatgatacatgagacagtatgtgttcctgaggtgtcgatattttgggttttgacatgaattatttttaaagatgtggaagatggtaaaagtgtagtacttttcataaagtttacaatatgcttttgggaaatcactcagtttttcattaaattctgaggctgagtaccattaaatcaggtgtaaatatgagtcacattttaaaacttctttgtcctagagaaaaccggtaaatagctactttcaaagaagtattttgtctaattgatgataaccattacaaatttccttgttccttctccactcccagtgcttcattttactagcataaaaaataaaacagtattttgaaagctctccatgtgtttcacagcaggttaacattttataaactaactggttctttgaaaattaaactatgggttttagttttgtaaaaacttttagaattttaatgagttaaacgtatgagatgctaattcttttaaaataatctattttaaaataattataaagcagtttttaatccttttccctcctgctaactcactccttaaaggctttaaaatgttataggtttcttttgtctgcctttatttatttatttatttatttattttgagacagtctctctgtcacccagattggagtgcagtggcacgatggctcactgcaacctccacctcctgggtttaagcgattctcctgccttagccttccaagtagctgggattacaggtgtggctccaccatgtccagctaatttttgtatttttagtagagatggggttttgccatgttggccaggctggtttcgaactcctagcctcaagtgatctgcccgcctcggcctcccagagtgctgggattacaggcatgagccaccacgcccagccagagaattgtctaagattaaaatttgggagttttagaaaaccactcagtagcaatgatggtctatgaatattctaaaattatgtgaagaattttgtgtgtgtgaatgcatacattcatttttctaacctttatcagatttcaaagaggttcctcgtccccagaaggttcaacaccgtactggaatagtcaaagcactggaattttttcttaattttacatctttctatagttttagctaaaacttctgtatctaattctaaatgtatatatttgagctaaaaataaatggtatttaggttttaaagccattctaataaagcagctatatttagtcaccttcaccagtttccccttatttaagggttaaggttgttcttcatgcaataaacactgtaacataaagaaagcttcctgaactatgtgtagtgtaactgaagatggaactatattagttacaactgacctctttttatcacctcttacaaatattttctctaaaatctagtttttactaacttcctgttagagattatagaaagctattttgaggttataagcagtgataacacatttaaaatgtggactgcatgaagcactacattgaacaagatgaagtgaaataatccccattttttccagagttaatctggagtcagcctgtcataatttgtgtcataatttcctgtcataaattatgacaggaaatatttattgaagcattgtgaaaaaaatagctacgtgatattccgcatgtaaatctgggtcccctcccaccaatatcctttgaaatgaaggtttatccttgacatcacagaatattgagtggaatgctacagttttgtagtcactgctactttaaacagcagtttagccgcactaagcaagaatagctgtagagattaaaatgttacattaagtgttctttaaaaatgaacatatatagtatatataaaaatgtaaactgcaaaatataattttcatctatgacatgatttaaagcaggggactctggaaagggatgggagctgaaccagttttatagcactcttcccgagctaaggtacctttttatcttaatgtagaatgttttataaagggaaaatcatccattttaaatattgggttcacattgcttttcaggctggacaaccatttcttgagttcttaaattatttttatttgacagaattataaattgaggtagacataggggttctctcttctggtgagatccttttttcttttaggtccccaagaattcccatccctccatggtttaaataataggtaggttcttgtattataaaggaagctgtgaagaaaaggcactggcagtaacattacttgtaagtaagtttttttttttctcagtaagaatctaatattttattttgtatatggcaagcatttttttcttaaattcaattgtaactggtacacaacaaaatgtaaatatgtactatcaggtataggatgttttgggggtgtgctgttgaaaatttagtttcacgttataaagttgaccacactttcatgtctgttaatcttagtaaattatgatcatctttgtgtgaaaaatttggtctgctttcattactcatcaaacatgcagtataagtgatgatacagtgaagatcttttttcaggtttcttctacccatctcatccatgaggtttttctttcctctgagataccttaattgtactttaatatgatataagactagaattgagaggaaactttattttctcatgttttgggagaagaaaaaaatagaaatatgtcattcatgaggactgattgattcagagtttttatgcaaagtttgacctttgaactctttgttttcatgtctttatattaattcaaaccttatactcaattctcaactccttgtttttaggtggttagccagcgtttccctcagaacagcatcggtgcagtaggaagtgccatgttcctcagatttatcaatcctgccattgtctcaccgtatgaagcagggattttagataaaaagccaccacctagaatcgaaaggggcttgaagttaatgtcaaaggtgaattattttgataatctagctatcttaaattccccttccaactaaattttcagcttttcttacagtacttcctcttacatttatatttgaaataccctatggttttcagttatgtgcttttgttttatttgtttatattacaaaggaattcattagttaggtacctgatggaccttattttcatgataaaacattttattatagcagatgtcttgtgttatgaagatcattttttgcgtaatcattctagacattctgaaacagactagaatgtagactataggattttttattttaaaagtcattaaacatttttaatatgtatttttacatgtaaatataataattatatttgggaaggttagaaacactacctaaaataatttatagaatgaggaatgtttgatttttaagtactagcagaaattatatcaatgagaaaattcatgtttttaaagaatgtcttaatgtatagacttcatacaataaataatctgattatttataaccctgttttattgtgtagatacttcagagtattgccaatcatgttctcttcacaaaagaagaacatatgcggcctttcaatgattttgtgaaaagcaactttgatgcagcacgcaggtaattttcttgccacttactcagttgctctgtttgaatcaaatattttcggtttcacataaatccatgtacctgttttacatgaagttcctgtgtaagtttttttcttttcctgctctaggtcaagacatagcttgtcttattttattttactataaaagacagtcatgaaataaattaatattttttataatttggtagtgattttcatatttgaaaaccaagagggatttttgacatgtctaattaaataaaggatttgaggatggtacaatatgtggacaaggaagaagtaggattctttttatttaaaactaaaaccaaattggtatcaataatacataacaatgtttaataaggtttttttgatgttagagtatttgtgatacttaaatttggaagtgtatctaaactaaaatgttattctttaaaccaagtcaaacaaacacataagattttgtttatgaggaactgaactttatgattttagaaaacttttctgctagatttctataactagttatttcactttatttctctgagttattggtctatctgtaaagtagggataaactctttgcctgagttgtttttagagaaaaaaatgagataattcataagaaagcgctttgtaaatttatgtctggaattctgcttttcatgcagtgtgaatctaattgatcctcatcatctaagctagccttgtacaactctctcttccagtttatcatcattgtagttgttactgactttttttctgttagagaaattggagttgaaaaggtatattgctgaatgacaagccatgttggaaagagagtgaatgtcagcataggattcatattctggcactctgtgtacccatacaaagttaaaaggatcaaagttttaatcctggctctgacctagcaggctatatatctttggggaggtctttcgtctggaccttcatttccttatctgtaaaatactagcctctttccaaagtttcatccatcttaattttgttgttgtttaacttcagagcctactttgaagctgaagccgggtatcagaaatggaaagccaactttctccttgtcctttttgctttgtctaatgtcaagtcacattgtgtgaacaagccctccatatttgtaatcttagttacttcacaaagttacttcttataaatttaattcaaacataagtctgggtgtatctggtgttgaaaattctaatgactttgcatttttgaaggtttttccttgatatagcatctgattgtcctacaagtgatgcagtaaatcatagtctttccttcataagtgacggcaatgtgcttgctttacatcgtctactctggaacaatcaggagaaaattgggcagtatctttccagcaacaggtaagatttcccagtcatggggatagtgaacactctccgtttaaatttagattaatacaattattggtcatgaatagtgctttttactttgcatcttcttggactaagaattatggtttagaaagagaaagattctttttttcaaaaaaatacaaacaaaaggttaagtcatattaaataatcaacaaacctacctaggttccagtggtcattattattatttttttgtcaggttaagaaatcacagatttgctctttgggtttttatggcttgcagattgttatagatccaaagaagttcagattagcgttggcatttgactctgaagaacagccaattcgtaggaattcagtaattaaaatattgtcagtgttttaattctatgataaactcattcgtgatactcttaagtatatgcaaataaagctttatatagaaaataccggcctggcacagtggattacacctataatctcagcactttgggtggctgaggcaggcagatcacctgaggtcaggagttcgagatcaggctggccaacatggtgaaaccctgtctctacgaaaaatacaaaaattagctgggcatggtggcaggggcctgtaatcccagctactcgggaggctgagccaggaaaatcgcttgaacccaggaggcagaggttgcagtgatccaagatcgcacaattgtactccagcctgggccacaagagctaaactccatctcagaaattaaaaaaaaaaaaaaaatacttaaaaatcaaaattattaatttgggcattgtttcattagctcttattagtctcttgtgtaacataaattacttgctgtcccatctagttatataaacttgtaaagggaccaaattcctatgtatgaagagttccttacaaaggaagaatgagtccaaattatttttaaatgccaataaaaatgattagcacattcacgggaaaagtagtggactgtgaagctaagggtaagcaattgggagatgggagtttaaatgacagggcattttaatcttttatgaattattaatggattgaagtagacatggtcctgaggtctttttggtgctgtttacaaatcagctgacagtaaaaggaaaagcaaccagttacaagttaaagaaatgtgtagtgctaaatgtgaactgctaattttttttctaagtagtttgctgtatctagggatcataaagctgttggaagacgaccttttgataagatggcaacacttcttgcatacctgggtcctccagagcacaaacctgtggcagatacacactggtccagccttaaccttaccagttcaaagtttgaggaatttatgactaggtaaagtacaaccttgaaatagttgattgctttctttttggttgagaaggagagtttgccaccaggccacttgttagatatgatagaagactatgaggaaagatgtatttaataatcacattgccatgtttggggaatccaactatatattatttatatatatagggtgtgttttattttatatattgattgtcataacaatagtaacaaatcatattttatcatcttgctttcataagttttcacatttaatacttaccagggagtgaagacaacattattttcaaattatagttaaggaaaatgcaactcaatgtgaataattgacttgcctaagattccacacctgattcataggtcttttggttttaagtgcaggacttctctactacactataacatttttcagaaccctcataaaggttaatggttttaaattatttcagattaaggttcagaaaatatagtatacttcagtattgctataaaatttctgtggacatttgtttgaatcccatttagtgggatttagtttgtgaatgaaaagatcctcattgttagacacttactctgtgatgatacagtgagagtagtttgctgaatcttttaaagtacctttcacaggactttatgcttagtaagtgctccttcgtgtctgtgatttgagtgctatgttcatagtatgttccaaaacagaataaaacagaatctgatgatgagaagttaaagatttgtatataatatgccttgaattgtaagtgcctgttgttagttgtattacttacaggtcatggttttgtacatataactccaaaccattgatactgttaaaagaatatatgaatatatgaaagaatgtataaacataagaatgtatgggtatatagtgtcctttccaaattaatttttatttttagctctactagattttttttagtgtaacaaatgtttattcctatgtaattaagggcatattttccatacagactattcacattacctaattgaaaattatatactacaaaaatataatactatttttaggccagacatggtggctaatacctataaccccaacattttgagaggccaaggtgagagaattgctggaggccaggagttcaagaccagcctgggcaacatagtgagaccttgtctttattagatagatagatagataggtaggtaggtaggtaggtaggtaggtaggtagatagataggtaggtaggtaggtaggtaggtaggtaggtagatagatagatagataagataagataagataagatagataagatagatagattgggcacagtggctcatgcctgtaatcccagcattttgggaggccaaggcaggaggattgcttgagcccaggagtttgagaccaccctgggcaacatagcaggactccatctctacaaataataaaatattaaccaggtgtgatggtacgcacctgtggtcccagctacctgggaggctgaggtgggaggattgcttgaggatgcagtgaactgtgattgcaccagtgcatttccagcctaggtgacagaatgagaccttgtctataaataaagaaataagtaaaaatataaataagtaaaaagaaatataagtaaatataaatataaataaatataaatataaaaatgaatgaatcaaaacagtttttaaatttgacatcactgaggacatcctagccatttttctagaaaaatatttttattattccttttttctgagatcctaccttcccttacaaagcaatcttttgtgcttttgaagattaagtaatccaatatatataatatacttagcatagtatctggtacttgtaaagtaattaataaatgttggatcttatttttgttctaaattcccactgatgctcttggagacccattttcttttttttaaaaaaaatgaaggtagctttataatattctcagttatttaaaaaattattaaattacttgatatagaaatctaaagaaagttaaaaaaattaaaaattgtttatcctccctctcagaatacttcacttaacgtttggtgaatagtctcccagtcatttatctatgcacatgtacatttgtttctcctatcaaatgatatctaggttgtttccattaatatttttaaaattctgacctggtaccagcagcatgatgggctgagctaatgcaatctcttcccaagacataaggctcatagaaatactaggtgtaaaagaaaatatgtgtacttaaaaaaatttaggccgagtgcggtgactcacgcctgtaatcccagcattttgggaggccgaggtgggtagatcacctgaggtcaggagttcgaggcaagcctggccagcatggcgaaaccccatctctactaaataaataaatatatatatatgaattagccaggtgtggtggtgggcacttgtaatcccagctacttgggaggccaaggcaggagaatcatttgaacccgggaggcagaggttgcagtgagccgagatcgtgccactgcactccagcctggtcaacaagagcaaaactccatctcaaaaaaaaaaaaaaattaaatttatagctgaagctagtttctaagcaaattacctagcatacagtcagtatagacagataaatggaaaatatgaaagaggttaggagatgcagaagataaaatgaggaggttcaaaatatgtctagtaggtgttccctagaaactgagctcagtgagaatgggaagaagtaatatttgaaaggctaatggatgtatgttttctagagttgatgaatgacatgaatcttgaggttgaagaagcacactgagtcttgagcaaactatataaaaattaaaccaggctttaatacatatgggaacataatatatgctaaagctggtattcagaatcgagattaggatggactttcaataaatggttttgataaaactgagtaatgatttggaaaaatattttcataccatttatgataaacttccataaatcaaaaaaaatgagcaaagcaaggcctttttcatccattcaaaatccataaactagaaaagattgataaaatgaattatttaaaaaatcataaacttctgtctgggacaaaaatgtcatgagtaaaaccaatcctatggttaatattcttgcccagtagttctcttagaatagtcctaaaagtgcttttgtggttcaaagagtaataccttgaaatttttggtgcatgttgccaaattaccctttagaatgcctgttgcttttaaaatattttttcattttagtattttattgtttatccaattatagacttttttacatactcagtagacaacataaagcctcataattactctgttatttttcttttaggcatcaggtacatgaaaaagaagaattcaaggctttgaaaacgttaagtattttctaccaagctgggacttccaaagctgggaatcctattttttattatgttgcacggaggtaagaaatactatgttttgggtctcttaacagaattttttaaattatagcaaatatagagagatggcaagtttggtttttcccagttgacttaacaggaattgaagacaagtttacttgggagcatatagcagggtaaatagcctgcgtttcctaaaatgatggtcggtatctagtagctgcttttcatactacccatttcatattgcttactctgtcctacatcattttttaaaatactgcctgcaatggattaattaccaagagttaaaaacccacaaagaatcttttgttttcaagtatattctgattaaatagtactcacaacatgataactgggaactttttttaaaggaagaaataaaactataagagcctatttctgagaacttttaaaaatatgctgtgtaagacagcatcaggatgatttaaaaaataattcaaaggagtggtgaaaaatctctatgaagatggtgcaaggggtggcctggaaaacggtgcttgttcatgctgccctcagttgaggctagttcctagaaagcctttctggaaatgttgtgagctcttccttaataataggtatgatgcttgccttgctttccctaccattgtcttttcttttttgcttcattttaccttccttttgaaaactcaatctgtgacgttatttggtcagttttactttttcccatttaccatgacatacattcatggtaattgagccttagagacaacatgatacatagagaaaccactgactttggaatctcaaggaccatgtttagacctagttctgctactcattagttatagacttaatctttaccagtttcctgaatttaacagtatttaacatccatgaccattaagttagtagacttacattgttagtcagcttgctggccacaggtggcagtgtgtaggaaacaaatcaaggttgagaaatagtagagagacggtgaaggaagatcagtggaagatgggaaacttgtctaatagggtcattcagatagccttaagaccaagaagtccaaaggactggagtattagggaatcaagaaagtaagaaaattgcattgaacctcccgccacccccctgccctttaacaactctaagtaacccctgctcaccttcccatgaaaggcctctctccagctctcatctcagttgccatttctaaattgcctaagatcattttaattttcgtttgcgtttgagatgaaccatatttgtattctaaccccaacctttaatacaaccaggatatttttacttttccgttgttgtctaagtaaaaagcaaacattggtaagggaggtagaagatgtgtttccccctcttctttaaaatcttattagtttacaaatagcaaagatttctggaaaacaaagctgcgtttttttttttcggaatcagaaactgttatatttgtattccctctctgtggtgatctagaaaaagctaaaggaaagattggacctgctgcagatcccttagtgagattcaatcagtttggtttccatgaaacctattgagtcttgtggcctgagaatgctaagaattctcagctctgctgcttattagctgcataatcttttttttttttttgaaatggagtttcactcttgtcacccaggctggagtgcaatggagcgatctcggctcactgcaacctccacctcctggcttcaagtgattctcctgtcttagcctcccgagtagctgggattgcagacatgtagaaccatgcgtggctgattttgtatttttagtagagatggggtttcaccatattggccaggctggtcttgaactcctgacctcaggtgatctgcctgcctcggcctcccaaagtgctgggaattacaggtgtgagccactgcacctggccttagctgcataatcttagataagtttatttttccaaatctgttgcttcatatgttaaagctggggtatgtgcttataaaaactgtctacctctcctataaagtgttttgtgacctataaagttgtgtaaggagtaaatttgagattttctttttttctttcattctttttttgggggatatggcactgtcagtttcagattttcaatccttttagtttcttacttagacctactggagctcctcctgaccttcattttcacctggtgtgaagcctagctccaagacagatgagtacacagtatatcagagcagagcatccatttactccattatgaaggtcttgtctgtctgtatgccgtcagttttgtcaaagagcacttgggtttgacttctcttttgatattcctgtgtttctgtggcttagactactatgtattaagtaatgctttttgaattgtggattttctaatttccttatcgatggtccacagacgtttcagacttgaaatgtccaaaacttaattcagtatatcttcaaatcaacctcctcttcacaccgtatttctgtttctcagtaccatcatcatcccttctagttccccatctagagaccctaatcattttaaattctttcctcttattgtctttctcattgttagtcaccaaatcttggttttacctgtgagatcctgggcaatcagttaagttgttttagttaggcttttattgcaaagcagtcatttgtattttctcaaggatagtttttaggaaaagcatgaattagcgcagagcctacccagatatagagaactagatggctgtggtgctggaactggctatgctctttgactgtctctcggttttgtgttcaactcttcctcatgattttcatctttctgtatcctttcagcttttgccccagatagtaacccgttcattatctcagtactgcacatctgaaattccagaaagaaaatatgattcagctaaaaagcatctctgcttggcagaaactttaatgttaggttctggccagccagttgattactggctgcccctatgtccagtatgtgctcctggcccagcagtcatgtgattcaaaatgtgaccacttggctgggcgcggtggctcatgcctgtaatcccagcactttgggaggctgaggcgggcagatcatgaggtcaggagatcaagaccgtcctggccaacatgatgaaaccccatctctactaaaacacaaaaaattaggcaggcgtggtggcacgtggctgtagtcccagctactcgggaggctgaggcaggggaattgcttgaacccgggaggtggaggttgcagtgaaccaagattgcaccactgcactccagcctggtgacagagcaagactctgtctaaaaaaaaaaaaaaaaaagtgaccacttggtgctgtttcttcatcaggggctgttcttaggtatgtgttttaattttttttgttttgtttttgagacagggtctcactctgttgtctaggctggagtgcagtggcactaccatggctcactgcagcctctagctcccaggctcaaacaatcttcctgcctcatactcccaagtagctgggacaacaggtgtgtgccaccacagctggctaatttattattattattttttttgtagagatgaggttttgctatgttgcgcaggctgggcttgaactcctgggctcaagcaatcctcctgccttggcctcctaaagtgctggaattacagatgtgagccaccacacctggcctaatttttttttttagttggaccttaatggtctaatattactattacgtaccttggcaatgtctttcgaaaccattttcccccactgctttgctggaactctgtgtcttacctatactaatgtagcattattctcctcctccttcatcaccagttgactacttctaggtaatcttaacatttcttctggagccagtttccagtagaaagcttgtctgtcccattgactccctgtataaagtccaagttctgtagtcaaacatgcaaggtaattttggcctaatgtacttttctaatcttttccttctattccatccaatatacttatgctcttgccctgtggtaaggtagcataatacaaggacattgttgcaacattgtttatatagtggcaacaaaaaggaaaacaatagagttgtgtttcaaaaggggaattgttgaataaatgatgatacatttacattagggaataaggcaatgtgttaattttgcttgttacaagtgacagaaatgcaattcaaatttatgtgtgccaaaaaggaatttattgactcatgtacctaagaaaatcaagagatgtattagtttcttgcatgactagctgcagagctttaaacagtatcatctgcagaacatctgtcttctctggctcttaactctactttctttgtgtcggttttattcccaagcagctgctccctagctgtggctggtaatggtttgtgttctcccagcttaacaatcccagaggaaaaacacctctttcccagttttgtggtttcagcaaaagtggttggtcttactggcctggtgtgagtcacatgccattcctaaggcagtcactatggcaagggggatggaatttcttggttatctaggcctggatcatgtgccccttcctggaatgcagtggtaaagccagccctatccaaattgcatgaactaaaaggagggcatgggggcagggttttcacaaaggaaaattgaattgctgttactagaatgaggcaaaatggatactgggcaggcagaagtagcagaagtcctctacatccagctttaaaaaggcccagaaagatgactctgacacttaccttacaaggtacacgacagtgtgtgtgtgcacctgcacatgtgtatgtgtagactgagaaatgtatgaaagtatacatattaactgttcacattgcttatctcagaagtgtgattggaggagatagaggaccaatttaatatttctgttatctatctctatgttgtttggcttgccaggagcatatattgtttttgtaagaataattaaaaatataaaaccccaaagtggccgggcaaggtggctcacacctgtaatcccagcactttgggaggccaaggcggggaaatcacttgggctcaggagtttgagatcagcttgggcagcatggtgaaaccctgtcaccacggaagaatacaaaaatcagccgtacattgtggcatacacctgtagccccagctactcaggaggctgaggtgggaggatcacttgatcctgggaggtcaagactgcattgagccgagatcacaccactgtactccagcctgggcaacagagtgaggccttctctgaaagaatacattaaaacaaaacaaaacaaaaaccccaagttacaaagaagagttttcctcttaggaatattgtgatacctggcaattgctttttgggtggtagtagtaaataatgataatagctaacatttcctaagtgctttctctgcatcaggaaactgtgcatattacataatttctcatttaatctacataataaccttctgagatattattaacaattaattgacgtacgtataaactgaaacccaaacatggctatcagaatgatctggaacattaaaacaaacatatccccagcccccatttccaaaccaaaatctcaggggcagggccttatttatatatttaacaggcactccaagtgtttcatttattactaaagtttgggaatctcactgggtcatgtacttaattcatggtagcacaactagtaagaatcagaattcggtttcaaacctaagccaaagctcttaacaaatgcactattaattacatgcttattactattataattgtatgcttgggtaaatctttgtagatgagcatgaaaacctaaccaacagttatgagatatattactctggggaaaataagttctcgattccaggcatctgatttacaaatggttttttgaaacataagacaagagtgtactcaatataagataatcttgtcattggcgcaatatcattatacattacaaaggttagcagaattggcaccttttcttagcgaaatgacatattactattaacacattcatgaaatatgttaatacagatgaatgtgttattttgtagagcgctttagtttatcagattagcattttttgtctgtttaataaaaaataaaatatagaccgggcatggtggctcacacctgtaatctcagcactttgggaagccaaggcgggtagatcccctgaagtcaggagtttgagaccagcgtggccaacatggtgaaacccctctactaaaaatacaaaaaattaatcgagcgtggtggtgggcatctgtaatcccagctactctgggggctgaggcaggagaattgcttgaacccaggaggtggaggttgcagtgagctgaggtcatgccattgcactccagcctgggcaacaggagtgaaactctgtctcaaaaaaataaaaataaaatacaaaaacaacttcccccataccactccttatcccacacccccatcctctatcccctatcccctatccttcatctctctgtcactgttgctcactcgctctctcactctcatgtgtgtgctctctctcacatacaccacacacacacacacaccccacctacataatttcttctcttacacctttaatataaatatctgagttttggttcagttttgcaaacatttaaaaggcaaacatggtattttgcttgtttcagcatttaataaggtagtgcatacttctttcatatggaaggaaaacatcatattaagttaatatttaaacgtacacaattataatttgcaaaaaaaaatcaagatgataatttcttaaatagtaaattgaaataaatgatattttcctagcatgcttgtcattcagcaataataagaaactgagataagaatgcaggcagttgaagttcacttcagcctgagtgcaagtatacacaaaacagcaaaaatattacatagaaaataaatgttgtccattggattgagtatggtgctaccatttgtcacagtgttcatattcatagttgtggctatctttggggtcactgctgtattcagacttgtcttggaatttggagtcatctagggatttgaggtcattttgagatttgggcttgtcccaggattggtgctaccatttgtcacagtattcatattcatagttgtggctctttggggtcactgctctattcagacttgtcttggaatttggagtcatcttgggactcgaggtcattttgagatctgggcttatcccaggattggggttcattctgggattggtgctcttcctgggattaggtctggtcccgggattcaggcttgacgcaggattggatactgccatagaatttgaggttgttgatgttgaagtttgtccccggaatgttaacaaacatgaagagcaggccaatcggtgatagcttgaacatcatcctcctctgtttcacaataattatataattttaattgaacacttggatcacaaataggcaagcatatatccttaattgtgtttatcagtacatttgtgttatgtaaatgtttgctttttcactattagtgaacaaattaaaagcttccctttctttgttgtcaacatctgctgacacaagacctattttctattgagggctaccaactgaaggcaaaaacaatcccaagactgaaaaagagcttaattggcatttttctatttaaaaaaggaaaaaaataaaactctagacattcaatgcaataaatatgggggcttgagatcagtatagagtagggtaggggcaaagactgagaggcaatttgggacagtagagcaacaaaagaaataatgaaataaatattggtattttcttgatttctcatgacctttattccaacaatttaaggttttagtttaggtcacaaattaggatattacttctaaatatttacccaaagactaaagaggttaaaccaaagcatttccccagtgctgggatgaggttttcttcattaacaacaacaacaacaacaataacaaactagagaagttcatagttttaagatttagaaatgaacaaaaccaactccttcattttgcaaatgggctcagacaaggggcataacttacctgagggtgcatatctaaaaatgacccaagctagaacttaagtctgtgacttaaagcccaaattttaactgtagaactctaacatatatattaaaagttacatttggctctaatatgtaattgagaacatttcaaattaatgttaccttttgatatttttctttgaagagtaagaattcagtctttctccagcgtctatggggaatctgatttctcactcactgcatgctatttaaatataattagtgaggaagtcatgtgttctaaacttgacctgccatttgctctttggaagtatccaactgagtgtttccagacaactacatataaacagatagactttggcagagattaaagaattcaaataaagttctaaaatctgcttgctaatttaaagaatccagtgaatagcatttgttattcctcttaccatgtatacattaatgaattgcttcactggattgactctaactagatgaatttactattttgcctgctgtgattattatgattttaaaccaagtaagtgtattaaaggtgtctgcgttttccttagaacatctgtacatatgtttatagggcagtttctacccatggttattttgaagtttaaaaaataattcagtaatacaacatttcaggtatttaatttttggtaaataaagtaaccttagaaaagaagttaaacttcattaatatgaaacttaagaaaaggattacatatgaaagtgatactttttcatactgagtttacaaacttttgtgtgtttgtgtatggttttttaatgtattaaaccagtcaccttgaagtgcataaagtaaattttttgaaggaattttgtcttttggtcagccgttttccatgataactagcatatagggaaattgggttgtattctgctaatgttttcatcatattggccagcacactttaaaaattgcaggactgtgaacaatggtgttgacatacaaggaaattgcaacataaatggcagaagtacaagccagtacatgttcctcacttgttttactgtgctgtgaagatcatttttcccctgaatgaataaaccatgaatagaaccatgcttggtaaatcttatttatatggtacatataataacttcacttaactggaggttaatgtggtcagatctaagaagtaaacaaacaaaaaaaaactacttggcaaccagagtagatattatgaatcggagtactgcagtaatttacaggagtttgtcattgtcctctctctgctcacttgctcattctgtggatttctttggggggtatatagttggtaatagtaatagtaatagtaatagtaatagtaatgtttcgaacttgagcaaactgtgacttattctatttttctaatcttgaccttttgagtactacacttacacaactctttattgatgcttcaaacacctcagtctcaacttgtttaaaattcagaagttagtgttttctccttcctatttttgtatctagatatattcttctcataatctcttggttaattgtatcatcacctagccaaatgtttctccaacactggatttctcattatcttctctttcttatttatcttaagctctccaggcctcttcatgatgattaagtaaaatttaaattctatttagtactcaaatgttcccaaacaaacaatagtcaatttgccattattcaggtcttcaaatacccaccaactttgtatctttgtgcagcctccccaacttgcccaaagtgtaataatagccccctcttatcctaagtttcactttccatagtttcagttacccatggtccaccatggtctgaaaatactcaatggaaaattccagaaataaacataagttggatgtatcatgaggttaatagtagcctagcactgtgtcacagtgctgcattagtcaacccacttcatcttatcacataggcattgtgtcatatcacatcatcacaagaagggcgagtatagtacaataagatattttgagagagatgccatgtgcatgtgcttttattgtagtatattgctataacttctattttattattgtttttaatctcttactgtgcctaatttataattaaactttatcacaggtatttctgtataggagaaaaacacagcatatattgggttcaatactgtaattctgtggtttcaggtatccctgaggggtcttggaacatatcccccacagttaagggggtactactgtactttcctcattcaaaattgtgttgtttcttcaagctccactcatgtcagcaccttttatacgatccttccctaattcttcacgtcagaatcagtcattttagtactttatactttgatcagagtctcattttcactaaagaaactaaatcttccaccatattctggctttttttgtggtaagataccacctcttattccttctattccctctagcttctaatatagtgagtgtttataaagaataggacacagggccagttataaagaataggacacaggctcatgcctgtaatcccagcactttgggaggccgaggtgggcagatcacgaggtcaggagatggagaccatcctggctaacacggtgaaaccccatctctactaaaaatacaaaaaattagccaggcttggtggtatgcgcctgtagtcccagctacttgggaggctgaggcaggagcatcgcttgaatccaggaggtggaggttgcagtgagctgagatcgcaccactgcactccagcctgggggacagagcaagactccatctcaaaaaaaaaaaaaaaaaaaaaaaaggggcacaataagtattggaattcattgaaatacctcctgtttctccatgtcggagggctggtatcattaatgatgtctaaagtaagagttatttggttatttgcagttttcccttcacattagcataaatttggaaggcacaggcttgagtttaactttcatctctactttcctggctgctgttttgagaagatttcttcatttgtacaatgtggatcataatgcacattcataatcccttgtctgtaatctgaaaccccaaatcctccaaaaaccttaagttttatcaaaaaataaaaaagtttgacaccaaaatttatttggtgcaaatgccttatctgcatagatgggaggtttttagctatctttgtttcacttagtgtggatattaatgttgcgctgcagaaatattgatgagattgattttggggtgctgttccattttctactggagtgttacataatacatgataagaatagtacttagcatattcatgtttctcttcttccttctgggcacagcaccataccactcttagcattctgatagttaggtggtaccatctgactgagttctggccagtaaaatgtcagttccaatgatgtacaatcgacccttgaacaacactggggttaggggcactgaatctccacgcaatggaaaatctacgtataacttttgcctccccaaaaactaaactactaataagactgttgatcggaagccttttgataacataaacagattaacatgttttgtaagttaaatgttgtatatgctatattcttagagtgaaataagctccagaaaagaaattgttacccagaaaatcatgaggaagagaaaatatatttactgttctctgagtggaagtggattatcacgaaggtcttcatcctctttatcttcatgttgagtaggtggaggagaaagaagagggattggtcttactgtccccgggctggcagaggtggaagtaaacctctgtataagtggatcagcatggttcaaagccatgttgtttaagggtcaactgtatatgatttttaagcctgatgtctaacttctcaccaatcttccattcttgctttcttctatcaacgcctactagaaacagacggttcagtggagggggtctccaagacgccagaagatggtaaaaccattagaaagcatgatttaagagaaattaacttttgttgtcttagccagtgatattttgggattatttgtgacagaaattagttcgtgctgactaacataactacatgctggacatcttgcctttgcctcttcaaatccactctgttctttaccctgctgtgtaccctaagaggctgacctgtgtagagggtatcattgggctcccctcctttctggctttcagctggcccatagggaatacaagcggaagattagggagaagaaagagagtaaggttaggaggtatatatttttggctccgtttctgcagggtcccagtgggctggctacatccatccatgcagtatggtttttgttgggtgaccctctccacacaacctactctgtgtctgctttctgctaactgcttcctgcactcactacttcaggtgtagtatcacactgtctcttaagagtttccttaaaacctgccttctcctttatacataatctctaatatctcagtttgaatttgccacctgtttcctgctagaaccttaattgctacaagctgtatgtacactgtatcatcttcctaaaatcaccaggcatggtgggatgtgagctatagtcccagcaactcaggaggctgatgtaggaggattgcttgagcccagaaattcaaggctacagtgagctatggataccctaacctgagcaacagagcaagaccttgtctctaaaaaacaaaaattaagttaaaaaattgtgtctttctttatatacttacattactttccgttgatctgtttttgaaatgtttccagaactgtcttccctcacgtattgattcttccaaaattcttaagaaaatggaaaaaagtaatttctgaaaatgatgagaatgatcataaatttcatatagcactttcttgagaatttcaaattgcagttttaatattttactttagaaacaggtccagttttcccttctgtaatttttttctttggtctttttggattttttgggttttttttttttttttttttttgaaaagaacacagagatcttttcttgagtgatatttgcacagacattgccttggtaattgaagcttttttttttttttttttttttttttttttttttttttagaaaatcctattaagttttatgccatgtctatgctcattgcacctgtgcctcatgtctcattcattcattcgtttatttttttattattttttttttttgagacagagtttcgctcttgttgcctaggctggagtgcagtggcacgatctcagctcactgcaacctacacctcccagattcaagtgattctcctgcctcagcctcctgagtagctgggattacaggtgcctgccaccacgcctggctaattttcgtatttttagtagagatggggtttcaccacattggccaggctggtctggaactcctgacctcaggtgatctgcccacctcagcctcccaaagtgctggaattacaggcgtgagccgccgcgcctggccttcatgtctcttttaaataggacttctaaaattttgaaatgaggtcagcttcagtggctcatgcctataatcccagtgctttggaaggccaaggcaagaggatcacttgaagccaggggtttgagaccagcctgggcaacatcatgagaccctgtctctacaaagtacatttaaaaaaaaattagccaggtgtggtggcacacacctgtatagtcttagccacttgggaagctgaggcaagtagatcgcctgaccccaggagttcaaggttgcagtgagctatgttcccaccaccgcacttcagccagttaaggggacagagcgagaccctgtctcaaaaaaattttgttttgaaatgaatttatgtatgtttggttatttctgaaagcagttcaggcctacagccataccaccctgaatgcacctgatgttgtctgaaagcaattcaggttttcaggattaaaatttttatgctactaggtttgtaacctatatttaaaagtagaacatttaaaacattttagtagtatatagcactgaaaagtggctttttagcgtagacagttgtttttcaagaaactattttgtaatcctagctacttgggagcctgaggtgggaggatcgcttgagctcagaatccagtctgggcaacaaaggagaattccagcctctttaaaaaaaaaaaaaaaaggaagaaactatttgggagttttgtgaacaatggatatgcaaaaagacaggccattgttatgagaggcctaattgtgagtaccttctagaattgtatataagcatgattctcttcaatagtaaaatctcagcctcttcattttagaaatctaatataggaaaaagaacacatttctccatagttgtaaaacataggttctcagggtgaatgcccatctttgagcaagtttgtcttcctaatggtataatactgtaagtctgttatctaattttggcttgttgtcacttatttttcataatcaaagaaaaatgatttaattttaaaaagatgctctcctttctgttttcttctcttggatgatagtatccctatctgtctgagtttatagaatcttaatttttacctgctcttaccacatacatctgattagtcattaagtcttactgattctgcttcagaaattttgttttatgcttcactctcatgctaccaacttatttggtagcttcagcagttgtctaagctggggttggcaaattttttctgtaaaggaccaaatagtaaacattttaggctttatagcccatataaagtttttttttaattttttttttttttaaaaaagaaagaaatgtaagaacccacacctgtaattgcagcactttgggaagccgaggcagggtggatcacgaggtcaggagttcaagatcagcctggccaacatggtgaaaacccgtctctactaaagataaattagctgggcgtggtggtgtgtgggtatgtgcctgtaatcccagctactcaggaggctggggcaggagaatcgcttgaacccgggaggcagaggttgcagtgaaccgggatcgcgccactgcactccagcctgagcgacagagtgagactctgtctcaaaaaaaaaaaaaaaaaaaaaaaagtaagaatcatacttagcctggaggccatacaaaaataggtcacaagcaggctgtgggaaggatattgtaagtgggccatactttgctgacctctggtctaggctattacaacaatttcctaattggagtatttgtcaccggtattttaccccggtgtaagattgcctccatcttacacattactgccagaatcatctctctgaaatgtgaccatttcacttccaggtaaaatctttatgtgctccttttagctaagttttcttgcttaaggtattcatgtattacttcggggattttttttttttttgccatttcttcataaccatctatattatttattcagtatttttatagacttttttttcttaaaggaaagtttatactgtgaatggaaaatcaatattgattgccataactagaaaaccaacaaaaggcaacagtaaaaggaaatatagaactatgaaatgcctgtttcatgtagcacccaatcatatatgtactacatttcaaaaagtcactggcttataaaaatattttttagcatctcatacaagtctcttcataatctgttatacagctcaccttacttgcacgattgctgagccaaagcagatcgaaagtcattttggtaagaggctagatgctgaccttgtattctgaaaatctgatgattctactgttgttgatgtgattccaagtaagcctgtgtgaacttctgggctattctcagggaagtgtttatgacacattgttgaaggtatcatcagggcagttgatccaagaagactctaggagctggctaagccacaaagtctgcccaaaaagctcagaatgacaaatgaatgttttgtacattatctccactataatgctagaaaaaagtcttaaaagcatttgtctcaattgatcatttatatggaataatactggttaatcatcttaaatcatcatagtgttgggtaatgtctgtagaaggatgctttaaactctacttggtgcttcagctatgctgaccatctcaccattgccccctttgccatgccctgacatcctcacatgtctctctgcttttgcatactcttttccacctggtttgaatgcccttcctttatcatgggacattatcctttccatttaatacccatcttgataacctgactctgaccccctaggcaagtttaaaaaaaaaaaattcattgaaatgaaattcaccctttttgaagtgtacaattgcctgggcacagtggctcacacctataatccctgcactttgggagactgaggttgggagagtcacttgagtccaggagttcgagaccagcctgggcaacatagtgataccctgcctctacaaaaaaaattgcaaaaattagctggatgtggtggttgatgcctgtagtcccaactactcaggaggctgaggtgggagaatcacttgagcccgggaggttgatgctgcagcaagctgagatcaagccactgcactccagcctggacaatggagagagaccctgtctggaaaaaaaaaaaaaaatcttttttttaagtatacaattttgggccgggcgtggtggttcacgcctgtaatcccagcactttgggaggccgaggcaggtgaatcccgaggtcaggagatcaagaccatcctggctaacacggtgaaaccccgtctctactaaaaatacaaaaaatcagctgggcgcggtggcaggcacctgtagtcccagctacttgggaggctgaggcaggagaatggcttgaacctgggaggcggagcttgcagtgagctgagatagcgccacagcactcaagcccgggtgacagagcgagattccatctcaaaaaaaaaaaaaaaaaagtatacaattttgcatattcagagttgtgtactcattaccactgtctaattttaaacattttcatcactccaaaaagaaacctcatagccatcaacagtcactctcccctttcctcctgccccccctcagcccctggcaaccactgatctactttctgtctctatggatttgcacagtttagatgtttcatataagtggaatcatacaatatgtgctcttttgtgactgccttcttttactttaatattttcaagattcatccatgttgtagcatgtatcagaactttatccctttttatagctgaataatattctattgtattcatacaatatataagcgtttgtgtggacgtatgcattcagtttttttagatacatatctaggagtggaattgagtcatatggtacctcagtgtttaactttagaggaactgccaaatgattttccaaagtagctgcattattttacattgctaccagcagtgaatgagagtttgaatttctgtacatcttcacccaacacttgatattgtctgtctttctagacaaattttgataaatccctccttttctaaaccatagccaagtctattactgtttaacaatgaccatcttggagtataaattttctgttcacactttgaactttaacttccgggtcttagatgtctttatctggatatacagagaatctaggttttgtatgtaattattcaatgatagtattaaaactaagtccggacgcagtggatcacgcctgtaatcccagcactttgggaggccgaggcgggcggatcacgaggtcaggagatcgagaccatcctggctaacacagtgaaatcccgtctctactaaaaatacaaaaacttagctggtcgtggtggcgggcacctgtagtcccagctactcgggaggctgaggcaggagaatggcgtgaacctgggaggcggagcttgcagtgagctgagatggcgccactgcactccagcctgggcgacagagtgagactccatctcaaaaaaacaaacaaaaaaaaacactaattaccagtttttttgtttttgtttttttgggacagggtctcactctgtcgcccaggctgaagtgcagtgacgcagtcacagctcactacagcctcagcctccctgggctcaagtgatccttccagctcagcctcctgagtagctggaactacaggtgtgcaccaccatgccagactaatttttgtatttttttgtagaaacaccatgtctagctgatttttgtattttttgtagagacagggtttgtcatgttgcccaggctgatctcaagctcctggactcaaatgatccaccttggcgtcccaaagtgttaggattacaggcatgagccaccttattaggcctaattaccagttttaattatagacctacatgactacggtttgaaggaaaaagactttatttaatcctagtgattggaattggaattctcatttgagccagaagatttcttgagtggttttgttttctgtgataacttggtttatataagtaatccacattacttgggtgttagtggtaaagcaagtctttgccttgtacaacaaagataatttagtgattgatacattctgaataatctggtggttatgacttgacacatacaaaaaatgttagtggttgcagtccatctgttgctctgtaaaaagatttttgttattgtttgtttgttttgagaccaagtctcactcttattgcctaggctggaatgcagtggcatgatctctgctcactgcaaactctgcctcctggattcaagcaattctcctgcctcagcctcctgagtagctgggattacaggcatgcaccatcatacctggctaatttttgttttgttttgttttttctttttttttgagataaagtctcactatgtcacccagcctggagtgcaatggtgagatctcagctcactgcaacctccgccccccaggttcaagagcttctcttgcctcagtctcccgagtagctgagattaaacagtcatgtgctaccatgcccagctaagttttgtatttttagtagagatggggtttcaccattttggccaggctggtcttgagctcctgacctgaagtgatccgcctgcctcggcctcccaaaatgctgggattacaggcatgagccaccgtgcctggcctaatttttgtatattttatagagacggggtttcgctatgttggccaggctggtctcatagaactcctgacctcaggtgatccacccacctcggcatcccaaagtgctaggattacgggcataagccactgtgcccggccaaaagtttttttgaatcacctatggttcatttatttcagtttaagtgtataatcctcaaaggaaataatccattgggatgtatttatgaagtttaagtctgtaaaacaatgtggaggccgggcgtggtggctcacgcctgtaatcccatcacattaggaggccgaggtgggcagatcacttgaggtcaggagttcgtgaccagcctgccaacatggcaaaaccccatctcttctaaaaatacaaaaattagccgggcatgctttgcgcgcctgtaattccagctactcaggaggctgaggcaggagaatcgcttgagcccgggaggcagaggttgcagtgagccaagataatgccactgcactccagcctgggtgacagcatgagactccatcttaataaataaatagccaagtgtggtggcacatggctatagtcccagctacttgggagggtgagacaggagaattgcttgaacccggcaggcagaggttgcagtaaaccgaaatcgcaccactgcactccaacctgggcaagacagagtgagattctgtttaaaaaaaaaaaaaaaaaaaggaaaaattctgaaacaaccatgtaagaataaatgcatccaaatgaacgttgttcatctcagaagagtcacctttggaggtgatgcacttagttccaactttgctgcctttgagcacaacattttagggaaataattttttggaagtgttgtcaaagtctgaaatacattcttgtagaatgtggaaaatctcatacttgaaattttttgataagcaagacaaaatgtcacgtttagtaatactgttttttgtttaagatgaggtttttctgctggacatgggggctcacacttgtagtcccagcactttgggaggccaaggcaggtagattgcttgagcccaggagctcgagacaaacctaggcaacatgatgaaaccccatcacctgtacaaaaaattagtagagtgtggtgatgagagcctgtagtttcagctgcttgtgaggctgagatcggagaatcactttagcctaggaggtcaaggctgcactccagcctgggtgacagtgagaccctgtcttaaaaaaagttttcttatgtaacttacaaactagctcttagtggtatttgaaaggaacagccccagagttgttttcagtaacgatggtatcattggagtaaaagtatagcgatccaacctgactactttgaagaaataatacagaaaatgaggtgtatcatgtgtgacatttatgtttaaatttaaaatcagtttatagtcaactcatagttaatatacgaatattttttactaacttcaagtgattccttgatcctttaaataattttaatatgcttttttgttgttttttgttttgagatggagtcttgctctgttgcccaggctggagtgcattggggcaatcttggctccctgcaacctccacctactgggttcaagtgattctcctgcctcagcctcccgagtagctgggattacaggtgtgcaccaacacacccggctaatttttgtatttttagtagagacagggttttgctctgttggccaggctggtctccaagtcctgacctcaggtaatctgcctgtcttggctcccaaagtgcttacaggcgtgagccaccacacccagcctattttaatatgttttaaagagactttagcttttacaaggtgtctctaagctcatacttaatgacctgcagctttttttgtagaatttaaagtcaaggcaagagactcataatactttatccaagtatattttgttaaagcaaaaaaaatgtcatgtgatcttgtggaaaagccataccatgaggaaattttagctcctataaataggtgaaactatttttaaacaattgtttgctttcttagattatttgtcattggtataaggaatacagatgagtatttaatgtctaaataatataactcataaatggatgtggttgtatgccagttactcttacactacataatatctcaaatgtgataatggttgctgaggctttggatggcaaattagggctttcccagtggttattgtggtgtatggcatccttgtcttcccttacttatgttttgtttttcttctttctcaatggaaagccattaagtcttagttaattttctgttgaggcaagcatttgacattcattcgaattccctcagccttccagaagcattcagtatgtttcaactgtgactatgagcaacaaaataatacaaagtgaaaaactgcgtttcctggtgtgagtatttcattagatttattgatccttggccttatggtatccatgtgaaatgttcagacatctaattttttactgctaaataatttttttaggggataaataacaaaccttgtaaattatttgaagcataactgaagatgtcagatatatgagaaattatttactattactgtttcagtcattttcacttctaatcttgttaactacccaagaatctcttgtacaaaggatagtaatcattaaaatggttatatagcacccacaaagtgctttaatatacatgttttaatctattccttaaaacaccttctggagtatatgttcttaaccatattttttatcagaggacacatttaatcacttgcccaaggtaaaaacacacaccgtaggtgataaactttatgtcatgctctgctgttaaaccaccaatatagttagaattattttgatcagacaagagcgaagcagttttcctgtttttagtgagtgcgtatgtatgtttaatttctgtgctttgatctcattcataactgtgtgtgtgtgtgtgtgtgtgtgtgtgtgtgtgtgacacagggtgtggctttgtcacccaggctagagtgcagtggcatgatctcagctcactgcaacatccgcctcctgggctcaagccatcctcccacctcagcctcccaagtagctgggactacaggcacacgccaccacacttggctaatttttgtatttttttgtagagacagggtttgccgggctcagagctcaagcagtctgcccacctcggcttcccagtgtgctgggattacaggcatgagccactgctcctgggctcattaataacatattctcactcataggtgggaattgaacaatgagaacacatggacacaggaaggggaacatcacactctggggactgttgtggggtggggggaggggggagggatagcattgggagatatacctaatgctagatgacgagttagtgggtgcagcacaccagcatggcacatgtatacatatgtaactaacctacacattgtgcacatgtaccctaaaacttaaagtataataataataattaaaaaataataaaaataaaacatagttttaaaaatacaaaaaaaataaaaaataaaataactttccagaaatttagattcagaatctcaggtcaggctttctagataaggataagtgggtatgttgagcatgtgtctcacctggctcttaaatatgtttaacaaagttggggctgttgaaccaaactgacatttcttaacagttgatcttcttaaagacctcactttgcaccacagttttctaaatgtgaaacatactaatctgcttaacacattattaacaccttaacatgacatttgtttctacttctcttctaacttcccttgagcaattttctatattgaattgttcatgggtatcagaattaacctttctctagaattgttccaaaggtaactccacattgcccagaactagttttttttgctttgttttttttttttttttttttttttggagtgggagacagagtcttgctcttgtcacccaggctggagtgcagtggcatgatctcggcttactgcaacctccgcctcccgggttcaagcgatcctcctgcctcagtctcctgagtagctaggataataggtgcctgcccagctaatttttatatttttagtagcgatagggtttcaccattttggccaggctggtcttgaactcctgacctcaagtgatccacccaccttggcctcccaaattattgaggttacaggtgtgagccatggtgcctggcccagaactagtttcttatatgactagtagtagcctagccaaatcctccctcattcttaacttttctttgatctttcttttctcaggactttgaagctgtaactttgaaataaatgaaagaaacttagactctagaataagactcgcaggtttgacttggtctgtcctaagtaggtcattgttagccaactagtcacatctttgatctatgttaattcattcttttatttataaattcagataaaggtggtcaaaaaaacaaacttctaggggcaagtgaatgtctcagctgaaatcaaaaggatgagtagggtttgagagggcaagaagagggagagaggacatgcagcatctctgaaagcctggtggcacgaagcatggtgactaagggacagaggatattttgtttgtttgaactataaaatgttagagagctggaaaattttaagatgatactctaaagggaagcaaggccctgatcatgcagtaaaccatattaagagtttagattttattatgagatatgagaaattattgaaagggaagggttggtacacagttcatcttgtgtcttcttatttctcttgttttcttactcagtctagatgccctagacaaacatttcagtagttcttttcttagatctcttggctatttcaaggacaaggcaggtaataaaatatgcttggtctacagtgttagttagcattttggcatttttctttttgttactttttaatacatggttctatgtcctataattttttcttatttttctaatatttgcgttttccacatttcacactttaaaaaactcttcataaatatttttattggccagatattctggtcagtgggtcattgtttacttaatttcctaatggtggatatttattgttgtttcagtttttcttgttagaaagaatgctgtgatttacctataggcaaaagtttaaatgccttaactgtagacaaaagttaaaatatcttacttttttaaaaatttcattgccaaattgctttcccaaagaattgtgccaatatgtgaacatggccatttcattctaccttccccatcgttggttttttttttaattgcttgctattttaatagtgaaaaatgatgtcacatttttattgcatttctcaattacgtggttggccatattcccatatattaatcatagtattttgtatcttgtaaacattctttttatgtcctttgcccatttattcattgagaattttaagatttttttctcatccgttttatgagctcctgattaacaacctcctttatagcatcttatttgaatatttttatcaggctggttgtttcagcataatggggattttgtatagaccaatctattgataatttctttgtgattgtttttttttctaattaaatagccttccacctgaagacttacaaatatttttaaattcttctgctggttttatgacttccttgttcatgttttctttcactttgtcagtgtatcacatgaagtgagtgttaaactgaacttttttccaatttcctcatctcatttattgagtcttttcctttcccctttggtttctgatttttctttccacagctaacaatgtttgagaatttactgtgtgctaggcactgttctaaacactttatctgtattatctcattttcttctcacaacaaccctgtaaggaaatagaggcacagaaacctaatttgctgaagtgacacagctagtaagtaaagctttgtcacatattcagttcttctgtgtacctgtgctctcattgtgctgttgtttctatattgtggttatctttctgtttttatgccactatcattctgtaattattatggctgatacatgtttctctctcaagaaaagctaatatcggccgggcacggtggctcacgcctgtaatcccagcactttgggaggccgaggcaagcagatcacctgaggtcaggagttcaagaccagcctggccaacatggtgaaacctgatctctactaaaaatacaaaaattagctgggcatggtggcacatacctgtagtcttaactactcaggaggctgaagcagaagaatcgcttgaacccaggaggtggaggatgcagtgagccaagatcgcaccactgcattctagcctgagtgacagagcaagactctgtatgaaataaataaataaataaataaataaataaataaataagttaatgtaactgtagtatttacttctttttctattcttgcttgtttctaagtgaacttaaggttccaaaacatttctcattggaatatttttcagaattgccttaatctgtaaactatactggaaataattgcaacgtaatagtatcccaccaaagtcctctgtaccttagtgtttgatatgttccaggtgctgactaaatatttgttgagtgaaagaatgaatgaatgaatggagagaccttagtttgtcatctgcatcaagtcttaatttatacttctcattaatatttttcagattttccccatttgatgctgcatatttcatgttaatgttacttcttgacattgtatatttttcccataattttctaattatttgttgccaatatctgttatttctgtttttttgttttggaatttcccaaatattgttaaaaaagattggcaatagtgggcatccttgtttcgattgtgattttaatagaaatatgttattcttcaccagcaagatgttgggtggtagtgtgtaatacattcttttatctagttcttaaaatatattttataaggaaaaattttatgaaagattttaggttaactcttgactgacatttttggtattaaaggaatttgctgttgtttgatagcatcattatggaagatattgaatagcacatatttgtgatcttttaagttagctatagaagccatcttctcattctgctgtggtaagtgaatgtctttctgactttcttctgggtccctatttcactgatatctaaacctgatttctagcagggaagagactaaagcaagcacatcctttcattcccttgctctcagtgtgtagagctgaaatgtttccatatatgggaatttctcatagcattgggtttggacatacagatgtgataataatcctcacaacaacaacattactgcatctaggaatgtgggtgggccaagacactgtgaagggtttatgtgaattatgtcatttaatcttcagaaaaaaaccactgtaagttctgccagcccattttatagatgaggaaactgtgacttagagcagtgaaataacttgtctatggtcatacagctgagaagtggcagaggcaagttgcttgtaaagtagagccaagccttagagatggatgggtgaagatagatatagatgtatgtgtatataggtatgtgtatatctgtacacatatgcatacatatttgatgtgcttgagagatagatgctaaggactaatgcattttgaaatttttctggagccaggaatatagtaatacttagtggcaaataatgagcctttttccattaataataagaatataatttctttggaaggaaatactatctaattatagtttccctcagtatatctgggggattggttagcagacccctgtgtataccaaaatttgcgcatattcaaatcccaaaatcggccctgtggaacgtgcttccttgtggaacctatttatacagtatgtgggtttcacatcccacaaatactgtgctttcaatctatgtataagtgtgcccatgccattcaaacccatgttgttcaagggtcaactttactttaaggctagataattcttctgtctaagaacttagagtctgagtagttgacgtatattgtacttgtaagtttaccaagtttgactctgcattttgcagacatgtctgtaggattgacataatccataggtgctcctaatgcagtagtctataatttgactttcttattacttttccccttaaaaattctaagacagcattgagtttttggtatcctcagaggaaaagacagttacctctaagatacctactttcagggcaggcgtggtggctcatgcctgtaatcctagcactttgggaggccaaagcaggcgaatcacctgaggtcaggagtttgagaccagcctggccaacatgatgaagccccgtctctactgaaaatacaaaaattagtcgagcgtggtggcaggcgcctgtaatcccagctacttgggaggctgaggtgagagaattgcttgaacctgggagggggagattgcagtcagccgagatcacgccattgcactccagcctgggggataagagcgagacttcgtctcaaaaaaaaaaaaaaaaaaaaaaaaaaaaaaaaagaaacctactttctgtgaaagtcggtgtatatgtttttttaaataagacacaagtatgtggtagagtagggattatctaagcaattagtccctatcatggatggtgaaggtactaatcagtgtttgggagggagtggagatagcttccgtatatagagaggtaatgcattttaaaatcatttaggggactttttcaaataatcctgtttcttcatggtgagattccctgacacagtgagccaatcaggtttgctaaggcagaaaatgttcgagagccactgtactagacagcatgaaagatgactgttttgttgaagcttaatggtaatttttccataatcctggtccttaaaaagcaaaaaaaagaacacattagagtgttgttacttttctctctctcaatagaaatgttcctaaaccagcaaaggaggctatctgaatttttaaaagtttttacgaaggaacataaaaattcctttctctatcttttcccacctctagaaatgcttgaaatgagattctgccttacgtctcacaaattaaataccacatttgtgtctcacccatctcagttatgctgtcttgcattttaatcaatcctgtttcaggacttcttttgctgccttgtggctgtttcttatgtttgtcactaattcataagttggctaacttttatatttgtagagaatttctcagtgattttcttctagttggagttccagtgtggtttgatttggagtgtcaagatctctgtcccatgcctagccttagtcctcagtctgttttactgggttcaccacctggttgtagtaccaaatgcccttttccctttccctctctccttcctcacttcctcagtactgcccaagttcgtcagacccaatgattttattcttaagctaatcttatttttaatttaggtaattctgatttctgatttgtaaaagataaattttcttctccttcatgtagtaggattttaattttgtaaatatttaaattctccattaatggtgtgttaaatctgcactaaaactgcttctttacatgtttttaaattttttcattatgtttttaacacttttcttacatgcaaaaaacacaaccgttaaacttttcttattaaaatgcaaagcctagtgtcttctagctttttgaagagcttttgtccattatataatctgtcaagtagccaagagttcctcagaagcaggacatcatttagatttaaaacaattatggcttgtctgtaaaataatgttgtagcataaccattcatgggatggcagctacgattttacttcagtaaaatatccttggatactaccgccattttatttaccttaaagattttaccaaggtaccctagaacaaaaatggtgaggtcattttgattctgctaaagttggtatgactggaaagccaaatgacacagttatgagcatagaccttttattttccagatgtttgacagtgtaaacatacataaaatacatattaaagtttagatgctttatattttgtgcaataaattgaagccttaaaacatttcattttttttataaaagaaactcattagtttacttaattaagacagtaaaatagcagcaagtaccaagacattgtgcatttcttttatttaagacaagttacttcatttacatcagagttagaaatgttaagactggctttcttgaatacttaaatatagctcgaatcactggttagatatggacatattttcccaactgtacatcagggaggagtgctttcattagtttcagaaaatgcagaccctcagacagccagcatgaccacaacattgagcaataagagaaatgaagcatttactttccaagcatttgccacagaaggtaatggagtctttacatttgtggttgtctcttccctccataagttaagggttgtgctttgttgaggcatttcagagaaattatttggcatgccactagtgatacttagggtcatgggtgttggggatgattttgttgagctagtgaggcttgtgtttgtgaccattccatcttggagatgaatagttagagttgcagctgctgcttcatgtgaattgatagtctctgtggatgtatcttctggatagggcacaaaagccttatcagtgctagtaaaggtggtgtctttgcttagagtggcaccaaacgttgtttcctttgttcgatattgtttgggtattttggtcactttgggttgagttaccacactcagagagttaatggtgtccactgtctgcatcccacttacagtgaataagcttgaggtaaatccagaaggtgtgggatacatgttatgttcctttaaagatgatatttgggtagaacatggagtccctatcacatgggcttttgtttccatcatccacttcagtaagtaagtaatgttttgtttgtggtcacatgaccacctgttattgtaaagggttatctcttgcaactgaaagagttggtcaaaagattggtctggaatgaatgtgaacttattgttgtgcaggtaaagatgtgtgagatttgtcaggtttattaatgtacctggaagaatttgtgtcaaagaattattagacaggtccacgatatgtagtttggagggcatgttggttggaactgtccaaagtttgttactactgaggttgagaacctcgagacttcttagtgtatttttaatgaggacaaccttttccagcatgttcttagaaacatccagatatttaagattccactgataagcagtatcagatttgtcaagaagtttaatgttgttgttagcagcagacatgttccacagagaccgaggtaagtgagcaggcaggctttcaagcctgttgtttgaaatgtccagggtcctcagattggtatattgggttaactggttatgcagatcagtaaagtggttataagacaggtttaaatgtataatattctcttgcagtccagatggtaatgtagacaagtttctgcctgaacagtccacatgcctgtgcctctctgtgcatatacattggagaggacaaatgcataaaataccaggtgtgagaaacagaaggatgaacaggcagagagacattttcaatatctgatattccatcaaagcctagaaacaaacagatacacccttcttttaatatgcaaatacagtttaggcatctgcatgggtcagttagcattaggcaaaattttcaataaacctcgttgttgtcgagtccttttataattgttccagtgattaaactaacaaagctccccttcatttatagtccaaatgcttaatccttcaattgggctatgtggtagagagagactctctccctactctctcctgcattttctcctttattttctctctccctccccccttttctaaccatattctttcttatttatctttctagagccttaatatgataaaatagcattctttgcaaataaatagttgcagttgtaggctattactatttttgatgatatgctttcttactcagatgagaaaaaatggctgtcgtgtcttttttttttaatctctgcagtaatgtaattcaatgtgtgtatatagggtagattttatttagatattaaagcagttcttcgaaattttatctgtatgtttttaggataaatatatctttgtaaaaagcacttgaaaaatccagaccaacacagtacctataaacctcacattttataaagtgatttttttctgtatatttcagtgcccattttaaaggaaaacaatatgtatatttacagagtgactgaatgtataaaaaatatccctcaactgacactgcagcaaatttctggtgcatgcacttgctattgaatatatatttaatcctaacgttgactttttcttaaaagaaaaaggaaaaagattccaaagtcagccttttactgatttaaataacatcttaccgtggtgtcgtcttcaacatcagcatctcattttctctgggaaacttaaaggtcgtcttgttctgtagagtcggaactgtttctggctgtgggctgtgcttgcctgctcagctgcattgtgttgctgtgagctgaagctctgcaaccacctgatcagtaccacataggaggactgcagagctgtcgctggtgctgactcaaatttatggcaagaggtgcacacgcaacaaaatggacaattttttaaaaaatttgtggcatcaagcgtacctatatatctgatttgctataggatgggataccttatgcatgagagttggcccttactcctttctatgtatttgtctgagattgggttccatattttaacatttgcctcattaagaatctgtgaatttttaaaatacctctactctttatcctttttacatgttgaaaataaatttgaccttcctcatggatagttttctatgatattagtcccactattttttaactcctgcctttttatattcctttctaaaattgtataattttcatgtcacttttttaatattataaaaaatctgttttatgacttttatgtcttcccccaacatggtgattattatgtttaatcagcttttcaaatttatcaaccacttaagtgttccgtcttcccttttaggatgtatagaagtactgaaatacgattattttttctttatctttctgatacaatgatcatttgaccaaggctacacacaagccaggatacatttggaaattagcatcttatacttcagattatcagttcctatgtaaaataaacatgttttattttatatatttggagttaaagttttttttctttatgcaaccttgggtggtaagtggatatgagtattgttttttccaaagacatttttggtgctgtatgaatgaccatttatttgattttatgttttaagaatagcagtatcaatttaggtgatttcagagtgttgcacatttcatctttctgggaaagtagtttatagttttaaaattacatgaaatgatataaaaggaaaatttttcatcatgagttttataaagtgagatcagatttatgataaattttgctccactcttcagtggactgcttgtgtaaatctgttaaaacacaaatctgatttccagaatggcaagtttaaagaaagcaaataaagttacggtattttcgttaccaagtggcaccatttaaaaacgagtaatatttagcatgttatgtgtaaggaaagtctctttatgccttgttactaaatcgtttgtttttctctaaattatattagcattatttagattataccacaaatagaatttgttgtattaaaatttgaagtttattttcttacaagagaaactatactctaggagccaccttttgtataaaactaatgttcctcgaaaagtatctgcattttaagagtccgcaacatagaagtttattgttgattgggtgctttattgccactttactttgagggttcagttgaactctcaattggattcttactgtggatttaggaaaccagccatcaatcatagtgcttaaaataatgtgttaaaaatactacattcagcaatattgtggaaatagggaatgcattgacatttagagttctatttaagctcatatatacactgctgcacttctaaagatgtgactgagggtcaatttaccgaccacttaaatctcttaattttaggaaacctcattaagtcagtgtagaagtagagttatgcattttcattacacttaacagtacttttgtttgaaagaaaagacatgttacttcattaatggattcaaatgaatttgggtttaggctgtatcaagtttagtttctgttgtatataatagaaaattccagtgcaatagtagtggcaatgtttctcatttcaagtttgggacataccaaattgcttcatattattcaaagattattgtaaaattctcaaaaagaaaaagggagatcatttcaatatatttgaattctaacaatctcttacactgggtgcagcacaccagcatggcacatgtatacatatgtaactaacctgcacgttgtgcacatgtaccctaaaacttaaagtataataaaaataaataaataaataaaagaaattctcatgaaataaaataatactgtattactgttactcaaaaaaaatattttttagaggcataagtatgtgttacaacttattttaaatattattcagactcattacattttctattaggctgtctaggtcagtaatgatagttaggcaacttttacattctagattaagcagtaaattaatttacgtattcttttgtgtcctaggatatattaccccaacattgtgaaaggtatcacaaagcatctgccaaggaatagctatcccacgctaatcagtggtttcagttttccattattataggtaacatttgctatgcttgagagtcagatattgtttatttttggtaatatggttggctatttagactgattttcctgctgaatacaactgagagtactcaataaagtactttaaaagcatgaaagaaataacaacatagaaattaccaagtcaaaatccaaatgaatcagtttctttgcccacctccctactcctttttttctttatgccactggcttgttgccaaaactcagtcaattatttcctaaaatgtctctcatcttggagttttctctttgactctttgggaagatttaatttgttcttctgtcccccatattttctataagtgattcctcatatcattgacataattgctcatttgcatcatctcacaataatttcaaaataataccagtattgattgctacaattagattatagactaccgaataaagtttaaaatttgtttgtagctctgcttgctttattttactaaaagtgtatagtaaattctgtgttctaatgcaatgtgaaataattcttttctgtgtatttttatatcaccaacttgatataaactttgtttcagttttcagcttttcaggatcacaagtcaaaattatatatataacaatgtatattcagataaatcttgcttctctgtcttttccatcctatttccttccttctgctattagtaactgtttttattagtttttcgttgtatcattaacatttctttttgaaaacctaaaaaaaatgtaagcatatgtatggtatgttcttatccccccttctaatataaaaggtgacatatatacatactgttagataacttgttcttcttttcttactgtatcttgagtatcactccatatcagtatataggtatctgtatgattcactgtttgatccatagtactccatttgggaatgtaccatggcttattcaaccagtcccctattggtggacatctgggtttttcagacttttgctgttacgaataatgccacagtgaatacccttgtacctaaataattttatatgtttgccagtaaatctttgaaaaagattcctagaagtaggattgctgggtaaaagggtaaatgcatttggaatttttccagacattactaaattcctctccattgattataccattttgcagtcccaccaacagtgtatcatggtgtcgagttctatacagcctcactgtatactttgttgttgaactttgggatttattgtccatctgataggcaagtatctccatctaattttaaatgcatctctgtaattatgagggggagtatatgtctttacatatgtttaaagaccatttaaatgttttctcctgtaactgtctttttaatgttttgcactattaaaagttgtgttttgggtcttccccttcctgccccatattaggagcattttaaattttagaggtattagcactttgtcttgatttaagttttaatttttttttccagtttgccatttgtcttttggctttattatggtgaggtgtgtgtgtctgtgtgtaatgcgcacttgcatgtgtgtgatatttaaaagtttcatataatttgatttccctttttattgcctctggattttgagtctcagctaggaaggttttttcccgcttccagattataaaggaatttactcatattttcttctattacttgtataatttcatggtttatatttagaactctggtccttggtgttccaatatagtgtgaagtatggatcaaattttttcttttttccagatgtctatccaattgttccaatgcttgtttccactgatttgatatttatttctggactttttcttctgttccattgatctgtttgtttagtcatataccggtaccacagtgttttagttataggttcccaaaggtgctactttactttttgatcagaattcagtaagaacaacagttaaagatcaccctcatctaattcatttgtgtccctcaccactgacaccaaatagaagacttatgtgatatatgtatgtttcagtgcatgatgtaggtgctctttggtcctatattagtgaaaagagtgttgaaccaatagtcagggagcaaactcagcttttaataccacttctaagcacatcacttactttctctggtcctgttttctcagtagttaacaaacaaaaggagttgaaccaaatggtcttcagggttgtgtctgactctggttaatgctattttggttaagagcaccactagtatgtggtgtgaactttaatctaccttttattcccctgtgccttattcttttgcagtattcatgaaataaactttctcttctggatcttagttctttaatcttttctctaaaagatttttctttgttccagcattttcttctgtcctgcatttattagtttgtatctcttcctgctgattaagcaaggattgccactgtttggctgctcagcttccactgacctcactggggaaaattacatgcagttaaatgtgaattattcttcccccagcaaagaatttctttaaaaaaaataaaaggaaaaaagacaacataaaaacccggctgctgccagtagtctgtcctgttatacaaagaacagaaagagaaaacctccctttaaaagtacttaaagatatcagacaacactgtggtcagctaatcagctcccgtttaatctaagaaaattggtatttccctatttttccctgtatttctttcaggaaagaaggtggtaaaaaggggcaaaaatgtggaacgagcccattaagtaactgtcacaaatgtaaaatgagaacagttatgatgatttaaggcatgtcaaagacttggccaagtataaaaacatatcttatttaccataacaaaaattcgtaaaattaaaaagaataataggaaattctcaactccagattgctgctggggaaattagctttaaaagtactaagtttgggccgggcacggtggctcacggctgtaatcccagcactttgagaggccgaggcaggtggatcatgaggtcaggagttcaagaccagcctggccaatatggtgaaaccccatctctactaaaaaaaaaataccaaaattagccaggcgtggtggtgcacgcctgtagtcccagctactcagtaggctgaggcaggagaacccctttaacgtgggaggcggaggttgcagtgagccaagatcatgccactgcactccagcgtgggcgacagagtgagactctgtctcgaacaaaagtactaactttgaagaatacatgaaagaaaatttttaatgaggaagacaaaagatgtaatatgacaataagtatcatgcttattcaggaaaagtaagaagctcaaggaagtgtttctatagattaaaaaattaatggtcagtaaagatggcttgaaagattttaggaaaaacattgtatgtaaaattcctgtgtccaaaaccctactggttcttattaaatatggagctttgttaatgtcatgaatgccagtgctatgaataaatgctatgttctactctgaaaatcccagaactatgagtggttctccaagactgggctaccattttattctaagtgcttgtttccccctggagttagatgggactaatgaggaagaatatgtgcttgttgggcaaaggagcacttctgcagacaaaggctggcatccccaaaagtataggctgatgaccactcttgactttgacaaagattgggcccattcctactctaataactcagacttaccaattgtcagataatggataaagatgaaattctgtgtaagaaaggtgacttaagagtggatagcatcagaaagtataagtttagtaaaaagttgagaatcatctgtgttttgatagtctcttttcctgaaaaaaaaatcacccaaagtcacccgtatttagaatgaagccatagtcttcttttccttttttttgctttataaaacttgattttgtttgggtgtttataaagaagaaacttgtaaagatgccagttttaaaatttgtgcccccccaacatggtaggaaaatatttacattttatgatgcatcctcatatttttttcagggtaaatgttcctaacccaacccttcagttgatgttttaacatgtttgttttactctttgcaatgaaaccaagaagaaaatttctctattctcaaacatgcattttaatctcccattcccacaaacttggaatatttatttaatacttgaggtattaatttaaaacttgaagcatatacttagtctcttattcctctccaccctggtctttgaaatggaaacataaaagtttattcaccataattttatacacagcttttcaggggaaaaaaaactgtactgggtaataagtatatgtagattgtttcagagttcttaaattattgaaacataccatttacatatgtaaaatgtactatactttaaagataggtactataattagtaaatagattactgttaaataactttttttaaaaaaaagtttcatctatgcacataggctctgagcagatttcagatagttcctgaataaaaatcaaaattgactatcagttgccattttatatatgttaacatataaagaaaaaagagtcatttgaggatggaagatcagctaaaaagcaagttgtaatatttataacagttctgcaggtggaggtggcagggattcattaagatcttgatcagagttgggaggaatagagaactcctgacactggatctcaaggttggaatcttcttggtttttcataaaatctactggtggcaggggcaagttaagtgagtcaagcggtggaaatgattgtattatctcagatttatgatctccacagtcttgattgagacagtccagagatggagggagactagtagaatcatttggaagaggagatacaattgtcattgtgggtttgtcagattggttactttcctgtccttccaaatccagaaggggaggtggtggaggcagatctgcatcatctgaagaagaaacagcagttccaactgttgaaccatcagcactatcttctgatgtaccatttacttgatcttttattttctctgttttggggttgttggagtcttcaatgttttcacttgattcaaacaacttaatttctaagtcatctgctaaaagtgtgcttttgcttggtttccagggtgtaagtgaaatgattgatgtacgttttgtggatatttcattttctctgatgttatccatacaaatgtcaggggtttctccatcagcaaatggagatctacctgcccaattttgatcatttaaaactggtttccttaagcatttccaaagtacaatgatgattatagctaccaacatagaagtcagaagtacaccaattagtatggcagctattgaattataattgtttttttgtggggtttgtttgttactggtagtatctaagataaatcctggtgtactcctaggtgaatttttgacagttgatgttggttgtgtggatggattatgaacagttatttgttttctagaagggatctggacagatgatgattgttgagtaaaagtatagacaaatgactttggtggttgtgtggtagaagtacgggcagatggtagttgtctggcagaggtgaacacggcttgctgggaggaggtgttggctattggtgttggttgtttggtgttgtaggcaagtggttgtccagcagaagtatgtgcttctggtttttcagaagaggtatagacagctggtgttggttgtccagcagtgactttggcaggtgatattgattgtccagaaaaagtgtcgctgaattgtgttggttgacccaaaggattccctgttgtgttttgagaattagccaatacctgtgacattgatgatgtgaataaggtaggctgtgactgcttctctgttgtaattgtctctgtctttgaaaaaaatgtattgttcaggtgtccacaaaacaaaattaagatgaaatatttgggatccatttcagaatatttcctcgttatctatagcgggtttataatgaaagagaaagacagttaggcgtcattggtgtctagttaaaaatttgacttttcattatgattcctggcataaagtaggtagacattattcctaattagtagtagttgattagtagttattattcctaatttagacttgatacactgtaggtttggtgtaacaactcttggatatactctaacccatcatacagcatttggacctcataagcagtgatctctcttcttttattaatacaagttctgtacttggctctgctgcccctctagcttcattatatttcagtacttcacttagtcatacttctcaaaacgcataggctctatatgctggatccatgtgttctctaccttttttcaccattttctactagaaatatattgattctcctgccttgaagaacaccagtgatcatctgttacctaatctaattgttctttatttcttctctcccctcccctccttgaccacattagacactactgttccttcactaatattcaagtagctttttgtaatcagtcttcctttcatgttactctcactagctctttttcttctgcctcctaaatatggttaattgatattctgtcctcacccttacctacttttctttgttcctgattctgtaagattttagttctcagctttatgccacaattcctaaacctgtacctccagcctacatcttctttgtcctaattctatttgtgtgacttcttggtggatttttccatattttatatatatagatagatagacatagatatagatataaatatctcccactatcagcaaattcaacatatttaaaatggagttcatctttaccctcacaactgacaactgactcttctcccaacttctctgtatctgttaatggtaccactaagtttcttaggcacagagtctattagtaatctttgaagcatccttagtgtctctgtagcgtggtagccttatgttaatattgcatatttttaaagaatttcattcaactcagagtcttaggcttaaaatcctagagtgatctctgaatctggtggagtaaattcaatccagttggtcaagtagtcctgctgctgctttcattcatctattggtaaatgccacatttgtgtggagctctgttctaggtttaggagattaaaaaaaaaaaaaaaagatagtcactgcctttaagtgtttcagattctagtgatagaagcaaacagtaaaggccaggcgtagtggctcattcctgtaatcccagcactttgggaagccaagatgggaggatcgtttgaggccaggagttcaagaacagcatggaccacatagtaagatcccatctctaaataaaaagaagaaagaaaaaaagctaaaaaataattacaataattttttttttttcaagacagtcttactctgtcacccaggctggagtgtagtggcacaatctgggctcactgcaaattccgcttcccaggttcaactgattctcctctctcagcctccaagtagctgggattacaggtacacatcaccacgcctggcctatttttgtatttttagcacagacggggtttcaccgtgttggccaggctgctcgagaactgacctcaggtgatctgcctgccttggcctcccaaagtgctgggattacaggtgtgagccaccacgcctggcccaattacaataatttgataagctttctcataaaagtatgcaggagatgtacagagaagttaacctagcctggaaaggcttcagtgaagtaaagcttgaactgaattttaaaagtctataaaaactaattaagtttccagccagggagagcaacaatgtgggcacaggaaaataaggcacatatgaaagtttggcagatagggctttttctgggatgtggtagatgctaaaacttggagagttaagtttcagttctacttctcccatctaactacctgtctaaccatgagaactagttgcttaacctttcctgttctcaattgcctttcctctaaagtgaagagttctactgagacaatttgcaacttttggtataatatacttgttttgcacatcatcaaacacaatggcaactatttggttatctcttaacattagggaatagaaaatcttagggtgttagatattggtatacatgattagaaactatagttcttctgactcataagcctatatttagagagatttgatgttctgttggaaggtgcaataaaggttttacaaattaccttttcagcatatctaaacagcatatcattgcttactcctctaccacttggtacacagtgatgataaatggccctgttttagtagaagaaaagatatgtgatttttttccctatacgaataattcaagcctgaattttaaaacagttctcctttgaactctcctgcacactgctgaattaatcttaaaagtgtgcatgatcaggttactactgccttgcttgagggtttaatttctgttaagataaaacttcctttttctttttttttttggagacagagtcgttctgtcacccaggctggagtgcagtggcatgatcttgtctcgctgcaacctctacatcctgggttcaagcgattcttgtgcctcatcctcccgagtagctgggactacagtaggcatacactaccacacctggctaatttttgtatttttagtagagacagggtttcaccatgttgtccagaccggtctcgaactcctgacctcaagtgatctgtccgcctcagcctcccaaaatgctgggattacaggcatgagccaccacgcctggcctgttaagataaaacttctaaattgagttttcttccttctggcttgagttaaccagtccagattcacgtatcatgactgaaacttcttatccagccaaatgcatccctttcccaccttgcatactttctaaacacacgatttttccctgctaaacagacacttctatgctgttttttacccttctcaagggtgttcttttttttttatttttcttccagacctagcctcttcccctttctggctgcatatctgaatctgtcctcatctttcagacctcagtttaaattccccttcttaacccaagttctctgtgactgactacagcccaaacagatcagtcatttactgaattccccctagctctcatttattgtttttatggttccttacataattcatgtatgtatctcactcacacttctattctcttaagtaattgtgtttacttttcacattttcctatacctacttccttgaacaagattataaagaaccttgaagaaggcagaaaggagaaagaaaaatacttatctagagcatattatgtgttgtactatcccagttttgcatactttatttcacagaaccttcaaatgactttataaggaaggtaaagggatcccttatttacagataaagagacagtgtcaaatgagttaagcagtttgcctgatgttataccactcgaagtgacagattgggagtttgtacccagggccacctgattccaaagcatacattctttctgctaccctttattgcctcatgtttttatattttgatttctttgtagttaatgccttatatattaggagcacagtaaacatttaacctgtattgggcttcttgattcctttccattttagtttttgctttttactagtacttctaccagaaaataagcagaggcagtgaaatctgagttaataaattctgctttttatccattttgcaaaagatttaaaagggaaaatttgaacacttttggcatagatatagggatttgaataatctctggatggtcatcatccatgcagttcctacccattattcttatagattacaaaaaaaggcggggggacttctttagaaaatgttattctcttcagaacttcattttaaaaatctgttttaatgctatgcaaagcatcagaaaatataagccatgaattgtctttagccaaaaatgtttcctcttttgtgactttgcttaaaataaggaaaccatacggttcctcttttcagttagctgaaaaaggcattagagaaggacagggcccaaacaggaacataattttaaacccaggttagtttgtaagatcaattttgataggctcctatcctctactgtcagtagtaagctggtggaaccctccatgtatgagattttcacttgtcagttaacggttatggcaatattaaaaccaaattccattttttgcctatcctaacactttctaccactcttcagttagctttttatcctcctaggatctgccacatcagagtactagaaactgtattagaattctatgatggcaattcagtgtagtccagagaaggagaagaaagatttaaaagaggaataaatagggaatatggtagtggaaaaaactgacttttttcccagcggtaatgaggccagcgttactaccagtgtggaaggttatttagcatacacattttaaaatatgtaagtggtgtgtacctgaagtaccaacattgtttctgtaggtaaagaacaatattgggcaggggaataaaaaggagatttagaataatataaaaggcaatgcaaagaaatacaaaataacacaaaagagaaaaaacaaaaactctaggaagcagcgaacagaaaagaggaaggtcaattgactagagaagatacagaaaagaagaaaagttaataaacaggtgaaaaaaaaagcagtggttatataattagcaagaaggcagtgtagatgattgaagtaggcaaaatgaagttgggggtggggggagatgattgaagtagatgaaagaagcaacggcaaaatgctgctctgttgtggctggcctgtgtttgtgagtgcagggagacagtaaagaggagcttgctttctaaaatggaggaccagaaggaaccatcctttcaaattcatttacctttcatttcaggctctcctgtctgctgtgagtatccttaccatcctctccctttttttttccctgacactatccagaagcatacctagcaattattccaaagaacccatgtacccgtgtacgttttatatagagttttccagaaatcccttagtctgctgctcaagcaaatttgtcagccctcatatgccggtttttactcattattataggctggcactttgaggtttaaatctgtgattttggttctttttctttgctgaatatttagaatattttaaaaagaaaaacataaatttaaacattttaaagacagttacagtgaagcaggagtccccgtgtataagacatgttctttttttttttttttttccgtttggagacagggtctcactctgtcacccgggttgcagtgcagtggtgcaatctcagctcactgcagcctctgcctcctgggctcaagcgatcctcctcacacctcagcttccctaaagaagttagaaactgcaggtgcactacaccacgcccaactaatttttgtattttttgtagacatggggtttcaccatgtcacccagacttgccttgaactcctggactcaagtgacccacccaccttggcctcccaaagtgctggaattataggcatgagccaccgagcccggccatagacatgttcttataaatataatgcataagtacttaaagggtccagcatttaaaattgatgctgttaagttggatatgttaggaagtatgccattatcttttaaagagaatcaagatttggagagcatatcctagacaaaagacaagtatagatagctgtatcaattactttgatataataaaagttgtgatgcaaatataatagattaaaatttagcagtagtattatctctaactagtgaagttttgaaaccgtaaaagaaaaaaccagccattctgcatcttgaggaaaagtggaaagagaaattgaccttcaactacaataggaagtatttgatgaccatcttgtatcatgatagtgaccatttactgagcacccaccaaaggctaagcagtatcctattttaattagctaggtggtggttttttcatcctacagataaggaaactgagacaccacgatgttgggtaacttggcagtatcacagctctaagtagtggcactaatacaaaaatcatgctaatcttgtgccagaaccgtttctttctatcacatttcactgtatgtgctatactgcctttcatagaaaagttatgaaatagaaatgctttatgaaggaaggagatgtgagttggtgggaattacacgtaaataacacttgtaggtagtcttagataaagggtaggaaagaaatacctgaaaacccattttagtcctgattctacgaaaactattataagaatttggaatggtttctataaagtgtcatatttagtaagtttactgaaaattttgtggtgattttttttttaaagcttggacattgaaaggcatcagatttatgtttctcaattcaaacttaatcagaattaaagtttccttctaagtagaattatgtgggaattagctggaaaacacaggcactactagtaaactttagatttgggactaaccctttaaaaacatgtatgggaccaggcgcagtggttcctgcctgtaatcccagcactttgggaggccgaggtgggccaatcacttgaggtcaggagttgaagaccagcctgaccaacatggtgaaaccccgtttctactaaaaatacaaaaaattagccaggcgtggtggtgggtgcctgtaatcccagctactcaggaggctgaggcagaagaatctcttgaccctgggaggcggaggttgcagtgagcctgtgagccaagatggtgccgctgcacaccagcctgggtgacagagggagactccatctcaaaaaaaaaaaaaaaaagtatgggattctatgacaaaaacacaccataaggatcgatgggaaattttttaattttatgaaatatgacagtgaaaaaaatttaatataattttatgactttatgcataatgaaataaactaaatattagaagtagaaaaatatatagacaagcctaatctgaaaaagagataaatatctttattttctgacttccacagtaattacttagaagaaatccttctaagagaaagtcatgaatatttattaagtgttgaaatgggatatcacccactatgaacatattattccctgaaattacaagtctatgtaaaatactctttgcagtttttatttgcccattttacccacagcaagcatcttttatgcatattaacaattttctattgtttattctataggtttcttctatcttatactatgttctaaagtctcagataatgtgacataaacacgtagatgatattaatatacgcatgcatgtttgattattgactaacatttttggcttagtaagcttttaaaatgagccataatgttttcatgtcatcattattaaatataaaatctatatgtaaaaaataaagcatgtataataataatagtcaaataccacatctgatttctttttctttctaaattaagtgaaagtgaccattcttactatgcaaactaaaggggatacaaaaattttaatttatgcattatattatgtacaggaaaattctataaaaagtacattagaacttttaacaattaatattttggaggttataaattcagtcatagcctgtggaatctagttctatttctaacccttagctttatctgccatggctatagtttctttttaattctaaaactaaggttaacaaatatgattgtggctgggagcggtggctcactcctgtaatcccagcactttgggaggcggaggtaagcggatcacccaaggtcaggagtaggagaccagcctgggcaacatagtgaaaccccatctctactaaaaatacaaaaaaattagccaggcgtggtggtgggcgcctgtaatccgagctacttgagaggctgaagcaggagaattgcttgaacccaggaggtggaggttgcagtgagctgagatcgtgccactgcactccagcctgggagacagagcaagactctatctcaaaaaaaaaaaaaaatatgtgtgtgtgtgtgtgtgtgtgtgtgtgtgtgtgtgagattaaataaacttaaaaggtcttatacaaacctaggtgaaaatatttttctaaggcaagctgaactgagtattttttaattctatgcaacaaaaccacaaaaacctgttatagacatctttagactatcagagtttaagtttaaaacactaatgacagtttttaaaataaattttatataaagcaagatcaaaccaaattgtgtgaaaattttcttacctcagctgttaacttcttttgcagaatgctaaattcttgttctaactggacattttggtgatttggctaagaaaggaaaatgggtggttcaattcagatttaaaatgttcctctagcaaactgaaatagtttctgtagaaaaagaggaagtttatcaatagctggttccggaagtgcaataaaccacaaagtgactaagaaatatattactttaacagaacttattttgaaatacattttggagccctatgatttgagtgcttttaattatgtaaataaatatttgagatactctagtaatatgattatgtaaattaaatatttaggatggagtcccgaagagaaaattacatgttctaagaagaaaagctgccagttgggttatcacttacagtgagatttcttctcataagaagtgagtgatgtgttctgtttacttgtatgaccttaggcaagactctgcacttctgagtcaccgtttcctcctctaaaggaatattttattgggttattgtgaggattaaataagatagcataatataacatgtataaatgcctcaccaactgcaggtaaccaataaatgtaatgttatttcctcataatataaaaagtccagggtaaaagtataattacattattttgcaaatgacaggatctcattcttttttatggctgaataatactccattgtgtatatgtaccatattttctttatccattcatctgtttatagacacttaggttgcttccaaatcttggctgttgtgaatagtgttacaacaaaagtgggagtgcagatgtctctttgtacagttttcctttctgttgggtatatacctagcagtgggattgctggatcatatgatagctctatttttagttttttgaggaaccaccaaactgttctccatagtggttttactgatttacattcccactaacagcgtacgagagttccattttctccacacccttcccagcacttgttattgcctgtcttttgagtataagccattttaactggggtgagatgaggtatcattgtagttttgatttgcatttctctcatcagtggtgctgagtaccctttcgtatgcctgtttgccatttgtatatttgtaattaaattattttgaccaaatattttactagtgacttttgagttcaagttctcaactatttatttgattacccacaaagtagttacttctcagtggaaaataaaataaattggggatcattttttaaataagaagttaactaaagttaacttgttactaaagggtaatgaggggttggggagatggtgttaccagttaataggtacaaaaaacaatagaaagaatgaataagacctatttgatagcacaacagagtgactgtcattaataccataattatacattttaaaataactaaaagtgtaattggatcctttgtaacacaaaggataagtgcttgaagggatggataccccattctccatgatgtgattatttcacgttgcgtgactgtatcaaaacatctcattaccctttaaatatatacacctactatgtacccacaaaaatttaaaatacaaaaaatttttaagttaactaaacaaagtgtattgaaaggagtgagtccatctgaataaaaatttctttgagtaagtcacctttcctctcttgaaaaatggagatcataattcctaatttataagcttattgtggaattaaataaatgtaaagtgccttggatgatgcatattatagtaggtacggaatgtgttaacccatgcactgctttttcctggtcactgcgggaaacacaggttattatgaccttgttcttaacttcagggtacttatagcttggtgcaaaaagaatagtttttttttatgggctcctactataaagcataatataatcaaatgctataaagcttttgattcactggtttttggaagtattgttgtttttacggacagggtattgctgtgttgcgcaggctggtcttgaactcctgacctcaagcaatcctcctgcctcagcctctcgagtagctaggactacaggcacatgctactatgctcgctggctggcttatttatttattgtaaagatgaggctcttactttgttgtgcaggctggcctcaaactcctggcctcaggtgatcctcccaggattataggtgtaagccactgtgcctaacctgattcactatttttaaatccctgaattaagctggtgaactgtaatacccaggggtagggaatgtgtttttgttcaaaactaaatgacttttaaattttgaactcaaagatatcttacctaccattttaaaatacctgtcatttggaaaggaaacacttctgtttgttcagtaactatcattggatagtaccattctgagagtatatgtttaatagccaagatagtgagtggtgaattttaaatattcttttaaatatccttgtggtagaagctctctggtgagaaaatgtttgaccagtatgttgaatatgaaagtaatttcctatttttatgatgatattaatttcttttaattttctctgacacgtgtttatttatgacccttgattcaaggagtgctttgtgttactcctggatgtactggtgcacaatctcaaattttcaatttttgcacagaatgggaagtctgcccagtttcatttctaatctgggttatttttcccctcaaaagataacctgatttcagtcaccatgactggcatgaatattctcatgctttcctttttactttgttaacacttaactttatctggaataatattgttatgatttctcgtttagagaatagatttgttttttacaaattgctaataaattgataataaaaatgatgctttatttttttcctctcattttaataatagctagacgtttgaatttgatgaccaagagcagttatcaccttgagagttacgtaaaaattaccaatgcttagagttcaccccattccagttgcatcagaaggaagacatgggaattaggcattggtgttttttaaaaactcttcaggtgattctgacatgcagccagggtaagaatcactagcttagaagggagagtaagattgtagtcatacttgggaaaaaacatataaaaaatatttttaaaatggttactatattgcccgaaataaatgcccagtaagggatgagatttttgaaatgtggcctgatcttagccctgtgttaatttcagtagatatttggaaagtctctcaaaccaatttttgtaatatatttaattgaagatgggggggttctcaacttaaatgtaagtcattattttacttgaagccagtttctttaaaggttaaattataacctgaagtatgcagttttccagatttgaacacacacacacacacacacacacacacacacacacccctaataaatcattaggctacttggcatccttgaagtccaaaaattaatcaacctttggtacttgttgttaatgttccagtaagtagtatttatagaaaagatgaatattattaatcataaacagtgaaacatactttgcgtttacacttagcctattggtgtggctataaatcttatttattttagttgtgctctatttcttattgatctttacaatgtgttctctaaagtaataaagtgaatgcaaatatacgtggtcacaggtttattctgagttttaatttattatacaaaagtaaaggttttaatttaatattaatagtagaaaaacactttcttacgtgtgccatatggaaagataaaggatctattctaaaattagctgtgttggttgataagctggtgtggattctgccacatccagcaaggaagataccattaaattacacagtttagctctctctatctatgcattaggaatttgacttccatttgatgttaaagcatatacttggctttaaggacacactaaaactattcaaagtttaattacattcagacaaagatcatctaaccactgttgctacatagggaatatttatttaattatcccttgctatctctattaatcagtttcctcaatttatccttaaaattttcctcaaatgcttagttattttattatttgctttttaaaatattcagtgtcaaaacaaaagtacacagtttaaataattaagcaggcatacttctccctgtctcacctgcttgattctaaattgcaaggtctaccatgtcaaattttagataatcagaacaacactttgggattaaataccaactgacttcatttttactccataagccttctcattgctactttgcatttttcttcactaacctatctgtttgttagtaagtttttcagttccttcttcatcttttctttcccttgtagctgtgagcactccagtagattgcatcactaggttgggtcctgtgagctgttttgttcttttccaagtgtctgattcagcgggccatagaccgcttgccagaaaatcgccattgcttctaggctgacgcttgcctacttgttttgatcgtctgagagaagagactttgtttgccaaaaccacagttgatagaaatagaaaggtacagataagaaaaagcactgcaattataattaagcaaattagcatagccatgttgttgttgttttccgcacagacatcctttttgaaaatttcaccatgacttttgcttgtgttttcaatgctctgtactgttgaaggactgttgctgacgacagaaggtatataaagctcctgttcagatttagaagttaaagctacgatgtgagatgtttcaggcatgtttgtagaattacctttataatctacttcaggagttatagggtttgtgttaatgttttcattttggtttctgcctgtcttgttttgaataactgaatcccaggaagaagtactgttagcccacagacgggtatagtttgcttttgttccaggagacaaagaaaaaactgttgtcatcagaaaggcaagatgtaggtaatgtcctgtgtgttccatgtccgtgggcatgcttggcaatctgttgggatagcaatataatttgttagtttgtgaaagaataatggatcctagttttggtaattgtagttaaaagatagtgttgagatgttacaagtaaactacaagcttatgcctaatattcgctaccctgaattccttctcaactaaatttcttttctattcagctatgtatgaagaagcattttaatttctattaacacttttagatgctagaagttagcattacaaataaatattaatcattttaagtggactatcatggctttatatagttttcttcctttgaagcgtgctagacttctgctttgagtcagttagttctgcttttacttttctgattccttctttaaaaaaaaaaaaaaattaaggatcattcttacagaaactacccaccctctaacctgtcaccaatctttacagaagaaatgtggccttgagcttcttgcttcatgtatgaaataaatgcaaatttttttggtggaaagaggggaagtttggtagcaaccaaaagaaactgaacttcaaatagaaattcaaggtgttctttttttttcttgggtgttcatcttgaagcttagaataaagctggtacttagaaatacatttgtaagtgtatttgtgaacgcaattttactgtggtggttgtctcttttcatttatatttccctggactgactgtgtctttctgaaggcaaaggcataccagttttctcaacctaaaaatctgaagaaaaaaaaaaaaaaacagcaaatttcctctgagtagacttaaaagttcaacaaaagttgctgggttttcttttaaagcatcatttatacctagcattttttctgattttgacataattgtaaaaaaaaatgtgtaataaaatagaaatagagcatcaggatcttgatgatttgggatgaagtggcaggttataagcatctcaacagataattgaaaatgttgaatttccgctttggccctgagcttgctggaaactagtacaaaaaggagacaagttatattatacattttttaaatctaccaaatgattgatttaaatagaaatggcatatcttagaatttaacagttccatgtactgctaacccagcaggaaagatttataatcattattaaggtatcttataataatataccagtttgtcttgagctacttttgaaaggagtattttattgttagcatttatttgaatgaactaaaagcaaaactatattgttctcctgagatttactaaatgaaattgcctggttaagaaccctacgtatgctatagaaattcttctcaaatgtacttaggagtccttttatttaaaaaaaaaaaaaaaaggcagattcttacctagctagtataggtagggcctgaaagtctttgtttccaaaccaactcctaagcaacatggatgccactgctagtcaggcttttgaacatcaaggttttataagaaatggttgttatatgtcattggctgacatttgtatactattaaaatacagaaattgaaaataagaaatgtgatacgttgagttatgcaaacaaaagtagcatgtaataaacaatgctaactggagactatatttcatattaatagtagggaggaaaaactattaaatattccaggattaagattactttttagattatgacctttagtagacaattaaaggcccaagtcactggcttttgtataatagtgttcagctttaatttttaagtttagtgacataaatctttggatatttcatgattcttccacaaaaagaaatacttgaaattggattagcaagtaatttccatctttttatactagactggacttctgtattagatgctagaatgatttaaagtagattattcttttcacattagttcattaacagtgtagtatacatcatagtattggtacacattttaacagtgcttaccacggaacagataataggcctgctgttgattgtcttcagccagatgtactgcagtgcccaaataaacaaactgtatgacaaaatgagactttctcttgcccttacaaatgcctgagaattgaggactgtttttactccagtttatgccttggaggccaggttgtgttatcagaagttttcttatatctgatcattttcagtagaatttattttcagtagaatttgtaatgtccaagcattagtaatgagaaatttattttttaacttttgaaaaataacaaaacatttccagtttacttgaggaaaccaaacttagatccttcgtaatcctaatttaaaactccatggcgatggcaaattttttcatttctaacttaaaatttatgtaacaggacagaaaaaaaaagtatacattttcagtcacaattctagtttgttagtgagattcttacacactttgatagcatttcctcgaacactaatctgtcagacgttagaagtgaaaaggcataagaaaagccgtatatatatgacctaccttacaaaatgcttggtcaaaatctgattataacgtgattttgataaaccacttcttttcttgtcttctttttaaagcagaatagacttggagaatatgagccttaaagtaaatctgcagtaaaaaaggatatgtgcagctagttttccacttttaaaaccaaaccacagatgacacatttcctttccactgcaactaaagcacatgtcacaggagggaaaaaaaaaaaaacaacgaaaaagctccaacttctctagttggccactggcatgacaggaggctttgtagaaccaatccccgcctccagagcagggagggttttccacttaatgccttttgacagtatgctcattctataggcctgctacatgctttagtgtcattcaaaagaggttttgaaatggtatcttccatttcaaatcttctctaaaagacttatttgaaatctacagactgatttgaaaatgtgagtttggagtccatgggatactgatcagataatgtaacaattgtggaactgcagcaattatttgagaaaatatctagtaaacttagattatatgggacagaaaatgctttcgtgtggtgtagtgtgtgtatacacacacacacacacacacacacacacacacacaactgtcaaacatcctgtcatcacctcaagtttaacatgactgaaacagactttaagaactaggtatgggctgaacacggtggctcacacctgtaatcccagcacgttgggagggttgacgcaggcagatcacttgaggccaggagttcaagaccagcctggccaacatagagaaaacctgtctctactaaaaatataaaaattaaccaggcagggtagcatgcacctgtagtcccacctacttgggaggctgagacaggagaatagcttgaacccgggacgtggaggctgcagagatcatgagatcttggctgcatgagctaagatcatgccactgcactccagccaggaagacagagtaagactctgtctcaaaaaaaaaaaaaaaaaaaaaaaaaaaaaaaaaaagaactggatatggcagcacatatctgtaatcccagctactaggtaggttgaggtaggaggatcactggtggagcccaggagttcaaatccagcctgggtaacatagcaagactccatctcttaaaaattaattaaattaatgaaataaaaagaactttattttttctttaaaggaggctgcctgtgacagtcttcttgtttctgttcatgatagcaacattctaatatcagaggcttagtatacaacacatcattttaatttaagtcctctcagtcctgatcagactttgaatcatgttggtccttccttcatattgttggatcagtttctttttccctgtttttactgtcaacagtactattttagatccttatcaggtcatacctagactctacagtgccttttcggtagccctgaatccttcttatatcttgtatacatcactgtctttggtcataccaccctttctttaagggaaaataaaaccggttgaacagttccctaatacatacaacaatgattcagaaatgtttgtgtacataaacatcagatgagaagattgtttaaaaattataaaagcaggacatggtggctcacacctgtaatctcagcactttgggaggctgaggcgggaggattacttgagccacagaaattcgagaccagcctgggcagcatggcaaaatcctgtctctacaaaaaatacaaaaaaacaaaaacaaaaaactagccgggcatggtggcgcttatctgtagtcccagctactcaggaggctgaggtgggaggatcacctgagcctggggaggtcaaggctacagtgagctgtgaccgtgccactgcagtccagcctgagttaagggaaaaaaaaaaaagataaaaatttccaggccccactacatagatccatatttagtaggtccaggttgggaccaggaaactgcatttttatcaagcaccacagttgattctgacgccagtagtccacagaacatatgctgagaaatggtgagcccctagtagaaaacctaagccctttggttgggcagttatggtctctccacaatttgactattctgtattttcccagctttatctctcaaaacttctctacctgaatcctccattctggctagactagctgtctcttcaacacatctagttacctgtttcttttcctttttgcctttctccataaggcctgcccagtcctcttgctgagtctgcattcctccttacctgattcagccactgtatcttctatgtagctttcactgactgcccagtttgtgttaatctctctctctctctcctttgtcttaataacagtattttctctgcatttcctttgataagtgattactttctacctcatatcttctatcttgaaatatttgtgttgttttaaaatcatttgacttgtcatatttttatcttattttctcccaacaagattaaaaattctgaggtgaagttttttattgatacatgataatttgtacatattaatggagtatgtgtgatttttttggttttttttgtttttgtttttgttggaatctcgctctatcgcccaggctggagtgcagtggcacaatctcagctcactgcaaactcccctcccaggttcaagcaattctcctgcctcagcctcccaagtagctggggctacaggcacgtgccaccacgcccagctaatttttgtatttttagtagagacagggtttcaccctgttggccaggctagtcttgacctcctgacctcaggtgatctgcccgtcttggcctcccaaagtgctgggattgcaggcgtgagccaccatgccctgcctgtatgtgtgatattttgatacatgcatataatgtgtaatgattaaatcagggtgattaggatatccattgcctcaaagaaaagaaattgtttcgtctagctgttttgaaatatacaatgttattattaactagtcaccttactatgaatagtagaacttgttccttctatctaattctaacaatacatatattatttattttattattatttttttaagacagtctcactgttgcccaggctgaagtgcagtggtacaatctcagctcgctgcagcctctgcctcccaggtccaagtgattctcgtgcctcagcctcccaagtagctgggattacagacatgtaccaccatgcctggctgatttttgtatttttagtagagacagcgttttgccatgttggccaggctggtctcgaactcctggccttatgtaacccacctgcctcagcctcccagagtgctgggaatacaggcgtgagccactgtgcccagccctgattatatttttatatccattaaccaacctctgaggtaaagatttattttaacttacttagtagtattatcaccagaatcatcacatatggaaaactttgggcctaagttaacatagattgttttgatttgaaactttggtaccattacttcagggctttttcatggtcctcactgtggctgctcccatttattagtattcttttggttttaagcaacatatgacctaatatggcttaatcaaaaaatggtatttattggcttatgtaactgagcagtcctgggataaatttgaccccaggagaggctttatctcatacacaaatgatatggccagggttccagtttgtctatttctcagctccttctcttcagtcttttgggaggctcttcttttatatcccaaaatatgagctagcaactcctagggctacgtattcccttgtttataaacaccaggaaagaaatatctcaaatcccaacaatttaagctaaactacctgaactgggcctctttggccctggttgtcctggtttgaataatgtgttcattgctgaatcagtctgtgatcaaggtgggataaatggattggctaaaaccatctcactccagagctccagatgggtcattcctaccagactattcgcctaaggagtttggtgggccctgcaggcaaccaactaattcccactgttttcttcctttcttgactcatgggcaaattttttattgttgtcgtggctcaaaatttttgaattggagatttgtctcttctcttagccttatttctcagtgtccaaaaaacaactgatttaaaaaatgaatccagactttgaagaattgttttatattattctctctagaaaatgaatcataaaataaaattgattagtggcatctgtatatttattttaaacactgctaataatctttgtcttttttgtcattttccttaggttcaaaactggtcaaatcaatggtgatttgctgatataccatgtcttactgactttaaagccatattatgcaaagccatatgaaattgtagtggaccttacccataccgggcctagcaatcgctttaaaacagactttctctctaagtggtttgttgtttttcctggctttgcttacgacaacgtctccgcagtctatatctataactgtaactcctgggtcagggagtacaccaagtatcatgagcggctgctgactggcctcaaaggtagcaaaaggcttgttttcatagactgtcctgggaaactggctgagcacatagagcatgaacaacagaaactacctgctgccaccttggctttagaagaggacctgaaggtattccacaatgctctcaagctagctcacaaagacaccaaagtttctattaaagtaagttccagtctgtgttttgtaaacgattcattgcttttcttgactaactagactatatcctggcctccctaggtgtcctacccctatagtggtgtataaaatgtcacgtaaggctgtcgcggtggctcacgcctgtaatccaagcactttgggatgtcaaggtgggcagatcacgtgaggtcaggagttcaagaccagcctggccaacacggtgaaaccccgtctctactaaaaatacaaacattagccgggtatggtggtgggcacctgtaatctcagctacttggaggctgaggcaggagaatcgcttgaacccgggaggtggaggttgcagtgagccgagattgcgccactgcactccagcctgggcaacagagggacgctctgtctcaaaaaataaaaggttatgtaaatctagatgtaggaagaccaacatttgtgtcatcatggaggtcctgtggaggatatgagacgtatacattttattctagcttaggctggaagtagaagagtgttttggagagggcaatttgttatgtcattcaaattgtaggaatgtgtggagagtagaaattacctaatgagagttctgattattacatgcttttttcagagtgaggaacatgaaccttcaggataaaatcagtacttttctataagattgtttgttttgttttgttttgttttttgatatggagtctcactctgttgcctaggctggagtgcagtggcgtgatctcagagtgcagtggcgtgatctcagagtgcagtggcatgatcttggctcactgcaacctctgcctcccaggttcaagcgattctgctgcctcagcctccccagtagctgggattataggcgcccaccgccacggcaggctagtttttgtaggtttagtagagacaaggttgttggccaggctgatcacgaactcctgacctcaagtgatctgcccacctcggcctcccaaagtgctgggattacagggatgagccactgcacccggccttctataagattcttgacctttttaaaaaggaaaattaaaaaatttttaaatgttttttgtttcttttgagaacatttatcataataattactgaaccatttgaatatacaatggtgggaactcttccttaaatggcatagtgttttgtttggttggttggtttctggagccttttagaattttatgtaaaagagtttaattcttctccacttcaccccgtcaccaccactttccaggttggttctactgctgtccaagtaacttcagcagagcgaacaaaagtcctagggcaatcagtctttctaaatgacatttattatgcttcggaaattgaagaaatctgcctagtagatgagaaccagttcaccttaaccattgcaaaccagggcacgccgctcaccttcatgcaccaggagtgtgaagccattgtccagtctatcattcatatccggacccgctgggaactgtcacagcccgactctatcccccaacacaccaagattcggccaaaagatgtccctgggacactgctcaatatcgcattacttaatttaggcagttctgacccgagtttacggtaggttttttaaaattctcttcagtttgatttggggtttgttgcttttaaaatgagaccatttaatgaattttaaaacagcctctaccttaatattgtaaattggaaggtatgcagtgttggttaaccactgtgacctcatcaagttgtggggtattcacatgaactgtggaattccaaacagggtgattcacactaaaccaatatatgtcctttctccatcatgtaaaacaacacgacatagcagatttttttttccaaagtatcctaaattaagtttttcttcctctaagtcctctaatttttttccattttcagaagtatatcactatttagtttaaaagtcaagtcagattattgctttacaaaagaaggcctaatgttcaataacttggtaacattattgcatactttccacctacatcactcttaacaaaattctcaaaataaatcttaagacaaataagtcatctgagcagagtgtaattggttccatttaggcttaataacttgaatatgcatgtggaaagagcatggctgtggagtgagtagatgtggtttgaacagatatgccactttctagctatgtactttgagcaagatactgaagttttcagatatctagtttccttatttgtgaaataaaggtaattgcctttcttatatacccacaaaagcttaaaaaatagtatgtgtagtagtatagtatagcaaactagcaaatagtttatacttagtaagtagtattttcttatcttttccctccctgccagcatctccttgcaccctttctcccttttctcccctctccttaccaagttaggataattctttgtctcaagtaccctgagactttgaagatttttcagatgtaaattcttaacttctgaaaattttccctgaggataacatagcccaggttttatagtgggccttttaggattccaaattctcctttacttaaagggaaaaagaagaaaatcaagatatgtttacttggatgggcttcagaaattgtacataagattttgtgtatgctttgcttcctttatctcataggtgtctgtgacacctgtcctgggttgaggaagtccaattctttataagtgttgaaatacacaggataaaagttttgtcaaaattgtataacttagaattcctgggaattagtaaaagatacaagctgagcactggcactgtagtcccagctactcgggaggctgaggcgggaggacagcttgagctcaggagttcaaggctgcagtgtgctataatcatgtctgtgaatagccaatgcacaccagcctggggaacatagtgagactctgactaaaagttttttaaaaaagaaaaaagatatgtaaacagaaataataacactaattttcacattttaggaaaatggagctataagcctgcctttaatttctaattcaaagatcttcattgaaaaatacaaccttttaacaattattagcctgggtaaacctgtattcttctctagtgacctaaagcaatctctgacagcttctgctttttgctgaagcatgtcatcccagagaaaaagcctttaggcagacttaaattccagtggctttttttccctatatggttgttgcatcaatatagtagcatgataaacattcagaggtaaggaaaacctgacagttactgaacaaactatttcctttactggacaggggagaaaattaaaatttttaaattgagtctgagtcttttaggctgtctcctaaattgcttaaatatattttcagacatttgtaagtgatgtttggtctcaatgaaacctggatattatagtttttttccatattggtggttatatatgatgtaatgaggtcatagagggaaaaatgggaggacttaattataagttaattttgtttttaaccttcagtttgtagggtaacttttaggacacccagaaagaagttcagcagatcctgattaaagattttcacattctaatttgatgaagggaagggccatctgatatctgtccctatgatccccattataactggatctagtgggaaagagaaccagaatttgagttttggctttgctaaaaatgtatggtgtgccttattctgacttaatttctattgatccacattaggaccataagtcctctcatattttatgtctcagtgagatgtattttaggaaagcctataccccgcccctctgtcataggagcctcacagtgctcttatggttatatcaagtgtgtccctttttataaaatccctaaatgattaaggggtattttggttttactgtagaattataacatcttatttctaactgatcataaaatttaaaaatagttgatcatactttgtaacagaatcacaaattgtatgttatgaaaaaattttggaactataaggaaaaatacgttttaaaacaacttcatttgtgttttctcctaggtcagctgcctataatcttctgtgtgccttaacttgtacctttaatttaaaaatcgagggccagttactagagacatcaggtttatgtatccctgccaacaacaccctctttattgtctctattagtaagacactggcagccaatgagccacacctcacgttagaatttttggaagagtgtatttctggatttagcaaatctagtaagtaatgataattttctttaatactaacaattattctaagagaattcaaagaaaaccctttcatttcagaattttccagtgaagactttcacttacatttttactttttttcctcttctgattttatatctgtggtatcctgtaactgaaggaactctgaaggaactttttggtaggccacattgagaaatccaccaaaattctgataataaaagcaaagcggcaagagtttggtactttacacacctctggaccacttacaaagtattttcttcactgttgcagtttaattagcttcagcatttctcttcatagcagaaaagtccacataagtatccatgttgcctccttaattttagagaactagtcattttctcttttctttaggttgactttgaacaatgaatttattgtaaatgtacagttcacggagagcacagtggcacataatacagggcccagagtcagttctgactttgttttaactaagtcttataaatttaatatccactctttatatttgtccatctttatatcctatagttttataaatgttgatcttctcccagcatatttcctgaccttttcttccctttcctttccctgtaatatataaaacttttttttctgcattcaaacacatttcttgacttttatatattagataattaaaagcttcagcaattcactaagactctttgtcaggtaagagatgtaggactataaccctaacaaaaaaatgtgtaggactgacaaaacaagaaaagtataaactttattcataaatattaatatgagagaagatttgagtgaatgtaaaggcatattgtgttcctgcatgaacagttcttcccagattattacaaatttaatgtaatttcatcaaaataaccatgggatttgaggattgagaatggagatagaacttaaatgattctaaattctacataaaagtgcaataatagctaagaaaatattgaaaggaaagagacttgagacttaatagtacagatgtctgaacactttatagcagtacaataattaaaacatacatgtgcaagaatcagccatcagatcagtttaagagaaacagattgataaagaagcatcacaaactgatgagggagagattaaatcatttaataaatgaggctgggaaatgacttaaattaggtcttcgtcttcaccgtacaccataagataccaagtatgttctgcctgtatttaagagttgagtagggctgtgtgtggtggctctcgcctgtaatcccagcactttgggaggttgaggcaagaggattgtggcaggaggattgcttgagccccagaggtcagggctatagtgagctatcatcgtaccactgcactccagcctggatgatagagtgagacccttctctattaaaaaaaaaaaaaaaaaaaaaaaaaaaaaaaaaaagttgtatataaaagcttggaaccattttaaaaagaagaggaacaagtgaatatttaattgctttctagatgagtaaggacatatgaagtaaaaaagtgataggatgaaacaaaggaaatagcgaacagatttgactacataaaacttcaaaacatagctactcaaaaataaacacaagtgaagataattaaaaactaggaaatacacttggagcaaatatgagaaatgattaatatccttaatcggccagacgcggtggctcacgcctgtaatcccagcactttgggaggctgaggtgggtggatcacaaggtaaggagttcgagaccagcctggccaatatggtgaaatcccctctctactaaaaatacaaaaattagccgggctcggtggtacatgcctgtagtcccagctactcaggaggctgaggcaggagaattgcttgaacccaggaggcagaggttgcagtgagccgagatcactccactgcactccagcctgggcaacagagggagactctgtctcaaaataaataaatgaatgaataaatgaatgaatgaatgaataaaatccttaatcatgaagggtgctgaccgattaataaaaagtggattaacagtaacatacagatcatggttttttttttttttttattatactctaagttttagggtacatgtgcacattgtgcaggttagttacatatgtatacatgtgccatgctggtgcgctgcacccactactgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatgttttttaaaaaagaatatttgtacaaaaaaagaaaaaagccaggcaccatggcacatgcctgtaatcccacctgctcaggaggatcgctaagcccaggagtttgagaccagcctggacaacatagtgaggcccccatctcaaaaagaatatttatattttaagaaattcactaataaaagccaattgaaagaatagtgagataatcagttatcagcttggcaaagattttttttttaagatccattcctggtggtctgtggaattgtgagtagaggcaatttttctagaaaggcatttggaagtggataacaagaccttaagactattcataccttttggcctcataattctgctttttagcatttatcctaaagaattaatgttaaaatgtttattatagcattatttttatgtagatttttaaattgaggtatatcttgtcatcagtaaagtgcaagatcttaagtcaacagcttgatgaacttctacatgcaaatacatcatgaaagtatctccagatctagacatagaacatttctagcatccagagggatattctcagtaccctcccttcaccaagagtaaacactattatgacctctattgcacagatttattttgcctactttagaacttcatatgacattatttataatagcaaaaaaatgaacaggccaaaagtcaaagaataaggaactgattaaattattggttctccatctgatggaataatatgaagccattgaaaaatggctttgttacagaatttcagtttggaagatgaaaaggttctagagatggatggtggtgatggctgcacaatgatttgaatgtactcagtgccactgaactgtgcccttcaaaatgggtaaagccacggaactgtacatttaaaaatagttaaaatggtaaattttgtgttgtgtatattttaccacaattttaaaaactctttgagactttaggtaaagtgtatagataaatttttgtacaatttttgtcttataaatgtgaagctttttcaagtaagtttaaaagaagtttgcagaatttgtaatgttgaataaataatctcagtataggccaggggtggtggctcacgcctgtaatcccagcactttgggaggccgaggcgggcagatcacgaggtcaggagattgagaccatcctggctaacacagtgaaaccccgtctctactcaaaatatgaaaaaaaatttgccgggcgtggtggtgggcgcctgtagtcccagctactcgggaggctgaggcaggagaatggtgtgaacctgtgaacccgggaggcggaacttgcagtgagccgagatcgctcctctgcactccagcctgggcgacagaggagactccatctcaaaaaaaaaaaaaatgaataatctcagtataatcactgaaaaaaatattcagagcctactgcatgtatagcataatccccgtttttgcgggggagtgggagtgggttatacctgtgtacacacacataaatgtacattaactctacataaatttgaaagcctgaggagagatgagatgatacaccaatgttaatacagttttcattttgtggtgatgctttccttttaccaaactttctatgattaccacatttccttttataatgagaataaaacaactttttaacaagaaaggactaaaatggaggaaaataagacaaaacttttcaaaaattggcttactggcttttaaaattactttcttcaaggactgttctttcttcgcctctacaaaaatatatttgccaagtgtcttttctccaggcctgattctaggtaatagtctttaccttttaccattttttccccgaattctttatgttaaataattgttgatgtgattttcattgaccatcacatgctaatagtgtatttttttccaggtattgaattgaaacacctttgtttggaatacatgactccatggctgtcaaatctagttcgtttttgcaagcataatgatgatgccaaacgacaaagagttactgctattcttgacaagctgataacaatgaccatcaatgaaaaacagatgtacccatctattcaagcaaaaatatggggaagccttgggcaggtattgagtttgctcaaatatttatctagtatctcctttgtgcacatatttatctggtgccacattgggcaaagcactgcgctagacactagggatagagttgtaaaaaacacagtttcctccttcagaaagcatgtagacactcacccagctcttcatctggttcaaaattgtaaatgtctagtgcatgtctcagagccagagaaaagctagttatttgcacagtctccttcaaggcataattatatatatatatatatatataattatgccttgaaggagactgtgcaaataactagattttatatatatattatatagaactgtagaaatctggtgacatttctagtgctttattctagttctctacattccaaaggtgtcagtagatgtttcttcttattgatgctatttgggacatctgctttcatttatagttctacataagaatgccaatattaaaataggatataatgtaaattttatttttatctgacaagaattaggcatatcatttcttcaaagtaatcatttaaggaaataatgccctcactcaaacactgctgctcctcctccaaataattagaaataaccttggagccagtgttgcagccctagaaaacatcctggtacttaatgtcatttcctatattttatttttttttgagactgagtctcgctctgtcacccaggctggagtgcagtggtacagtctcggctcattgcaacctctgcctcccaggctcaagtgacccttccacctcagcctcccaagtagctgggcctacaggtgcacaccaacacacctggctaatttttgtatttttttttttttttttttttagagatagggttttgccatgttgcccaggctggtcttgaactcctggcctcaagcaatccgcccgcctcagcctccccaagtgctgggattacaagcgtgagccactgcacccagctctgtattttcaaattactattttatattgatgctacattactgtcttagaaaagcatagagatactttgcaagtgactgaagatagtattgatagagatttaaaatttttgaataccaatctcttaatctctgaaggagtcaaatgaatatactcatcctttactggatattttataataaattgtatttactgacaggcctgtaaataaaatctagtatttttgaggcctcaggtaaaatagaattttcatattgattaggctgttccaatgaatattttttaattaaaaattaaattggtagagtgattaaaaacatgttattttccttcttcaactagattacagatctgcttgatgttgtactagacagtttcatcaaaaccagtgcaacaggtggcttgggatcaataaaagctgaggtgatggcagatactgctgtagctttggcttctggaaatgtgaaattggtttcaagcaaggtaatcacttttcttttgccttctgtactatagcatatctgttttatcatcaggaggttttttgttttgtaattacttttaaattaaactgaacttttttgtgctaaaactttgagtcccatgtttttttttttaaaaaaaaaaatcctgcttctttacaggttattggaaggatgtgcaaaataattgacaagacatgcttatctccaactcctactttagaacaacatcttatgtgggatgatattgctattttagcacgctacatgctgatgctgtccttcaacaattcccttgatgtggcagctcatcttccctacctcttccacgttgttactttcttagtagccacaggtccgctctcccttagagcttccacacatggactggtcattaatatcattcactctctgtgtacttgttcacagcttcattttagtggtaagttctaggaaaggaatttgtgtttaccagttcctttctccattttacttcacctgatcaatatagattatcttatttatgtttgtgctctaacaccaagttgctaatttaagcctccagtaatgacatgaaatattaccaaaaagaaaataaattacttccattccatatcaagctatagtaaagattttctatgcatacttgtcatgtagagttatcccataagcggaatactcagtgccagttgaccatgttcagttaccagcactaatttgtagataaatgaagcaaggagcattaatacaatgtatctagaggtttgatttagggaacatgattatgtaatttttatatggtattcaaattttctaaattcaaaatgaaacatggaactttagaaattaaaaagtaatattttctgtctttacttgttcctttattctcttacagaagagaccaagcaagttttgagactcagtctgacagagttctcattacccaaattttacttgctgtttggcattagcaaagtcaagtcagctgctgtcattgccttccgttccagttaccgggacaggtcattctctcctggctcctatgagagagagacttttgctttgacatccttggaaacagtcacagaagctttgttggagatcatggaggtatagaagccaaaatgataagaaactaagttaaaatctttttttaaaaatatgttaatactatatagaagaaatattggtttattgtgctattttgtacttaatgcttaaataaaaacacttgcatggactgtgttattggtaacaggtcacttaatgacatcataataaacattatttaaacagttctaaaaacatttatgtacaatatgtattcagagtatccccttttttaggcatgcatgagagatattccaacgtgcaagtggctggaccagtggacagaactagctcaaaggtatgtcctaaattaaatataagttgtaaaaatatgcatattgttgaaaatacagctattactgtatgatcaatgttataatttattatttagtatatataaacacaaaggtttttataagttctgtggatcttttaattgcagatttgcattccaatataatccatccctgcaaccaagagctcttgttgtctttgggtgtattagcaaacgagtgtctcatgggcagataaagcagataatccgtattcttagcaaggtacctgttccgccctcacttctcccaaatatttatggttctcaagttgtaaagcatatctttcatttttctaaaagacgtttaaatttgaggtcaatgaaatatcttatatgttacttattaagcctttaaaatgtattttgattatttattgtaattctttgaagaagtcttctctaaagaagctgtctttatatgtaaactctgattacttcattaaggaagatgtctttaaaataaaatatgttgcctcttttgctaagcaggtacacttagtattttaccagttttcaaagcatttaattatatggtaagactatagccttgcataaaattatttaatttgtaattactataataatgtctgactcttataatgtagaaatgtcaaaaaataagaaaacaaatgtacattaagctagctaccaagatcaccatagcatgagaaatcattctagcatttattaaataagtaaatgttcctgaattcattccgagattcagtttaggagttaatgttttatttcaatgaaagtaaaataaaaaattctgttttcctaaaaggcacttgagagttgcttaaaaggacctgacacttacaacagtcaagttctgatagaagctacagtaatagcactaaccaaattacagccacttcttaataaggtaattactgtatagaaaatgagtgcattcattttgggtatcagtgttgaatgttactttctttcaaagagtttagaaaataagatgaattgagaataagttataaagaaaaaactatagttaaagtagaacctcttaaagtttagttgtttgaagtagtcatattagaagaagagtaagtatggatagtatgttctcaagcgcttgtaagtttttggtctcatcagtgctaaaggaaagataggtatatattcttaattattttatcttataactattaattatctgctattgccaagtactgttttaggcgctagagatagagtactaacaaagcccataaaactcactgccttcatggagcttactttctggggtgggtgtggaggttggggagtgaatggataatgaagtaaacaaaatacgtagtatgttagtgattattactatggagaaattaaagctgggagaagtatacttgatcgtcataagagtttgggtgccaaatgaagattatatttaaaaggagtaaaatgaagtggccactgttttaggatggtctgaccttatcccatttttatatttaagatatctggaaatcatgtttttgtattaataaaatgaaaaagattcgataatggcatggtattaccatccagttctaaagtggtttaattctgtgatttgagtacaaaggtatgccagacttgggagaaataacagagaaataatacctgttatattcctggtttgtctacaagcattctaattttgtattatacaaaatggttctctggtccccatcttctaagtgaaaatgagctcagaagggctaaataacttgcccaaagtcacatacctaataaaagaaccatgattctaatgtgatactatttgactctaaagtccatgtattttccctaatatcacagtgctaagtaaagattgccagtaataaatacttttaattcagagcagcaagagattaccatactggttaagagtgacaagaagttgaaaagacagtttaaaataaagttaaagggaaacataggagttaatgtaggtagagagaaagggagagagctgcacaagaatgccaggacaatggagggaaggtgggtagaacattctagttgtaatggagaagcttttcaaaggaatcgagagagggaaagttgtgaggactggatagacctcatctcacattcagcattgttcaaaagagtttggaaatgtacagtttttaagcagacaagtcatacgatgaaagcaggacttagctcctggtggtagtgtgcacagtggattggagtagggagaaactgaagtaaaaagaatccacctttataataaagaaggttggcatgtggtaatgtcattagcaataagaaagaaatgacaaaagatacaaaagagactactctagaagaatcaacaaaccttggtgactggatttagaaatcaaagaacagggagaagtcaaaggaggtgctaagtaacgttctcagtccagctaacagtgtctttagttatacatatggaaaagtgaagagcttactcatatctttatcttccccaaaagagaaaacatgggtaatttaggaagataagctgctttatttttaactgcagtgtgttttgaaagagactatgtcatgattcatcttactagcctcaaacatatcttctttgccaggactcgcctctgcacaaagccctcttttgggtagctgtggctgtgctgcagcttgatgaggtcaacttgtattcagcaggtaccgcacttcttgaacaaaacctgcatactttagatagtctccgtatattcaatgacaaggtaagcaaactttgccttgaggttcctagattactcaaatttagtactcttccatcttttcttgttgctattcttttaaaatcacaagaagtccataacttaagtaggaatttgtataatgtaacttattgtgagtatatttccttaccagctcataaagaactatgtaaacttgaatgcatattttttacataaaaatagcaaaaaaaaaaaaacaaaaaaaaaacagtactggcctaatactagtagaattacagaataaggataaataatacatgatcatccttacagaatgagcataaacaatacatggtaataatattaatagctaccatgccaggccgtatgctaaacactatacatttatttttaattttcataaccttaaggtaaaggttagcattctctgccccccatttcacacgtgaagaaataatctaaaagtaatcttagttttacttaataatgccacttaatgaaaaatacgtataattcatagtagataaggaagttggagagtctaaaggaaacttttgggtacttaattttactagtttttttattctgtctaatcttactttaaaatataccattagtggccaggagtggtggctcatacctgtagtcccagcactttgggaggccaagacaggtggatcagttgagctcaggagttagagaacagcctgggcaacttgcaaaaccccatctctacaaaaaaggcaaaaattagctaggcatggtggcatgcacctacaatcccagctactcgggaggtgaggtaggaggattgcttgagcctgggaggcagaggttgcagtgagctgagatcacgccactgcactccagcttgggcaacagagcaagaccctgtctccaaaaaaaagtgtgtatacatatattacatacacacatatatatgtaatgtatgtgtatatatatatataaagtgtgtgtgtgtgtgtgtgtgtgtgtacacacataaaatatgtaaaatccaactccaattaaggttaataaatgttaggaggggtgctaatggggtgtgtgtgtgtgtgtgcacgtgtgcatgtgtgtgtgtatatatatatgaacatgggcaaattacttcttagttcctttctaatttgtaaaatggagatctaattggggttggattttagttcatagagaatagaggagagaataaaatagtatgaaattacgtcccttttgtctttggataaaaatgggaagggtctaggagaaaagaggggaatgtttttaaaagaatgtgtatatacagtgagatttgcttgaagtgaaattaactgaactgtgggtacaaagaacaggattatggttttaagtgtaaaaagatacttggtctaaacattattagttcagtctaccagatgtagtgtgaacctggaacagatatgggtctgaaaaatatagaagcaaaattttagaggtaagaggtcttatggagtttattaatcagacctccattttgcaaattagaaaggaactaagaagttaagtaacttgcccatgcttgtacatctgttttgggactagaacccctctgtcctaattctcattgccgtttttctaaaactgttttgggacagtggtggtcagcgatatctagttgttggctatttatatgttaagaatatttgcaaattggccgggtgcaatggcgcatgtttgtaattccagcactctgggaggccgagttgggaggatcacttgaggttaggagttcgagaccagcctggccaacatggtgacaccctgtctctactaaaaatacaaaaattagccagggtggcacatgtttgtaactccagcgacctgggaggctgaggtgggaagatctcttgaacccaggaggttgcagtgagccaaggtggtgccactgcactccagcctgggcgacagagtaagactccatctcaaaaaaagaatatttgcaaatggagcattgcaaatggggcatctgcctcggtattttcatcttcaaaacagcccagtagcgggagctaatattgattctagtgccctttggatgctaggcatcagagttaataagcatgttaaaagtcaccgggatgtaaattgacagtcatttattttgtattgtaaataaaagtgatttcatcttccaccatcttcttatttatatgcttgactgtcttgcaccagttaatttgtagtagctaaaatgttctgtggttttctgcagtcaactgaaaataatttctctcaaattgaaaggattacttatcttgtcatactattgaacacaaaattaagtgagcctttaaagaaagctactgtgtgaacctcatcaaccatctcatgattatctttaatagagtccagaggaagtatttatggcaatccggaatcctctggagtggcactgcaagcaaatggatcattttgttggactcaatttcaactctaactttaactttgcattggttggacaccttttaaaaggtaaaaaagccttatttagaatatttttatgaagtactattaagaaaccagaagtaatttgaataagtgattacttgaaataaattgaagtaagttagcccttatgtcttactttaaatgcaaactaggccaggcgtggtggctcacgtctgtaataccaacattttgggaggctgaggcaggaggatcacttgaggctaggagtttgaggccagcctgggcaacatagtgagacttcatctctacagaaaatttaaaaattagccaggcatggtggcacgtgcttgtagtcccagctacttaggaggcatagatggaaggattgcttgagcctgggaagtcgaggctacagtgagccgtgatcacaccactgcactcagccctaggtaacagagtgagactttgtctcaaaaaataaataaataaatgcaaactatatctgtcttaatgagttgtgttttattcaatatgtgttttaagagagcttcatttccaattcaaatatcaaatttgcctgaaaaacaaaagagtttattctggctgggtatggtggctcacacctgtagtcccagcactctgggaggccaaagcagaaggatctcttgagcttaggagttcgagaccagcctgggcaatatggtgaaaccccctttctacaaaaaataaaaacattagccaggtgcggtggcacatgcctatagtgccagctacttgggatgctgaggaaggagaatcacttgagcccaggaggtcaaggctgcagtgggccatgatcgtgccactgcactccagcctgggtgacagagtgagaccctgcctttaaaaaaaaaaaaaaaaaagtgttgattcttacaaaaacctacatactgagtctgataatagctatattaatagtaacaatacctaagtatcttactgattttcaaaatgaaacagactgcaaatcactaagtgttatttgaataatttatattagaaaatgttaagagatttgatcacagattttcttcaacttgtttatagtttattgttgattaatactattattttataccattgtacatcacctttctggcaccctattctcacccctttctatattgcttatagccagtgatctccagctattcctcagagcccgctcattcacttcctaacctggttttactccccgttgctgacttcacagcttgttaactttggttcattaacatggggcagtcatggccagagactgcagttaataagaacagcatgtagtggtgggtcagaagcaaagcaggataaagtaagacctgggataaggagctggcatgaaccccagtggtctcagaagtggatttggccacaatagagattcaagctatagcttgagtcaacaattttgtattaatttaaatcataggcttgagggaccatggagattctcccagtttttatgagagagagagagatatgcatacacccactattgtgaatgtatgcatttgatttcactttcttatgaaatttctacaaaaaatattgacagtgttaatctctaaggtcaatggggatttctcaaaaaatactaccttactaaaggataccaagataagtaattgtaactgggctaataaagtgcttaattattctttatatctaaaagaataccaggctgggtgcagcggctcatgcctgtaatcccaacactttgggaggctgaggcaggtggattgcttgaggccaagagttcaagaccagcctggccaacatggtgaaacccctgcttgaaggcaggagttcaagaccagcctggccaacacggtgaaaccccatctctactaaaaatacaaaaattaggcaggtgaggtggtgcaaacctgtagtttcagccactcaggaggctgaggcacaagaatcgcttgaacctgggaggcagaggttgcagtgagccaagatcctaccactgcactccagcctttgtgacagagtgacactctgtcttaaaagacaagaaaagaaaagaagaccagatactttccatgttcaaatcacctatttttaaatgggggaaggattaatgattaaaagctggccaaagatcaaatttatcctctaatcaaccctatttattgggctcttagagcatatacttcctatgtcatcagcttttcttttaattaaaaatgtttttgtattccgcctgcgactcggtcccggcgctgggctgaggggaggggttgtcttaaaagtctctccttccccctgtaggggcggccggcgagtcccagtgagagcggagggtgccagaggtagggggccgagaaacaaagttcccggggctccctccggggccgcggtcggggctgcgcgtttgaccgcccccctcctcgcgaaggcaatggcttccaaactcctgcgcgcggtcatcctcgggccgcccggctcgggcaagggcaccgtgtgccagaggatcgcccagaactttggtctccagcatctctccagcggccacttcttgcgggagaacatcaaggccagcaccgaagttggtgagatggcaaagcagtatatagagaaaagtcttttggttccagaccatgtgatcacacgcctaatgatgtccgagttggagaataggcgtggccagcactggctccttgatggttttcctaggacattaggacaagccgaagccctggacaaaatctgtgaagtggatctagtgatcagtttgaatattccatttgaaacacttaaagatcgtctcagccgccgttggattcaccctcctagcggaagggtatataacctggacttcaatccacctcatgtacatggtattgatgacgtcactggtgaaccattagtccagcaggaggatgataaacccgaagcagttgctgccaggctaagacagtacaaagacgtggcaaagccagtcattgaattatacaagagccgaggagtgctccaccaattttccggaacggagacgaacaaaatctggccctacgtttacacacttttctcaaacaagatcacacctattcagtccaaagaagcatattgaccctgcccaatggaagaaccaggaagatgtggtcattcattcagtagtgtgtgtagtattggtgctgtgtccaaattagaagctagctgaggtagcttgcagcatcttttctagttgaaatggtgaactgataggaaaacaaatgagtagaaagagttcatgaagaggccctcctctgcctttcaaaagggtggtcacctacacatgtttaaggtgtctctgcacatgtctcaagcccatcacaagaaagcaagtacagtgtggatttcaaatggtgtgtaacttcagctccagctggtttttgacagctgttgctgtggtaatattttttacatgtgatggtgatagtctctggttctccccatccccacaaaggctgttgaaccacagcaccaggaagcctgagaatgaatcctgagggctctagcccaggctttgtcccaggctttctggtgtgtgccctcctggtaacagtgaaattgaagctacttactcatagtggttgtttctctagtcttgagtgactgtgtccacagttcatttttttccggtaggaataactccttttctacatccacactccatagagtctctccttttcagacatcctgggatgaaagaatttggcttttttttttttttttttttttacatctgttttcactcttaggcttttaaacaatagttattgctcttatccctctcagattctaataactgagagcgatggggctatattgaatctctgtatgcactgataactgagctatgaagaggatcttattaaactgctggtctgactctatggattgacactgttcctttcttttattgtgaaaaaaaaaacccctgaaagtcttgggaaccccctaaagtcttttgggaatcctcaaaaagcatgggaagttaagtatttagctacataaatgttgtaagatcatatcttatgtatagaagtaataagaccatttggaattactggactaattgaatagttaaggtttctattcgggacaataaaatgtattttgaaagtgctgctaactattgatgctgacagtgtttcactcctatgagtgacccaaacatattataaatatgtggtaaagggaatggagcctgtggggttgagcagaatgttgtactagctgtgcctggactgagtataacagctttatgattatgagaaaacaaattctttatttttttttctgttccaaagattcatcctatggggtggccataaagtctagaattagatactaatattttgtcattcattataacatatcgataaaccatttgttaaaagatttgcctggtttccagacttggtggccaccttgaataattcttgctgtcttctgggaaggatgatgaaatttattcctgctgccttaaaaatatgtatcccttcttcacccatcatgactgtccccagtgagtgtcctttactattcttgggagtgactcctgtctaacttttcatactggcgagaagaaaagaagcctattttaacactttagtggtgttgaaacacattacttactttctgaagatgtcccagtgaatcctctgtcaattcactgccatatgtaatctatatgataaggaatgcatcttccttctaagtactgcccaaactcttgccagctcctctcccattgtcccttcatgtgaatatttcttggctaccttagtggaaatatagatcagtcttctccccatccatcctctcaaacataatgagattgtttactttttagatttatgcagtgaaaatgcccagtcaggtctgaatcgtcagtgcattatattgactctgagcactttagaatttagagttgcaattgaatgccagctgtggagatggggtgcatatcagatatataaataaagctcaggtttgctagggaaccaggtatagagaaaaataagtctgatatgaggaaggaaaattgcacaatttagagtagttatgccatagagaaaatttccacaaactaggaaatgtagagagttattctatagaatactcaaaagaggaaagtatgtgatttttggaaacaggaaaatcttcaaacttctttcttcacttccctttgtgtttagctgaccctccaatgtgatcattgcctttggagtttgggagaggtacgggaagtggcctgatccctgcttccatacttcactcctccatccatccttccctccctcttcccctccagctaaatggacaattctagccaacattgagtcactcaataagtctcaacagtgggtgtgtttgctgagattgtccagcagttgagcagtttggtctcacctccctcgctagttgagaccaaaaagagacaaataactttttcatggtctttgaaacataatgcttatttcgtggtcaatggctttaaaaaaatctgtttcttgttttcttcaacaaactcactagttttcccttaactgatattgtaaaaattaaagtaatcttgaaaatgttttgacaaaagtaaaattaaagggacatcttttcttaaaaaaaaaaatgtttttgtaaaagaaccctattttcaaatgaaatcttaaggagaattataatacatagatttttttttttaatctctgtgctgctttagggaatagaagatctgaaagactatcatgttttttaattttcctcttcctggagtactgtagagttctagggaatattatattctacacatttttggtacttaatcttatacataattaattattctcattcacatatgcatgttttaccttcccaaatggctattcttggaaagtaggagttatatttcctttccttgcagagttgttagtcagggaagaagacctcagcagatgcttgttcaaaaaattaattcttacttgtttgtttgtttgtttgtttgttttttgtagggtacaggcatccttcacctgctattgttgcaagaacagtcagaattttacatacactactaactctggttaacaaacacagaaattgtgacaaatttgaagtgaatacacagagcgtggcctacttagcaggtaaaaacacaaaataaacaaaattaatcttgctacatctatatataaggatcacccaaaaagtacaaatacctataggttttttggcggttgcgtggcagagcagaaagttcacagtctagtcctttagtggtggttacaattttgagagttttgccagaacatttttctgtaggaaaaaatttaattcccattaaaatctgaaatgtgttcccttggtcatctttggttcaagacactacagtggctctctgttatctgtcataaaatctgaatgcttcagtctagcaccctgggtccttaaatagccctctcagttctgttatctttctctaaatttcatgagcctcattttttattaccactccaaatggatgagctattttaagctaatctacttgccatctcctacaagcaactgcctcttcaatattcattccttatgtcattttatctggagtatctgccctatccccaccattccattaaagcttcctatttgctcttatctgatttttgtttctctactcagcaacacttagcacttatgtacaatacaattcttgaacatagttgtttgatagaaagtgctgattctcagtttcacagacttgtatttgttcaacttttttgtttgaaccgtatcatcttgagcaaatcatttaacatctcagtattttttctcattcagcttaataatacctgccctgcctactttgtgtttgttaaagatcaaatgtatattaaagaacttggaaaataaaagatgcttattaaatctctctgtatatttcacatttatgtagtcttccaaaatatgtgcacatttaacaggtactatgctctttaggagactgtaagaagttcatcctgttttaagtcacacttgtgatttgttaaattttttaacctgccaccgttttccttttagctttacttacagtgtctgaagaagttcgaagtcgctgcagcctaaaacatagaaagtcacttcttcttactgatatttcaatggaaaatgttcctatggatacatatcccattcatcatggtgacccttcctataggtaagtggatttactctcctataattacataatcataatcaagtttcaattttccaactaatggaggcaagcagcagagtaatctagaaggtaacatgggagaaatctagagatggcctaggaagagtaagtgaaactcattttataaatgtgtggtattttatgtgggttagtaggaaagttattcttccagtctgattgtgctaatgttaacattagtttgcctctgaagcacagaccaaatgaacaatgaaaagagatgctcttgaaaatattaggttgcaggggaagggcctggggaaaaaaactaacgcgaaatataaacaacacattacgtgcttggatagagaacgaatctatacagatttgtaaaaatacaggcatgctaacacatttgttgtatttactcatatcacacaagttatttaaaagttttctataatgtagacatagatggtaaaaattatatctgctatacatgggtttgggtagtatatttttcagtataatttagagaaatttcatgaaaatggcatcattgggggatttttctgtattttcaattaaataaaaatatctttaaggtttagggacagtgttgaacacagaaaagttatcttctgttcgcaaaactcgtatcattccatttatcaacatcctgctttttgataaaaagacttcaacaatttccttaagattctaacaatgtacgcaaaaatttttcaaacatggtattcaatagtcttactttcgtcagtcccattattatattactttgagatatgccctttttgttatagaaagggtaaaatagtttgcctgtgttcccctgtcaaagtataaattaatatctgattttcttggtttttaaacaattgcctatttagacttaattttttctgatttaaaaaaaatcagtgcaataagttcaaggtcttttatcaacataactacagttaatgtattttatacttgaaaatagctacgagtagattttaagtattctcaccacaaaagataaatatatgaggtaacacatatgttaatttgcttgatttagccattctacaatgtaaacattttatttatttttatttttctttattaattttttttgagacagagtcttgctctgtcgcccaggctggagtgcagtaacacaatctcggctcactacaacctccgcctcctgggttcaagcgattctcctgcctcatcctcccgagtagctgggattacaggcgcgtgccaccatgcccagctaatttttgtatttttgtagagatggggtttcaccatgttgggcaagctggtcttgaactcctgacctcaggtgatccgcctgcctcggcctcccaaagtgttgggattacaggcgtgagccacagcgcccagccaatgtaaacatattttaaaacatcatgttgtacaccaagcttgctcaacccatggcctgcaggccgcacgcagcccaggatggctttgaatgcagcccaacacaaatttgtaaactttcttaaaacattaagtgattttttggggtttttttttttttttaagctcatcaactgtagttagtgttagtgtattttatatgtggcccagtatattcttctaattccagtgtggcccaggaaagctaagagattggacacccctgttgctatacctttttatttgtcagcttttaaaaattgcagtacagatctttttgttcagcatttggtgagtacctactatgtgcaagatactatggcaagaaagttgataattcctagggatacaccaagagtttgtatcctaaagccctttaaagtgcaattttaaaattaattgattgctgttgttaggaaataggacagccacttggaaggagcaaacgatggttgtatttgtcaccatattaattgatttttctctattgttttcatctttcaggacactaaaggagactcagccatggtcctctcccaaaggttctgaaggataccttgcagccacctatccaactgtcggccagaccagtccccgagccaggaaatccatgagcctggacatggggcaaccttctcaggccaacactaagaagttgcttggttagtttatctaaattatgtagattttttttattatttaaaaaaatagatatttttactcttggaaaattatttgaaatttcaggattatcaaaattttccatgtcagtgtagcaaagtttttgatgccatttaaaagagagtttgatagatcagttaagcattataagttgagatagagaaatgagaatgggaccttgaaacagttttttctgaatcttatactaaatattgtgactctccttattttgttttgcctttgctggccagcagggaatgggactctgagacatattagataaatacctataagaaaggaagagtcttgctgcactcaggggatttaatgatatactgtaatacttcccaaaattatcatctgagagaatatatgaatatggtatgaagctgtaatagtactatttgccgtgctttctttgaaaagacaaaaagacatgcttctcaattaccgaaagaaaataggattcttttttttcttttttcttttcttgatatgaagtcttgttctgttcacccaggctggagtgcagtggcgcaatctcagctcactgcaacctctgcctcccgggctcaagcaattctcctgcctcatcctccctagtagctgggtttacaggcacacgtcaccacatctggctaacttttgtatttttagtagagacagagtttcaccatgttggccaggctagtcttgaactcctgacctcaggtgatacaccctcctcggcctcccaaagtgctgagattacaggcatgagccaccatgcccggccggaagataggattcttgaaattaagattgctcagttacatcaacatttatagaatttttgtctctgagaagtacacctgaaatgctgcgagactcatttccattttagtaactgaaagtaaatgaatgaaaaaacccactaggccaggtgcagtggctcacgcccataatcccagcactttgagggactcaggtgggaggattgctcgagtccaggagttcaagaccagcctgggcaacatgacaaaacccatctctacaaaaaatacaaaacttagctgggcatggtgacgagcacctctagtcccagctacttgggaagatcacttgagcccaggaggtgggggtagcagtaagccaagattgcaccactgcactccagcctgggtgacagagtgggaccccgactccaaacaaacaaacaaacaaaaacactgatcttacatcgctcctcagaggaaatgcagagatgttcttgcattccattgggtaaaattgtaattgttactggaatacattaggatctgtatttcagtagccagcactgaatggttcaacagatttcagttatccatgcaaacatatttaagtatctttaggtattggaaaaatgtttgtgttcataaggaaattagtgaacaaacaacaaattgtaacataaataacgtgccagtaaaccgtgaaagaaatagaaaccatgaatgtgtcaatcacagttactagccacataggtgtgttactgttgtttgagttcccttctgttagtaccttgccataaataatcatttaggagtttcctggttactttgtgttttgtaattctggattttcatgccaatgaagttgtaaatgaaaaactaacctcagaaaaaaatatattgaattcattcaacccatgtactaagtgaaaaagataaggtaactgccctggaagactttgtaatttgtgtccaagacttataatcagccaatcacaacagcaactccaggtgccattaaaatgatatgtcttgatggagaaagctggagatctggggaaattagaagaaaaaaaactgcagagaggagataacatttgggctgtgtcataaagatttaatatatgcttgcaaaatagcaggataagtaggggcatatgtttaagagcagtggggaatagcaagaataaagaaaaggcaggaaagcaactgatgatacatcatggcatcatggggaatggggtaggaaatgagatgagaagaaggactagaactcgattggaaacgactgtatgccatggtaagatatttacccttatcacacattcagctgaggtatttaagtaggagaagaacatgaccaaattttaatttttgccaagtttttctagcagcaatgtggagagacaggaagagatttttagcaagggaaccatttaataaaattgatatagcagtccaagcaaaaaaaatggtgtgggccccgcactaatgcaggagcaatgggagaatggagaagaaccagcaggtttggagctgggcataatggtacacacctctagtcccaggaactcaggaggccaaggcaggaggattgtttgaggctgacctgggcagcatagtcagaccctgtctcaaaaaaaacaaaaatcaggtttggaataggtttctgaagtacaatggacatgacttagtgaccaattgttgcaggtggggaaggggagaagactgtgaaggatgtcagaagcttttagttttaaaaactgtctagatagtgataccattcatagagatcaggactaatacgttcacagtacatgataaatttaggttgattacatttgatatattttcaagacatctatgagtatatatctaagagataaaccacaagatgtacctggaattcgggaagaaagtaaacaagtaaacatttagaattgattagctcacagatagttgaagctatggaagcagaatgagatcttccaggaagaatgcagagaataaaataaaaaggacaagtgagaaaggaaggaaaactaaatgtagaaagtagtgtcccaatctcatgtactttggaaagcactgactggttttagaaaacctgagttttccatctggtcattgtctagatccctagccatgctacctcagactaattacttaactgctcatggcttcatcagtgtacatgtgcatgaaacgaagaagccggactagatccctttggactgttaaattatttggccttggtatttatgactattatgaatagttattcatattcttgaggtaatagactttgtatttctcaagtgttaaattgtcagattttattatattggctttaattctggctttaataaaataatactgttggccgggcatggtggctcatgcctgtaatcccagcactctggggagaccaaggcaggtggattgcttgagcccaggagttcgagaccagcctgggcaacatggagaaaccctgtctctactaaaaatagaaaaatcagctgggtgtggtagtgtgtgcctgtagtcccagctactggggaggctgatgtgggaggatcacctgagcccaggatgtggaggttgcagtgagctgaaatcatatcactgcactccagcctgggccacagagcgagaccctatcaaaagaaaaaaatagtgttaatacatgattacatgattagagaaactaaaagccaaatgggagataatgctacttgctatttttgaagcatctcccagtgtatctggtttttagtattttcaggcatgcatatctttttttcaaagcttaaaaaattaaaatcaaactctgctttcttcctaagcttggaaattactcatgtattaatgagtagttcttggcaccagcagcgtttcttaaactgaaaagactggtcagacatagttgacctttgctactgaataatgcctaccattgcatttattatcagttatcatatttgttgatttacctccagtgtagtttggtttacctccagtgtacagaatacaatctcagtttaatttgcaccagtaaggtgcaacctatcctgaaacagaaagctatgggaacaaaaccctttgagaagatggaaaataaaggaaagaaactgctccagggatgtattagagctttctttgagtcctcagtgaaagcttaaacactttatgtccaaacattttctttttagtgtattcccatttatagacactgtagttaatgaacttgcatattcttaacttttgtttataggaacaaggaaaagttttgatcacttgatatcagacacaaaggctcctaaaaggcaagaaatggaatcagggatcacaacaccccccaaaatgaggagagtagcagaaactgattatgaaatgggtgagaaacaaagtattgatctagatcattgaaaataaggtgggagagtacatgaaagtcatgtttattttccagccatttcttagaatctttagagtgaaatatagaaacgtttgccatttctcaaaagataaactctaccattcaagacagttatcttgaagcttgtgtaaaaattaatcatatatattatatacagcattgtaaataggtagccaaaacttttgtgtaggcgaatagtaattctctatgatgtttatgttagtattttaagtatctactaaagaaagctgttgaattttagaagtaacattgaaatagttaggtgaagtgattatccaggtgtttgatcacgttaattccctatcttgctgcagaaactcagaggatttcctcatcacaacagcacccacatttacgtaaagtttcagtgtctgaatcaaatgttctcttggatgaagaagtacttactgatccgaagatccaggcgctgcttcttactgttctagtaaggatttcccctttttgagtcccccaccctcaaatttttattccagtctacttttaggaggcccttaaatattaaaaacatgaataggatacagtcttctacttctcacccaaacagataacaattcagccacaaagtaaaaatgttgtgtgtttacttttttgcatcttggcaggctacactggtaaaatataccacagatgagtttgatcaacgaattctttatgaatacttagcagaggccagtgttgtgtttcccaaagtctttcctgttgtgtaagtatctccttttgattttaattcaccttcgtgcctgtctttaagttaaatgcttacccagtaatgtgcactggttgcaaagagggcaaaatgagatattgtgatagtgattttagctttgagacagtaggtttaatgagggttaagattagttttgacctactagatctattagaaagtttataaggaaagacttttaaaaaatctggttgatttatttaagtggtttattttgatgatcattgctcattttcctcacttagaagcaaactattagactgctatatctaaatcagcatatctgttttggtttactttttagtagagcttttgtatttatccacagctgagtgaaaacaaaattgaccttctgtttaggaggtgaattgtttactctctcttaaggactaaaaaatattaacctcaaagtgttcaaatttaaatagttcaaataaattcttttcctgatctaggccttctatatcatgtcattattttctttttttaatctcatgttagaattttagagagttagaactcagttatttttattaatggagtgtagccgggttagaaataatttttttcctaagtttcagttggatcatgtatttcactccctctaaactattttgctttccctatttgatctgactcagcattttaaaagcactgattaacattaaatttaatttttttctttttgttttgcacagatcctaaatttagttttaacttcctaagcgcatgtcagtatacaacagatggaaatagtactaaaacatgctaagtagcagacagagccaaccttgtcttaagcaaacatttaccgtatatggttacacatggttatatgacactaccagttgtttgttttcacaatttcttccctggtgactaaaaacaaaagacaaacaaaaacagacacacacacatgttcattgtagaaaatttggaaaatgaagaaatgccccagaaagtaaaaagcactcatctccctttaattttggcacattattctggggaatgtatattatgttttccactacatattttcatttaattttcctctaaaatgttcctctgttgactttttttttcttttaggcataatttgttggactctaagatcaacaccctgttatcattgtgccaagatccaaatttgttaaatccaatccatggaattgtgcagagtgtggtgtaccatgaagaatccccaccacaataccaaacatcttacctgcaaagtaaataaatgtatctggagaaggatggttgatgaacttgctaacatgcgcgctgttgtagaatgcactgactacagaattctttataagggatagacttgttcatacttttatttccatattccatttttttactctctcaactgtatgtccaatgtaactggttgacaactttttatgctgagtatattttaagtaggttttagttgctttgacactcattctaaaaacatgttttcaacatgtacatagggtttatatatcatcagctatatgacttatttaatttctgttacaattaaaagataccttgcttgttataagagtaaaatttgatttgttgcaggttttggttttaatggcttgtggcggtttgcaggaccgttttcaaaggtaagaaaatatatttttctctaacttttggcaaaatgaaggtttctgttcaaattagtatgcctgctttaagaacacacaatgtgctgaaaaccagaaaaataattcacaataaacacatatgttacttttataaaaagtttctcatcacaaggtttttttccaggaggcagcatggtgttggggtgtgtgtattcacttttacaaacaaagtcaacttatgatcaatttttcagaagagtatgataaacctctgtgatacttttctgccacagtcccttgtgtatttgataatcttaatgcacacagttagatatcttatgactagcaaggagcattaccatggttaaaatctatttcatgaaaacatttttatttccagcctattagattagattaatttctctctggatttgtcctcatttgctcttattcagtttttttgtttgtttgtttgttttgtgagacggagtctcactctgtctccaggctggagtgcagtggcgcaatcttggctcactgcaacctctgcctcccaggttcaagcgattctcctgcctcagtctcccgagtagctgagactacaggcatgcagcaccacgcccagctaatttttgtatttttagtagaaacagggtttcaccatgttggccaggatggtcttgatctcttgacctcgtgatctgcccacctcggcctcccaaagtgctgggattacaggcatgagccaccgcacctggcctcagtttgttttttgattggcattagtttatgtagtgctacataagatgtatatgatcattttctctgtatgtgggctctctccaaattgatcaaagttccttgaagacagggtttctgtttcttccttaaacagttcctggtgcagtgttttagatacagggggtgctaaatcaatatgaattgtataaaccttgttccagtttttaagaattgggtattttatttatttcctttcactattacttgaatatctgtcaacatgcaaaggttgtcacttaaaaaatgggcctgaagttacagaaataagtatatcatacagaagtttttgcatttggattgccagtaaccctctgagccctttacagtgtctagtgagtggaatctaaatggcagctggaatgatgatgctctgctcattttctctgttttggaaaattggctagacatcattcctggtgattgtattgtctcagtattacattcagtctgtcttgtgcatggctttcagaaaatgcaggttcatctggaagctttaagctgaatagaactccctgttgtaagtcctatggtagtctataaatattactccactccccttttttaatgataagtaatacaaaggaagaaaaatagtaaattaagtccaaacaaaattaatatttttggcttcagatggggatttacttaaaaaaaaggaactaaaataatttcctattttccattacagcaaacacaaattccagactatgctgagcttattgttaagtttcttgatgccttgattgacacgtacctgcctggaattgatgaagaaaccagtgaagaatccctcctgactcccacatctccttaccctcctgcactgcagagccagcttagtatcactgccaaccttaacctttctaattccatgacctcacttgcaacttcccagcattccccaggtcagtaaatgtgatctttatatgactttgagcaacaatataagacaccaacattaggaattcccttgtgatcagtttatagcaaattttgctcctttttcttatgagattcaccttacatttcttctttaccttgtaactgacttgacttttgttattctatgaagctttctactttcaaacaagttgtacataagacagtaaaatgttaaaatgtccacatgatattccaaggttgacaagtttgtagagtttgggcaggaagaggaacttaaaacacattattctgtaagtgaacagaactataatttatttactagatatactaacattgccctaagggcctctttctctgtctctgatacagcatactatatcaaaaaaaaaaaaaaaaaaaaaaaaaaagaagaagaagaagaaacacaaaatctattaggtacctcactttcctgctgccagcaataactcaaccatccatagaccatcctgaaaatctggaagtaaataaataatcaaacaaaaaattcatctcaagaaaataacatcttaaagcccataagcatatatataccaattcgtaatgcaacttagatttgaatacactgagaaatactaatagctaatagctccagtgggactgagataaacaaggtgggagaaatggcaaacctacagaactctggacttattcagtgtcatagtgaatggtttcatacaactctggttgaccctggaggtgctattcattatagaacttaaactattgtgtgtgttattatgacagtgagtaatgaaggaaagcttttgttatggttgtgttttctatttagaaagatattcttctaaaatggttaaaaataaaagaaactttagttgtttaacgttccattatctgaaaagttcacttatgaaacacatcattgtataaggaaaagttactatatatagttcttttaagtgttagcataaatttaaaaaaaatccaatgacataactattctgtgatattcaagatcaataaatagaattcccagtttatgatctcagttttgcatgaacatttcaacttatgtaattttgaaggttctgaagaatttggcaatacccaattcatattataaactattatgtaattaactatattctattaaattctgcttaacaacaaagctttggtcagcagaggaaacaaattttatttccacatttgtcagtcgccttacaagtaatccttttttcccccagaagtaagagaagtctaactttttttcccatgtaacaaggtttgtttgccctctgccactaactctctagtacagtgtttctccacgtgtgatcccagaccagcagcatcatttgggagcttgttagaaatgcagatgctgtagtttcacctcagatctgcacaaaaaactcccaagtagagcccagccagcagtcagtgtgttaataaataccccaggcgattcttacacacactagaattggagaagcactgccctggggtctgcttctggtcttgcccattatcagcatttcagctgtgaaggccagggcaaaacttaaaatttactttttttacagatactgcagccactgaattccttcctgcttccccgctgataaaccttttagcattttggagctagggaaccatacaggtaatttagttttaggctcacaatattgtgtacattggggagactgagttttagaagagctgggttaactgctttatacagttcttatctagaaccaaggccaggcccttttgtactacattcattgccttccatggctgttgtctgtttgattatctatctactttcccttctccttctttatttccttgtttttgtttgtttattgctaattcattacttctgtctgccttgccttaagcccaccagttcttttttttctgttggactattttctgggttactgaacagaagttgaaaagtttttaaaagtctgcttcatcttaaccaagcttttgccttttgggctactaaactggtgttaaacatgtcaaaaatggttagtttttttattgactttttttacccagtctaattgtagggaaatttctgcctatctttgcccactaatggagacaataaaataatctggatgagaataaagaaccattacaggtttctctgctatttgattagttgcatatgtccagtgttgattggctatttgccaaatcatttgctttggtgaaacagtcttactctacaaccttttacttaaaattgtttattaaaatcagaataggttttatggctttggttccagtttcaaactaatggtgtcacctccattagctctccaaagttggtgcctttattcaggctggaaatctctgactatacacagaagagatgaggaggtttaaaagtaatagagttaagtggtattgtggtgttcaactcttcctgtcactcaattgtgtgtcattggtttgacagtttattttactacatgttttcagagaaagggtttatcttttcaaaagtaaccttactctcccacaaaacccatttgtatctctaaattacaggctcatgttcacaaaaggatcccaatttatatgcccaatcactgagtttttgtcatttgctcttacagaataactcttaatggtaagagttgatcttttgtttataattaggtatattgcttcatatctttagctccatgtaatcttatatccttatctctctctttttttttttttttttttgagacagagtctcgctctgtcgccgaggctggagtcagtggtgcgatctcgactcactgcaacctctgcctcccaggttcatgccattcttctgcctcagcctcccgagtagctgggactacaggcgcccaccaccacacctggctaattttttgtatttttagtagagatggggttttatggtgttagccaggatgatctcgatctcctgacctcgtgatccacccacttcagcctcccaaagtgctgggattacaggcgtgagccactgcgcccagcattttttttttttttccccctttggagacagtgtctcgctcagtagcccaggctggagtgcagtggcgcagtcttggctcactgcaacctctgcctccttggttcaagctattcccctgcctcagcctccctagtagctggaattacaagtgcacaccaccacgcctggctaattattgtatttttagtagaaacccggtttccccatgttgaccaggctggtctcgaactcctgaccttaggtgatccacccatctcagcctcccaaagtgctgggattacaggcttgagccacggcgctcagccatctcatttctttatggcgttgagtttgcttatatcaaaaaaccaaaagaaagttgtccagattcctaactcagtctggcgtttcaactttgctgtttagctgtatagaaaccaaaacatttccttatctccattcccagcagccaagtctcaagcagtagtattgaaagaagttctctgtcattccccgatatggagcataagtttgatttaccatcaaattacccaacatcaacctatacttagtcaactgagatttaaacagataaaggttccattgccctatttcaaaaagcaaatgttgctgatctgcacgcattcaatcctttgctataaatgtttcatgtcaatgcaaaactcttcattctagatctttgatgtttagcaggatcagctactgagctgtattttcttttgtccaacattttctactagcaaatcaacaaaataagagattcatgaacctctcctcctccccctcctgccccagcattaggtcttacttaaattaaacatttgggcagtatttcgttagttaccagctttgaggagaagtggtagtcacttacataaagcaattgtctctgaaaatgcattcttcttgacaaattagcatagcctaattctccatcctaagggggactgttttacaagtctacatataaaagtacctaaatggttgtcttctgaatccctccctagtagaaattgaatttggcatcagtggagccagtgactgtacctgggattcagtgcatatagaattgcattgactgtgaccctttaggcaaatggatgtaagactttggctcttaggattttcccaaacaccaataagagcatcttgaagagaatccatttactttatgatatataaggatatttcaggtttgatattatgatccttattaggtccagtctagctgagctggacatgaattgaagaaccagaattagaactagaaaatgaaacccaggctgagtgcggtggctcacgcctgtaatcctaacacttttgggaggccgaggcaggtggattgcttgagaccagcctgggcaacatgacgaaatcccatctctacaaaaatagaaaaattagccaggcgtagtggcatgcatttgtagtcccagctacttgggaggctggggtgggagaatcacctgagccggagaggtcaaggctgtggtgagctgtgatcatgccactgcactccagtcagggattgagaacctatctcaaaaaaaaaaaaaaaaaaagaaggaaagaaagaaaatgaattaataggatccatttccaaagcattaaaatttaatatatactttatcagggtcttctgatattcttcagaggagaattgttgtaagttaattcaataaacatttgaatacctgttttgtaggtgtatgttaagtatgtattagaatccttgatcaccagagacttgacggtttttgccttgaaagttatttccttccgatccatgttgtttaacaaattctaagtgtgcactattttttttattttaaatacaagattaatactatagtgcactgtagaaaataccaaaattccagatatttatcctacatatatgtattgtttactatatgcaaggggctcttagaccccaggggagcagaggggctgccagggcatgatacctgccttcaatatatttcagatcagaacgggcagtagaatgtacatagataactattttgacctctattgtgatacctgtcatgttgtaccttgtactatatagtattctgatagttcaaagggacatttgtgtggaaggatcatgtaataattatggcaaaagttttataacacatttttcacctcaaaaatgtttttaaacaaaacaagtaaattcgtgatctatttaatttttttttttttttttttgagatggagtcttgctctgtcacccaggctggagtgcagtggcacgatctcagctcactgcaacctccgcctcccaggttcaagcaattctcctgcttcaccctgctgagtagctggcactacaggcacccactaccatgcctggctaatttttgtatttttagtggagacagggtttcaccatattggccatgctggtctcgaactcctgaccttgtgatcctcccacctccacctcccaaagtgctgggaattacaggcatgagccaccgcacctggcctaaaatttttttttactaggaaaaaggctttaacttttttttgtttgatcagctcattttactgttagtattggtgcgtgaattttttagaacaaagacatacttagttcatcgttactttagactcccttcttccatttttatttctggccttggtccaagcctaccagtcattctctcactttgcttctgtaatgtagaccttcttcctgagaagctggctagatcaggtagtgatcataacattcctaaaccaatagtgctgatagctctgtgtacggagggatatttcatctaaaccattgctctaaacttagacttggctctgagtcagtaatacttctgtttactaggtttgaaatatctccctcttagctgggcacagtggcacatgcttgtggtcccagctactagggaggctgaggtgggaggattgcttgagcccaagagttcaagtctggcctgggcaacatcatgagaccctcgtcttttaaaagaaggaaaagaaatatctcccttttagaagaaacctagaagtctctattttgaggccacttaagatctctgaaatgattttaatgttttagagaattgtttatggtattacctgacctttttttcttgatttgttttctttttctttgttattatcctatgtttaagggagaaaaataattttaaattgagcgatttcttggtataattcttgctaatttttaaatctaatttttagcttaattcttaatttaaactaaaattcttaattttaatataagtggtaaaaaaatacatctacaaagttgtaagttctctcatttatttaccaactgtaatatttaggaaattaatggtcagaattcaataattaaaaccagattccttctgaaaaccaaggaacattataattatctagtatctaattgtatttcacccttttttaaatcttatgaacatcacttacttgcttttttttcttccattctttgtaaagcttctctgccttgctctaaatcagcagttttcatgcagctgttccctcatcaaggtactctttattttcatcatctttgcacgaaaatactgcttaccccacactcatcctgggcacatagcatgagactttactcaccggtccctgtaagctcagtctgccttaggcactttaggaacttgtaaagccaccactttataaggtcttggtacttaacaggaattgcacggccagtgtgtggcctgtcttgtttaaggagctgctaatacccacccagaacaatgaagatgcaatcccatacctggactaacaaaggcaggttaataagaaactcaagagagagttaatagagaaagagcagaatacgtggtttgatgaagtttttttagcttagaaaataacttgttttccccaaatagaaagccaaccccagtgtttcctcagaaattaaagctggctgtctattcaatcacctgtggttaaaaaaaggaatatggccaggtgcgatggctcacgcctataatcacagcactttgggaggccaaggtgggcggatcacttgagtccaggagttgaaaaccagcctgggtaacgtggcaaaaccctctttctacaaaaaatacaaaaagctattcacaggactgaggtggggaggttgaggctttggtgagctgagatcgcaccaccgcactccagcctgagtgacagagcaatactctgtctcacaaaaaaattaaaaaaaaaaaatatatggtcattagttagctataaggactaagatgaaaaaatttgacacatttatgtctaatttataaaagatgccttttcttttattcacctgtaattaatatacaaaaagattacacctaaacagaaaaagaagtgctagcagttggtgaacgtcatttttaaaaattcttttttctttttgagacggagtctctctctgttgcccaggctggagtacagtggtgtgatctcagcttactgcaacctccgcctccccagttcaagcgattctcctgcctcagcctcctgagtagctggaattacaggcatgttccaccaagcctggctaattttttttgtattttcagtagagacgaggtttcaccattttggccaggctggtctcgaactcctgacctcaaagatctgcctgccttggcctcccaaaatgttaggattacaggcatgagccacaataccaagccaaaaattcttatagttacaattttttatatttagctcaaaataaaaatatttctaagtatatatttaatacgcctccatgaatgtatttactgtagcttaaaaataggctgtagctacctaagaagatttattctattttgtgcttatttatattagcttcactcattttacaaattctagcataaaattaaagtcctagtatttgttctaaaactcctttgtatcacctggtcttttacttcagatattaggagcatcttaatttgtggagtaattattttatctgtgtgcaaaaattcttcacatagattattttgtctaacaaccctttgaaatagacaagtctgctgttatccttaattgccagattaagaattacaactaaataagaatattgatccaaacaagtctcaaacctaggtcttctgacatgtttaagttctcctgtatgtaataagagttttctaataagtttgccatattgtatatgaaataaactaaatgcagagtaaggtaacctactagtgctcctgcacaggtggcaggagatttcagtttttattagtctgtcatttttgtagtataacttctcacaaattacctaacccatttttccttagcttttcaagagttaaaagcgattctgttgttttattatttcatgatactattataactgattatttcagtttgggaaaccaaaagtgttttttaaaaatgagtgactaaaaaattgtcaggctggagctacatcactagttgtaaaaatacacaaaccttgatacctgccttcaaggaactcatgttctagcagggaagatagacatctaacttaaataacaataatgtaatctaatccttttccccagctactcaaattcactgaattttggccaataacaccttctagttaggattttgtctttatctggaaccaccacaatttattgaaacatagtactgctgatatactgctgtacagaatgtccagctgtttctgctctgcatgtttgtaattggctgcatgtttgaccacagcatatctgtggggtcatttaagctggcaaatcaggaccacagaagttttagctttatttcctttgtgtggtagcctctgggtttctgtcagtcactttgtagttttgtctgtttgttgtccaccaaaggccagaaaggagagccaatgctttaggggcaaaagagataccagaatacaaaactttaaaggggttttgatgaaaagaagtgcagcaccaaggccttctcactaacttaaaatatggcatatagcaatacaggatgtgttctgtctgcattggagtggtctatcagataatctgagagtttttcctatgggatattgaggtgaaatccttcaccagttcctagagagatttctagatttaattttagaggataaaaagaaagaatgctgccaaaattcttagaagtgagaattatgctgagaaacttaaatgccagaactagatactatgatcattctgtttcatactaccttggctttttcaagatatattttggtgtaaacgtaatgcattttaattgtttttttttaatgactttccaagatttttgttagtttctcctttgatccttacagtaaaacatctttgctgtgaagttgaacttaggaatcacagtcacaccacatttacctatgtgtgatttatacagttgggtcactaagtaggaagaaaacatacattccaaaaacaagaatttagatgaaaaatgaatttgagaaaagaagtagaatatcaacttttgacatagtgttgaagcttttggttatgagggatggggctgacaagtcactcgtacttttacatttttaattaatgtgctcattaggaaaaaaattggaaaattcagaaaaataaaaggaaaaagttacccacaatcctatcattctaagatagataaccactgtttattaacattttggtgcatttccttccagtttcttttttttatatacttgaggtcatagtatgtgaacaactttatagcttgttttgtaccctcaacatttaacaggagataaataaggcctttaaaattatttgaggtttgacggttatttgcttcacaaaacagaaagtggaatgttcttagcacttttttgaagataccttcaccctagtgacttcatctacattactacaatttatgtaattgtaattctcaggaataacactgtgcccaaacagaagcattgccacccatgtcatgactgttttcccctcagagtaggccatggtctagtagtagcaagacacacaagaacgagccccagggtagcagattgctggcagagagtcacagggccttcctagtggtcatccatgcttcatgcccctcctgcatgcgggccagctccaagttgtttcaaacctttgtctttttaaggtcctagttttgcctgaatcttattttctattaaagaaacaactcagaattactggacttgaaacttgtaggccaaatgcaaatttgaggaaatggaaggtcaaatacgctgacaaattcataattttaagtggaggatgccaaagggaaaaaaaaaagttctatcttttcaactaaaaatattataccactctctggagatcagggattgcatgctttggggctctgaattacaggtatctagctatcacattttaaaatggaagtgttcagttcattcagtattaattgaaaataatttttcaatgtattgaaaaaataactagattttacaggaaaacaaaaatgaataataatgatctttacccttctcagtgcctttactcagtagaggaagatggatgtacaagttgtagaatcataggcaagttaatttaaaagcaaggaaggagaaagtagttctggcaagagacagaataatgcatcatgaaggaaaaggatatgagaaaaaaaaatatgggttgaattttatcttgtagagatacgcaagacaattaaaagagcctacacaaacatacatcccaaagaagctcaaggcacattccagagatcatgagcagctttctttcagttttgttatttcttttgtaaatagctctggagaggatgcaaataaatatacagaagagaatttaaatagaccagaattctgttacccagagaaaagttccatgaatgtttctagtcatctttctatgcatatgattagattagattagattagaacatgactagccttaaaaaatttaataagggttttaaaaaagatttgaatagaacagattttcagtggtggttcagctatgctcacctcctggagaaatgtcgctgatgtttttccttgcactcatatgcctgatgcagtgcacatgttcataaacagtcactgacaaatgcccatgttcctttgacagcagttcagattttcaagacagcaaatctctgttgagcacgtgtaaaccaggccacgtgcttacagatgcctgatactcttgagtcgaattcagagctgaatccaaatgaaagatgagtggctcctagagggaggtcatcccaagttcatttcctgttcatgagccaacaaataactaactgggtagatctatgtacattttctgtaacataatgaatacttcttgacttgaaatattactttttgtccaaaaatggaaatttttctattctaagatttaaaatttcaatatataaagaagaataaagtacaaattagctgaaatcttgccatacagaggtaaaatatattttttagtcctttggcttctgacagagataaaatattttggcagatgtttacccagccctacgccctctccccacagtgtgtgggtgtttttttcctactccaaaaattgtggtcatctttttgtatcagtaaatatcaatcagtaatgtacattttgatacaaattactaaaacgttctgcagctgtttgctttcccgccaaaatttatgccagcagtaagtataatcagtctaattttgggggtaaattttattgatgtttaacagaaaagttcacaaattgcaagttttcagcttagtgaacttttaaaatgtaaacacacttgaaaatccatcatctacatcaagaaacagaacattaccagcatcccaagaagccatcctcatgcccccttaagtcactacttccgcaagggtgaccacagtcctgttacccaatttgtaatctttcctaatgtgatagataaaaataaaaatcttattttagtttctggttacttttctgaagttactgcttagattatttataatattaattggggtggggtgcagtggctcatgcttgtaatcccagaactttgagaggccaagatggaaggattgcttgagaccaggagttcaagaccagccttggcaacatagtgagactctatctctagacagaattttaaaattagctgggcatggtggcatgcacctgtagtcctagctgtttgggaggctgaggcgagaggatagcttgagcctggaagttcaaggttatagtgagctatgatcacaccactgcactgcagcctgtgcaacagggcaagaccctgtctctaaataaataatcaatcattgttaggcccaggttttggaggtttaatctcctcctcaagagaaataaatggcatctgtttaaggttgcagaatgtgaaatgacttggcatagctgaaaagaagcaaagattctacagtatgacctttgtgatatattattttctcagtaaatagtttctttgggataggcactgtgattaaaaaaataaaagcatcttgagttttctttgaagtgacaaatttgctggaaagatcagtactttctgctgctggagagtatattctgtttataaacatgaatgaggatgtgaataaggctagaagatgacctctgctggaagtttctggtatgatttggaggaaggagcactagtcttccctggtggctgctagcctttcatttagttcaagcctgccagcctctagcttttccttgcaacttgtcttttcatttttcttgtgctattttctgctatgatagcaaactttgcataacaaaatgtgaagttttccatgtgacattaacttagtaaacattttagcaattgactattaaaatgaaatgtgcataaacaatttgccaggttgtatcttatcacaaatatagtcatgtgctgcataacaacattgcagtcaacaacagaacacatatagacagtggtcccgaaagattataatactgtatttttactgtaccttttctgtgttagatatacaaatagttagcattgtgttacaactacataaagtacacaatatggtaacctgctgtacaggtttgttgcctgggagaaacaggctataccatatagccttggtgtgtagtaggctatgctatctaagttcatgtaagtacactccacaatatttgcacagacaaaatcgcctaatgattgtttcctagaatgtgtccccgttgttaagcgacacatgactgcaatgaaattcagtcctggaaggaaaagaagaagtaactggctgttctctttttctccaggaatcgacaaggagaacgttgaactctcccctaccactggccactgtaacagtggacgaactcgccacggatccgcaagccaagtgcagaagcaaagaagcgctggcagtttcaaacgtaatagcattaagaagatcgtgtgaagcttgcttgctttcttttttaaaatcaacttaacatgggctcttcactagtgaccccttccctgtccttgccctttccccccatgttgtaatgctgcacttcctgttttataatgaacccatccggtttgccatgttgccagatgatcaactcttcgaagccttgcctaaatttaatgctgccttttctttaactttttttcttctacttttggcgtgtatctggtatatgtaagtgttcagaacaactgcaaagaaagtgggaggtcaggaaacttttaactgagaaatctcaattgtaagagaggatgaattcttgaatactgctactactggccagtgatgaaagccatttgcacagagctctgccttctgtggttttcccttcttcatcctacagagtaaagtgttagtcctatttatacatttttcaagatacaagtttatgagagaaatagtattataaccccagtatgtttaatcttttagctgtggactttttttttaaccgtacaaaactgaaagaaccatagaggtcaagcctcagtgacttgacaccataaagccacagacaaggtacttgggggggagggcagggaaatttcatattttatagtggattcttaagaaatactaacacttgagtattagcaataattacaggaaaataagtgcgaccacatatatcttaacattactgaattaaaactatggcttctaagtccttatccaaactcagtcatccaaactagtttatttttttctccagttgattatcttttaatttttaattttgctaaaggtggtttttttgtgttttgttttttgtaaaccaaaactatactaagtatagtaattatatatatatatatattttttcccctccccctcttctttcctaactaattctgagcagggtaatcagtgaacaaagtgttgaaaattgttcccagaaggtaattttcatagatgtttgcattagctccatagcaaaatggaatggtacgtgacatttagggtagctgatatttttattttgttaaataatttccaagaatagagtatggtgtatattataaatttctttgataagatgtattttgaatgtcttttaatcttcctcctcctctccaaaaaaatcagaaacctctttaagaaaacatgtaggttatatatgctagaattgcatttaatcactgtgaaaagactggtcagcctgcattagtatgacagtaggggggctgttagaattgctgctatactggtggtatggattatcatggcattggaattttcatagtaatgcagatccaatttctttgtggtacctgcagtttacaaaataatttgacttcagtgagcatattggtatctggatgttccaatttagaactaaaccatatttattacaaaaagatattaatccctctactcccaggttccctttatatgttaagatataatggctttgaggggggaaaaaataaacctaggggagaggggagtttcctgtagtgctgtttcattagaggatttcagtaaattaaattccacagctaattcaataaataatggtacatttaagtgttctgattttaataatatatttcacatttatccacacagtaacaatgtaatatgttaatgtaaataaaattggttttgatactcagaaataacaagaatttaattttttaaatttgtttacagtcctgggaaaagtaagaattatttgccaaaataagaggaaagaaaaccttagtattattaatgagtttaccatagaattgttggaaatactgaagacaggtgcaatttactaaacttttgtttttaaactattgtagaggctgcattagaagaaaatgtttataatgacagagcaactatgactatataaaaaagctgaaattagaactgtgtttagaaatagatcagtaacccagtgccaaggatgccaagctgccaccatggtcttggctctcccacaacccagtgtttctggggtaagtttcacagtttctaggccctggaatagcaggcagtgtaagcctttgataactttagttcgatgtttttcttgtttttgtttgttggtttggtgcatatgatagtgggtgttatgctattttgctcttcccatcaaaataaagaaacttccagaggtttactgttaaaaatactgatatttccataaacgggtttaccaagggtgtagtatttcataccgcctgaaatgatcagcattggcacaaatcaaaattcagccgcctttgaaatgcaaaaatacctttgactagtaagtacatcctaggagtttgaaaacttaactaaggtttaaaatttaccttgtttaaagaacttctgacttttgaggaaaatctagctttccaagtaactaaaatgtacatgagataaacctctcaccactatgtgtcccttgagaaatgcaacacttttttagtcttcatacttgtaatctataaaagaaattctgaagtttagaccaagttgcccatttctgcgtaattgacataagttctgttaaaaatattataagtaattcgtttcggtttgtagatgtttcccctgacttgttaaagaggaaaccaggaactcagtcatgtttttgtcctggataatctacctgttatgccagtactcccatccgaggggcatgcccttagttgcccagatggagatgcagttcagtagatttggggcaaagtggctacagctctgtcttccattcactcaacacctgttcatgactgagccaggtgcccaggacacatcctaaacagtcagcttctatcctgtgtcctagttggggagacagagtgccagccagcaaccctcccaggtttgtaggttttaggggttttcagttttgtttgggttttttgttttttgtttttgtttctacatccttccccgactcccaggcataatgaggcatgtcttactcaatgttatgcaatggatttaggcaaaaattcattcttagtgtcagccacacaattttttttaatgcagtatattcacctgtaaatagtttgtgtaaaatttgacaaaaaaagtatatttactatactgtaaatatatgtgatgatatattgtattattttgcttttttgtaaagcagttagttgctgcacatggataacaacaaaaatttgattattctcgtgttagtattgttaacttctttttgcgactgcgttacatcatttaaagaaaatgctgtgtattgtaaacttaaattgtatatgataacttactgtcctttccatccgggcctaaactttggcagttcctttgtctacaaccttgttaatactgtaaacagttgtacgccagcaggaaaaatactgcccaacagacaaaatcgatcattgtaggggaaaatcatagaaatccatttcagatctttattgttcctcaccccattttcctccttgtgtatgtacttcccccacccccctttttttaagtaaaatgtaaattcaatctgctctaaga

SEQ ID NO: 154 - DNA, 282752 bp, Homo sapiens; identical to SEQ ID NO: 153

SEQ ID NO: 155 - DNA, 127839 bp, Homo sapiens
caatctctagctcgctcgcgctccctctccccgggccgtggaaaggatcccacttccggtggggtgtcatggcggcgtctcggactgtgatggctgtggggagacggcgctagtggggagagcgaccaagaggccccctcccctccccgggtccccttcccctatccccctccccccagcctccttgccaacgccccctttccctctccccctcccgctcggcgctgaccccccatccccacccccgtgggaacactgggagcctgcactccacagaccctctccttgcctcttccctcacctcagcctccgctccccgccctcttcccggcccagggcgccggcccacccttccctccgccgccccccggccgcggggaggacatggccgcgcacaggccggtggaatgggtccaggccgtggtcagccgcttcgacgagcaggtaaccggcccgtggcgggcgggaggtgggagcggagtgggggtggggacagagtaggtgaggggaggtaggagcggccgcctcccccgcggctgcctcaggctctggaggaaaggaagggaagggaagagaagggaaggggggataagtgggggtggccaaggcgggaggtgaggggtaggaggggacagctgggagcttgggcaccctttccctcctaagtcggggggtggggccttgtccctgaccagcctccgaccctccatcccctttatcccagcccttccgcttggaaatggggatgagtgacctgggggcgcctttaggggcgcgccatctggatttaataattacccccttacttttgtttttgagcagaggtgggtaacgtttaggggttctctcttcctcttccctccgtgaccctcctaactggggacgagcgaaccctaaggcctgtcttatataccctcaataggagaacgataacattccgcccctcccccagtttcttcagcttcctctcctggagggggaagagcagaagaaagcaaggaaggcacaggttttcttactttctgctccatcgtctcatcctgccccgagagcttcaagtgcacactcactgcacatctttgtgatgccctacaacgtcgtcccccatatcctgatgacacagactgccttttttttttattgccgtttgcagtggaaaccgtggttctgaaatatcttccccttccttgataattgcagtctcttccccccccccttttttttttgccagcggtctgaggatgtgatgcattctcgagtgagaatgttggggagtaaaggggagaagggtgaaaggaaagtgagaaactgcttcagagccaccgacaacagagcaaagccagctgggatgtggtcctggagcggatcattctgctagtgtttgtggttgtttttgactctctcctggttgacaagagaactttcattgagaatatttgggatgaaaaaaaagttttgtagcttgaggaggtgactttttatcgcctgagtttcacacaataaatcctggggctgattagaataaatgcacacatagccttttgtcagtggaaattggtttaactttgtgttgctgtaggtagttggggatggtttaagggatgctttctgcagctgtgggtgcagtgggcttcctgtgatgggggaattgtttaagattgagtcaacctattttgtttactggatataatggtaaaacattatgggagctgaaggggtgggggaagagctcttctgttatttgatgcataaacatttctttacgggactcagcgtttcagacctacctggaaaatatcttggaatagacagaggaagttgagaagaagctatgtagataaaatagagttatgaagctgtcagagacttgaaggaattgttttatccattcgtatgcttccagacccaaaggcatctaaactaaactactaatccatctgaagtataatgttactgcatataaaagattacattattgatagagcgttagatttaaaacttggtagaaaagactctgtaattttaagaaaggatttaaaaggcacatagaagacttccaaagctgaaccttgtggacagcagaatctggatgtaggaaattgaaggatccacgccgcaattctccttaaattttaaaaattaaaaatttttttcagttttttcttaattttatttttttacttcttacctgttcatctctaggcttatttgccatattggaaaaagatacttaagagaggaatgattttgggctgggcgcggtggctcacgcctgtaatcccagcactttgggatgccaaggcaggtggatcacctgaggtcaggagtttgagaccagcctgaccaacatggagaaacctcgtctctactaaaaatacaaaaattagctgggcatggtggcgggcgcctgtaatcccagctactcgggaggctgaggcaggagaattgcttgaatccgggaggtggaggttgcagtgagctgagatcacaccactgcactctagcctgggcgacagagcgagactcttgtctccaaaaaaaaaaaaaaaaaaaaaggaggaatgattttgattatatacccagtaaagcaagaaagtgtttctccttctgtccctagctttaaaagaccttaaggcttcgttgtttgttatgcatattgtggaatcaaactcaccaccatctgttaaaaattaaggacattagtttttaaaacagcatttttctgcattccttatgttgtaattaagagaaagatatataggagagattattcctcactttttttttttgagacaaggtcttgctctgtcgcccacgctggagtgcagtagcttgatgtcggttcattgcaacccctgcttcccacattcacgtgattctcctgcttcagtctcccaagtagctgggattacaggtgtgcaccatcgtgcctggctaatttttgtatttttagtagagacgggggtttcaccatgttggtcaggctggtcttgaactcctgacctcaggtgatctgccccccaccccctgctcggcctcccgaagtgctgggattacaggcatgagccactgtgcctggcctattcctcacatttttctcttagaaagttaaagtctctgaccttgagatacaaaaatgtaagggttttcagtgtttaacataaggtacttatatatattatatatagtatatatataaaataaattaatatattaatttattatataagtgataaatgtttaattcaaattagagttcaccttacggttgaaaatgtcttttagtcagaaaactgaggcatgggaaggttaagtgacatagatctaataagagcttcagtatgaaaagtagtgaatgcttgaccatcagggagatacttttcctaagtatcccataaaatttgttctaatccattaaatatatttagaagactttattttattttttttatttttgagacggagtttcatgattcttgcctaggctggagtgcaatgatgcgaccttggcttactgcaacctctgcctcctgggttcaagtgattctcctgcctcagcctcccaagtggctgggattacaggcgcctgccaccactcctggataacatttgttatttttagtagagtgctgagattacaggcgtgagccatcgcttacatttttattgaggggagaaaaagccctgcatgtactgagagatagttgtataagaatcttaagagttggccgggcgcggcggctcacgcctgtgatcccagcactttgggaggccgaggcgggccgatcatgaggtcaggagatcgagaccatcctggctaacacagtgaaaccccatctctactaaaaatacaaaaattagctgggtgtggtggtgggtgcctgtagtcccagctacttgggaggctgaggcaggagaatggcctgaacctgggaggtggagcttgcggtgagccgagattgcgccactgcactccagcctgggtgacagagcgagactccatctcagaaaaaaaaaaaaaaaaaaagaatcttaatagtttcaactgtttataaaacttttgaattttggattatattatctgtactttgctttactgggcccagggggagttaagctttccttcttattacagctaagagtttgcctgttggaccacttaacgcccccagggagcatgtgcatgtctaaagatggcaactctgtttatgattgctgttttggttggatttctaatattcggtgtgattaaagcagaaatgcatttctagccactgctgattacagacatattgcactctgatgggtatcgcttagcaacttagtgcagtagactcagttaaaagaagtggatgtgtgccatattgacattttgagctcacattcttgtgggtaatataaaattccttaacctgataatattgcagctaaacctagtatttagggtctaagttgaatgagtattaccaattttagaagtaatcacctccttggttagggaaatgacagttgcacaggtggacagccagaaagctgaatgttatcagttaaatcttacatctctccttaacctgccttcgtggtgccaaatagcaagtttctaattgaaactgacaaattgtaggtgtgtagcttttttttttttttttttgagacagagtttcgctcttgtctcctaggctggagtgcaatggggagatctcagcatactgcaacctctgcctcctgggttcaagccattctcctgcctcagcctcccaagtagctgggattacaggcgcccaccaccacgcctgcctaatttttgtatttttagtagagacgggggtttcaccgtgttggccaggctggtctccaactcctggcttcaggtgatccacctgccttggcctcccaaagtgctgggattacaggcgtgagccaccacgcccggccatgtgtagcttttaattgtggttcattaacccagtttctaagcaaattagaaccttctgtgtatctcccctagttctgtatgccccactggttcctgtagagctttatttctgaagggaagtatgggaaaactatggatatttgaactaaaaaaaaaaaaaaaagaattaaaaagaactccatcccaaaatgatttgttgtaaatatgttcatttaaagcaattatattttccatatctgatcaagcaaaagtagtacataaaagccaaaaaacccaatttaaagaatatgttatggaataaactctgattttagaggttgtagtagcatatttgttgttctcatacattgagtgttcatctgaatgtacgttgaatatgcggtgagtgattcacagtataaaatgattggcaagtatcttcgaaattacaaaccacatactgattagacaaatagatttgcaaaactgaagctttttggatttaaaaaatatctcctagcctcattcttcaagcctggtgtgtaatttttataaggccttatagtagttgaaaatgagtactcttttatggtgacgaattctttatggtgagtgagaaataatgcttattcttccaattttagtatatgtggtgctgaatcgagcacaataatgcttattctttgcttcggaattttttaatttattattattgttattttaaatttttatttatttatttattttgagatggagtctcactctgtcgcccaggctggagtgcagtggcgcgatctcagctcactgcaacgtctgcctcctgggttcaagcgattctcctgcctcagcctcccaagtagctgggactacaggcgcatgccaccacgcccagctaattttgtatttttagtagagacagggtttcaccgtgctagccaggatgggtctgaatttcttgatgtcgtgatccacctgccttgacttcccaaagtgctgggattacaggcatgagccaccgtgcccggcccggaattcatcctttagaaagatttcttccagctgttcctcagttctctgcactcccttacactttccaccttatctgtctgggaactaatttagtctttatgttggctgctttcttttcacttttcaggctaagatttcctttctcttggaaatcagacgtttacttggtcctgcagctctctctctgtggaccagtcttttttgttgttgttgttgccagatactcaccgcctctactgtttatccacccatttcctttataactctgaaaagtagctcctgcctctgcttgattgctgttttcttgaaagtgattacttctggcaaaacatagtggtcattgcttagttgtaatgccactgtgatgttccactccccccggaaaccaatctcttccagttcccaagacacaatacttttctactgaattggagttccttagcgggggtcttagttttgttctgctattcagtgcctttgtccctatcctagccattagctttcctatagatccttgatttcctcatctgttgaaaaagaaatggctagaaaatcttttagattctttcaagtttaaatattcgatgattttaatattctaacagcatgtctctgtgacccagcagtctattgggagctgaccccacttgatttaccaaactctttcccattatgcctctgcatgcacctatgttccaggcaggtcacctcagtctcttctgtgtgtatcatgcttcttcccacttcttggcctttatttctgccagtctctgcctgaatgctttaattcctcctttgtgcttttctaattcctgtccatccttcaatgttcagctcagatttcattttttttttttccccatgaggttgtttcagactaaactctgctatctcacttcttggtatccttgttacctggagttttacagaaccacacagtaagttttcttcctttaggaggattgtttgaacacagcttggctttgttttctttttttcttgtctttttatcaaatggagtgcatactttctgaaaagcaaagaacgctatttgaattctcttctagtcaccccagtgcccagcacagtcttaaacacacagaacattgatggaatgtttttcatatgattcctggttgaagggtagactggctaaataaaaaaagtggtacttttggctttgttttactgaattttacttccatgtttgcaatagcctaggtctgataagtgatattttaactaggaatgagtaagaaaattagcataaagaaggaatttatacatatttatatttcctcccatagagcaaacatgttttttgaatcaggtttcagatctgatcaactacttttgtaattttggatttgtcacttactgttaggatattttgcaatggtgtgatagaatatgaatgtgaagcactttgaaaagtctaaaatttttctaatataagatttatatgttttctttatagcttattattattattattttttgtgtgtgtgacagagtcttgctctgtcactcaggctagagtgcagtgtagcttattactgattattgtgttttcattaaataagggagagtaggccaggtgcggtagctgatgcttgtaatcccagcactttgggaggcccatgtgggaggactgcttgaggccttgaattcaagaccaggctgtgcaacatagtgagatgctgtctctaaaaaaaattagttgggtgtggtggcatgtgcctgtagtcgcagctactcaggaggctgaggcaggaagatcacttgaacccaggagttcaagcatacagtgagccatgattgtgccactgtactccagcttcggtgacagagtgagaccctgtcttccaaaaaaaaaaaaagagagcgtgactagtctctggatattcctttgtatgtaccttggccaatatataccttactttagtatccattgacaagttctcttttttcttcttcttcatttttttttttttgagatagagtctcgctctattgcccaggttggagtgcagtggcacgatctcagctcactgcaagctccaccttctgggttcaagcgattctcctgcctcagcctcccaagtagctggcattacaggcacgtactaccacacctggctaatttttgtatttttaaaagagacaagggttcgccatgttagctggtctcaaactactgacctcaaacaatccacctgcctcagcctcccaaagtgctgggattataggcataagctgtggtgctggtctaatattgttacattttattttaaatgttcctgttttttgccctactctttttatttgactttttaaccattaggaaattagattcttttctcaaatctgctttattattattattattttgagacaagttctcgctttctcgcctaggctggagtgtagtggtacaattttggctcactgcaacctctgcctcccgggttcaagtgattctcctgcctcagcctcccaagtagctgggattacaggcgtgtgccaccacacccagctaatttttttgtatttttagtagaggcagggttttaccatgttggctaggctggtcttgaactcctgacctgaggtgatccgcccgcttcagcctcccaaagtgctgggatcacaggcttgaaccaccgtgcctggccctatttttgtatttttactatagacggggttttgccatgttggccaggctggcctcaaacacctgcctcagcctcccaaagtgctgggattacagatgcaagccactgcacctggccttaagtctgcttttaaaaaatgttttggctgggtgcggtggctcatgcctataattcaagctttttggggggctgaggtgggaggatcacttgggcctcagagtttgagaccagcctgggcaacagagtgagaccccatctctacaaaaagtaaaaaaaacaaataaaaaaaaaatcagccagtgtgcattggttgaaagtaaagaaaagaaaaaaaacagacaaattagccaagtgtggtagtatatgctacttgggaggctgagtcaggattgcttgagcccaggaaattaaggctgcagtgaggcatgattgcaccactgcactctggcctgggtgagaccctgtctcaaaaaaaatttttttttttaatatggagaaagtatttttgtttttcgttttttatttgggtaccggccactgcacccaaccaaacattttgtccttaaacaaaagtttaagtcatataatacagtagtaagaatgccttattttttacatctttgttctttaaattactcagattgctatggggcatttttgttgtagctttcaaatttggtattctggggttctatgtagactctatattgttgcattctaacgacatacttttaaggataagcagcgtattaattaaaaatgtgttttccacttgtgttccttaggtctgcgtatattttggaggtgtgtgtgtatataagtcaagggacaggaggtatcggaaggctctaaaggaagtttaaggaggagaatattctatagaagtggaaggggagatttgtggtcagcttaaactgttaaaaggcttgggatcaataccgaagcagaatatgagcatcttaatctgtttctttgcaaaggattgacttgtatttataaaagcattggcttgtttcatctgacatcttttaaagtaccccattttcttgggggcgggaagggagagatgagaccatttgttttgatcttgaaggacagaaaagtggttttacgttgtagtgactgtgaattaagtttaaggtctcagcaagttgtaaatttctgtatcatactatgtggtagagccttcagtaaacagagtactctcaggtgtttaatgctataggatataaactataactgctgtttatagtaccctcgctaaattctcttaaaggcaatccatttgaccacttcaaatgttatatgcctgtgatatatagttatattctctgcatataactggtttttaaaaattgtttattattcatttattttagaagtgaggtctctctttgttcctcaggctggagtgcagtggtgtgatcatagctcaccatagcctcgaactcctgggctcaagtgatctcccacctcccgaatatctaggactatgggcgtgcgccaccatacctggctattattttaatttttttcgtagagacagtgtcttgttatgttgcccaggctggtctcaaactcttggcctcaagcagtcttcccacctggcttcccaaagcactggaattacaggcgtgaactactgtgctgggtcctgagtggcttttgagccactgactatatcatcaaaaagcttctgttgagacaaagcctcaagctagtgtggagttcatcctactaaaatgaagaattggcattatgttctaaaactttacatattcttaccataaatggtactaattactttgcagtagcagtaacttgaggtgcaaacttccagattgcatattttctttaaaccatagtctggcactcacggtttggcttagggttgccactgcagtccacaagctgtcgcctgcccttattcatattttatagctttgaatgtcttattccattgaacttcagataactttttttttttgagatggagttttgctcttgttgcccaggctggagtgcaatgttgtgatctgggctcactgcaacctctgcctcccaggctcaagcgattttcctgcctcagcctcccaagtagctgggatgacaggcatgcgccaccatgcccagctgattttgtttttttagtagagacagggtttcaccatgttggtcaggctagtcttgaactcccaacctcaggtgatcctcctgccttggcctcccaaagtgctgggattacaggcatgagccaccgtgcccggctgagaacttaactttttctgatgaaattctttcctgctccacctaactcccgtgtcccacccccaccagcagagtggtatatctagcacaagaggcatgaaattaatttagtaaatagcaggactactagaaacttttaaggattatttaacttatttttaatcaaaattttatactcagataatgaccttttgggaagttatgtctcttaatgatctcaagtggtgacacttttctgttgacacggtttctcttgggtagttctcatagtagtttgggcatgagaaaacaacttttaccactttagacttgtgagggcagcctactatgtagtaaaagaaaaagcttttgattgtgcaacttgcagtgtggtcttggggaagtctcttaacctctctgaacatcagttttctatattttcatgtgtaaaatgggcatgatacttacccttctcacatcatgggcttgtttaatgacttaggtatgaatcttatatgaaaggaagctgtaaacagtcataaaaatgtattagcatctgtgcagtattttttttctatccattctttataatttggtggttattatttctactctacatgagaaaaaagttacagaggcaaaacatgttcacaatcatatgattatataattaactgagttaaactagagtatggatgtcttgacccttagatcactatctttccaataaatagttttaaaagtctaaattttactaacaggtagtacaaatatgcaaaatgagggatgtatgattgcttcttcactcgaagatggtatattatgtttttccttttaagttcatgttagagtatctgaatcttttcaagttggttagatgttagaaatagatgtaaattttaagcattatatatccttgatttcattatgtattattctcctggtcactttatcaaaacttcttcagctgttagaagttgtaacattgtttcccttttatttagttatataatacacttattgtacattcttaagtgggagaatagaatttgtgagaataccaacagaaatacacatacagctataaatatgagattatgattctttcatgttggcattgcacagtctatttttgtaaagttggtttttatattctaagaacattttacttagagtttgattacatttgaggcaaacttttcaactttggtagtatttgaatgaagattcctggatgtggtttttttaattgttacatctactttttcagtttttctttttccctataacaaccctcaaatccttcatcttgtcttttggagtatttttttctatcctcctgtctttatcggtgccttctattcctgtcccaccttgggtctgggaaaatgtgcctttatgctccatgtgagtcttcttccttttgggtaatgagtgcggagggaaaaaaagcacagtatttctttccctgttatgtttcagtttttggcctctgataagtgaatctggagtagggaatgacagtgatagtaggttttgttttagtcatatattggcgacaaagatcaacgaagacctgaagctcttgttcctctcatgacacaaactacccacaggtgcatgccaccatgccgggctagtttttaaattttttgtagagacgaggtttcgccatcttgcccaggctggtcttgaattcctggactcaagcgatcttcccacttcggcctcccagagtgctgggattacaggcatgagccaccgtgcccaaccgagattctgtctctgaaaaaataaataaataaataaaataaatacataaaaataaaataaaaacatttgaagacatcttaagtacaccctagattcccacccccaccaaaaaatttcattcattcttcaaccatttctcaaagaacatgttttcaagacacctcactatcctaattgttttccttttggtgcaatggtggtcagtactcaggcataccattttttatctttcctcccaatgttgtatgagggcattatatgaaacttaaatggatttaaaaatgctgagcttgctggacatggtggctcacacctgtaatcccagcactttgggaggtgggggagggaggattgcttgagcccaggagtttgagatcaacctggacaacacagctagtatgcacaaaaaaataaaaaaagtagctaggcgtggtggtgcatgcctgtagtcccaggtacttgggaggctgaggtgggaggatggcttgagcccaggaggttgagcctgcagtgagtggtgtttgtgctactacactccagcatgggtgacagagtgaaactctgttaaaaaaaaaaaaatgctgagcttcaggtacagtatatttttggtatgcatttgattaccagtacagtatacctatcaaaaatgttaattcacatgttttaaaataaaaagtttccaacataaaagtagagagttttttttttttttttttttttttttttctgagacagagtctcactctattacccaggctggagtgtaatggcacgatcttggctcactgcaacctctgcctcccaggctcaagccatcctctctctcagcctcccgagtagctgagatcacaggtgcacaccaccacgcctggctaaattttttgtattttttgtagagacagggttttgtcatattgtgcaggttggtctcgaactcctgacctcaagtgatccacccgcctcagtctcccaaagtgctgggattacaggcgtgagccactgcacatggcctagagagatgttataaattaatccttttgtatccattactcaatttctccctagtcttatttcatccgtattcctacccatttcctgctcactacctctttattattttaaagcaatcctatatatcatttcagcgtgatttattcttatactgactttaagagctgtgtaatataaaaacaactcaattaggaatcagaagacttgactttaagtcttaactttctactggaatgagttaacaggggggcaagccaagctgtatgagccctgaattcctaatatgttgaagagagtaacacgtggtggaggggacataatgttacctgcactttttcacagggatctatgagaatcaaagataggaggtaatatgcatgaaagtattttgtctactctaaactcaaaagcaaaagtgctttacaaaggtaagattttattagtaaatgctgcttccctgtataagtgctaacaactcatgcctaatcagtcttagaattatctggatgctgacattaaattaagtccatagtattaaaatcaccctttcacctttacccactcttggattttgacaattgcaacaacattttctcattcccaatctggctcctgttacttttcatgacttctgcaagttcactgaccacatttctcttaccatatttctaaattttcatctgtatcttggattcatgtacacttgagctcaggtaaaacagggaggtgggctcttcatgctttatgtatctaagttctgatgactctcagcaatgctttttttcagatttgaagatcattttcttttttttctttttcttttttttttcttttttgagtcactgtcacccaggctggagtgcaatggcgcgatctcggctcactgcaacctccgcctcccaggttcaaacgattcttgtgtctcagtctttcgagtagctgggattacaggcacctgtcacgatgcccggctaatttttgtatttttaatagagaaggtgtttcactgtgttgtccaggctggtctcgagctcgtaacctcaggtgatcctcttgcctcggcctcccaaagtgctaggattacaggcgtgagccaccatgccttggcctcattttattttcaactagaacaattagaaataaaaattgagttgaatagttctgcttttaatgacctattggtgctggaatcatggactctagtgattcttgttcttctttcctcatctttttgatcctaatgtattttaaaagcctttacatatttttgtctttaacatttctagttattctgaacttttgttttaactcttctgttaatttatccattgtgtgtagtgtgtattttttcttaaatgtccttataaatactgagctgtgggggaggggagaggaggagcaactggtgcaggcacgctagtttctttagaaatgtcagctctgccagatcacttaagacttgttaaaagtacagatttcctggctctactaaacatcgtgtgatttctagaggtcccaggtcatttttgacataaagctgggtttgtaaaccactgctgtgtgatatacagggagaatttaatttctgggtggtatttaataggtcacagtacagtcatatatatcactgcaacaagttagaaaaccacaattggatgaactttaaaaatcaatactaaaaaaaatattggagagctatggatgtaatgaggactagatgaattagaattccagaaatagaagagatctttataggtgagcagaggattgctgacatttgctgattctggacacacactgaaggaaaaggaaactagagaggaagtgcattttactaaaactgcaacatatccctggcccagttcaattcctgattggactgaggtgatcagcctatcttatcccttttgcctaatagaggaaatagacagctcttactgaggagatatattctggggtttctatggttctttcgtttataatactatcatactattaactattctagagatgtgaaagggtggaaaaattcaagagaaaaataaaacttatagaagcagactcagaaaattgaagttcatcagacaaagacttattttaaaataactataatatacttaagaaaataaaggaaaatacggagaaaatggatgaaaattttcatagagaattggaatccacagaaagaaaccaaatgaacattctaggaatcaaaaacacaacgttggttgcttaaggtctttatttgtagtttaattagaaactttggcgcaggactctaggacactccacctccccctcattctttactgttcttaaaaaacaaaaacaaaaacaaaaaaaacccaggtaaatttaatgtatactatttaagttccacgagagcagggcctatgtctgttttgttcgttgttgtactcccagggcttagtatagtgcatgccacattaaaaaacaaaacaagacagaacaaaatcttccttaacaccaccatcacaaacccccccattaataattaattgacattaatctgaaattaattattcattgtaccggttcagtagcagactatacacagcagaaggcaagactagagagcttgtggacagatcaatagaaaatatctagataaaagcacagaaaaaaaaaaaagaatggaaagagtagaacagagcctctgagacatgtggaacattagtaaaaagtctaatgtgtaattggagacccaaaagtagagagattagcatggaagcaaatacttgaagaggtaatgataaaatattttcccaaactgatgaaaggcatcaacctataaattcaagtagtttagcaaaccccaagcaggatgaacacaaagaaaactacacttagcatatcttaatggaactgttgaaaaccagaaacaaagagaaacgcttaaaagcagccagaagaggggaaaaaaggcactgtgttcaaaggaacgatataatacaactgatggctgactttttaatacaactgtggaaactgggaaataacagacattttttaaatgttggcaaaaaaacctgccaagctagaattctaccttcagcagaaatatccttcagacaagaaggcgaaataaagacatttttagacaatcaaaagctgacaatttatgaccagcagacctgcactgtaagattactgaaggaagttttttaggcagaatgaaaatatctcaaatggaagtacaaaactgtaggaaataatgaagagcacacactcgggtaagtgtgtgagtaaatagacaagacctattgcctcttgtttttattgctgtttttaggaactttattgctttttgctattctagaataatagaatttccacagcttttaggttaaggtaaaattgccatccaatcaataaactgcacatatttaaaatgtataatttgatgagttttgatatacatataagcctttgataccatcaccacaatcaagatgaagaacatatattaccggcaaaagttttctccagcctccttataatccattcctacctccatcccatccctagggaacccttgagctgtttttgtctcagtggatatatcataagttgtttatccattcacttgttgatggataactgaagacaactcaaattttcaccattacaaataaagttgtcttgaagattcatatacatgactgtcatttctcttgagtaaatacaaaggagtagaaatgggtggatcatatggtggatgtatataataatgttacaggatattatattctgtaatattttaagaggccaccaagctgttcctaaagtgattgtatcatcttacagcagtatatgagagtttcagttgttccacatctttgccaacacttatttaaccttttcttttaaattacagccatcctagtgggtatgaagtggtgtctcattgtggttttgatttgcatttccctaatgactcatgatattgagcatcttttcatgtgcttatttaccatctgaatattttctttggtgagctgtttatctcttttgcccatttttaaaaaattgggttttactggagttttcagaattcataatatatgctgaatacaagttcatcagataaatgatttgcaagtcttctagtttttccttgtttttttgttctcaaagtctttcaaaagcagatgttcttaatttttctgaagtccaccttatcaattaaaaaatagatcatgttattggtatatctaaggtatctttttctaatataaggtcacaaatttttctcctctgttttctgtagaaatttaggatttatactaacgtttgtggctcatttttagttaatttttgtatttgtgctatgtgcctgttatgccaataccacatagtcttaactataaaagagcttaactatataaactataataaaatatcaagtcaggtagtataagtcctccagctttcttgtttctcagaattgttttgactagtctaggtcttttgttatccttgtatggtttcggattggcttgtcaatttctattaaaaagccagttttgatagagattctgctgagtccatggatcaactttgggaagattgccatcttaacaggtattgttttttagtttcaatttttgattgttgctaatatatagaaatacatggatgtttattgatcttgtttgtttttatttaggccatagatttttttctttttctttttaaagacagggtcttgctctgtcccctaggcttcatagctcacttcagccttgaactcctgagctgaagtgattctcccaagaagctaggactacaggtacatgccaccacgctcggctcattttcttattttatagagacaggatcttgctgtgtttcccaggctggtctcgagcacctggcctcaagctgtcctctcgcctcggcttcccaaagtgcatgagtcactgaacttggccaggccgtaaattgttttgagacagggtcttgctctgttgcacaggctagagtgcagtggtgcaatcatggcttactgcagccttgacctcctgggctcaagtgatccttccacctcagcttcctcagtagctgggactgtaaacactcaccacgatgcctggctaatttttgtagagacagggtttcaccatgttggccaggctggtctcaaactcctgaccttaggtgatccatctgcctcggcctcccaaagtgtttgaccactcagcctttatacagatatttcatcttctttacaagaagaaaaacactctaagctcttgcctaaaaagatgaaaatgttctttgtaaaaatgaggatgtccttaccctcttcccaaaatgaggagcagagtctcataattgtattgatttctgggggacattcacactatctatttctaggctgtgttaattatgcctcaaattcatagttccttctgaatatcctgttacctagggactaaattgtaaagttaacctttaataaagtttgaataacatagagaagaagagggaaggaattgatttataaacttgcccgtttccctgtaataaggaagaaaatatgtatagctgctgtagaccttgcttctgtaactggttgagagattgtagttcatatttataactacttctgctgtacattccatgtttcctttgttctcattcaagatctcagctggtggggtaacctaaatcttcattaataaagaatatggctttgggaggctgaggcgggtggatcacgaggtcaggagatcgagaccatcctggctagcacagtgaaaccccgtttctactaaaaatataaaaaattagctgggcgtggtggcgggtacctgtagtcccagctactcaggaggctgaggcaggagaatcgcttcaacccaggaggcagacgtggcagtgagctgagatcacaccactgcactccagcctgggtgacagagtgagactgtctcacaaaaaagaataaaaaaaaaaaagaaaaaaagaccatgggccggacatggtggctcacgcctgtaatcccagcactctggaagctgaggtgggcaggtcacaaggtcaggagtttgagaccagcctggccaacatagtaaaaccctgtctctactaagaatacaaatattagctgggcgtggtggcaggcgcctgtaatcccagctacttgggaggctgaggcacaagaatcacttgaacccgggaggtggaagttgcagtgagccaagatcacaccactgcactccagcctgggcgacagagcaagactctgtctcaaaaaaagaaaaaaaagaatacaaatctttggtggtcctgcttcatgtgtgtgcatgcctgtggctgtggttttccattaagttttgctcttatatatataggtttagaaaaacatttcagggaatcctcagggttccagacatagtcctctttgtccccattatgtagcaacagtacagtatcacctagtaataggactgaattacatcagctaatagaataacccccttctttgactgttgatgtagtgcggtggttcttaggacagttttacctcccaggggacatttggcaatgcctggagacatttttaattgttatgactttcgtgggggtgggggaatgctactggcatctagtgggtagagttcagggatgctgtcaggcatcctgaaatgcacaggacagcccccaagagtagagactgatccagtccaaactgtcagtagtgctaagattgagaaattctgatttagtggtatggaggcagtggtcatgaggtagttgttacttccagttcagtggaactgtgtggaatcattccctgcttgggaaccaaggcctccaatccagcagatatcaaagtcgtaggtacttgaaacaaaacttctgctaatggaatttttaggaataatagaggaactacttctacttgtgccccttgattctcaggcctttgtattctagctatggggaaaacaatattgtatattgctcattgatccactgtaactgagtgagtcttcagtagtccattctgttagaccagctgcttctgggtgatggagtatgtggtaagaccagtgatttccaagttccataacccattcctgcataaccctttttctgtgaaatgagtaccttgatcaaagtcttgttgagtagtataccttgatgatgaacaaggtgtcgcccatgtccttgatggtgatgctggcagaagcactgtaggcagggaatgcatattcatattcagaatatgttggtgccagtgaggacaaattcttgtcccctccatgtatgtagagtttttgttttgttttctttttttaaggtatggtattatccactgtcattaatattttggagcattttacttccacattaaaaaagatcaaaataggtaataattatctgaccaagaaatgttttaaataaattgtagacttatgacagctatatcatctatctaaaaaccttggagtaactgtaaaatagtgacttttgaactgtagactttactcatgcagatatctcactaattttgttgaaatctaccagatagaaatccattgttatgggttgtatggttgaaaactttttaggctgtcatttgtttcaagatacagattgactcggtatactttaacatttctcatagttggccaaatttaggtaaaactatttaatttcattgaacgttttagggaaaatgcctgaatattaatagagataggatgaattaaattaaagaacttaccctttgaaaaattgccagggttagcaatttttatgctaaccctgcataaaaattgtgcgtggtggtgtgtggagtggtgtatatgtttcagagaaataatataaatgttcagataagagtatctgcgtaatctaactaggacctgtctaacctacctgcttaaggatagaggaaatcttgagagacttgaaattgaagaacttaaaattttaagtcttccctttcaaggccctatcaaaacatcatgaccacatctttgaaatagttacttttatcactcaatatagttagaaaattttatttttagaactccaaaatcattttattttattttatttatttatttttttcgagacggagtcttgccctgtcgcccaggctggagtgcagtggcgccatctccgctcactgcaagctccgcatcttggtttcacaccattctcctgcctcagcctcccgagtagctgggactacaggtgcccgcccccatgcccagctaatttttttgtattttttttttttttagtagagacagggtttcgctgtgttagccaggatggtctcgatctcctgacctcgtgattcaccttcctcggcctcccaaagtgctagggttacaggcatgagccactgtgcctggctcattttatttttattattattttttgagatggagtctcactattgcccaggctggagtgcagtggtgctattttggctcactgcaacctctgcctcctgagttcaagcaattctcctgcctcagcctttggagtagctggtactacaggcgtgccgccacgcctggctaaatttttgtatttttagtagggatggggtttcaccatattggccaggctggtcttgaactcctgacctcagttgatcctcctgcctcagcctcccagagtgctgggattataggtgtgagctaccgtgcctgacctccaaaaccgtttttattaattatattctttattaagtatatgtttgataaagacaagcatttttccttttttcactgttacattctttctgtttagaatagtgatttgcggccaggcgcggtggctcatgcctgtaatcccagcactttgggaggctgaggcaggtggatcatgaggtcaggagatcaagaccatcctggctaacaggtgaaaccctgtctctactaaaaatacaaaaaaaattagctgggcgtggtggcgggctcctgtagtcctagctactcgggaggctgagacaggagaatgacgtgaacacgggaggcggagcttgcagtgagccaagactgcgcctctgcactccagcctgggtgacagagcaaaactccatctcaaaaaaaaaaaaaaaaaaaaaaaaaaaaaaaggaatagtgatttgcacatagaagggactcaataaatatttgttgaatgaatgaatatatgaaataaaatcttccatgctcttgaagagaagtatttgtcatgtgactggtcttatatggcagaatgtcccttgtttaccattcctattcccttctaaccaaatcatgatatgtatttttaggtattctttggcatttctttttgaacacctggaaaaatgctaaaatatggtttaaaactcaatgtttgtgaattaggctgttaggtgcagcctgacttaagggataagggctgaattatagagaaattgaattatgctttcaaatatggtacgcatatgaaagtaatacatggttgttttttaaactaggttaaatgtggtaaatgcactcttttaatttagtgttttattaaattttggtatatgttgtgttataagcataaaagtttctgaaagaatttttgtgcctagaaattgtgggaattgttgctttctttaacttttgatttgaaacaatcacaaattacactggattcttaaaaatgttgtaggatctttagggagctcaactgcagtccagatgctgattttttttttttttaatactttaagttctgggatacacgtgcagaatgtgcaggtttgttacatagctatactcgtgccatggtggtttgctgcacccatcaacctgtcgtctaccttaggtatttctcctaatgctatccctcccctaaacccccaccccgcaacaggcccagtgtgtgatgttcccctctgtgtgtccatgtgttttcattgctcaactcgtacttatgaatgagaacatgcagtgtttgattttctgttcctgtgttagtttgctgagaatgatggtttccagcttcatccatgtccctgcaaaggacatgaactcatccttttttatagttgcatggtattccatggtgtgtatataccacattttctttatccagtctataattgatgggcatttgggttggttgcaagtctttgctattgtgaacagtgccgcaataaacataggtgtacatgtgtatttatagtagaatgatttataatcctttgggtatatacccagtaattggatggctgagtcaaatggtatttctagttgtagatccttgaggaatcgccacactgtcttccacaatggttgaactaatttacactcccaccaacagtgtaaaggcatttctatgtctctctctcttttttttttttcttgagatggagtctcactgtgttgccaggctggagtgtggagtgtggtggcatgatcttggctcactgcaacctccgcctgccaggttcaagtaattctcctgcctcagcctctccactagctgggattacaggtgtgtgccaccacacccagctaattttttgtatctttagtagagacagcgtttcaccatgttgggcaggatggtcttgatctcttgaccttgtaatctgcccgcctcggcctcccaaagtgctgggattacaggtgtgagccaccgcgcctggccttaagagttcctgtttctccacctcctctccagcatctgttgtttcctgactttttaatgatcgccattctgactggtgtgagatggtatctcattgtggttttgatttgcatttctctaatgaccagtgatgatgagctttttttcctgtgttttttggctgcataaatatcttcttttgagaagtgtctgtttatatccttcgtccactttttgatgggttttttttttttcttgtaaatttaagttctttgtagattctggatattagcccttggtcagatggagagattgcaaaaattttctcccattctgtaggttgcctattcactcatgatagtttcttttgctgtgcagaagctctttaatttaattagatcccatttgtcaattttggcttttgttgtcattgcttttggtgttttagtcatgaagtctttccccatgcctgtgtcctgaatggtattgcctaggttttcttctagggtttttatggttttaggtcttatgtttaagtctttaatcaatcttgagttaatttttgtataaggtataacaaaagggcccagtttcagttttctgcatatggctagccagttttgccaacatcatttattaaatagggaatcctttccccattgcttgtttttgtcaggtttgtcaaagatcagatggttatagatgtgtggtgttatttctgaggtatctgttctgttccattggtctatgtatctgttttggtttcagtaccatgctattttgtttactgtagccttgtagtatggtttgaagtcaggtagtgtgatgcctccagctttgttcttgttgcttaggattgtcttggctctacgggctcttttttggttccctatgaaatttaaagtagttttttctaattctgcaagaaagtcaatggtagcttgatggggatagtattgaatctataaattactttgtgtagtacagccattttcatgatatcgattcttcctattcatgagcatggaatgttttttcatttgtttgtatcctcttttatttccttgagcagtgatttgtagttctccttgaagaggtccttcacatcccttgtaaggtgtattcctaagtattttattctctttgtagcaattgtgaatgggaattcactcatgatttggctgtttgtctgttattggtgtataggaatgcttgtgatttttgcacattgattttgtatcctgaaactttgctgaagttgcttctcagctaaaggagattttgggctgagacgatagggttttctaaatatacagtcatgtcatctgcagacagagacagtttgacttcatcttttcctattcaaataccctttatttttttctcttgcctgattgccctggccagaacttccaatactatgttgtataggagtggtgagagaaggcatccttgtcttgtgccggttttcaaagggaatgcttccagtttttgcccattcagtatgagtatacctatgtaacaaacctgcacattctgcacatgtatcccagaacttaaagtatttaaaaaaaaaaaaaatcagcatctggactgcagttgagctccctaaagatcctacaacatttttaagaatccagtgtaatttgtgattgtttcaaatcaaaagttaaagaaagcaacaattcccacaacttctaggcccaaaaattctttcagaaacttttatgcttataacacaacatataccaaaatttaataaaacactaaattaaaagagtgcatttaccacatttaacctagttaaaaaaaaacacaacaaccatgtattagtttcatatgcataccatatttgaaagcgtaattcaatttctctataattcagcccttatcccttaagtcaggctgcacctaacagcctaattcacaaacattgagttttaaaccatattttagcatttttccaggtgttcaaaaagaaatgccaaagaatacctaaaaatacataccatgatttggttagaagggaataggaatggtaaacaagggacattctgccatataagaccagttacgtgacaaatacttctcttcaagatcatggaagattttatttcatatattcattcattcaacaaatatttattgagtcccttctatgtgcaaatcactattctttttttttttttttttttttttgagatggagtttcgctctgtcacccaggctggagtgcagaggcacaatcttggctcactgcaagctccgcctcccgtgttcacgccattctcctgtctcagcctcccgagtagctgggactataggcacccagctgtgggtttgttataaatagctcttattattttgagatgctctccatcagtacctagtttattgagagtttttatcatgaaggggtgttgaattttatcaaaggccttttcttcatctattgagataatcgtgtggtttttgtcattggttctgtttatgtgatggattacatttattgatttacatatgttgagccagccttgcatcccagtgatgaagctgacttgatcatgggggataagctttttggtgtactgctggattcggtttgccacaattttattgaggattttcacagatgctgaatttttttctgggaagaatttactttgactttttcatcctacaaaaattattctggttctgaaggatgcaggtgtttcaatggtgtcccattaatatccccaggcttagcacagttcttgcttggttataataggcaattaagtgttgaatgaatgaaagaattttaactttattctgtgggttcagggagctgttgaagagtattaagcaagtgagtggcatgctcacatgttctgaagagtgtttcctggtagtgatatagaagatggatttgaagggacagtaaaggcaagaataataattaagaaattgttataatagggatgatctgagccagggtactcattataggaaattaggggcaaccttgtcatgagatttgtttaggagatgaaattggaaggcttcagatggatgataggggtaaggaggaaaggaggagatttaagtgaataagagttgaggagagggaggagttgtaaatgacaagtttcttgtttattgttttgaataaaggggaaaattgttttcagttattcataaaggacttaaaaatgggctttgatcccaaaagttgttttgaagttatttcctgctttatctttggagacccttcttcccacccccacatcaaagcaaatgccctcaactgctttagatgcagtcttgcattgaaataggtatcacattgttttattttgcttgaatgggtgctgttggcttaaacatctaattgcatctgctttgtcttctttagttgtgtctacttatgggccaaaagagcatttctacctctgtaatttcatttgcatattggttttcagataaattgaagattaattatatgaagtatatggtttgtaatctcaattgaaggtgaattttttattttcctggttgaatataatggaatcattttggtatggagaagaaatggttaaaaatagaccagtgggtcatctcagtgtgaaagtcaagaggacttctaggcttaagcctggtagctaaatttctgttggctctaccctcttcatgatgagtccaagtttattttgatctgcatctttcttttttttaatgaatgaaattctccttcattcagcctggtaagtaacctggccattagtacgtgactaaatagctgaagcttctggcttgaattaagttataaacttagcacagtggcaggtgcttgaactgccatgttaaaactagcgcatagaatctttgccattcaaaaactgttttctcaatcccatgaaggagatgaagcctacatgggaatcttcactgattgtgctgacttttcttctacaatttttagtttataacatgtatagtttgtcaattgtgctaggatattttgttaatatgttcttaaaaattcaaatcccaggggtaaacatcaaataatttaattgtgcctatttgactttatgggagagttaacaaccatatttatatatatggttaaatgtgtataatcttcattctcaatctttcagaatccttattttccattttcatttttagcattagctgcattatttctttatacaactaggaaaagggattattcagaaatttggttgatggctttttattttgtagagacagggtctgtctctgttacccagcctagtctctaacttctagtctcaagtggtctttccacctcagccttcctagtgttgggattacaggcatgagccaccgcactggccagatggcattttaaagaataatgttaggaaaataattaatttttgcaagtgaagatagttgaaatgttagctaaaatgatgacctagaggcagcttgttttggtaaatatcttagtcagtttaggctgctataacaaaataccatagatttggtagtttataaacaacagaaacttacttctcacaattctaaagtctgggaaatccaagaataacattcctttaagcaaggttgaatgtaccagcttgggcgatagtggcaagtagcctcctattccattttgttctagaaagcattttttctcttttctattatttttgtctctttatatgtttatgtgttagggggagaaggagagagaatatttttatatttttcttttggggggatatttttatttttaaattataaatacttctaatttgcaaaggatcccagaaatagttgaagctgtctttaaacccctctctgatcccattctatcctttctgttaactactattctgaagttaatttgtactctgtccatttttatccttttattacatatgtttgtgttcataaaaaaattacagtttaacatttttacataaaaaatgttcttgtaaatattctgcaatttgcttttttaaattttattttttatttttaatttttttttgcagagccagggccttgccttgttgcctaggctgatctcaaactcctggccccaaggaatcctcttaccttggcctcccaaagtgctgggattataagtgtgaaccaccactcctggccttgcagcttgctttttaaacctattctaagacttgctccctatttatacatgagtattaagttaactcattttaactgcacgtataatattctattatcagtatgtcagtttatccatttctggtatagaggaacacttaatttgttttcagggttttttttttttttgcttgtgtttttgttttattataaacaatgcttcaggaagcatatatttgtattcttgaattttttttttttttttttttttttgagacagggtctcactcttgtcgcccaggctggagtgcagtggtgcgaactcggctcactgcaagctccgcctcccaggtttatgccattctcctgccttagcctcctgagtagctgggactacaggtgcctgccaccatgcgggctaatttttttttgtatttttagtacaggcggtgtttcactgtgttagccaggatggtctcgatctcctggcctcatgatctgtccgccttggcctcccaaagtgctgggattatatgcgtgagccaccgtgcctggccttgaatttttatttgacttaaaacatactgtgaaacttgtaagattatgtgaatcatgtttgtacagtttatacttaaaaaaaaaaaaacatggtgaactcttatcaattcacagagtaaaaaacaacattcccaatgctgtggaaacacctctatggcccaaatcacagttcttttcttaccattccccctaccactatcttgaattgtattttaaaatttcctttcttttctttatgtctccatgaacaatgtattgctttgtttacttattttgattttcatgtaatggaataatactgtaagtattctgatttcttttgtaagcatcatttttcttttgagcgttaatctatggtattgtatgcagttcattcagttttactgctatacattagttcattatttgtatatattgtatatatatatatatctgggctattgatgcacatttggattgtttctagttttttgctattactaagaatgctgcttacgaacattgttattcatgtcttttgtgcacatgcaggaatttgaagtatatgtctgggagcagaatttttcattttatggggtatgggtttgtttagctttactaagtaatgccaaatttttctaatttttaaaaatttttaattaattttttttttgagatggagtttctctcttctcccccaggctggagtgtaatggcacgatctggactcactgcaacctctgcctcctgggttcaagcgattctcctgcctcagcctcctgagtagctgggattacaggagcgagcaccatgcccagctaatttttgtatttttattagagacggggtttcgccatgttagccaggctggtctcgaactcctgacctcaagtgatctgtccacctccgtctcctgaagtgctaggattacaggcgtgagccactgcgcctggccaccaaattattttttaaagtgattgaatcagttgacactcccaactgcaatatagaagtattcctattgctctgtgtccttgccaaagcttagaattgtttctttaaaaaattttatggggccgggtgcagtggcttacacctgttcaaggccagcctggccaacgtggtaaaacccggtctctactaaaaaatacaaaaaaattagctggacgttgtggcatgcacctgtagtgctagctactcgggaggctaaggcaggggaattgcttgaacctgggaggcggaggttgcagtgagctgacatcttgccattgcactccagcctgggcaacaagagcgacacttcgtctaaaaaaaaagaaaaaaaaattatgtatctggtgggtaagaaatgttgtttcattgtaatttgaatctgtatttccttgactaccaatgaggtttagtttcttttcggatattcatagagcatttgtgttatttattctgtgaaatgtatttgtgtttcttattctgtgaagtgtctgtatatactttttgcccatttttctgtttggattgtttaatttttcctgattgattcatagcaattttttatggttttagatctaattctcttgttttttgagacagggtctggctctgtcacccaggctaaagtgcaatggtgcaatcttggctcattgcaacctttgctaggctcaagctatcctcccacctcagcctcttgagtagctgggactacaggtacgcgccactgtgcctggctaatttttgtattttttgtggagatggggttttgccatgttccccaggctggtcttgaattcgtgagctccagtgatctacccacctcagcctcccaaagtgttgagattgtagatttgagccacagtgcctagcctagatctaattctagatttgtgttgcaaatatcttttccaatttatgattggattaaaaaaaacttcggtgattgaaattcttgatcttactgcagctgaatttatcagtcttctatgatttatgttttaaaatttttttgtgtcctatcattaagataattctctattttctaaaagttgtttgcttttcacttttacattgaagtctctaatccacatggaaagactttttttgtaaggatccacttttatttttttgccatatgataacagataactgattgttccagcctatttattgagtagtgcattttttctcctgtgatctcagtgcttgcttgggtgaatattaagtgtcagtatatgcacaggctcagtttctagactctcagttcggctctctcctctagtgccagtaatccacttgattatttgtcctgattgtggttgctttataataattcttagtataaagtatggcaggtccccaaaagacttataataatgcctttccatattggttttacagtcagtttattgatttccgcaaaaaatgatactgggattttgaatggtattgcattgagtctttggatcaagttgggaagaattgattgacattgttatgatattgaggcttcctatttaagaacataatatgactttctatttattttatgttttaaaaaatcattccagttaagttttataattttctccttatataaagaacttctacataaaatgtcagtttttcctagaatatttttattatttatacatgatatttaaaaagttatattttctgattgtatatagaaatgaaattaacttatattttgtctttatactttttttttttttttatttaaagaaacggggttttgctatgttgcccaggctggtcttaaactcttggcctcaggtgatcctctagtctcagcctcccaaagtgctaggattacaggtgtgagccaccacatctggcctgtttttgtgctattactgacttatatctagattctttggggttatctatgtagacagtggatgatctacaaatagttgtagctttgtttctttatcttcaatctttttttttctctgtgcatctgttgagggcttttaatgttgaataggggagatgacattgggaagctatgtgttgtttttaattaatattttttttgtacattgacctcttctgtaccttgcacttctgttttgttttgtttggttttgtttttggaatgcagtggcgcaatcacagttcactgcagccttgatcacctgggctcaagccatcatcccacctcagcctcccgagtagctgggaccacaggcgtgtgccaccatgcctggctgatttttgtattttttttttttttttttagagatggggtttcatcctgttggccaggctggtctcaaattcctgagctcaagtgatccacctgcctcgacctcccaaagtgttaggattataggtgtgagccactgcacccagccccagggttgttgcttctttattgagcttgtcactcagtgccttttaactggggcatttagcccgtttacattcaaggttagtattgatatgtgtggatctaattgtgtcatcatgttgttagctggttattatgctgacttgttggcatggttgctttgtagtgtcactggttatgtacttaagtgtgttttttttagtgtctgataatgttctttcctttccatatttagtgctgctttcaggagctctcgtaaggtaggtctggtactaacgaattccctcagcatttgcttgcctgaaaaggatcttatttttcctttgcttatgtagcttagtttggcccaatatgaaattctgggttggaatttcttatctttaagaatgttgtggctgggtgctgtggctcacacctgtaatcccagcactttgggaggccgaggcgggcagatcatgaggtcaggagatcgagaccatcctggctaacaccgtgaaaccctgtctctactaaatatacaaaaaattagccaagcatggtagcaggcgcctgtagtcccagctactcgggagcctgaggcaggagaatggcgtaagtaaacccgggaggcggagcttgcagtgagcctagatcgcgccactgcactccagcctgggtgacaagagtgagactccgtctcaaaaaaaaaaaaaggaatgttgaatatagacctccaatctcttctgacttgtatagtttctactgagaggtccattgttagtctgatgggctttcctttataggtgacatgtcctttctctctagccacctttaacatttttttctttcatttctgccttgaagaatctgatgattctgttttttggagattatctttttgtgaaatattttgtgggagttctctttatttcctgaatttgaatgttgacttctctagctaggttggggaagttctcatgaatgatatcctgaaatatgttttccaagttgctgcctttctccccatatctttcagggataccagtgaatcatatatttagtctctttatataatttcatatttcttgggggttttgtttgttccttttcattcttttgtctttattcttgtctgtcttcttatttcagaaagccaatcttcaagcgctgagattcttttctcagcttggtctgttctactgttaatacttgcgattgcattatgaaattttttttttttttttttttgagacagagtagtgacacgatctcagctcactgcaacctctgcttcctgggttcaagcgattctcctgcctcagcctcctgagttgctgggattgcaggtgcctgccactacacccatctgattttttgtatttttcgtagagacggggtttcaccatgttgaccaggctggtcttgaacccctgacctcatgattcgcctgtcttggcctcccaaaatgttgagattacaggtgtgagccactgcgcccggccatgaaattcttatagagtgttttttagctgtatgaggtcgtttatattcttttctatactggctattttgtctgtcagctctgtatcgttttattgtgggtagcttccttacattgggtttcaacattctcctgaatctcaatgattttcattcctatccatattctgaattctgtttctgtcatttcaaccatctcagtccagttcagaacccttgccggagagctagtgcagtcgtttgttttagaggaaagaagatgctctggctttttgagtcatcagagttcttgtgttggtgctttgtcatctttgtgggctgatgttccttcagtctttgaagtcgctgtttttttttgtttttttttttttatcctatatgatgaccttggatgtttgtggtacaaggtaggttcagttaactggcttcattactggaggggccagggctcatctcaggactcccggagtacatgggtcctccaactctgggggactggcattgggccccagctttgttctctggttctttaaggttaggaacctgctgcactggaggggccgaggtgctcctggacctctggtcacaatactcccgtgggttgtgccagccaaagtgtagggggtggcagtggaatcaattcttgttcgcatgtgccagtagcagtggcagcaaggccacagggtgctggcctccatgtgggcattggcagcaacagtggcagtaaggccagggcggggggctgctggtacacatgcactggtggtggtgttagcacaggggcagggtgctggtgggtgcaggactgggtgtgccctctgtgcacgttcatgctggcttcagtggccggtaaggggtgggggtgggtcctctgttttctctgcctagtttcatgttggtgcaggggctcagtgctggtggggatggcactggtgggctctgtacctgccagtgctcccttgacaatggccatggagggataggcagggtgtactcacgctggctgcagtggcatgggagggtgcttgcacgcatgtgtgctggcggggaagggaaaacaaggtacacctgtgcacacgtgtgggcaaagcatttggagggtggccatgggcgagtgcctgcaggcaaagcagcatggagcagccttcggtgggaggagggtattggcaggctcgtgcttttccacagggatcactgtggttggagcactctgcctgtcagcaccttgtcagtgcaggagctggtatgtggccccccccggcagtactgcaagcatcctggccaggctggagccccatgagagaccagcagactgagggtactcaggtcacaccacccccaccttatgggcaagactgccctgcagagttcaggtctggcagttcctctagggctaaagtctcctatgggagcaagtcgagccttgggggatgggcactcctggccctgttgcactacagatgctccagcaccaaaacctctgagctctgccctggctggagttctgcccctaccacttctctaagcagctttccctgccagctcaagtgtccttggtggttgaggggtctccttgtggtggaggagtctccttctgcagggattccagagtcccctggtgagagtgggttgctgcttccctgttcaactcaactgcctcttcaggagtcactgggggccaggaaaaagtcccggtgcgtggtagccctgtgcagggttccttacttcttccctcgtcagttcagcatctgtgtcttccctctgtcagcactcagtgctttccctctgaagatctgctaagagtgtgccagtcatcctgatcctctgggagatgttcctactggctgcagctagttggccatcttggagccccctccctgtggcttttcatgatttctaataattacattgatgttacattctgtgggctgttcttattgaaatgtataaatttaacaaatcagttgttggtgtaaacttgctgatattttgtttaggatgtttgtatctatgagtaagattggtttgtaattttcttatatagctgttgtctggatttcatatcaaggtgattctagccttataaaatcaattggggagtttatataatctatttaatctctgtgttaactgaagttgtgtctaatatttcacccctaatgtttatttctttattttttcatgtttttttttctgtttgtgtatttcgtttttatttttttgagacagggtcttactctgtcatccagactggagtgcagtggtgtgatcactgttcactgcagccttaacctcctgggctcaagcagtcctcccaccttagcctctcaagtagctgggactacaggcacatgtcaccatccctagctaatttttaaattttttttgtagagacggggtctcaccttgttgcccaggctggtcttgaactcatgggctcaaatgatcttctttcttggcttccaaaagtgctaggattacaggcgtgagccactgtggctggcctcagtgtatttttaaagactcatttctaggccagacttggtgggtcatgcctgtaatcccagcactttgcgaggctgaggtagatggatcacttgaagtcgagagtttgagaccatcctgaccaacatagtgacaccgtttctactaaaaatacaaaaactagctgggtgtggtggcagacgcctgtaatcccagctactcaggaggccgaggcaggagaatcgcttgaacccaggaggaggaggttgcagtgagtggagatcatgccgctgcattccagcctgggccacagagcaagacttcatctcaaaaaaataaaaagactcatttcttagctttttaaactttgttttctgttttgttaattttgttgttacattttctttccttgggtttattctgctatgcatttttcccctaactttttaatgttacttatttatttattttttgagacggagtttcactgttgttgcccaggctggagtacagtggcgtgatctcagctcactgcaacatttgcctcccgagttcaagtgagtctcctgcctcagccacccaagtagctgggattacaggcgctcgccaccatgcccggctaatttttgtatttttagtagagatgggatttcaccattttggccaggctggtctcgaactcctgacctcaggtgatccacctgcttcggcctcccaaagtgctgggattacaggcatgaaccaccgtgcctggccttaatcttatgtttaaatgtggaaaaatgcacataacataaacgttaccatcttaactgttcctaagtgtatagttcagtagtattaagtacattcaccttgttgtgtaaccaatctacagaactcccttcatctcaaaaaactgaaaccctttactcattaaactagaacttcccattcctccatgttcccagccactggaaaccaccattctactttctgtttctatgaatttgactaccctggatacctcaaataagtggcgtcatacagtatttgtctttttataactggcttgtttccgttagtgtaatgtcttcaaggttaatccacattgcagcatatgtcagaatttcctaccttttaaaggctgaataatattctgttatttgtgtaaaccacattttctttatccattcaggacatttgggttactttcaccttttggttattgtaaataatgctgccatgaacatgggtgtgcagataccacttcaagaccctgctttcagttcttttgcatatgtacctagaagtagggttgctggatcatatggtaattctatttgtaatatgttgaggaactgttttactgttttccataggtatatgcactattttactttcccatcagtagtgcacaagggttccaatttctccatatcctcatttacgtttgttattttgtgtctttttttttatttttttgagacagagtctcactctgttgcccaggcttgaatgcagtagtgtgatctgggctcaccgcaacctccgcctcccgggttcaagcgattctgctgccttggcctccctagtagctgggactactggcacctgccaccatgtctggctaatttttgtatttttagtagagatggggtttcgccatgttggccaggctggtcttgaactcctgacctcaagtgatctgcctgcctcggcctcccaaaatgttgggattacaggcatgagccactgcgtctggccttatttcatgtctctttttgatagtagccatcctaatgagtgttaggtggttttatgactttttggtttttttttaatagaggtttttgctctgtcatgcagactagagtacagtatcatgagcatagctcactgcatcttcgaactcttggactcaagcaatcttcctgccttagcctccccaaagtgctgggattataagtggaagccactgtacctagcacgttttctgacttttagagttatatttaagctcatcagttttgaatatttcatttgattgtaagtattcaaagttataaatttattaaatgctgctttaattgtatcctacaagtttcaataattggctttttatttttcaatttcatatttccatataatgttttcaattatgatttctcctttcacctagagtgtttcatatgaatatgaaacatgttatggtttatatgttaccagtaatttcaaatttgaacttagctttatgaccttgaacatatttattagttatttattgttatgttataaattattcccaaatgtagccgttttgtacaacaaacatttattatcacataaagtttctgtccatctgaaatccattagtggctgaactgagtgtttctggctcagagtctttcatgaagctgcagtgacagtcttggctgggtctgtagtaatctgaaggcttgactgggggtagagcatttgcttccaagtaaattcacttacatagcttttggcaggaggcctcagttctttgctggccatttgtaagaggtctcagttcctttctacttgggcttctccatctggctgcttgtaatgtggcagctgacgtctcccagagtgagtgatctgagagaatcaaaagccacattctttcatgatccttagaagttacataccttcctgcttgccgtataatattggttatgcagaacaacccgaataccagatgagagaggatgacacacgggtgtggatatcagaatgtaggaatacttgcagaccatcttggagtctggctaccataagcatacagtccatttttataaagttttcatgtcttcttgaaaatgatatgtagtcccaagttcttgagtgtgatttttacataggagtttgatcaagtttattaagcagttcaactcttctaaattctgattcttttttgtctgctagatcttactactgagaaaggtaagttaggaaatctttcactgaattagtatgtttatgcttttttcttgcagatgtgtcagttttgtgtgtgtgttattaggtgcatagaggcttacaatatcttacagttgatttgagtcctgtatcatcatgtagtgcccctcttgatctctagtcctttttatcttagtccactccagttttctcttgtttctatttgcctgatagatctttttccatttcttaactatcaatatttctgtgcctgtatgctttatgtttgtctcttataaacagttcatgggaaaccagtctgatggtttttttttcttctgcctggagagtttagttcatttacattcattgtgatgactgacatctttggattcctttctgccattttctttttaaaatttaatctaattattattacttttttgaaacaggggtctttctctgttgccctaacttgagtccagtggtgtgatcatggctcactgcaacctctgtctcctgggctcaagtgatcctcccagctcagcctcctaagtagctggaactataggcatgtgccatcttgtctagataattaaaaaacattttttttttttgtagggacagcatcttactgtgtttcccaggggctagtcttgaactcctgagctcaagcgatccacctgcctcagcttcccaaagtgttgtgattacaggtgtgaaccaccacccccagctctgccattttcttatgtgccttttattcaactgtttcatttttttaccccttgagtctcagaatttacctctgggttcattttacttctgcttgaagcatattctttagaatttcttttgatgagggtctgttgcagtaattgctcttactttcctttctttgaaaatacagggccagcgcggtggctcacgcctgtaatccgaacactttgggaggccgaggcgggcggatcacaaggtcaggagatcaagaccatcctggctaacgcggtgaaacccccatctctactaaaaatacaaaaaatagccaggtgtggtggtgggcgtctgtagtcccagctactcagtaggttgaggcaggagaatgacgtgaacctgggaggcggaggttgcagtgagctgagattgtgccactgcactccagcctgggtgaaagagcaagactctgtctcaaaaaaaaaaaaaaaaaaaaaggaaagaaaatacagtagtctccccgctccccccacaaccacttatcagcagttttgctttctatggtttgttgcccacagtcaactgcagtctgaaaatgttaaatggaaaattccagaaataaacaattcataagtttaaaattgcatgctgttttgagtagtgtgatgaaatctcacacagtcctgcttcgtcttacttgggatgcaaatcatccctttgtccagtgtatccacactgtgtatggtacctgcctgttagtcacttagtagccatctcatttatcagattgactgtcatgatattgtagtgctgtgttcagttaacccttattttatatagtaatggccccaaggaggaggagcagtgacgctggaatattgttataattgttctttttttaaaattagttattattgtcgatctcttactgtgtcttataaattaaacttttttataggcatgtatgtgtaggaaaaaaacatagtatatatatagggttcagtactatccctggattcaggcatccactggggctcttggaacttatgccccatggataaggggagactactgtatctttatttctcccttattcttgaatgatagttttgctggatatatagaattctggacagttatgtttccctcagtatgttaaagatactatttcactatctgtctgctatcatagccattgagaattcagttgacataattgcctttattttataggtgacattttctctccagttgtttttttaggtctcctttttgttgtttgttctgtagtttcaccaaaatgtttgtaggtatatggatctctattctgctttgagtttttggacttcttgggagtgacatttgttgttgtctaacagttctaaaaagccattaccttctcaaatattgtttcttttctgtatttctattagttttcttctggaactacaattagatgtatgtaatattgtttgaggctgagccaagtagtgtactgtgattaagtttactttctggtacaactttttgtgtctcctaaatgtaatgtctcatttagcctcatttttttcatttgcttcagtttttatgtagctattgttatttctttccatcattaacacgttctcagtacagtttttcacatagggtcaaacctgttaatctgttcagtgtgaccattttccttgaggatttcctcccatgctagtgtttagaattggctgcttgctataccaggtgtgcagctatcatcctgtgttctcccttcagcatcattttggaaattcctattgcttgtctcctgtgttgattcccttgttttgtggatctcattcatttacaacacaccttccactagcttgctggaaaaaaaaaaaagtacaaaggagataaattttgagaccttgaatgtttgagaatgtctttattctaccttttttgaaaaaaaaattgataatttgtctaggtcttaagttctaatatgaaataattttttttctcagaatttggaaagaatttctccattgccttttagtttatcactgagattattgctaaccccaatgccattctggtttctgttacgttgtcatcaatctgtttattttttcttttctagaatccttggaatttttttttatttgtccttgctattctgcagttcaataataacatgttgggataccaaatgggtcttacttagtttagagactcttcaagtctggaaaacttcttgtgttattctctggcaacgtcttcctatcttatttattaatttttttctttttttcacatgttggaattgattactcatgtaatgttttacatttttttctttcatggtctttcttttgttctttttttgtagaaaatatcttgactttatcttccaactctttaatgttttctttctttctttcttttttcttgagacagggtctggctctgtcgcccaggctggagtgcaatggcacgatctcagcactctgcaacctccacctcccgggttcaagtgattctcctgcctcagcctcctgagtagctaggattacaggtgcctactaccacacctggctaatttttgtatttttagtggagacaaagtttcactatgttggccaggctggtctcgaactcctgacctcaggtgatccacccgcctgggcttctcaaagtgctgagattataggtgtgagccactgcacctggcctgctctctctattttaaaaatagcattctttagtttttttttttttttgagtcagcgtctcgctctgttgcccaggctggagtgcagtggtgcaatctcggctcactgcaagctccgcctcccaggttcacgcaattcttctgcctcagcctcctgagtagctgggactacaggctaattttttttttttttgtatttttagtagagacggggtttcaccgtgttagccaggatggtctcaatctcctgatgtcgtgatatgcccaccttggcctcccaaagtgctgggatcagaggcagcattctttaaatttttaagtattttttaagatactaataatttaccgtattttgaagttttcttctcattcttcattatcttttttctcaaaattaattgtgtgtacttggttctttttctttcatgttaataaggtttccttatacctggtgattctgagctgttttcactttaaatatctaagttttgtttgtttgttttttgagacagtctcattctctcgcccaagctagagtgcggtggcatgatctcagctcactgcaacctccacttcccaggttcaagaaattcttgtgcctcagcctctcaagtagctgggattacaggcatgtgccaccatgcgtggctaaattttgtatttttagtagagatgaggtttcaccatattggccaggctggtctgaaactcctgtcctcaagtgatcggcctgcctcggcctctcaaagtgctgggattacagcatgagtcattgcgcctggcctactcttagatcttaaatgttttacacagacacacacacacacacacacacacacacacacacacacggtaactgtgatgatggatgtgtcagttgatcgtggtaatcatttcagaatgtatacatctattaaattatcatgtagaccttaaattattatttttgtcaattatacctcaagctggaaaaaaatgcagatctactcttaaatgtgagataattggaagctcatgtgcatgggctagggtaagttggtggagaactaactttattgttggaggctttctaaatgtatgtcttttctttgaacattagtttgttccagaaaatattgcgtggttggttgcctgggaagatgtatgtctgattttcggacttggaagcaagataaaggaaagaggctgctggtttatggtatagagattttcactcgttaagaaagtaacaaagtaaggaagtaggattattgtagaaatattattttacagttcaagtttgtaaaacacaggtgaaggtaatcgttggtgggtctcttcctctgagatcaccaaattatctgtagactggttggtagacttggagagaccacttgttcttggacaacagttagaagcatactgccctaagcagtaaaaaggtgattgttgagggcagcaagaggcggtgtaacataccagttcatttttcttttcttagcaagcatgtactaattgccttttaaaactcctgaccataggggataaaacgattacaagaaagataccttccctgctcccatggaatttacattctagcacaacagtggatattaaacaacgtatcatctggttatgtaattacagtaataagaatcatgtaggagaggtcaaggaagcttactgctgtggggttcaggatggcatctccgaaagtatgaataaggaaagtggtgggagaataaaaggagagtggcagagactcagactgagagattaattgagataatgacaattgtgggattcaatgaggtgtataatgtgtttagtgcctggtacttgtgctcagtaagtgctaattagtagttgtttatagcaatactgttatcttggatgatcaaatagaagatccctagcaagtaattttataaagacaaaaatttcgtgtcaactctgtaataaaacaatatatccttagaatcagttatcacttaaaatccttattttatagaaatttttgtgtttcaaaagtatagctagggcaagtcccccttcagggtggatacttaaaggagatgaaatcacttcataaaggtgtctgcactcccatgttcattgcagtgttatttacaaggtagccaagatatggaaacaacctaaatgtctgttgatggcaaattgataaagaaaatgtgtgtgtatgtgtgtgtttatacaatggaacgttattcagcctttaaaaagaaggatattctgtcatttgccacaacttggttggaccttatgctaagtgaaatagaccacgcacaaaaagaaaaatactatataatctcacttatatgtggaatgtttttaaaaagtcaagtatacggagacagagaataaaacagtggttaccttgggcaggaggaggaaggaaatggggttatatagataataaaatagcagatatatagaatgaagaagtctggagagcttatgtataacatgaagactatagttaataaaacaaaactgtattaaggatttttattaagtaatttagctgcttgtaacacttacacacacacacatagtaactatgatagatgttttcactgtagtaaccattttgctgtctatacacatcccaagatatcagcttataaatctcatatacacagatttttttttttaaaggtattgttggggcagggatcaggcttaactttgtggttgtatctgtagtacccagcacagtgcctgacacatagaaggtgttaatcttgttttttttttttttaggtatctgaaatacttaccagaaattctattctttcagatgagagacatctatgtgattttaggtattaataaaagaaatattcttccttttttcttactacggtgttggtagtggtgctctttcttcagggacatcattgatggccttttagttagaatttaaatgttatcctttctgtagccagcagggatctgttgggataaagtcttatttttcttttcttgggagtaattggtgctttctaacttttcagcacttagactcacaatgtattagttatctattgctgcaaaacacattacttcaaaacttagcagtttaaaacaacagacatttattatcccacagtttctatgggtcaggaagataggggtaccttagctggatgcctctggagcacggtctcttgaggttgcagtcaagctgttggctggggctatatcatctgaaagctttactggggcaggggatgatgtacttccaagttcactcccatgattgttgggaggaggacttaattccgtttcttgtgggcttcttcctggtttatgtttgttacctggtgtctagagctgatgtattgggtacttcccctctagcatggttattttctttgttttttctctcatttaggtgaaaacttaggtgaattttaatgtaaaccctacccccattatggtctaaggggccttttagaaaatgagtagaatgtacacagaggcaaaaattttagcctgtgaccttttgaagaattttctaagtgaaactagaaacaaattaaccattgttcacagagtgctttgcttaatgttatgccttcttttgctaaatcctcttgtttgttgaaatcttacatcttaagttgctgatagtttgttaatagagatcataattaaaaggtgattatatttcttcatgcagtttagctttacatttcttccattatacccaaagatttctataatatagcaagaaatgtttttaaaaagtgtttttcctcaattgtgtgaaagtaatgtatctaactgaaaagaagagaaactcataaaagtaaaaattttaaaaaatcaccttattcttacctctcaaatacaatgacctcatattttaaattttgctcaaggttttttcctcctcattctaggcataattattttcttatatgtgtttcagtattactttttttgtgaaaaatatggttacaaatgtggtctaatttcattttgcactttaaaaattattaatgaggccggaaatgaggccgggcactgtggctcatgcctgtaatcccagcactttgggaggccaaggtgggcagatcacgaggtcaggagttcgagaccatcctgggtaacacagtgaaaccctgtctctactaaaaatacaaaaaattaaccgggtgtggtggcaggcgcctgtagtcccagctactcgggaggctgaggcaggagaatggcatgaacccgggaggcggagcttgcagtgaaccgagatcgcgccactgtactccagcctgggcgatagagcgagactctgtctcaaaaaaaaaaaaaaattattaatgagatggtcatatttttatgttatttactgatcacttacctttgaattgccccttgtttcttgaagtttttccaataaatattcttattaataggcaagacaacctgatctgttagttatgtaaactttttggtagctaattgtatgtgcattcttttacctcccgtttgtttctttattagcagtgtctttttgttatagaatttatacattttcttgtaagcaaatatcagtgtttttattataggtgctgtatgtttgtcttgcttaggaaaatctttattactccaatattattaaattattctttagtatttgtcctaatagctttatggctttgttttttttaaatcacacacacacactcacacacacacacggacacacacactctttgagacgggtcttgttctatcacccaagctggagtgctgtggcgcaattatggctcactgcagcctcaacctcctgggctcaagatatcctcccacctcagcctcccaagtagctgggactacaggtgcataccaccacccccagctaatttttaaatgttttttttgtagaaacagggtctcactttgttgcccaggctggtctgaaactcctgggctcaagtggtcatccttcctcagcctccccaaagtgctggttttacaggcatgagccaccacacctggcagcacccatatattttaaaatttagtatgaattagtcttttctttttgatgtggcataattgtattgactaatccattctttaccattgatttgaaataccacctttattatattaaatttgtgtgtgaatatgaatatcttttctgtgattgcaattaatttgtacttgtacagattgtgctgtaagagcttaacagtatatttcagtacttggtcatgtctcttgttcttgtttttcttttcttttcttttttttgttttgttttttgagacagagactcgctctgttgcccaggctggagtgcagtggcgcagtctcggctcactgcaagctctgcctcctgggttcatgccattctcccgcctcagcctcccaagtagctgggactacaggcgcctgccacgacgcccagctaatttttgttgtatttttagtagagacagggtttcaccgtattagtcaggatgatcttgatctcctgacctcgtgatccgcccgcctcggcctcccaaagtgctgggattacaggcttgagccactgcgcctggccttgttcttgtttttcaaaaatttctttggtattctcacaagtttattcttccaaattaacttcagaatcagcttaccattttaaataagcaccccccttctaaatctattataacatctcactactttctcttctattcatattagcttaacttaagctaccatcctctcttgagtaagactgttttctaacatacagcaacaagagggttctttttaaaacataaatcagattatgtcattcctttgcttaaattcgttcagtgcctttttcccctgtcttttggttatctattgctgtataataagctactccaaagccttgtagcctaaaaacaaccattttattgtgctcacaatttttgggggtcaggaattcatgacaggttcagctgggcagttcttctgttccatattgtgttgctgacactggagaatcccttccattatggcttcttcagtcacatgtctggctcctcagtgtttcttggcctctctctccacaatggcgtcccattcttcagaatctctgcatgtggcctcggcttctcacagcatgctgatctcagagtagtcccattttttacatgacaactggcttctaggaagagggaaataaaaactgtcagaccaattaaggactatggcctggaactacacagtgtgcctttaagccgtattttattggtcagaatagtcactggacctgctagatgaaaggaggtagaaaaataaatttcttttcctaatgagggagtggcaaaatcttattgcgggaaagcatgtgggatgagagatacttgacagttggaaaatataatccgtgacatcgtcaaattcaaaataaattcagagttcttaaaatggcctataaggcttttcatgatctgactcctgcttcttgaatctctgaccgcatcccctagattttcctcttcgttccctttgggttaaccacattggccctcttgctaggctttgaacatgccacacccaacatcagatccattttacttgcaactactgccgtgaatgctcttctttagatctttgcatgggtcttcccgttctcattcattcattcattttgagacagggtctcactctgttgcccagactggagtgcagtggcacgatctgggctcaatgcaacctccgcctcccgggttcaagcaattctcccacctcagcctcctgagtagctgggactgcacgcatgtaccaccatgcctggctaatttttgtatttttgggtttcacgaggtttccccatttggccaggctggtctcaaattcctgacctcatgtgatccgcccgcctcagcctcccaaagtgctgggattagaggtgtgaaccactaatcccatggctggtcttcccatttttttacttcatttaggtctctgctcaaatgtcacatcttcagagagcttcccctgaacaccttatctgataaattcttggttacttagaactccttaatcttgatttttttttccttttcatagaatttggtgctgttagtaggagcctggggggcctaagtaccacttttcttccttccctgcctggcttctgagcaagttgagaaatgagtaaaggtggaggccaaaatatattttaaaaattcttctgactaaagggagatgaagtaaagggaacaaaagaagtatcatgaagattctcagatgtccgacatgggaaactgggtagattgtggtactatttaccaagacaggaaacatggtaggaagattatgaattaagctttggaaatgttgagtttgaagtgcctacaagttatccatgtggagaaaccaaatggacatttggataacacatctgaagctcaggagagaagtttccattacagattcaggtttggtagttgttctagttttctattgctgtgtaacaaactaccacaaacagtagcctaaaacacacaaaattactatcttacaatttctgtgggtcggagtcaaggcattgcttagctgtgttctctgctcaggttctcatcagcctgaaatcaaggttttggttggggcctcagtcttatctgaggcttggggttctcttccaggctcattggttgttggcagacggttcaggaatctggggagacaagatttttgggagcgccaacccagatgtttccattccatgtgtcagagtcttgttctttcctagccaggcccctgatctggacgtaggagacctgctgcctttgggagttcaacctttgaagcccaacacatacagatttagatatctaatctgtctgtccatccatccatccatccatccatccatccatccatccatccatccatccaatctgtatatctctgagatatataagtgtaataaatgggcgataatcaagtgctggttttggtccttaggtttctctgccctcctgctgcaggagaggagaatctctgtgttttcagagaggttctctggctttcaaacttagttttcaattggaagttaatcagcttttttgtttttatcttttttctttgaaatcaacatctgggagtgaggagcactgggcaaatgcagtgcaggcccagcaccagctttggccaacccccacggggagcctggagcgagaatgggagcctgggacaagaatggctcttctgagttgcccagaattgcggtggctgatgtgtccaggccttcatattgccatatcaattagtcatttgatgtgggttatcttgggaaggatatgaccttgaacagggttgttccttgtaggtgaggcaatccctgaaggggctgactgacagcactcccagcatttaaggtaagtccttttttgaaggaggaactgggtagcacctcagtgtctaccacgatttctctgtatccaccaaatggccaatttgtttttgttttttattatcattattcattcatggatttaaacatatatttagcaaactttctgttaaattatgtgtatagaaaagggcacaaattgtaaatatacagctcagttaaatgttcacaaagtaaacacaccagtgtaaccagtatccagatcaagaaataaaacaatactgtgaatctaggagtcctcctcgtgtttcctttcagtcactgttttccagggatctatcctgacttctaaaatcatgggttgaatttagcatggttttgaaatttatgtaacatcatacaatatgtcttgttctgacttctgtctgtcagtattgtatttgtgaaattaagctcacaattgtaagtcattctcttgctgtatattttttcatggtatgactataccagtttttaaaaaccatttctgctattaacatttggattgttccagttgttgggaattataaaacatgctgctgtaaaacattgttgtgcatgtcttttggtgaacatatatacatttctgttgggtatatatctagtgaaattgctgaatgtgtgtgtgtgtgttcagttttagcagataatgccagtttccaaggtaagtactgagttacatgcctactagtagctcctaagatttccagttgctgtaatttgctcctgtttgtagaagacacagccttcgagggcttatcactgagaactgtatttactaaggtctccactagcagattctgaactcttttgtcctctcgaagctgcaaggctttcaaattctgctttgcttttcagaagtttttagtttagcctttttaccctcttccactcactgaggcatttgagattccctcacgtcttcagttttgccaatctagccctcagtgaacaccagaatctctgatggtttcttcttccattagaggtacattgcctgggaaaaaagccttatttctcaatctgttttcctgaccagaatctgcaaatgccccaggggaaaagcagctgcagaagatccccttacctcattatagctcactctttttggaatcttagtgttgctaatccctattccttcagtagctctctgaattcttcaaacaggtgatttttatatttcatcttttgttagaaattaagtttgtggtgggagctattgttttgcagtaaattattctatcctacatggaaacagtagtatggatttaaatatatttaatatgtttcaataaattgccatccttaagtgttcaaattattacacttttggccagtgggggcctctttaaaattcattcctaaccatttttggcttgaccgttattagtcagtgctgctatctggtatgacaagatgttccggggtcattatgtcttttttttttttttttcctccagacatagaagcagccatttcctaaaggagtccagattccttttactgggaaatggtcgttcaagattacaactgagtgaggattactatgggattggtcattagtcattactatgggattggtcattgtttctaggcattttcattggacagaaatagaaatatgttttttaaagtacaaaataaaatatcttgacttcatatagatacttctatttcaaattcaagactacatttctttactttaccattacttttatttcccatgctgaaagtcttgggtttttagaggcactaggagtcatagaattaaaataccacagaattatttagttcctctctttataccattaaataattagatacatttataccattaaagaattagatacagttttcagttgatttgtttatttttgatttctagacttcttaaaattttaattttatgtttatgtaagttacgtagttctaaaatgaaatctacaaaaacaatatgtattccatatagaatatggattctatccttttcacttctactttcttttcatttcctaaaggcaaccactaatttttttgagcatttcattcttctactgttttgttttgtttcttaatataagaaacatatatttctatctcctccctcttcttagatgaatggaacatactgtgtatattttctccatcttgttttttttttaacttaagatgtgtcctggagattattctatcatttaatgaatttggattcattttttggttttacgttacattttatacatgtcttttatttaagtgtcactgtgttcatgttatttgctctttcagcatatataaatatatacacttatatacatgtacacacacacacatacacacacacacacacacacacattttttgagacagagtcttgctctgttgcccaggctggagtgcagtggggcttagctcactgcagcctctgccccctgggttgaagcaattatcatgcctcagcctcccaagtagctgggattataggcacgcgccaccatggtcaactaatttttttgtattttagtagagatggagtttcagcatgttggccaggctggtctcgattgcctgccttggcctcagcatatatttttgtatttagaaagatttattcagaccagcgttcatactgtgtaatgataaggaatttattgtagaaattagattgtatacagttttgaggggactaagtgaggtgagtatctggaatggggaattggaggatcagaggagtccactaaccagatcgtccaaatcaatgacaatgggtagataagttggagctgttggggaaatctgagaagtcaaatatatccagccactgaagtgagattatgaaggaggagcttgaggagggcactgtgggaagctcttgccatgtaaggtttgtcttacaaagccctgtaggtttgcacccaagcatctggtggtaggtttgggctagtattggtcagcaaagtgaccactggtccaaagaaagagctggacatggagtgaaagagagagagagtaaaagctggaactttctgggtgcctctgtatctgtctctcattgtatgttactgtgaaaccttcagaataatagctgctgcttcgcttccacatttcaaacaaattttatacaggtcgagtatcccgtatctgaaatgcttgggaccagaagtgttttggatttcacatatttttgggttctagaatatttgccttttactcaccgtgatcatccctaatctgaaatgagcatttcctttgagagtcatgttgttgatcaacaagtttggattttagagtgttgtaggtttcagatttttcaattagggatagacagcctgtacaaattaccctttagaccaactctaaccagaaccatatagtgagtgggatctgggaaagtagttcccagcttaacagttaacacaccacgcaccaccagtacaatttgtgtttttgttctggtggttaccattatattaatacctttatatggtattctaatttccttctcttttggggtggaggggtattatgtgttggttttttactctgagcaatattgaaatgaactagaaacctcctttcctcatctcctttttccctagcattttactctcagttaataacaagacaatcaagaaacatattctactatttatatgctctcaccaccctccctctcctcattttgataattgtattgtatctatattatcaagtacataaagcagtcacctaatatactttctcccttattgccaccattctcagttcttttagaaaacacagtgatgctccggctgggcacggtggctcacgcctgtaatcccagcactttgggaggccgaggtgggtggattacctgaggtcaggagttcaagaccagcctgaccaacatggtgaaaccccgtctctactaaaaatacaaaaaaattagccaggcaatggtggtgcatgcctttaatcccagctactagggaggctgaggcaggggaatcgcttcaaccttggaagcagaggttatggtgagctgagattacgccactgcactccagcctgggtgacagagcaaggctctgtctcaaaaaaaaaataaataaataaataaaaatacagtgatgctccacataatgacattttggtcagtgatggactgcatatgtaatgggagtccctcagtattataatatggtatcattaccttttctatgtttagatacacaaacaccatgtgttcaagttgccaagagtattcagtacaataacatgctgtacagttttgtaccctgtataccatatagcctagaggtgtggcaggctatactatctaggattgtataagtacactctgtgatgttcacatgacagtggaatcatgtaaggacacatttctcagaacataccccatcactaaatatatttaatgattcctattaatgtggatgtctttccaattattctggtcatctgaagcatattctctagtatatcctccaggaaaaggaaaagggaacaaaatttccagggttcttgccgtttagcacagtttgtcattgctataaaattgtctctcagtatctgggacattggttccaggaacctccatggacggtgaaatctgtagatgctcaagtccctgatatgaaatggtgtggtatttgcatatagcctacacacatcctcctgtgtactttaaatcatcccttgattactgataatacttaatacaatgtaatactatataaatagttgttatacactattatttagggaataatgacgaaaagtctgtacctgttcagtacagacatactaaaatttattttttgatctgcagtttgttgaatgcatagatggagaactcatggattcagagggctgactgtatttgaattcagtttggctagatataaaatccttggtttatgttttcttctttttttaattatactttaagttctagggtacatgtgcacaatgtgcaggtttgttacatatgtatacatgtgccatgttggtgtgctgcacccattaactcgtcatttacattaggtatatctcctaatgctattcctcccccctccccctaccccacgacaggccccggtgtgtgatgttccccttcctgtgtggtttatgttttctttaaatatcttaaatttattttactttattgttttctgacataaaattttgtcaaagtctgatgagagtctaatttttgggttttttttgtataaataatgtcctctttctgcctgtaagttcaaaagattttttttttcttgttcacggaagttcaaaatatgttaaggtattggtcattctgggtcacttttccaggtgtgtggtatgcacattaaagatacagtttcaagtttttaaaaatttcaataataatttcagcaaagttttcttgaattctagtttctaatatccactttattccattggtttggtttctttctttggtgactcctgttatatgtatgttgaatcttctttttctatctttttttgtcactttattgtaaatttttattatctcgtatgtaatttcttttttatattacaactttcctccttagtccccccttttttttcaacatttgtttactcttaaagcattatcttctgtgttaatttactcttatgtatcttctggttagttttcatttctgaaatgatttatcttctaattctttcttgagttctgtcaacttatttctatctgtaattcttatttgtgttattccacatcttttgtcattttcttaatttctcttggctcactttgaaataataatttacagttttcatctgttggtggatatgtctttttggaaactttgattttctgttgtttagacccttatttttatgtttttctgtttcttactcctttttcttaataataactttacatattatttgaccatagaacttttctgttggcttatttttatgtgaaattaatttttctgaattggtaggagggatttgtaggccaggatagctttgtagctttatgtctctagagcttattctttttttactttcatgaaataaaaaaaaaatggtctcattctttcagagatctcttgttcatctctctctttttcatttttatttggacctttttccttttctccctttacccctgttttcagtttggagttcattctcagcagtttcttctcagtgtgggctagaactgtgctgtccagtcagatctaataattacatgtgtggctacttaaagctaaatttaaataaactttatttaataataacttaaataaactttaaacttttgatttcttgtctataccagctatgttacaagtggttaatagctacatgtgacgactagtggctgttgtattgggcattgcccatgtagagcactatcattaccacagcaaatcctattagacagtgatgcttttgagtgtgctccattctcttgagacttttatcataggcctttttcattcatctgcaaattgcaatgagcataactaccctctgttttggctaatattcctaaattgggctgctgtgctttttattaaggatgcagtacattgggaatctcctcttgtcagatccattagacattctccttccacctgctttctcttgcatagatgcttataccacattagtatttttgttttttgttttccagacacaggatctcgctctgttgcccaggctggagtgcagtggctagatcacagcaactttctgggctcaagcagtcctcctgcctcagcctcttgagtagctggattacaggcacacactaccaagcctagattttttttttttttttttaaagtaaagatgaggtctcactctgttgcccaggctggtcttgaactcctggactcaagcagtcctcctgcctcagcctctcaaagtgctgggattacaggcatgagccattgcgcatgtccccaaccagttttgtaactataaatggtttgtttctatttgttcacttctctgggtttgggaatgagggaccttgtcccttcattttcatgtagatattcatcagtttgtgtttttactagagaagttctagtttctttgattttttttttttttttttttttttttgagacagagtctctgttgcctaggctggagtgcagtggtgcgatctcagctcactgcagcctccacctgctgttcaagccattctcgtgcctcagcctccctagtagctgggattacaggcatgtgccaccacgctcggctaactttttgtatttttagtagagacagggtttcaccatgttggccaggctggtcttgaacttttgacctcaagtgatccacctgccttggtctcccaaagttctgggattacaaatgtgagccaccgcacctggccatttctctgatttttatgggatacttagggagattcaccagctgcattttatgaaaccctagttcaagaaacatactggaaaaggagatatggtcacaaagaataggagatgtttctaagggaaataataaattaaaatgaaagttacagtgacttgtgctcactgaatctaaaacccagctgattaaaaatttggcaaaataaaattaaaaaggttatctgtgctcgtaaacaaaagtcccatttttggcctttcaggtttttttcctccataatctttataattaacattacgaagttctgtagtttctgttctgccccctcctttacactctaaaaatgctgccccaccccgccaatttcatttagtatttccttttttttttttttttttttttatttgagatggagtctcgcccgatcgccaggctggagtgcagtggcgtaatctcggctcactgcaatctctgcctcctgggttcatgccattctcctgcctcagcctcccgagtagcttggattacaggcacgtggcactacacccagctaatttttgtatttttagtagagtctgggttcaccatgttggccaggttggtctcaatctcctgacctcgtggtctgcctgacttggcctccgaaagtgctgggatgagccaccgtgcccagcctatttagtatttctttactatcaaaataatcgtccattattaactgatttagcaaacttgggcatgcccctcggtctctttccacctttagttgtactatgttaaaaatgagaaagttatattcaggtttgtttttttcacagaggaacattgctaggtttctctgttagcattagcagggtttaatattaacagtaagtatgtccatgatgctttaaatacagaatgctatttttgagcagagtagagatgaacttctagacagtggaacttaactcattcacagagaaatgtaaatgtggtcttctcatagaatattttttctcatgggatttgtctgcttgtgttctgttatcccttcaattgtgtagctgagggtgcttatcttactgagtgagtcttactgttttttccccaggttttatagtttgttcttgcttctgaacaatcagcagttgtttgccattattgacaagaagtctagggcatagattttcttgatctgtttttcttttaatgtttgagttcaatggataagggaaacggttgtatgcattttattgcagacattctctgaaataatttttagccacaagcaaatagctctgtttctgtgagtcatcatttcttcttatatagtgctggataaagaattctattttgtagatagagatttatgacttccagaaagaaagctgcaaaaatggaagtttccaaagaatttaagatttgctataataaatgctatcatatattggtgtttgagatgcaaatgtacatatctgtgtatcatatattggaggttgattgaaaatcggagtttgagatgcaagtataggtatctgtggttgatgcagttttcctaaaacgtcatgattttcaatggcaagtaagttatttatggtcgtttttaaggataagctgttaacgtgttttttttttctttttttttcagcttccaataaaaacaggacagcagaacacacataccaaagtcagtactgagcacaacaaggaatgtctaatcaatatttccaaatacaagttttctttggttataagcggcctcactactattttaaagaatgttaacaatatggtgagtatttgggttactgtgttttggggaatttgctttcttttctttttgattaaaaagtttagaacagcatattttgaagtatggaaagtgattttctgtggactttggatataaccattaatcttattttgtttacgagcacagataaccttttaattttattttgtcaaatttttaatcagctgggttttagattcagtgagcacaagtaactgtaactttcattttaatttattatttcccttagaaacatctcctatcttttgtgaccatgtctccttttccagtatgtttcttgaattaggatttcatagagcttttgtggcctacacgaattgaccacagtaatccattacacatatttttctttagcatcttgtttgaatttacttacggttgtcccagccctaagtagatgataaaatatgatctcatagtcctaaaatgtggattgatttttttatgaagatatgtgttttttcttccttctgtaacctgtgacagattctgtagtagttaccctgttgttgaaacagtttttctcaaataccagtttcatcaaataattccactgttaaaagctcataatttctttcttcttcccattttctaaaatcgattgacgtttcctagacttcagagtactccagctgtcctccctctgtacctttgaacatataacatcttttgtctttctcaagtgatcccttcctctctctaaattcctatttaacatctccattctaagctgtttcaaactaacatactcagttcatggcaactgatctggatttttcttgattaactctgaactctctgctggtgtttagcatttatttatttatttatgaatgaataaatgaatgaatgaatgaatgacagggtctcattctgtcacccaggctggagtgcagtggcgcaatctcggcttactgtaacctcccccttcccagttcaagtgattttgctgcctcaggctccccagtagctggaattacaggcatgtgccaccatgctcggctaatttttttgtatttttagtagagacgaggtttcactattttggccaggctggtctcaaactcctgacattaggtgatccgcctgcctcggcctcccaaagtgctgagattacaggtgtgagccaccgcgcccagcctgcatttataatcccagtttgtatttgtttgtattgagttgtgaaacaacttctggttatagattgtgaagattgttcccccttccttttttttgagatggtccttaggtttattagataatattctagtatgacattgaaaagacatgaagttacctttttgccttattcccatattttagataatttttctcttgttctattttatttttaactggcatacaataattgtacatgtttatgggtacatattgatgtttcaatacatataatacatagtgatcccactagggtaattagcatatccatcatctcaatatttatcatttctttgtgttgggaatattgaatattctcttgttatttgaaactatataatgttaactgtaggccaggcatggtggctcacgcctgtaatcccagcactttgggaggccaagacgggcggatcacgaggtcaggagatcaagaccatcctgtctaacatggtgaaaccccgtctctactaaaaaaaaaaaaaaaaaaaacttagcggggtgtggcggcatgtgcctgtagtcccagctactcaggaggctgagacaggagaatggcgtgaacccgggaggcggagcttgtagtgagccaggatgcgccactgcactccagcctgggtgacagagtgagactccgtctcaaaaaaaaaaagttaactatataatgttaacatagtcattctacagtagtacagaacactaagtcttattcttcctataaagctatatttctgtatcctttaacaaatctctacccaccccgattctccctacccgacccttcttacctctagtgtcctctcttctactttttactctttttagcttccacatatgagtgagagcatgtggtgtttaactttttgttcgcatcatccttggtgtgtttccttttaagaaagttgcttacacaataccctaaacttacaaaactaataaactggaggtgtagaaaatcatttaccttctttatggaaaaaattagtattttccccccaaaagcaggaccatttataaataggtaaagagatttacggaaagacatttaacattttttgtagctcctctgttgcagtgtgtggggcacagtttagtatttgcacatatgaatatgtggctgtgttcccagttatattgaaatattttaatatttgggaccctcttttcaaaacaaaacagcattgttatattggcgttcatttagtgcttattaaataagttttcaaaaccatagtctcttgttaataaatacatatgtagtattcattttgaggatagtgagtacttaaaattcactgtggtgctatagcatgtttttgctataaaaattaagactttgatcatttcgtggcataaaagtatagttaaatccccaattcaagattctggtacaggtctatatgtgtgtctaaatcctacatatttttaaagcatgaagcaaaacagcatcttttactgttacaaggttaatggcagactctaataaatgccatttctgtttgccttagactttagtttttatgaggattaggataaaatcagaaataatatatttaagtatagtataatctgggaggtaaaatggaagactattgttgatcttttagtctttcacttttcagatgtgtgttgattggtagcagaaagtgaaactaacttttatgttctgaatatcttttctgttagagaatatttggagaagctgctgaaaaaaatttatatctctctcagttgattatattggatacactggaaaaatgtcttgctggggtaagtaaattgatcttaagtaggcaggctttgtgaatttgatcttgagaatgatcttatgtcccaaagtacagatgtggaccaagaggacagtcctatggacttttgtctgagacatataaatatgagttttgttaatatagctgacctggtgacagacaatttttcatgagaaaattttctcatcttttgtaaattaaacagatattaagtttacttataaaatgttatgtttcagccacgtatctgtctctcaggtttttaggaaaatattttatgaagagatcactatttgatttaacggatctctcagagagttgtgggagagtgcgattcagaagtccaagagtaatcttgtatttcctcctatatgaatatgattttaatattctacttttgaaatttatgtaaatgagaacttaaaaattaaacctattaaggatagatgttaccttgagaacacttgttttatgtagacacacaaatatgcgataggtatgtggaggaggagagtaccaaacaattatttctctggtttcctgtaagttgttaccacagtgtatttcaaccatgacttaatttgaactttttcaagagtatttctattgtgtaaagaaagtatttctatacatcattatccttaattcttcctggaacatggtaagagtttatataaatatataaattaaatacctctgttttaatgatctgcctaatccatgtgtattgaaattaactcatttcttatgttctctcttcctttggctcagaattcagaattttgttttgattcagaattgcttccctcttcacatatgttgcagttctctatagtgaaactagttgaaagagaccttaatatatgaggactgatagtgtggttgagaagtgttggtggaagcattggggtagggcattgaaaaaaaaattatattgacacaactgtgtatccctagggaaggctgtaagcgaaaaaatgtaagcataatatgtatatatatttttcttttgagacagagtctcactctgcggcacaggctgaagtgcagtggcaccctctcggctcattgcaacctccacttcccgggttcaagctattctcatgcctcagcctcccaagtagctgggattacaggcatgtaccaccatgctcagctattttttttgtattttcataagccatgggggttcactatgttggtcaggctagttttgaactcctatcctcaagtgatccgcccattttagcctcccaaactcctgggattacagatgtgaaccactgtgcctgccctaagcataatattttaaattttcttattgaccgttgaccatattccaaaattgtggagacagtgtttataagttttctacttaaaatcgaaggtgagctagttgttttagcatggtattttccgttaacttgtgatatgctattgttcatgtgtaaaatggagtgaaagagcaaaagagctgttacataggatgatggaactgggaagatgggcaaattttaaacttttcttgaatcagttttttccagtggtcttattactttgactgcaaattaccagtatatcagccacacccatgactgaatggtggggcgtggggtcatatattgccttgttcagtttcacagcttttctccattaacatttgtaattgagaggtaataatgaatgtattttggagaatgattaccgatattattggcctctgtttgatttaatactctttgaagatagcctaattgaaatgctaataagtgggcctagtataacttatgtaatgcataaaatgtatattatcttgccgtgctctactgttgaaaaatgtgtatgctttttcattaaatttactatttaaaaagtaatgctatttatattattgaacaattgttttatttccttcagtgattttacagatgtttcttgattcttacttttaaatcaaagtaaattgaggcagtttaagaagaacggagctcacaagtatacgtttgttatacatagttggaatatttaagtgaaagaaaaatacttaccaatatgttatgagtgcaattttgtagaatttgaggaatcttaagtatttttgttcctgtgaatatgactattatttaaaagatttaatacttcttagatttttatttgttagagttaacatctgtattgtttggttagcctataaacaagaaataggcattgtaatgtgaattcacaggtttttgtgaagtctgtttatgtactgtccctatgtttcagtgtatttgcatctgagagtgcttggattgcagttacagaattgagcgtagcatacaattgtacacatttttgttctttgccatcttgctcagtgttattaaaattcttatccgcatgtagttatcaagactgttaggtgaaatagtaatgtggaacagcatacctacaggatagcttatccattgattgtgtgttaattgtaaagtatatatttacaaagtagagatttcactgttaacaccgaagttatcaaacttggtgtcaataacaggaccacctggccttatgttctcatggtgtgatgtaatataacctatagtgaatcccctaaactgtttaacctcaatctaatcagaccattaggtttaaattttagcttacagaaaatatacaggccgggcaccatggctcacgcctggaatcccagcactttgggagatcgagacaggcggagagcttgaggtcaggaatccaagaccagcctggccaacatggcaaaaccccatatctgctaaaaatacaaaaattagccagatgtggtggcacatgtctgtagtcccagctacttgggaggctgaggcaggagaaccacttgaaaccaggaggcagaggttggagtgagccaagattgcgccactgcactccagcctgggccacagagcgagactccatctcaaaaaaaaaaaaaaaaaaaaaagaacgaaaatatacaatacagtaactagaagagcaaatcaacctatgtcactggaaaataattaaatcaaggatatggaacattctgtaaggcagctggcccacttaaagtcatgggaaataagagtggtgaatatgggccaggcgtagtggctcacgcctgtaatcccagcactttgggaggccgaggagggcggatcacttgaggtcaggagttcgagaccagcctagccaacatggcaaaaccccgtctctactaaaaatacaaaaattagctgggcatggtggcgggcgcctgtaatcccagctattagggaggctgaggcaggagaattgctttaaccctggaggtggaagttgcagtgagctgagattgcgcccttgcatagaatagtgaaactaaggaaacatcatgttgtaatcggtgaacttttttggatccttattgaataaaaatgcctatgaaagacattttgggggcagtggtgaaatttgaattcagacttggtattagatgatacaagggaattgtttatttttccttggtgtgttaattgtattgaagttacattagagaaaattcttttaagagatgccaaggcacatggggtgaagtattctatttataatttactttgaaaagatttcaaccaaaataaaattactttgagtaggtagtgtctgttttggtcagtctgcacaaaagcaagtgtgatggctcacccaggaatttacttaaatgtcaagacagatgacacaatgcactcatcaatcaatatgaattaagtcgattctgtaattgtagaactcacagcaaactggggattcccagggaagggctcgtttggtgaacaagagagcaagcaggaatgggaggactggtaaggatggcagggggattgaactttaattgtgattatggggtcagagatggaaccatcctctttattaaactatctatagacagatgtagcaaatatgatgaaacgttaacagttgttaaatctaggtggtgtgtatgtaaggtgttcattatttttgttctgtgtgtgtgtttgaaaattttcataatagaaaatgtttacaggtaaaattaaagtttagaataatgtgattatttctattttagcaaccaaaggacacaatgagattagatgaaacgatgctggtcaaacagttgctgccagaaatctgccattttcttcacacctgtcgtgaaggaaaccagcatgcagctgaacttcggaattctgcctctggggttttattttctctcagctgcaacaacttcaatgcagtctttagtcgcatttctaccaggttagtgtgtaaatccacatgggactactgaagtaatatgaatattagaagttttgttttttgtctacataaaaataaaaagttaatggaaatgaggtttttttgtttttgagacaagttcttttgcccctcacagcagctttgacctcccaggcttaggtgatcctcctacctcagcctccagagaaatgagtttgtctgggcttgcgtagaaattttatgcattaatatctttgacattttaattgcgtaatattgtgatattgatatgtgcaattaaataagagcactgttatgaatgtgaaagtctaaatttcagataaaaatatctgccgtgagcaggctttaaaaaacaatactaggtatgaacttttggtttggctttttaaacatattatccctttaaatgaaactacccaattagatggaataattaatgagagtagtcagaattcaaatactttcacaactctaccctttatcacaagattttaggttaccaaaaaacaaaacaaaaacaaaaacaaaaaaacctaagtgatgtgaaaacacaaggaggtgaataattgcaaagtagaattctccagaaagtggactacattttaaatgtatgtaaaatactgccatttattgagtatttatagcatttcctttgctgtctcatcctcacagtaaccttgatgatacttccctcattttacaggtgagcaaactaatactcaaaaaagttcaggtgatgtgccaaataatggaggacccaaaatttctaagtcaggctggcttcagaatttatattagtttcactataccagattgcttccctatctattttagccacattttgatgaaatctgttttataaaatatacttctgtttttaaagatgtatcaaaaatataatttaagcttttattgatgactcaaaatcatcctgagcattagttgtgatatgctacctacaggtggagaaattagtataggtagtgctctatgggatagaattataagtgacagtagcaagtagctgcaaattgttgttatgcacatgatttgcctttctaaggcaagtaaagtcagatgggttattaacttaattagaaactatagcacaaattatttagtgattcgtgaatcgaagactaataccgaatagagaaaaacaatcctctttgttggtgcctgcatctttggctcgtcagtgttgtacgaacagtggactttgattattcagatttactgattcctttgttgttttccagcaggtgtgaaagacaacatacatcaccatttgagaatttgtgttacggttttttgggggaattgattaacttcagagtcctgcaatctttttaatcaacaatgacatttctataattaagatcctaggcagcaatatttttcaacctcaatgcaattcttgatccaaagaaaattaaagttttatttaatggtatattattgataatcttgggtaatatttacatgatagaaaaatgttttcatgaaatcttttgagcagtaacgttttatattatgaataataatacagtggttgagtcagcaaggtaacaaacacctagagagtaggagggtggaaaattgtatttaataaaaaacgcaaacccttttcatttaggtgactgctaggccggccttactatttgaaacacctgttaaattaaaggtagaaagtggtacaaaaaaacccaaatgtcttgtagtctatcaatgcatgaactgccttatagaacacaacaaatgtgccaccttggaaaattctagaaaatttctagtcaccaaaggttttactttatgggattttgcagcattagcacatgtaaaaataagcaacttttgtttatttcctgaatctagttcactgttgccagaatagaaaccaagtgtctaaaattttattagctttcagaggacagaccactcagaaatggcatctgtgaaataacattgtttcagacaactgcattttcagttccatttagcttgtgtcagaaataggagctgatcttactgaaggatcactcacctaaaagaccattatgatggtttagtttaggttggaacatcttatgctgtcatcgtcatagtattaggtgacttaaaatatgtgtgtggcttgaatggtagttctttctaaagattgatcttatgttttatatataatagatgaatcagtatcatgaagatgtttcgtgtttgtccattctccccgtcaatgtttctcctttaagattaagatttggtttttatatttctgacctttacttttctttaggggaagataggctatagatttatttattttatgtttttgagacacagtctctctctgtcacctagtctggagtgcagtgatgtgaacatgtctcactgcagcctcgacctcctgggctcaagagatcctcccacctcagcctcttgagtagctgggactacaggcacgtgccaccatgcccggctagtttctttaatttttttgtagagacggggtcttgccatgttgcccaggcttgtcttgaacccctgggctcaagggatcctcctgccttggcctcccaaagtgttgggattacaggatgtgagctaccatgcctggctggctataaatcttaagatagctttatttttctctgggagtataccattttctgtggcttatagtatttatgtagcggagtaactgctttctccacagaattactccacaaatgcagttgatctagttgttttgtagtgagaaggtgcttcagaatatctcatttgatataccaccagaagcagaaaactcaatgactttaaaagtcatttggttctttacagtttactatttggttccatacaaatctgttcgttatggtttcttactctttttttaaaaatagttttcagtttttttatatgtctctgatcatttaaaacgtattttacgttctctttagtattgtttaatattgatttgtttgtgctgattcattcatagtgaattgtttcatctcagttttggaatccttgattgcaaagttatctttagtgtggcctgtattttctttgagaatccttgtagccttgggctgagggagtgttctagtgatggttttgcatttgcatttgccaggtgcccagttctggagctatttttttcttaatttctcagtcccagcctgtatgggcagtataaatttgaaccctaaactcttagaaggtaaacagctctaggtgacttttttcactttatccaaagtttaggcagagcagttaagcttctttgtgctggtaggtttttttctttttttctttttgtggggagtgggggcggcagggggagtgcattgttctttctagttcatgttttatgcagggcccaagttagaatcctgaattattagggtacaaggcgtttatatccagtctccatgtggatgttaagccccaagctcctaggttaaggagatcaaaaacctcactcatctttcctttgttgcagggctgggtcatgtacttgtgcacttaactctctggttttcagttttcttcttcttttctggacctatacatttaaaatatctttcagtatgcctagactttctagctgttttagtgataggttttctactgttcatttcttttgctcagactacgctttatttgatttctctgcttcggaaatgatgtttaaccttcacaaaatacctgctctctataagggtaccagactataaaagggacaaaatttttctcccatttttcacaaacaaccacaagagtcaacttttcagaagttggtattgctgatctatgatgttgtgttttctgaggagccgtactccatatttctacgctctttgcagcagctgtggaatttttagcattgaggacaacctcattcccagcttgaaatgctgagcttttcttaccctgatgataggaagagagttcatgtaagtgcttagaatagttgtactgttagctgtagtctaattaaagctaaagtgagtgaaacgagaatttgagaaggaagaataggattgattacattcttatcaactgaaggtttagtgtgatgattaataactcctttgcaaattgcactaaatgattgaaattcaagttaatacatataaattataagaccatatagtatttgtgccttttcaccatatctctattgctgcatttataaaagtttacaatttaattgtgctgcttatattttttatgtctattaatatgaataatgagtatgcctcattaggtagcatgatttaatagattagcaataccaacttttgaaaatctgagtgctgtggttgttggtgtaaaatggaagaaaagtttaatgccttttattaacatttaggctaagtgaatttcttttatcagtttaaaaatatctacatatttgttaagtgttaaatgtttctacgtttgtgataacttcatattcaacataggagaagctggggtttaaacagatattcctgtccttataagcttatgttctgtgaagtagggatattaagcaaataattacataaatacatgtacaaactgtgaaaagtgcaatgaaaaaaggcttactcggttttcaaatacaaagtaaatgtaccctgtgaatataaagtttcattcgtgtttcaaaaatctagttgataaaagtagaagttagtaaaatcaagtttacttattatagttttagtcttaattcaaattatacttttacttgtaattggaaatatgaatttttaaaactattcattgtggaaaaatggaaaaatacacatagaatagtacttcaaatccccatgcatctcttactctgctttaactgtttctggcatgctatggtttctcttcttcccttttcagtaatttaaagcaaaccccagacatcatttcacctgtaaatatttcagtatatatctctaataaatagatttttaagcatttaactataatattgtcatacctatcaagaatcataattccttaatatcatgcattgccaaatttgtgggttttttcattatctcagaaatggcttttttgttttgttcaaattaagatacaaataggatgcgtactttggaattggttgatatttctcctgagcctctgttaatcagtatcatttcttcatttcttcaccttgctctccattttttcccatgctgtttatttgttggactgcgttatttgcctttctacattctgtatttgggtttcattggattcacgttcatttggctggggggggacaagaatactttactgatgatgctatgtggttcctaatgaatcacatcaggaaacatgtcctattattgacttttaatgttatgatcagtgattggatttcgatgttatcagcattatgtattcattatacagtttcccataaatttttcctaatgtttttagtaatcactgatgatcactgcctggattccacttcattgggggctgcaaaatgaaacgttttctattctgtcattcattctttattttaaaattgtgacttctatgaaagatttttgcttcattgtgtgtttagttatcttgcaatacagtccatgtagggaatgcaggatacagacttgacttccattattcgttatcagaatgagttggtaccctaacagttgcgaaaggttacccatgaagttttttctttcaatattataacaggcttgtgtgttttaatttattgtatgtgtttccattgtagacataattcttttgatcctcagattatcccatttttgacagttgagatgcctaaagtgcatacctgtgtgatatttgacatggttctgatagttgttgatagtttcctgttttcaagcccaaggtgacctgccctcaccttgtatatctcttgcccccatcctggaattaactaattttcccaaagaaccctggccgaaagtcggcaatatttagacacctcaatcttaaggataaggatgctacgatgctacgtttactgaattatcatggtttcttttatcatatcccttgtttgttatgttcctttaggtttttataagaaatatttattgccttatttttatatatgtctttactcttatgaactcatctttgggggaagaatctgttgaattcagaatttagggatacccgaagactttttttgtttttgttttttttaagagatagggcccactctgttactcaggctgaagtacagtggtgtgatcacagctcattgcagcttcaaacttctaggctcaagagatcctcctcccttagcctcctgagtagctgggcctataggtgtgtgccatcatgcccagctaatttttgtattttttttagagatgatgtcttgctatgttgcccaggctggtcttgaactcctggcctcaagtggtcctcctgccttggcctcctgaagtgctgggattacaggtgtgagataccacacctgtcccctaatacttaatttgataagttaattttggtttttactttttaggttacaggaattaactgtttgttcagaagacaatgttgatgttcatgatatagaattgttacagtatatcaatgtggattgtgcaaaattaaaacgactcctgaagggtaagtttaaatgtataatatatctgaaaaaaatcactgggtcaaaaactagtatcatgaatgtactaattatattaattgtgctgaactagaacaccaaactggattttataatgacatttccttgtgaaataaccagtaatacaaatgggtaattatttttcaatctttgaaaataatgcagtagagaaaatgagcattttaaatcttggcaatggaaagttttgcttaactacaatttttgttttcaatacagagaatgcaagggtgctattatttcatttttctggaatttgatctctcaagggtggctataggttatagaagctatctgtttagctattgtagcactttacaaagattgtctgtagtaggatatcaaagttttattgcagaatggaacgaggagattgtgatgttatggtgagaggatgaattgagccagagatttcatttctgacatttctgttttcagctctctactgactgactttatagcattacaaagtcccttaaccttccattgccggttttgtctccttgtagaacatgtcagtagtagttccacatggggatattataacacctaatatgtgactttaaagcttgggaagtactttacatgattatgtggattgaaataaacgatcagaaggaattgagatatgttctgtagtaagcagtgatgtgttaatgtaaatcagataccaatgagtattcataaactgagtatgatctgaaggaattgagataaattctgtggtaagcagtgatgtattcatgtaaatcagatatcaatgaatattcataaactgagtatgaatatctaaatttcattttacaaaaaaatgttttttagtttttggcattattagaccctggctaatttagatatgaaaccgtatacagttcacacatatttttatttgtaacttaaggaattgtcaaacaataatatttttaatatctgacctaaaacagattgaattatattagcttcagaaacatcagttctgcaatgtagttttcaaaatacgtgtttttgttttcttaatatttcctttaaactcaataactatctcaccagagatgtaaaaaggcaatacctatataaaggaataatataaagctgtgttctattcatattacccttgttcataatttatgattttaggtcattaccattgtgaaaccaagcaacaattaattcagtaactttaataaaggaaaatataggggtgattttagctgttatgccaagatacaaacatgtggacagcaattattttagattataataaaccaccattgaattaatagttgagatttgcaagattttgatatctattattaagcgttgagcagttgagaaactgaatggtaaaatttagagatctctatgaattaaagttaagaagtattagtgggattttatgatttttcataactattcagtgatgttttggaaacaagtctagtccaggttgcctgtgaatagctgtttaaaacaatagaaatgttcaatccgtaataattaactgaaatgtctcttctgtccaaataagagaaactaattgaatgtgtggataaatgactttcttttatactgaagtaactttcccatcgaatgcggctccctcatgaacataaatttagagtatatgctgataaatatataaagtataaaaccgatattaaataggccagcaaaatatggctcttggtgacagtggtaaaaggaatgcaccctttcagtaatgagtagtaaaggtagtaatgtgttttaaatacaactcaacaagcctttgttgagaaactatgtataagaagccatgctaagtgctgggattacaaaaattaataaaatatggaatctgtccctaaggagctcatggcatggtttatgagacaagtgatgtcattatcaagttatttgcagaaaaaaactatgataaactcaaatagggtgagtgtaaagtgagagaggaagtatatatttgtttgaggggatgagagatgagcaagatgtgaaggtacaagaataggtcagatcattttaataaaaatatggccaggcctggtggctcacacatgtaatccccacactttggggaagccgaggcaggaggattgcttgagccagggcaacatagagagacccccatatatacaaaaaaaaattagctgggtgtgctgacacgcacctgtagtcccagctacttgggaggctgaggtgggaggatcacttgagcccaggaagaggttgaggttgcagtaagctgtgattgtgccactgcattccagcctgggtaacagagtgagatcctgtctctgtctgtctctctgtctctctgtctctctctctctctctctctttctctctttctctcgatatacctatctgtatatagatatatcaatcgatatgtgtatatccagatctgtctatagatatatctgtatcttgatagatatatcgagagagagagagaaacatttgttatattttcagtctgcaccgggccttgcgctatgcagtttgcatgccttttctcatcaattcttacaataaccctgtgacgcaatactagtattaatattatcatctcttgtgtagatgaggaaactgaggcctcagtaaattttcaaagtcacagagctagtaattgttcagtaaagattgagttcacatctgctcgtctctagaacctagatacttgactgctgcactgttgtgcttatgagttacgaagctttattttagtggccctgggaagtgatagaaaggctttgaggtagagaataccttaatcagtattttattttagatatacccctttgcttgaaatttgcaggatggcttggtagagggttacctgaacttctgggacttggttatgcagtaatataagtgaaaaataatgagagttgtggagatccagatgatggattggggtagggtaaggatggggaccagtttgataggtatttaaagaagtggaggctgggcgcagtggctcacacctgtaatcccagcactttgttaggctaaggtgggcggatcactgaggttaggagttcgagaccagcctggccaacatggggaaactccgtctccattaaaaatacaaaaaatgggctgggcgcggtggctcacgcctgtaatcccagcactttgggaggctgaggcaggtggatcacgaggtcaggagaccatcctggctaacacggtgaaacactgtctctactagaaatacaaaaaattagccagtcgtagtggtgggcgcctgtagtcccagcttcttgggaggctgaggcaggagaatggcatgaacccgggaggcagagcttgcagtgagccgagattgtgccactgcactccagcctgggcaacagagtgatactccgtctctaaataaataaataaaataaaataaaaatacaaaaaattagccgggtgtggtggcacgtgcccataatcccagctactcgggtggccgaggcacagcagaatcgcttgagcctgggagatggaggttgtagtgagccgagatcacgccattgcactccagcttggacaacaagaccgaaactccatctaaaaaaaaaaaaaaagaaatggaatacatagcatttgatagtcaatttagatatatgaggttagagagatatcaccaaatattacagaataagctggttagagcagaaaagggaaggaaaggttgatggcagaagagagggtttgaccaggaaaatgataaattcagttttagatcttctgagtttgaggtatcagtaggatgtccaacaagaaacttgtagaactgaaagatactttggctttgagagtagattatggtatataacacatttaagatgtcataaaggtaaagttgttgctaaagagcactgtgaagagtaatgtcattatttggaaatcagtggagggtgagagcaaagagaattcaaaggggtacttttaaaaactgatttggagagttacttatttgcaagtccagaaaaaagactcatctctctcttagacacttacatagatgtaataaaaacctttatcccttcattaaaagtcaacaggagaagttctttgccgagggaccattgccagtaaaatcgcttatagacaggtcattttttccaaacataaatctttttctagatgtggacaataaacttaaagaagaagaaattaaaatacccaatatatttatatggagaaatgtttactgttacttgcgttaaaatgcagtctactattttgaacactccaattagcaaaataaagaaaatgaacatacttttatgatgacaaagataggatgaaggcactttcgtatgctgcttggtgatagcagcatttggcccaaccctagtgaaaggcagcttggtaatctttatcaagggccctaaaaatattcatctctttgactggacacttctagagattccttatcttaaataagcagtgatgtgggaaaagatgttgatatgaaaatatttgttaatgttatttataatagtgaaataacagaaataacctcagtgttaaaactggaaaacattaaataaccagtcacttaatacagtgacttaaatattatgaggggcatcaaagcatactgaaaagaccttggttttaaagcccaattcaatcatttattagatctgtaaccttagacacacagtttgttcatctgtaatactctgaaaacattaagattcaaaaagaattaagtgtatcatactaaaaatacatgatatgttttaatagtttgtgtaatagttactattgcatatagagccatcaaaaataggccaggcacagtggctcacacctgtaatcccagcactttgggaggcctacgtgggcggatcatgaggtcaggagttcgagaccagcctgacgaacatggtgaaaccccatctctactaaaaatacaaaaattagctgggtgtagtggcgcacgcctgtaatcccagctactggggaggctgaagcaggagaatcgcttgaacctgggagacggaggttgcgtgagccaaaattgtgccattgcactccagcctgagcgacagagcaagactccatctcaaaaaaaaaaaaaaaaaaaaaaaaagagtttttactgatacagaaataattagggatactatggaaaagaacaggtttgatacagcttatatgatctcagttatgttaaatatatttgttttctacatgcataggaaaagtggtagaagtaaaaccaccagatgttaactgtgattgtctctgaatgatagaatcattgatggttttaaaaatttcccataaacacctgtgcttttgctttttttttttttttttttttttggacagagtcttgctctgtcgctcaggctggcatgcagtgacatgattatagtacactgtagccttgaaatcctgggctcaagctatcttcccactcctgctttcgaaagtgctgagattataggcgtgagccatcgggcctggccctgtatatgttttccaaattttttaattatactttaagttctggggtacatgtgtagaacatgcaggtttgttacataggtgtccatgtgccatggtggtttgctgcacccatcaacgcatcatctaccttaggtatttttcctaatgctatcccttacctcagcccccaccccccgacaggcaccgatgcgtgatggtcctctccctgtgtacatgtgttcttatggttcatctcccacttatgagtgagaacatgtggtgtttggttttctgttcttgtgtttgctgaaaatgatggtttccagcttcatccatgtccctgcaaaggacgggaacttatccttttctatgtcagcatagtattctgtggtgtatatgtgccacattttctttatccagtctatcattgatgggcatttggattggttccaagtctttgctgttgtgaacagtgctgcagtaaacatacgtgtgcatgtgtctttatagcagaatgatttgtaatcctttgggtatatacccagtaatgggatggctgggtcaaatggtatttctagttctagatccttgaggaatcgccacactgtcttccacaatggttgaactaatttacactcccaccaacagtgtaaaagtgttcctatttctccacattctctccagcatcttttctttcctgactttttaatgatcgccattcttactggcgtgagatggtatctcattgtggttttgatttgcatttctgtaatgaccagtgataatgagcttttctttatatgtttgttgtcttcttttgagaagtgtctgttcatatccttcatctactttttaatggggttgtttgtgtttttcttgtaaatttaagttctttgtaggttctggttattagccctttgtcagatgggtagattgcaaaaattttctcccattctgtaggttgcctgttcactccgatggtagtttcttttgctatgcagaagctctttagtttaattagatcccatttgtcaattttggcatttgttgtcattgcttttggtgtttcagtcatgaagtctttccccatgcctatgtcctgaatggtattgcctaggtttctttctagggtttttatggttttaggtcttatgtttaagtctttaatctatcttgagttaattattgtataaggtgtaaggaaagggtccagtttcagttttctgcatatggctagccagttttgccagtaccatttattaaatagggaatcctttccccattgcttgtttttgtcaggtttgtcaaagatcagatggttgtagatgtgtggtgttatttctgaggcctctgttctgttccattggtctatgtatctgttttggtaccagtaccatgctgttttggttactgtagccttgtatagtttgaagtcaggtagtgtgattcctccagctttgttctttttgcttaggattgtcgtggttatgcgggctcttttctggtttcatatgaaatttaaagtagttttttctaattctgtgaagaaagtcagtggtagtttgatggggatagcattgaatctataaattgctttgggcagtacggccattttcacgatattgattcttcctatcgatgagcatggaatgtttttccgtttgtttgtgtcctctctggctggcatctggcaggtgcccctctgggacaaagcttccagaggtaggaacacgcagcaatctttgttgttccgcagcctctgctggtgatactctggcaaacagggtctggagtggacctccagcaaactccagcagacctgcagcagagggttctgcctgttagaaggaaaactaagaaaggaatagtatcatcatcaacatcaaagaccaaaggtagataaatccacaaaaatgggaagaaaccagtgcaaaaaggctgaaaaaaaaacgagcacgcctcttctcctccaaaggatcacaactccttaccagcaaaggaacgaaactggacaaagaatgagtttgacaaattgacagaagtaggcttcagaagatgggtaataacaaactcctccaagctaaaagagcatgttctaacccaatgcaaggaagctaagaacctggaaaaaaggttagacgaattgctgactagaataaccatcttagagaagaacataaatgacctgatggagctgaaaaatacagcatgagaacttcgtgaagcatacacaagtatcaatagccaaatcaatcaagcagaagaaaggatatcagagattgaagatcaactcaatgaaataaagcgagaagacaagattagagaaaaaagagtgaaaagaaatgaacaaagcctccaagaaatatgggactatgtgaaaagaccaaatctacatttggttagtgtacctgaaagtgatggggaggatggaaaaagttggaaaacactcttcaggatattagcaggagaacttccccaacctagcaaggcaggccaacattcaaattcaggaaatacagagaacactacaaagataatcctcgagaagagcaaccccaagacatataatcgtcagattcaccaaggttgaaatgaaggaaaaaatattaagggcagccagagagaaaggtcgggttacccacaaagggaagcccatcagactgacagcagatctctaggcagaaaccctacaagccagaatagagtgggggccaatattcaacattcttaaagaaaagaattttcatcacagaatttcatatccaggcaaactaagcttcataagcgaaggagaaataaaatactttacagacaagcaaatgctgagagattttgtcaccaccaggcctgccttacaagagctcctgaaggaagcactaagcatggaaaggaacaactggtaccaaccactgcaaaaacataacaaattgtaaagaccatctatgctgtgaagaaactgcatcaactaatgggctaaataaccagctagcatcataataacaaattcacacataacactattaaccttaaatgtaaacgggctaaatgccccaattaaaagacacagactggcaaattggataaagagtcaagacccatcactgtgctgtattcaggagacccatctcacatgcaaagttacacataggctcaaaataaagggttggaggaagatttaccaagcaaatggaaagcaaaaaaaagtagggttgcaatcctagtctctgataaaacagactttaaaccaacaaaaaagatcaaaagagtcaaagaagggtattacataatggtaaagagatcagtgcaacaacaagagctaactaccctaaatatatatgcacccaatacaggaacacccagattcataaagcaagtccttagagacctacaaagagacttagactcccacacaataataatgggagactttaacaccccactgtcaacattagacagatcaacgagacagaaagttaacaaggatatccaggagttgaactcagccctgcaccaagtggacctaatagacatctgcagaactctccaccccaaatcaacagaatgtatattcttctcagcaccacattgcacttattccaaaattgaccacataattggaatacaacactcctcagcaaatgccaaagaatggaaatcataacaaagactctcagaccacagtgcaatcaaactagaactcaggattaaggaactcactctaaaccacacaactacatggaaactgaacaacctgctcctgaatgactactgggaagataacaaaatgaaggcagaaataaagatgttctttgaaaccaatgagaaaaatacacaacgtaccaaaacctctgggatacatttatagcagtgtgtagagggaaatttatagcactaaatgcccacaagataaagcaggaaagatctaaaattgacaccctaacatcacaattaaaagaactagagaagcaagagcaaacaaattcaaaagctagcagaggacaagaaataactaagatcagagcagaactgaaggagatagagacacgaaaaacctttcaaaaaatcaatgagtctcctgacctcgtgatccgccgccttggcctcagtgaaaccccatctctactaaaaatacaaaaaaattagccgggcatggtggcaggcacctgtagtcccagctactcgggagcctgaggcaggagaatggcgtgcacccgggaggcagagcttgcagtgagccaggatcgtgcaactgcactccaacctgggcgacagagcaagactctgtttaaaaaaaaaaaaaaatcaatgaatccaggagctggttttttgaaaagatcaacaaaataaatagaccactagccagactcataaagaagaaagagaggagaatcaaatagacgcaataaaaaatgataaaagggatatcaccaccgatcccacagaaatacaaactaccatcagagaatactataaacacctctgtgcaaataaactagaaaatctagcagtaatggataaattcctggacacatacaccctcccaagactaaaccaggaagaagtcgaatccctgaatagaccaataacaagttctgaaattgaggcaataattaatagcctaccaaccaaaaaaagtccaggaccagatggattcacagccagattcagctagaggaggagctggtaccattccttctgaaactatttcaaacaatagaaaaagagtgaatcctccctaactcattttatgaggccagcatcatggtcataccaaaacctggcagagacacaacaacaagagaaaattttaggctgatatccctgatgaacatcgatgcaaaaatcctcaataaaataatggcaaactgaatccaacaagcacatcaaaaagcttgtccaccatgatcaagttggcttcatccctgggatgcaaggctggtttcaacatatgcaaatcaatgaaagtaatccatcacgtaaacagaaccaatgacaaaaaccacatgattatctcaatagatacagaaaaggcctttgatgaaattcaacagcccttcatgccaaagactctgaataaactagggattgatcaaacatatctcaaaataataagagctatttatgacaaacccacagccaatatcatactgaatgggcaaaaactggaaggattccctttgaaaactggcacaagacaaggatgccctctctcaccactcctattcaaactaatattggaagttctggccagggcaatcaggcaagagaaagaaataaagggtattcggttaggaaaagagaaagtcaaattgcctctgtttgcagatgacatggttgtatgtttagaaaaccccatcgtctcagcccaaaatctccttaagctgataagcaacttcagcaaagtctcaggatacaaaatcaatgtgcaaaaatcacaagcattcctatacaccaataacagacaaacagagagccaaatcatgagtgaactcccattcacaactgctacaaagagaataaaatacctaggaatccaacttacaagggatgtgaaggacctcttcaaggagaactacaaaccactgctctaggaaataagagaggacacaaatggaaaacaattccatgctcatggataggaggaaccaatatcctgtatgtgttttatacttttttttgaaaaagcaagttattaaaagaaaaagctcacaatcattgatgtccaaggcatatttgctgtttatggaatttttctttcctagcagacaactatcgagttttgggtttatgttaggtgtctttacctttcattgcttacagataatattggagcaaaagtaatacgtaaatggaaagttattttgctctgagttgtatttgtgttaacttattctagagttaatttttaaaaattgtgttttttccagaaacagcatttaaatttaaagccctaaagaaggttgcgcagttagcagttataaatagcctggaaaaggtaagttacaacctctctggtattaaaattttgtttttgatgtaaaatttgctgttgttagcatcctgaatcaaaaagttatgacttgagtgatagtttcacattcattttcaggaagaatacattgtaatattattatgaaggaagttagaagtttgtgacattttatttactgtattacaaaaaatcactgtaaagacatgtggttctttatttataggcattttggaactgggtagaaaattatccagatgaatttacaaaactgtaccagatcccacagactgatatggctggtaaggatacgattgattttttttttttttttgtcttttaaatgcctacttgtgacataaaaacctatcatcgttttccaagttatttttgttataaaggtgcttttacatcttctattgtcaactggtgtcaaataggaaatactgtttttctcttacatttctaaattaggcccaaccctcttcctttccttggagcaaacaaagtagtttgaaatgaaggtcagatctttagagctgtgataggatggggtgtttggctctttgttgtagagaagcatgtgctctgaagctttattttgtatttagggagatgtgtataaagtagtaatattctcacctataatgtaagacacaactgcaaggcagagaatacagactcctggagaactttggtaattctttttgggaagctgttcagtctttgttgcttgggtacatcacactttgcataaggcccttcacagtgagactgaatacatgatcatccattctaaaatgtgagcttttccaggatagatcaagatagctcttctaacacatagacagtattacattgcttgtctacttaccagaatgcatttgtgtagttgcttaaatgaagttccatgtttatcttttaaaaatgttgcccttgggtttttacatagtgtcagcttttactttaatgccagggattttgttcctatctaataatgtcatttaatatatttttcatgcagaatgtgcagaaaagctatttgacttggtggatggttttgctgaaagcaccaaacgtaaagcagcagtttggccactacaaatcattctccttatcttgtgtccagaaataatccaggatatatccaaagacgtggttgatgaaaacaacatgaataaggtaaggagggcaaaattatttccattatatctagatgtgaagcagtttattttactcaaggtgtgtattactttaggcttattatttaagcaaagtatttcagggaaccatttaaatgatcattttaggtttctttgtttgatggacttagaagagacatactcatacataattttatttggcagagggaaaataataccaggcaatgaacaaagatttaaaataatcccttagtttcattcttttgtctgagaagactaaacgatacctctgttattattaaacgtagtttctctaatattcactacaaggattgccctacttgagttcatcacttttatagtgtgttatttgcatgtacttagggtatgtgtccatatagtgctactgaaattatctagtaactcattttaagtattttagaacagttttcaaagaattttgccaggaaggtaaggctctcgcatataccatctatagtgaaattggcaccatgacaactggtaattctaggaggctcttaaaatttttttaaatatcacctaggtgattgaaaaaaaaaagaactgagtattaatcctagggttttactgaaatttcaatatgcagtttgttttgcaaatattttttttttcattttttgctgcttttggagaaatactcttagctggctgaacatgagatggtttccttcatggtttgcctgtagatggagatgttcagaatcagctgaatgatttattactttgtagaagtattggaccgggaatttatacattaaagggtaaataaatgaaccaggtaatccttgagagtctgtgattgcgtgttactccacttaggtgtatatctcaacttttccattatgaggacaccatttttcatggtagattgttttggagcccttcaaaatagtaggtttgatgataaatactgagtgtcaacttgattggattgaaggatacaaagtattgatcctgggtgtatctgtgaagttgttgccaaaggagattaacatttgagtcagtgggctgggaaaggcagacccacccttaatctgggtggtgcaccatctaatcagctgccagcatggctggagtataagcaggcagaaaaatgtgaaaagagagacgggcctagcctcccagcctacatctttctcctgtgttggatgcttcctgccctcgaacatcagactccaagttctttagttttggaacttggactggctcttcttgcctcttagcctgcagacggcctattgtgggaccttgtgatcgtgctagttaatagttaatatcccctttatataaatattctattacttctgtccctctagagaaccctaatagagattttggtacaaggagtgtggttctagaggaacggagtattaaggatggagtttcttagtttgtttgggggtttctggagtttgctgcttaatatgattagaccctaaaatattaaggactctacttctaatattgtggagaacactgatagtcgttgctgtgaactgtttagagagtttgcaaaataaatgcatttgacactcctgattcaccgctaatgagaggcaaggagtttagtgaccctatacataataatacctttgaccatatatggagaaccaaggaacataatgaagctggttggttgctcctaaattcagtggacaaagtggtgaaagaaaatgatgggccgggcgcggtggctcacgcctgtaatcccagcactttgggaggccgaggcgggcggatcacgaggtcaggagatcgagaccatcctggctaacacggtgaaaccctgtctctactaaaaatacaaaaaattagccgggcgaggtggcgggcgcctgtagtcccagctactccggaggctgaggcaggagaatggcgtgaaccccagggggcggagcctgcagtgagccgagattgcgccactgcactccagcctgggcgacagcgagactccgtctcaaaaaaaaaaaataaaaaaaaaaaataaaaaaataaaatagaaaatgatgagctcagggattctgtctcctgtcttcagaagcagatactgagcctcaaatctgctaagattgacctgagtgagacccttatctcctgtagaaaaagagctgaaattgtgaaaaaacaaacacaaactcttatcatgcaagtggctgacctgcaacaaaaggtgcatgtacagcctaaccaggtgtctactgttaaagtgtgggcattgattggaaaagaatgggaccctgcaacttggaaagggcatgtgtgggaggaccctgatgaagctggggactctgagtttgtaaactctgatgaaccttttttgccagaagaaacagcttccccatccccagtagtggcaacatcccctccctgagccatgctgccatcagcctttccacttttgtctgaagagataaaccctgcgctgcctgaggcaacaggaatggcctcccctgaggcagttgccaggcaagataatgttgattctcctcagaagccacccccaacacccctgtttgcttctagacctataaccagactaaagtcctagcaggtccctagaggtgaggctgagagtgtgacccatgaggaggtgcgctacactcgtaaagaactgcttgagttttctaatttatataaacaaatcttacttggagagaccttggtcatgtttcacttccacaacatatgacactggtctattacattaatgatattatgctgattggattctgtgagcaagaagtagcaaacgcactggacttattggtgagacgtttgggtgccagaggatgggaaataaatccgagtaaaacttagggaccttctacctcagtaaaatttctagggcttcaggggtgtggggcctgtcaagatattctttctaaggtgaagaatattgctgcatttggcccctcctacaaaaaagaaagaggcacaatgcctagtgggcctacttggattttggaggcaccattcctcatttaggtgtgttactctggcccatttatccagtgacccaaagaactgccagttttgagtggggtccagaacaggagaaggctctgcaacaggtccaggctgctgtgcaagctgctctgccacttgggccatatgacccaacagatccaatggtgcttgaagtgtcagtggcagataaggatgctgtttcgagcctttggcaggcccccataggtaaatcacagcggaggcctctaggattttggagcaaggccctgccatcttctgcagataactactctccttttgagatacagctcttgacctgttactgggctttggtggaaacggaatgtttaactgtgggtcttcaagtcaccttgtgacctgaactgcctatctatgaactgggtgtgttctgacccatctagccgtaaagtgggtcgtgcacagcagcattccatcatcaagtggaagtggtacatacacgatcgggctcaagcaggtcctgaaggcacaagtaagttacatgaggaagtggctcaaatgcccatggtctccactcatgccaccgtaccttctctctccccacctatactgatagcctcatagggagttccctatgatcagttggcagaggaagagaagactagggcctggttcgcagatggttctgcacaatatgcaggcaccacctgaaagtggacagctgcagcactacagcccctttctaggacatccctgaagcatagtggtgaaggggaatcttcccagtgggcagaactttgagcagtgcacgtggttgtgtactttgcgtggaaggagaaatggccagatgtgcgattatatactgattcatgggctggagccagtggtttggctggatggtcagggacttggaagaagcatgattggaaaattggtgacaaagagatttgaggaagaggtatgtggatagacctctctgagtggttaaaaactgtgatgtttgtatctcatgtgagtgctcaccaacaggtgacctcagcagagaaggattttaataatcaagtggatagcgtgacctgttctgtggatgccacttagcctctttccccagctacccctctcctcgcccaatgggcccatgaacaaagtggccatggtggcagggatggaagttatgcatgggcttagcaacgtggacttcactcaccaaggctgacttggctatggccactgctgagtgtccaatttgccagcagcagagaccaacactgagcccttgatatgacatcattcctcagggtgatcagccagctaccttgttgattatattggacctcttccatcacggaaagggcagagatttgtcctcactggaatagacacttactcctgatatgggtttgcctatcctgtatgcaatgcttctgccaagattaccatgcatgggctcaccaaaggccttacccaccatcatggtattccacacagcattgcctctgaccaaggcactcactttacagctaaagaagtgtgccagtgggctcatgctcatggaattcactgtttttgtttgtttgttttttgagatggagtgttgctctgttgccaggctggagtgcagtggcgcgatctcggctcactgcaacctctgcctcccaggttcaagcgattctcctgcctcagccttccgagtacctgggactataggtgtgcgccaccacgcccagctaatttttgtatttttagtagtgatggggtttcaccatgttggccaggatggtctcaatctcttgaccttgtatctgcccccctcggcctcccaaagtctaggattacaggcatgagccaatgtgcctggccacactggtcttaaccatgttcccaaccatcctgaagcagctggattggtagaacagtggaatggccttttgaagtcacaattacaatgccaactagaagacagtactttgcagggctggagcaaagttttccagaaggctgtgtatgctctgaatcagtgtccaatatatggtactgtttctcccatagccaggattcccgggtccaggaatcactcaccatcacccctagtgatccactagaaaatttttcttcccgttcttgagacattatgttctgctggcctagaggtcttagttccagagggaggaacgctgccaccaggagacacaacaacgattccattaaactggaagttaagattgccacctggacacactttgggctcctcctacctttaagtcaacaggctaagaagggagttacagtgttggctggggtgattgaccctgactatcaagatgaaatcagtctactactccatagcggaggtaaagaagagtatgcatggagatccattagggcgtcttttagtattaccatgtattgccatgccctgtgattaaggtaaatgggaaactacaacagccccatccaggcaggactacaaatgacccagacccttcaggaatgaaggtttgggtcactctaccaggaaaaaaaccaccacctgctgaggtgcttgctgaaggcaaagggaatacagaatggctagtagaagaaggtagtcatcaataccagctacgactgcatgaccagctgcagaaacaactgtaattgtcatgagtatttcctcctccttttgttaaaaacatgtttgtgcatgtatacacctgtactaagaaaatatcttcattttatttcctttttcttttatcatatgacttaagatttattgacttcacatcagcattttaagtattgttaacttttagtatttgggttgggataggtgtgtttctggttgtacgaaggataattgtattatgttaggcataattatgactttattgtctttatttaaagattatgtatgatctcaggagatatgtatgggttcaagttgacaaggggtggacttgtgatggttaatactaagtgtcaacttgattggattgaaggatacaaagtattgatcctgggtgtgcctgtgagggtgttgccaaaggagattgacatttgagtcagtgggctgggaaaggcagacccacccttaatctggctggctaccatctaatcagctgccagtgtggctagaatataagcaggcagaaaaatgtgaaaaagagagatgggcctagcctcccagcctccatcttcctcctgtgctggttgcttcctgccctccagcgtcggtcttcaagttcttcagttttggaacttggactggctctccttgctcctcaccctgcagacagcctattgtgggacctcgtgatcgtgtaagttaatgcttaataaactcccctttgtataagtatctattcccttaattctgtccctctagagaaccctgactaatacagtagggtgttttttgttgttgttgtttattggaaaaatagaaataaataaataagctatagattcagtagtactcgagtgaatttacgttttaataatcacaactgtagctttctaagtgtttactggttatttgtgtatcttcagggaattgctgatttttccattgaattgtttgtcttttgttgatttgtaagggtatatgtgtacatttttacttggtttcatttttaaactttatgagttctttttactatatagatatttaaaatttgcatgtagtcacctcagccttgttcctttttgtctcctagcttttttggtcagatctctcttcccagaagatattattcattttattgagatataattcacatatcataaaatttacgtttttgaagtgtaaaattcagcgattttagtacattaacaaagttgtacaatcatcaccattgtttctgtgcagaacattttcatcttcccaaaaagaaacccgttagtaatcactccctgttcctctcgcctcactcgcagcccttggcaaccagtaatctagttttttgtctatagatttacttaattctaaactagacatttcatacaaatggaatcattcagcatgttatgtttttgtctggcaggtgccaagatttttgaagtatgctttttaatttttttctggtattttctagatttaaaagtttagatttttaaatctttctggattaaaaagaaaagtattttttttttttttttttttgagacggtgtttcactcttgttgcccaggctggagtgcaatggcacaatctccgcttagtgcaacccccgcctctcgggttcaagcgattctcctgcctcagcctcctgagtagctggaattacaggcatgcgccaccacgcccggctaattttgtagttttagtagagatggagtttctccatgctggtcaggctggtctcgaactcctgacctcaggtgatctgcctgcctcgggcctcccaaagtgctgggattacaggcatgagccattgcgcctggctaaaaaatgtatttttaaaaatgtattacaaaaaaaaaaaaaaaaaaaagctggccatggtggcaggctcctgtgatcccagctactctggaggctgagccggggagaattgcttgaacctgggaggtggaggttgccatgagctgagatcatgccactgcactccagcctgggcgacagagcgagattccatctcaaaaaacaaaaaaacaaaaaaaataaaatagtattctcacccttttctactcacattccttctgagctggttagtgttattggctggtatgtatccttccagtcacatctatttacccatatattcaaatgcaaaatatacatacgtagggtggtggtggttgtattttaaaatgaaattattttatgcacattactctgcatcgttgtttatctaagaaaatattttagctgttcctcaaaatagttgatagagatctgacacattcctttcagtattaggtaacattctgttacactaatgagcctcatttactcagccatttcactgaatgggtggatattcagatgttttcagttttttgacacttagctaagccttaagtaaatatcttgttcatatatccttgttaactgatgctcttaattctatagactagaatctaaaaactaggggttcctgtgtcaagaacatttgcatttaaaatttgtaatagttattactagatttacattccccaatagttgcagcaggtcagagtttcatccccactgaattgcctattttcctgcatttttgtcaggattagctgttgttaaatctttaaaattttgccacactaataaggtgagatagtatctcatctcaggtattcttaccttctctttcagaggtaaactgtgtgatgtgatggatatgttattaccttgattgtggtactcattttagaatgtataagtttatcagaacatcatgttgtacaccttaaatatatacaatttttatttttcaatcgtacctcaataaagctgaaaaaatgtcattcagaaaggaagcaaacagtagatactagcattaaaaatatgttgtaaattttcaagcatagaatgataacataaggttaggaacaagaatatgtgtatagatttaaatatttatctctgtgaatattaatccatagatacaaatgttgaaggcaagttacaatcttgaagaaaatgaaaattatgttgtgtacctataatatgaaaataaaaaatcacacaaaggcatataccttcactcaaggatgtatactcgagtatacatattatttataatagcgcaaatttgaaaacagcccaaatgtccctcagctggtgaatgaataaaccagtggtgatgccttggaactgtggaatactattcagcaataaaaaggaactactgactcggcaacatgtgtaaatctcaaaaatattatgctaagtgaaagaagccagggtcaagagatgacatactatatgatttcttaaaacttccagagaagacaaaattcaggacagaaagcagatcagtggatgccaggagtgagagttaggggaggaaatttattgcaaaggagcagtaggggattgattgtggtgatgtttgaaatgttctatgtcatgatcgtggttgtagttacatgactattctgaaagttcatatttaataagtgatataaaagaaaaaagtattaatggcttaaacattaattttccaaatgagagcactaattaaaattctcaagtgttgagaacaaagatagtatctcattgtaatttttattctttttaaggttagtgaggtttgaaaacagttcatatgtttctttgccatttgcatgttttcttttgcaggtgcctgttgacttcctttacctattattctgttatgttgcttccagttccttatgaattcgcggaactttttgtatattcagagcagtaatcctacatttttagtctgtaaatgtttttccagtcacctgtttcttttgactatagtatctttttttaaaaagaaatatttgaaatgtacaaagaatgtaacagtttcccatactgctattaacatttttatattttgctcatcttttgagaaatttatatatgtgtccacgaaaagagtcaaactctataaaatattttaagagatttattctgaaccaaatacgagtgaccatggcccgtgacacagccatcaggagttcctgagaacatgtgcccaaagtggttggggtacagcttggtttgatatattttaggaaggcatgaaacatcaatcagatacatttaagaaatacattggtttggtttagaaaggcgcgacaactcaaagtgggggcttccaggccataagtaaatttagacgttgtctggttgacggttgagtttgtctgaagacttgggattaatggaaaggaatgtccaggttaagataaaggattgtggagaccagattttgttgtgcagaggaatctctcagcagacttcagagagagagaaggttgtaaaatgtttcttattagacctaaaagagtgcctggctcttagtcgattaatctcctggatctggaaaggaaagaaggaaaacaaagggaaaaggggattctctatagaatgtggatgttttttccccacaggagactttgcacggcaaatttcaaggtatggcaaggaaatatattttggggctaaatattttttccttgtctcataatgttatgccagagtcagattgaaaagtaagtcacgatatatagcgtcaaataaaacccatctgatgagaatttatggtttgtagggcatgacttcctagaccccttaggtaggagtttgggcaagttaaaaaatcagagctaagtcctcacatggcttttaaaaattgtgaataagtaatacttccataaattctgatttaattacgaatcccactaatttcttttttttctttcccagggacagccactgcaaagggttaaatgtatattcttccagtctagcttttatatttttatgaggatggggagatagacagataggtatatagttcagtgtttctcaaagtgtggtctttagaccagcagcatcagcgtcacctggaaatttgtgagaaatgccagttcttagtttctaactaaatacttagtttctcactaaaaacagccatttttattaagtccttcaggtgattgtgatgcacattgaagtttgagaaccattgttcatctaggtcattgtctttaactgctgtatggtgttccctaaattgaatataccattttttaaaaaagagactaagtcttgctattatgttgcccaggctggtctcaaacttctgggcttatgcgatcttcttccacctcagccttcagatagctgcaactataagcatgcaccaccgcacccagcttgaatgtaccatattttaaattccatattgtcaagcatttaagttacttttctttaaaaaattaacgttattgcaaaggaaacaattggcagagtgaaaagacaacctacaggatgggagaaaatatttgcaaagtatgtatccagcagaggattaatatccagaatatacaaggaactctgatatctcaacagcaaaaaacaaaacaaaacaaaacaaaacaacaacaaaaaatttaaaaatgggcaaaggacctgaatagacatttcttaaaagaagacagacacatgaccaacagatatattttttaaaaaagctcaacatcactagtcatcagggaaatgcaaatcaaaaccacagtgagatatcatctcaccccggttagaatggctactatcaaaaagacaaaaaatagcaaatgctggcaaaggtgtggagataagtgaactcttaaatgtggctagtgggaatgtaaactagtacagccactatggagaacagtgtgaaggttcctcaaaaaactgcaaatagaactaccatgtgatccaacaattcattactggacgtttatccaaaggaagggaaatcagtatattgaagagacatctgtactcccatgtttattgcagcactattcacaatagccaagatatggaatcatcctaagtatctaacaacagatgaatgcgtaaagaaaatatggtatatatacacaatggaatagtattcagccataaaaaagaatgaaattctgtattttgaggcacgtggattgaattggaggacattatattaagtgaaataagccagggacagaacattaaacactgagtgttctcattcatatgtggaagctaaaaaaaagttgatctcagaagtaaaaagtagaacagaatactacaggctgggaaggatagggtgcggggagggtagggaacgatttgttaaaggattcaaaattacaactagataggaagagtaagttctagtgttgtataccactgtaagatggctgtaattaacaatatgttacaaagtttcaaagagctaggaggaggatgttgaatgttcccagcacaaagaaatgataagagatgatgggtatgctaattaccttgatttgatctctgtatagctatgaaaatgttactatgttcttcataaatattaatacatcaaaaaatttaaaattaataattaacaaaagataaagggccctgaactctagttttagagctgaattgtatccagtcagatagtttctatgttatttaaatgttcactttaaatttggagctgaaatatatttggaaatctttacttttagtatgttcatttgtgtgtgtgaggtaaacttggttggctattggcaaatgtattgggtagctgcttaataaaacatttccttccagtgcttcagctttctgatgcttagaaaatatgtataattaacataatatgcattatcacttttgaaagtaactaattattcgaacagttatttgtgccaaattagtaatgtgaatttgggaactatcagtcttttctatggcccggaataatttaaataatagaaattatctgattagatagaaatcattgtaaaatcatcaaggttaggatttcctttgacttttgcttatcattagttttaaagaaaaaaaataaattgacataatggaaattttcactgtacatcaggaagggaattcagtggaaaagtaagcttcctattcactcttgaccttcagtttatactttttttcctaagtcaagtactgctactggtttcttatgctctttctagaactagcctgtttattgtctatttaaaataactcattaatcaccttttatttgagctcccttatggatctgtgtagtttttctgtctctttaaaattttgtatgcggtaaaatgcacgtaacatcaaatttaccatcttagccatttttaagcatacagtttagtagcactatctttcacatcgttgtgcaatcaatctccaaaacctgttcatcttccaaaacaaattctgtatctattaaacagctctccgttcttccctaccctcaactcctggcaaccgtccttttactttctgtctctctgaatttgactacctcatataagtggactcatacagtatttgtctttttgacatgggcttattttacttagcataatgtcctccagttccattcatgttgccttgaaagacaggatttcattcttttttttttatggctgaaatagtattcatccatgttgtagcatgtcaggatttccttcctctttaaggctgagtgatatattccattgtatatatataccaacattttatttatctaaattcatctgccaatggatttttcagttgtttccaccttttggctattataaataatgctactgtgaacatgggtgtacaaataacttcaagaccctgcttttaattcttctgaatatatatccagaagtgtaatttctggatcatatggttattttatttttgattttttgaagaatttctgttgtttttaaagtcacttttgatggtttgttctttgctagaaaatatatatttcagttttatcagtgcagagttgtatataatacttacatattttgtacaattatataaaggttatattatatttccatattctcatataattatctttagtatccatgtttgtaactgtttactcatttctctttcctcattcacgtttactattttattggtctttaaaacctaggctttgattttgtttcctagcatttaaatttttctgtttcattaattttagctttcattttatttatactgttatttcttgaggcaatggcttggttcatctattttcagtttttaaaaaaactgtaaagtatttgtaaggctctaaattttattttattttttagttataggaatttttaatatattctggttattcaccccttatgagatacattatttgcaagtattttctcccactctgtggattgttgtttcatcttcttgatagtgtcgtttgatacacaaaagtttttattttgatgaaatccagtttatctgttttttcttttgttgcctgtgcttttttggtatcatatacaagaaatctttgccaaatccaatgttgaaaatatttttttttcctatattttcttataggagttttatagctttactgttaagttttggtctttgatctattttgagttaatttttgtatatgatgtaagaaaagggtccatcttcattcttttgcatgtggataatcagttttcctagcatcatttgttgaaaagaccatcctttctctattgaatggtcttagcatctttgtcaaaaattggtcatatgtgtgagggtttctttctaggctctctattccattggtctgtatgactgtgcttatgctagtaccacattgttttgattactgtagctttgtagtaagttttcaaataagaaagtgtgagttctccaactttattctttttcaagatagttttgactattatgcggctctttgagattccatatgaattttaggatgggtttttcctttttttttttgagatggagtctcgctctgttgcccaggctggagtacagtggcgcgatctcggctcactacaagctccgcctcccagggtcacgccattctactgcctcagcctcccaagtatctgggactacagggacccgccaccatgcccagctaattttttttgtatttttagtagaaacggggtttcaccatgttagccaggatggtctccatctcctgacctcgtgatctgcccgcctcgacctcccaaagtgctgggattacaggcgtgagccaccgcgcctggctttttttttttttttttttgcaaaaaataccattgggattttgatagggattgcattgaatctgtatattgctttgggtaatattgttaccttaacaatctaggaacgtgagatatctttccatttatttatgtttaatttctttcagcaatgttttgtagttttttattaagtttttcacctccctgattaattcctatgtattttattttggatgctatcgtaagtggaattgttttcttaatttcctttttgtatttttcattgctaatgtatagaaatccagctgatttttgtgtgctgattttgtattctgtgactttgaatttattagctctaacagcttgtttttggtgtgtatgtgtcatctttagggatttctacatatatatcatctgtgaatagacatagttttgcttctttctgtccaaattcaatgaattttccatctttttcttgcctacttgctctgtccggaatttctagtattatgccaaatagaagaagaaaaagtgggcatcctcatcctgttcctgatcttaggggaaaaacgttcaatctttcactattgagtatgttgttagctattggtttttaatacatggcttttacgatgttgaggaaatttccttctattcctagcttgagtgtttttttatcataacaggtgttgaactttgtcaagtggtttctctgtattgattcagatgatcatgtggagtttcttcttcattctattaatgtggtatattacattgattttttcattgttgaatcatcttgtgctcctggagtaagtttcacttggtcatggtgtgtcatccttttaataggctgctgattttgttgagtttttcatcagtattcctagggtgtattagtctgtagttttcctgtagtatttttgtctggctttggtatcggtaatgttggaccatagaactaatgaagagaagtgttcccttctctttaatattctggaagtgtttgagaagcattctttaaatgttgggtggaatcaaccagtgaaagctatctggtcctagccttttctttgggagctttgtgattactgattaatccctttactagttatagttctatttagattttctatttcctcatgagttagtttcggtagactgtgtgtttgtagaaatttgtccattttgtccaggttatccaaattgttggcatacagttttacatagtatcgtctcataattctttttatttttgcaaaatcagtagtgtcaccactttttttgttgttgttgagggggtgggggggatagagtcttgctctttcgcacaggctggagtgcagtgacaagatcttggctcactgcaacctctgcctcctgggttcaagtgattctcctgcttcagcttccctagtagctgggactacaggcatgcaccaccatgcctgtgtaatttttgtcttctttacagtagagatgggggttttaccatgttgatcaggctggtcttaaactcctgacctcaagtgattcgcctgctttggcttcccaaagtgctgggattacaggcatgagccactgcatctggccgtgtcaccactttcatatctgactttagtaatttggtgttctttctctctgtctctcttttatttatttatttttttgttaacctatctagctagagttttgttgactttttcaaagaatcagcttctggttttgtaatttttctccattgtttttctgttctctcttttcactctaatttttattattttctttcttctgctagctttggtgtagtttactctttttctagttccttgaggtatatggttaggttattgaatgagaactttcttattttttgatgtcagtgtttacaggtttacatttttcttttagctctgcattcactgcatcctataagttttagtatgttgtgttttcgttttcatttatctcacgttggtttctaatttcctttgtgattttttcctttgatctattagttaacattcacaaattttcacatatttgtgaattttttagtttttttatctgctgttggtttttcatttccattatgatcacaaaacatactttgtatgatttcagtttctttaaatgtattaagacttattttgtagcctaacataggtctgttttggagaatgttccatgtacacttgagaagaatatattgtgctggtgttgggtgagtttagtttttgacatgttacatttgagcattcatttaggagaaaagccaaaggaagacatttgttaatgaactgtaaagaggggttgacatcacaagaataggtaattttttttgagaaacaaatttagagcaacagaacagccttgaatatattcttatttagaaggctgaaggttgaatataacctggagtgttagaaaagggtggaacagtttatcatagaccagagccaagaaagtataatatttagactttaaatatcaaaaagaagatatggtcagctgaattcaaagttgaaggctaggtgtggtggctcatgcctgtaattctagcactttgggaggctgaggcagaaggatcacttgagcccaggggttcaagaccagcttggccaacatggtgaaatcctgtctctactaaaaatacaaaaattagccaggcatggtggcaggcgcctgtaaacccagctactctggaggctgaggcgggagaatcgcttgaccctgggaggcagaggttgcaatgagccaagatcgtgcctttgtactccagcctgggcaacagaggaagacaccatcttgggaaaaaaaaaaaaaagaagttcagaaaacagcttgtttgggaaggactgttttttgtattcctttaataattcaataaagaaaatagaaaaaggattttttttaaatttgagaaacatttaaatgatgaccactacttaaattatgaaattgaaaaccacaaatataaattatgcattctttatagtatgagttttagaggctgttaatttgctataatattagctacatctggaatagaagaaacttcatatattatcttatcgctatatttgaattctgtagaagttatttctggacagtctacgaaaagctcttgctggccatggaggaagtaggcagctgacagaaagtgctgcaattgcctgtgtcaaactgtgtaaagcaagtacttacatcaattgggaagataactctgtcattttcctacttgttcagtccatggtggttgatcttaaggtaacatgcttattctttctctactacaaactttaagaaaattaaatgaattttctagcataagtattatgtcaaagataattgctaacattaaagttctgactcttcgttgataagttcataggacttgcttttgttgttactgtgttcatcagcctaaatggactgagaatatgaagaaaacaccattttcttaaataagcataaatatacagacttgggtttaaaataatgtggcaattagggcctgaaatgaacctatatatggtataggaagaattgtatcagactgatgaaccacagtatgggtgctttgtgcttcttctggcagctggattttactgccatttgtgtgggtaatgtgttgatgttattacatgttagtaaagaaatactgcatgggtatttaaaggcttttgttttctgttggggtttttatagaacctgctttttaatccaagtaagccattctcaagaggcagtcagcctgcagatgtggatctaatgattgactgccttgtttcttgctttcgtataagccctcacaacaaccaacactttaaggtgagagcattggtttttatctaactatatttactgatgctgttatcctttataaacaaaaagactatagagattaataggttcacttttatcggtatttctcactattatgtattgatgttcgtttcaagaccttaaaaacttagtgttttttttttaaactttctatttgctgttctttttggcttcatttgtattactgagtatttttctcatagaaataatctgcttttttttttctttttctatagatctgcctggctcagaattcaccttctacatttcactatgtgctggtaaattcactccatcgaatcatcaccaatgtaagtccaaaaggtattgctaaattactaaaaaaatttttttctttcttttctttgcgtatttctttttaagaaatgcactcttggttttcaaaaaggttctgaatttagatgtatgaaataggaaaatttctccatggtgattctatttgataattgataaatatttgtatttttcatattaagtcttgaccgaagggaccatattaaggaagatggagttaataagatgctttggaaagattaaatctaaaacgttttattcagatcagaagcccttgagaaaaatgtcactgaaaatacagtttaaaattttcatcccgaagcttttcaaacatattatttcagcatttgatacattgacttgccaccttaccatttaagttaaaagtaatagtatttatgttgtagtctagtatagcacattgacaaaatgatgggactatatttgatggtacttttaaatcttttgatcctaaattcattcatagtgtaaaatttcatttttcttaaacaaaatgaaatattaacatactttaaagtaggtattaacaagatacaaaagcatatcagacaaagtaagtgaaatcattaaaaggtacttgcgaaaccttcaactctgtctgatgtggagacattaaatagacagcaaaactatcagatttggactgtggatttttaaaattctgttcttgtaataatgaacaaccctattttgaaagttttcaagtgttattttccattgttccacttttatcaaatgatactcacatttatgggtaaattggttgatgctttccttccttaaaggaggctgtaatcattgataacttagtatatttgacctgtttataatcaaattccattttaagactgtgcctctggtgagttgaaaataacccttcacctcatttgccctggatgttgtatttatttaaaataaatactgcccatattctatccattcctgcagtggaaaattaactattgataaagctatttggtgatacatttaatttttctcagcaggtgtttagtgagcattttgggaggacagtcctttgttgtgcaggatgccttgggcattgcaggacctttaagatcgtctggcctcatttcattaaatgccagttgtgctgcatctccccatccctagtcattatgaacaaataaacatgcctgagggaatgatacctcctcccttagttgagtatcactgagttaaattgtaggtaaaagtaacattgaatatgctttgttccaaaagggaaagtttaatgaagattgtaaataaggtatgtttgtattaaaaacttaaaaaaaatcactgtacttttgtcagcgtaatgagccagggcattgtaccttcaaggtttactttcaaggccattaaaacaaaaagatgatttctcccctcaagtttatgtgtaactcagaaataagtcattattgcttttttccgctgtggctcagaacactaaaaatattcaaagagtggatagctttgcataaatgcttaaaatttgtatacaataaacccaaatatatacttttttgatactttgtggctagttactttaattgtgaaatatttttgtctacaactgactacatagagcactttcaagcatggacttggcactgctgtaagtggctgagctgctcctttctgggttccaagcatgcctggagtggtgcttcatgcatgcctcagtgtacttggtgaaagtggctgtgcatcctcttctactctaatgagcactgcatgtgtggagggtggagtgtgtctgtatcagagatcaagttatatgaaaatctgtttttataaagaaaaaaactacattgaataatttttaaacattaagtatcagtaacttttcaatgaaatagcttgaaaaggaacataaatattagttcaaagtatctttttaaattatgctttgggtagtgatactttattattatagatagtgtgggaaattgtttctcgttaggatattttcccccttggtttgaggctaatcgctattgaatctgaagtactcttttggttgaaaaggactatttataaagtgaatatagaaatttatgagattgactattttagagtttcatttgaagacatttattatggcaatatttttgtcttgaaaaatcacatgaaattattcttagatatttggacttctgatcttaaattcattcgtagtgtaaattttttttctaatgattcttggttcaatgtacctcataagttctcttctcccatggttctttagccagtccacacattttttttaaagcatcacattctcaaataagataaaagttttagtgatgtgtattgagggtttgtgtagaagtagtaaggtgtttggagttctacttttgtgaaacatactcatactcagttcataagtactgagtttagatctaaaatattctagtgtttcttcttagaaaatctaaaatatatccactatttgattcttattataatgcaggttcctagcagttactaaaatagtagttgtactgtcatcttttttattatgatgtgccataagagatgaattaatagttgtaagatctatgttatatgcataatcttcatagacttcctttaggttaaattagatatgtaattgggaaatttaaaaagtaatatacacacttatgaaccaattatcttagccatcactggtacatgctatagctggtatattacttatttctgttttttccttacgacaatttatcgtaatttacatatggatagttcacatactgaaaatgagatgattgctttctactgagaggttgtagttgaaaggaattgtttccaaggcatttgaaaattatttaaatctcttaaggaattgccacataatttgttcatattatgtaagtgttgccatttggctataaacatggtattttcaaggaaaaaaagagtaagtctactttaattgactggtgttcaggaagggcacatttagtaactgctcaaaatactaaacttttttgccaaccacatgatgtctagtttttcatacttattttatttgaaaatgtgtattttactttaaaatgaatatattatgaaaaatgaaaactatgaaaattactaaatcttaagcctaaagttattttatgtggtgcacctggtaccacaatacggtttcaaaagctattaaaaaaagacacagtaatttgaataggatgttatatgggatgcctttcttagtttatcagtttctgacaagatcttacgagatgtgttgggtaaggaagacccttcactcaatgtactttgttattattcagctttttgttactttaggctgattaacacaagctgtataatttagtaagtataaggaaatcaagttgcattggttgctttgggcaagtcaaaattgctgagagttggaggaatccattatactatcagactaaaaattgatcatttgtagaaactagattaaataaagtaggagttgagggaaaaatgtaaacaaccatactgtcccaaaaaagcatttcttccctcccagttttgggattcctccctgaatggagttcagtattcaaaatgtgtatcataagttggttttatattttactatccggcgaacaggatttgtaatccacagtttgggttaaggtaatataactcgatgctattcaaaatattctgagaattccaagtgaagaaattaaaatgtcgagacttcaattagcttagttttgaataagaaaaaatctgggactgaaatgtgagagatgtgaggctattcaatccctcttatctacaatttgaatgtattattcttccagattttttaaataaacatctggagtattataaattagaagcctacattttaggtcatttaatgcatagtctacatatgtagtgaaaattcatccagtcagttttttattaaatgatagactttaaagatatagtgattttcacaattgtcattttttaataatatatcaagtaattcattttaaagttaaagatacacttccaaataaaataggcactaaaaactagacatcagagttaaacagggtaaattgaaatagaaaatacataaaataattgtttaaaaaatatttcactaggatcagtttgtctttgtttatggtaattgttagtctcccatatatcatgtcatcattgcatatcaatttataggtttacttaatagttttatttcatttactaatttcatgttgtaattatcattgttgtctgtaaacatataagtaatggttttccacatacacttttaatactgtgttgaaccactaatcacttttaaagctttgataatagcattcttacctgggaaaatatatgccatgtatgcacgtgtgccagaaattgtaaaacattaaacttaaaaaaaaaaaaagaagattggctacagattagctctctgaagactttatttttcaaattcactggctaatcatcgagaaaagatgtctcacatgcacatgctcataaagtgggcaatttgtctcatgctcactattatgttttataatataatatgtatgagttagtgtttgaattaaagacgttgtttgaagactttggaaatcatggtgtgtgtttgcatggtcttagaaagttcccgacaaaaggataaaacttaaaactacagtgataaacagagcatacaactcacgtaattttgtactttttcttcctattggtctttgtttttctctagtccgcattggattggtggcctaagattgatgctgtgtattgtcactcggttgaacttcgaaatatgtttggtgaaacacttcataaagcagtgcaaggttgtggagcacacccagcaatacgaatggcaccggtaagataaatcacgaattttgaatctcacctcctttctattgcattttttttagtgtctttatcctattcctgctgctttggttattttagagaattgaatgggtccttcatttcctctaaatgttgtggtatgttgtatctagaatattgttgaatactagattatgtttgttttccactgtttccatgagttgaacttaacttttcttagataaattttctcacaaaacactgaaagtcttaatgaatgtcaccttttttttctgtttttaaagttttttttctccttaaaacttttgaacaaaaatattttgattagcctctcacgttttggggatgagtaagggaagctgactcctgggttagagtgaatgttgctgccaatgcacattttagctaattgaatggtgactattaaacataggaaatgaataaaatttagagtttttgtatttaaaataaaaatattttgtatttcaacaaatatgccttgaggttttacaactgataggaactttgatactgacatttgactctaaacttaataaaaagcagacttaaaattgggtattctcacagattattactcttaatatggaattttaaaactcctatggaatcaatttaaaaagataattataagattgtggaagtcatttttttggtgtttatgtatagcaagagtattatacaagagcaactcttgacattgattggtggtgctttgtcttctgcttcttattttctattattggctgctgtcgctcacatgatcagatgccaaccagtcactgttttgcatggcagtgggcttctgtggctgtaagtatgacccattgtaactacatcagaaaagtccttggtttctttgacttttctgtgtatagttaccattatagtcacatcttgtcatttcaactgaaaatatagcatgtcttcacctgttggttttatctagtaagttagtcatttcacagttaggagataatttaaacagctttctccctggcatgcttctctttttccaagtccccttagtcagtgaaatattttggttttatacagttgtggttcactcttatccagttgtcagtaattatttctgaggattgtttatcttagatgttcaaatagagaagttttttatgtcatatattttgggattattgagcctaaaaaatatagccaaaagatcatggcaatgatgtttccttaagtaaactttaaaatgcaaggttaccttttagttgactttttgtaatgccaagtacttcacttttttttaagttgaagaaattttcagtacaggtataagttaattggaggtaagcataaataatagctgtttaaatgtcatttaataagatatttttaaaaaatcttttaaaactacttgaaataagttgtttaaaagttatttattgacctgtttattccagagatctgggaaatcagaagtttatttgacttttttgctttaagtttactaccttttctggtagaaagttaatgacctccaataataggacttgttggggggttaatattcacttcctatttaacttcaatatccactttaccagctgcccataattttctgtgaataaggactaaaaatgaaactaaatgattattttgaacagaggtaaaatttgattggtagtctaaatatgttctctacacttagaagttattttacttcttagccctagttataagctgattctcagagctacatattattttaccgaaaagccataactagagaggatttcctcttttggctcaaggacacctgtaataagaatttagtttttatttctaattattttctgaaaatatcaatatacatttaattttcaaaatcattcctaagctgtttatgtttttgaaatgttatatgtatgtatatttgtacataatgactaaaggacagcttttgggctgatattaccaggagagaaaataaatagcaaatgtaatatgaaacaatttttagaataagaaaattttaggttttgaatggctgttagggtaaaatctcacccttcataaacttggtgagttaacagtcagataaccagtatggaagtattgaccttctactctttgccaggcaaaggtgctaatgccagggaagcatggtgaactaaacatacacagcacttcccctcaccgagattccaagcaaaaggtttatagcttttgcttgaaaatgtctaatgaagaactcaacaccggacacggtggctaacgtctgtaatcccagcactttgggaggccaaggtgtgcggatcacctgaggtcaggaggtcgagaccagcctggccaacatggtgataccctatatctactaaaaatacaaaaattagccaggcgtggtggtgcatccctgtaattccagctactcaggaggctgaggcagaagaatcgcttgaacctgggaggcagaggttgcagtgaactgagatggcgccattgcaccccagtgtggacaacaagagcgagaatcggtctcaaaaaaaaaatcaaacaaaaaaactcactacaggtggcatggagtctggcaacacaggcaaatatatataataaatggtttacagataatacctaacatcagagtttcctactgttggcactattaacattttggactggataactctgttatagggggctgtactgcgcattgtgggatattcagcagcatctctggcctctacccactagatgccaatattccctttaccccccagccctccaagtcatgaaaaccaaacatgtctccaaacatttccagatgccccttgggggacaaaatcacccccagttgagaactactgtattacagagtatgttcagtgggttgtccctcatttgtattgcctcaaatgatttgggactgataaacctgagccattagcttgcttcagaagtagcaatctaggagttctgttgcaaaacagtaaaagtaaaataatatctgcttcaaggctttactaacactttgtattttggagagacaagttacttgttggaaggagctaattatttgaaaattttctcttcgaccaagatagaatcatgtctctgtcacttacagccatcactgatcctctttctgttggagctctatagaatacttctgattcttccacaaggtggccctgcagatatttgaataaggttattctgtactcctagaattcgttttatttttatatcgttttggcattggaagggattttattcttttagctctctctctttttttttcttcttgagacagagtcccactccgagtcccactctgtcacccaggctggagtgagtgcagtgatgcaatcttggctcactccaacctctaccttccaggttcaagtgatctcctgctttagcctcccgactagctggggttacaggtgcccaccatcatgccagctaattttgtgtttttagtagaccatttagcaccattttgggcaggctactcttgaactgtgacctcaggtgatccacctgcctcagtctcccaaaatgcagggcttataggcatgagccactgtgcctggcctcttttagctctctttaaaactgtatgtgtgtttgttgggtctgtttttatagctaaagaaactgaagcttaaataaagttatattaataacaaatgcatggttaatgaacagtcaaccagagttagttctgaggtttcttgacattcagttcagtgtctttatcaggttctttagttgtccttcttcactagcaagttagcttgatgaaagcagtagctttgtctggcttaatcaacactgaatccctaacgtttgaacaacatctgatacatattgggcatttagtacatgtttgcagaatgaatgaaggaatgaatttcttacttgatgtggtttcaaaatcctcgtacaggccgggcacagtggctcatgcctataataccagcacttagggaggccggggcgggcaggtcacttgagaccaggagtttgagaccaactgggccaacatggtgaaaccttgtctctactaaaaatgcaaaaaaattaggcaggcgtggtggcaggcacttgtagttatagctactcaggaggctgaggcaggagaattgcttgaacccgggaggcggaggttgcagtgagccaagattgtgtcactgcactgtcagcctgggcaacggagcgagactctgtctcaaagaaacaaaaacaaaaaacaaaaaaccctcctgtttctgatttgcttctcttctggaaagaccaacctgacaaaaatttttaaaattaaaatgccatattaagatctgatgttagtgatacagatataatactatgatgtaataattgataaaagctattaaactgctgtgtttgtataccctgtttctattaatacaatctaagatagtattattattttatgttgactttttagttatttaaactctttggccctttttatatgaatgttgagccataacttctcctttgtacctttgtagtatttttttaatatttgaaatgtttgtcttagcactgattttactatttgcaaactaacatctcctgctttcataaaattcaaaactgccaataacagatatatgaattttcacaagtatttgttatttctcaacattttttatcttaagtggcatgctggctcaccagatctttcttacatgcctgttattcagtcacatggtctaaattaacaagtggtttgggcctttaatagatatctgaagactctggttcatgaatttcttcccagacatgattgcctctcatctttggccagatcacatgtaccagcttctattcctactaatacctgcaatatagaagatcaactaatgaatgaatgaatttttttcttacatttctaattaagaaacacattgcttctttagcatgtttttcctcactttctgtaacccactaaaattaaaaggtatttgagatgaattaaatttattggaatttctgaagtcatacatttcatattaggcaaccatgttggaacagaatttacatgttgatatttgggattaagaggtgacataattaaactaatatagtcatacatcacttaatgacagggacatgtcttgagaaatgagtgcatccttagtgattcagtcattgtgcaaacatcatagagtctgcttacatgaacctagatggttatatagcctgctacatacctaggatatatggtctagcctactgctcctaggctgcaaacctagactaaacagcatgttactgtactgaataccttaggcagttgtagcacaatggtaagtatttgtttattcaaacagaaaaggtgcagtaacaatacagtataaaagaaaaaaatgtataggacacttaacacaaatggagtttgcaggactggaagttgctgtgggtgagtcattgagtgagtgttgagtgcatgtgaagcctaggacattacactactgtagacttaaaatttttttaaatttattttacttttaatacttttgcatttttctcatactcaggatctatactgtagactttataaacactacacttaagctatatcaaatttataaaaaatatttttatatgataactttacagtagcttttaaaatataaacttttaaattttttaattttttgacttgtaataacacttagcttaaaacactttgtatagctagctgtataaaatatttttctttatatcctgtaagttttttctatttgaaaatgttctattttaatttttattttgaaaactgttttaagatctgggacacaaacatacacgttagcctaggcctacatggggtcaagatcatcaatcagtgttactgtcttccacctccacatctgctcccattggaaggtttttaggggaaataacgtgtggagctgtcatctcttgtggtaacaatgccttcttctggaatacctactgaaggaccttctgaggctgtgtttcatagttaactttttatctttaagtaggagtataacaatacaaagtatactatagtaggctgggcctggtggctcacgcctgtagtcccagcactttgggaggccaaggcaagtggatcacctgagatcaggagtcgagaccagcctggccaacatggcaaaacctcttctctactaaaaatagaaaaaaattagctgggcgtggtggtgcatgcctgtagtcccagctacttgggaggctgaggcaggagaattgcctgaacccgggaggcagaggttgcagttagccgagatcgcgccactgcactccagcctgggcaacaaagtgagacttggtctcaaaatatatatattataataaatacataaaccagtaacagttatttattctcatcaagtattgtatactgtacataattgtatgtgctatactttttttttatatgactagaagtgaagatttgtttacaccagcatcactacaaacaataacgcattgtgcttggacatcacgatggctatgatactaagtgataggaatttttcagctatgttacatattgtctatcattgactgaaatgttgttttgtggcatatgactctatttacgttttttggaaatgattcttaaggaaaaattctgatacctgctcattgttctctgatcttgtgttcctgtgcaatggctgcatcagggaagagccatttgatagttacacttagttacatcaaagtaaataaattcgtttaatcaaagtttcagcttgatctgaggtgaaacacctcaacttagagtgaggaaaaaaatacagttgaaagagagcaaacagtaaaaccagaatttattaaatcatttagtaaaacatttgctttggggtcagggggcagttataaaaagcaaactatttggaagttttgctatttctcttctgtagtgacattcttgagtataaatgtgtgcattaaatagctattcttccccgcaaggactaaaacccttcggtgttcttgggtataataacaaatgcatatttcacttaaacattgaggatagttcatttgtgttgtagatatgcatgtctgcttcttaactttgaaagacagcctgtttacctggacatttgtattatgggtccacagttggtacacagtcttgttatttctgtattatatatatgtttacataaagacattcattcagaatcagatagttttgtgttcttttcaaggaaaaaaggaaggagatgttttataataataggtgatgttagctctggaatataattgttggatttttggttgaaaaacatttataattattttaattcatcatatgtctctataattgaaacatattttctgtaagtttacctttctgagttctttctgttttacaaatgttcttcaggcaaaatgcatgcattctgtaacttaaaagaggtggagtgccgtcgaaggaaaaagcaaattttacaattaaactagtaaatacaaagattgcctacatgtttcattaattctaagaagcacttatttttactcttctctaaaattgggaatgtatcttattttaaatggtgtcttacaattgacagcagtttttcattccttttgggacatcaaataatgatgcatcttacaattgataatgttgtagagtctatgaaatacttgtatgtatgtctggggaatgtttgttaaataaattacccagtgtgtatatttgtgagaactataggccaaatcttttttcccttatgtttttacattttagaaaatagttttttacatagatgttttacaacctgatactaagcttttagtattgtaatagattttcattgttttattagattgataaaaaaaaatataaatggtgcaaaaacgattttcattgttttgttaagcttaataatactgaccttatgcttactattgagtgtttctactaataccacacatttggtagtataaaaaatagcttttttcaaaggtttttaataataaatttcttttaaaaggttggatagctattatcctgagtcttatgtctgataccatgtttttgttttgtttttagagtcttacatttaaagaaaaagtaacaagccttaaatttaaagaaaaacctacagacctggagacaagaagctataagtatcttctcttgtccatggtgaaactaattcatgcagatccaaagctcttgctttgtgtaagtatttttttatgaaatgtctcaaaattatcacactaagttaattgggtttagctgaaacgccaagaccttgaggataatttttagctcaagagcacttactgatcctttctgatcatacctgaaaactaagacgtctctaagaaaactaatgtataatgaatactaatataattagatcagattcttaattgcccttatcatttcctaacatttctctttcttcttaatttccctatcattaaactaacatactttgatgagatctctgttctcatcctattactaagttatatattattcaggtataatcctggtatgggggatagaagtgaccatcgatcacagtgtctacatctatactgttggtttaaaaaatctccagattgcttttgccagtttagcttttctatccccctttctttgtgttatcagctttctgttatcattggctctgcctacaaatactgtattggaaaaagaatgaggtgaaaatgggtgtggttagtacttgagttagtgtgattatcattattattattattttgagacagggtcttgctctgcttcccaagctagagagcagtggagcagtgatggctcactgccttcgaactcctgacctcaagccatcctccagcctcggcctccccaagtgctgtgattacaggcatgagcccccatgcctggctagtagtcagttattgtcataactactcttactgcctcagatgatattaaatttctgagaacatcactctggtacacagagtaattaggaacaacgcaaataataaaaatgagtcataatgaagtgattaacagcatggacgctggagactacctactagctatgtgatttggatgactatttaatctttctatgccttagttttctcatctgatatattgggatcataatagttcctatctcagagatactgttaggaaaattgaaatagtacatacaatgctttaggaacaatgcctggtgcataataagcactaaataaatgttagctattattgctattaataagatacaatttaacactaattaatgcaccaaatgtaatagttctatattgtgtctttcataggatgacatgtttaacctttgttgagcttcttcagtccctggagagcagcatcaagcaaggtttcttatcgttttgctcagtaactggctttttaaaaagtgttaaggtgctttcgattttggtggcatattttttaaattactgtaatacagggagtttgtaactacatgcctatgattccaagagttctatgaaacttcgtgaattttttaaaaatgtgtatttatgagtaatttttcttggagagtggagaggagagaagaaggaacattcccaaaggatcagtgaccccaaaagaaggcctgtgatactttaagcctgaaaaacccattcaagtttgaaagtctaattagaataaacagatctttggcatgaaaaaattccataaaacctgtcagtgaaactctataaaaaaatgaagttccctttctcttcattcctttgttatgtgttacaagctatttgtggcattatttcatcatgaaggtcacataatactagcagtactctgtttacgtggtgataattcacattcaaagcaggcaccaaactcaccaatgccgtttctactaaatgttgcttcaagaagaatttaagcaaaacttgccattttccaaggatcatttaaaatggaaattatttgctttgctgccatctagtggttaataagttttctcaaggtaaccataagtacattaaaatagaagattcgttgtaaatatttgaccattttgtcttttacataaaaaatctgagtcttagtaatttaggaggaatgtaggaataattattaaatggtctcaatcatggtatttttaaagtaatatgattttgtcttccattttagtactctcaatttctcaagcctcctaattactcagcttgcatcgtttcttagatccccctgatcatttctccacactgaagttatggcagtctctttaaaaagcaaatcttattatgccccctctcagcttgaacccttttagttgaaattgctcttgcttatgaagaccaaactccaaatagatctacagggtcgtgcaaaatctttctcccatctaccatttcttccacatgtagcattacattttttgtcttcctttactctattcatgatggtcttcctttcagtctttctaaccacatgccttcatacctcccttgcagttgcttttccctctgcctagaatctgcttactcttaacatagtaattcctactcattctaagctattgtcactgcactaaggaagcctccctgagtcggacacttttccatgttataggctgtcatagcagcatgtaccttaataatagctcttatgtgatttgcatttttatacttgttgatctgattatttcattgatgatatcttcccccatgagactacatgctcatggaggatgggaaacacatcttctctttttcattgttgtgtctttggcattcaataaaaatgatttggttttggatgaatttatatgaatgtcagaaaataagctaacggttttgaattacagatatattgcagtgagggcttaccttagtcattataatggggaaaaatctatagttagcaaaataaaatatgggacacaagttgcattggcttcatatattcttcttttttttttttctgagacagagtctcactatattgcccaggctagagtgcagtggtgtgatctcagctctctgcaacctccgcctcctgggttgaagtgattctcctgcctcagcctcccaggtagctgagattacaagcacccgccaccaaaccggcttgtacttttaggagagatggggtttcttcatgttggccaggctagtctcgaactcctgacctcaagcactccgcctgccttggcctcccaaagtgctgggattacaggcatgagccaccatgcctggccaaaccatatattcttgaagtgcaaatatatgcttccaagttaagagaaacattttagtctctaaataggtaggcattcggcagggcgtggtcgctcacatctgtaatcccagcatgttgggaagccgaggcaggtggatcacctgaggtcaggagttcgagaccagcctggccaacatggtgaaaccccatctctaataataatgcaaaaattagctagacgtggtggcgcatgcctgtaatcccagctactcgggaggctgaggcaggagaatcggttgaacccaggaggcagaggttgcagtgagccgagatcacgccattgcactccgtttcaaaaaaaaaaaaaaaaaaggtaggcattcacatttttacataacgttaattttctttgcttagtacactatatttttccacgatgaaaaggaccgaagtatgggtatctgccgatgcaaattctagcctttgctttgttaccagctgtgtggatttgggcaggacctttgtatgggtcaagagggctgtacaggataatcatgcaatccttatccaacatgtatgtcctttacctttgatcacaatcatgtataagctcaaaaccagtaagttccaaaccagagatacgttctttagccagtttactattgttggaaaaaaaattattcctcatattgttgatgtaatttttaatgggaattcgtggtttttgttttcattaggattttccctggacattattcacattaatgaacaagtatagatgtggattaaaagaatccctaacaaaagaagttttgatttaataaaatttttattttattgagataaaaatactatacccacataccataaaattcaccatcttaaagtttacaattcagttgttttcagtatatttacaaggttctgcaaccattaccactatgtaattctagaacttttttttctttctttcttttttttcttttttctttttttcttttttccagatggagtctcgctctgccacccaggctggagtgcagcggtgcaatcttggctcactgcaaccaccgcctcccagcttcaagcgattctcctgcctcagcctcccaagtggctgggaccacaggcgcatgccaccacgcctggctaatttttatatttttagtagagatagaatttcaccatattggtcaggctggtctcaaactcctgacttcaggtgatccacccgccactacctcccaaagtcctgggcttacaggcgtgaaccaccgcgtccagcctagttctagaacattgttatcacccctaaaagaaacttggtaccctttagcagtcactgtctatttcttcctccttctaatctctctcgatttatttatttttttaattgaagtttcctttttttccttgcagaatccaagaaaacaggggcccgaaacccaaggcagtacagcagaattaattacagggctcgtccaactggtccctcagtcacacatgccagagattgctcaggaagcaatggaggtaaggggaaaatgaattccatgttcttgaaggaaagattgtaactatgtacattcatgatgttcctttggtgtgtggtttctgtgagtaacaggtagatgtcatttctggaaatggtatgtttatgtctatacattgttttataaaactccatggagaaagaaggggtttacttgctttgtatcacatagcaataacattgtacaaattctgatgcttaataaaatagttcgagattttctaattgcagttgactttaaaatttttaaaaatattattattaaatattaaaaatactaatttttaaattgagacataattcacataccctcaatttggccattttaagtagttcttttttttaaattttattattattgtacttttaagttttaggttacatgcgcacaatgtgcaggtttgttacatatgtatacatgtgccatgttggtgtgctgcacccattaacttgtcatttagcattaggtatatctcctaatggtatccctcccccctcccccctaagtagttcttattcacacagttgtgcaactatagctactctctaatccataacatttttatcaccccagaaagaaacttgactccccattccctcatccctaccaactactaatctattttctgtctctatggatttgcttgttttagatatttcatataaatagaatcatagaatatgtggccttttatgtctggctaccttgacttaatgctttcaaggttcatttatgttgtggtatgaatcactattttcttcctttttattgccaaatatttcattgtatggatctgttttgttcatctagttatcagttggtggacgtttggtgttgtttctactttttagctattacaaataatgctgctatgaacatttgtgtaaaagtctatatgtggacatatctcttaagtatataggagtggaactgctaagtcgtgtggtaactctgtcgaacttttgaggaactgtcaaactctttttctgaagcagctgtatcattttatattcccagtaacaacatatgaaggttttaatagttctgtatgcttgctaacacttcttataatgtgtctttttgattgtagccatcctaatgtacatactgtacaaatgtttatacatacccagtaaaaatgtttataaaaatattttagcacttactacgtaatcattgcttccatttgtgtacattgctattggtcccgtaaattgatacatttcttgtagtctttttggaaggctatttggcaggagctatacaaacatttcatttttttatgcaaataattcaatttctatcactttaaaaatcttatgaatataactcaaaaggaaaaagctgcacacataggtacttattgctcttaattataatagaatattaagagagctttatttactgggaggagaatgggttaatattcaatagtgagaatgctattttaacttggtgagctgttaaacatttattaaaacttatatagatcacacagcaatatggaaaaatatgaaatgtcaagtgagtatactgcatttatggctttgttaaaacatggaaaatacaaaaaaaagaaggcaatatgaaaagaaaattaaagcctggaaaaggctaacacattttctttcaatatgtatttttaaagttttatcaaacaaaaatatagagaatttgtcacttaaaaaaactagtgccagtaaattgtaccacgtttttgtacaatagtagcaaaattgaattttaatttgtgttgtttttccttgatatgagagctataaattatatagctttttaagattctcaacaattaattgcaattttcattaaatatctcaaagtaattacaataaaaatgtttgaaataagataatatgggtctggcctttaaatgttgatatgttgaccaaggactgaaagaaatgtccagagcttcacagtttctgctgggttgggggtggagggatggtgggaggaatgtgaattgggattgtagaattggagttgagataagatcagttcgaaggaagagtttgtgttttttttatatctttgatggttttaatttatataataatctatttatatgttatatattgtaaatgaattatttaattcccgttagtgttctctgagccagattccaacttcagttctgtggtcaattgaaatactttagaatggataatctgctatgaaatactgaatccattttgcttcctctctcttgattttgaaaaataattgctcttttctgttacaagagactttgtggcaagtgagacagtttaagtaaaaacttaaaagataagtaaatcttttgctgtgtgtattaattttggcaagccttcttacttggggattagctttttgtttcatagagttctttaatatctattgaaattattttgtttgtttcttaaagcagtttttacagttatatattgttccgaattcatcatttagctttatatgtacatgccagttagagtcagaatgatgggaataaaatgatttcattctgtctgtattattccctagaggtttgtgttcaccagagtttctctctttttaccttttactatatattgaaactacaaatgaaagagctcaatttcttagcatttataaaataagtactccagtgttatgtttaccaaaaatgtttgagtgagtcttctctttgtctttctcttttttaaaaaattcaggctctgctggttcttcatcagttagatagcattgatttgtggaatcctgatgctcctgtagaaacattttgggagattaggtatatgtacttttattttttaaattcaacttttaaattttattttgtatttttgtcttgaaatattaactctgtagtacttagtacattgtaaaacttacacttccaaaggttttatggttttgtattttatttgacttcaaattattagaatttcttgttttaactgtaagaaaagtatcacagcaatttagaaaataaattttaagaatagtgctaaattttgtcaccctaacataagtactgttgtttggtatattacttttttcagatttcaatgtggttactactgtatttttaatagattttcatagttataagcctagaatgataaaattttgtaacaatactgttttttcagttttttgaactatgatctttcataaactttctgtaataccaatgctttcgatgaatgaattaataatggacacctgcttagaagaaaaaaatgtatgcagaattttgtggtctgcttcctagattatacaaatcattacattttaatgagcatgaagtcaccacacggaggaaaatgtaaatgtgtaaacctcaagtttgccattatcttataagaatgggtgtgctaagttacttggcagctgaattaaaccttactctagagtagtgctgtccactagtaatataatgagaaccccatatgttaaaaacttttttacttactacattaaagagtaaaaagaagcaggtaaaattaattgtaattatgttttgtttaacccggtgtatattatctataatttcaacatgtaatcaatataaaagttattaatgacatttcattctcttttttttaataaagtcttcaaacttt

SEQ ID NO: 156 - DNA, 232205 bp, Homo sapiens
ccagagtctgtagcatagctcattttattgtttaaacagtttttgcataggaaatatatccgcttccagtaattgactgcagtatgagcagctgctagcagtataggctggatataacagtaacaatcacattaagtcaagcttgatttacaccagtttaaaacttgtggcaattgagttcatttgcaacccacaaaaagtacccaaagaacgttatcctccaaccgggcacaataaaaccttcactaacattctggcccagtctggggttgatcccagaggcctgaactctagaaattaagtaactgtcgtataatacatcctactgctaaaggtttgttacatggagattgtgcatgtgcctccttttgtaaaaaaatttaattaaaatacaaggttctgtatttatggcccatgaggacaaaatgccaaaagttttaaaatggatcaaccctggtgtgtagctagcaagcaataactgactactcgtcacctacagttgtactaaatgtatctaaagaaacacacagtcctacaaaagttgttctcagagaaatatcattgaggtgggggcagctcttcccaggatgctaaaagttctatatgatataagcacaaattaacagcttgatgaagacataatctactgcagctttgagaaacctatgcctgggatgtagttacccctcacattctacaatgttgtagagattttttttcccaagaaaatgtcatttgaaacatatttacaactgaactcaacagagactgtgaaattgaacaggcactgctcatttgtttgagttttttggtaaacattttgctggttttttttttttgtttgtttctttcttgttttgcatcaacttttatcagtccatgcaacttcaatgccctcgatgaaggatgcataaaaagccatacttcttaaaaaaaaaaaaaagaaaaaaaaagacttccttctgcataaagagatatatttgccacatcagtccctgtagcacagttttcaaaaccattctgtcaaaaatacagtaatacaagactggctttagtgtcactagcttacactgcttttcatgtatttaggccacctgttgttcctggtactgtatcatgcaataagtcatcaagggcttagtctagtgtaccggtaagctagtggcactgaagcgcttttcacaatctcaacatacatttgaattgcaacacacagatatttctagagtattaactagtgaacccttttattattaaaaaaaaaaaaaaactacttacaaccattgaagaaaaaattgcaacaaaaaatgtaaaaattgaccgtctccaacttgtcccctttactattaacaatgtgaccaacagatctgtggcacggacacagtacaaagagttgtcatggcaatgagtttggctgatgcaaaggtcattgtgcagggtcaaagggcaaaatcagtggtccatgttaccccccaactgcagggctccactccacccacacaattttagggaattagaaaaaacaggggaactaccagaaagtgcaaaatatgaagaaggcagctttcagctccttcagcatggagtagaacattcatttttgagcttttactattgaacttgaatagcctgcacattaaaaaaaaaaaaaaaaaaaaagttttctatagaaacccaatttcttaaagtccagaaagcatgcagctggttaatgttaacaaaagaccttgacaggaacatgtaaactatattgaatgtcatgcttggggcctatctgccagcaatattgtagagttgtttcattaaaaatgaatactgtacactgaatatgggataactttctgcagccttcatcatttcacacagtacatagaatttgaatctaggtaaagaacatgtcctgctgtcacaccgctgaagatgtccctgtgcaatctctttcgttgagtccttatgaagctacaagtcacaaatccaagattctgctccctgaggacacgttatgtgagacatagcactgttttagttttctgcctatcctgaatgctctgtgaaacttaaccttaaataccatcacgtaacaatcacaaaaacttttgctaaaggccgtatatactaataaaaagacagtggtgcttcgacattctgaaatgctctggaaaccaacttttccaatactaaatacaacaaaataaccttcataaaatataacttttctccatttacacttttttaaaggattagtatcctatgcttttcaagcacaggaatctgtgaaataactcctaacatggacagattttctttttaatacataacttaagagactggagagttttaactcaagtccagtctctaaacaaggaatattcttgtttactttaaaaatggaaacaacatatagttccattataattgttaaaaagttagctttacaaacatgggaattttaatttaaaaaaaattcttaacaaaactatacagtgtacaaattactgtctacaaggtaggcggttcattaagaagacctttcgctcttctcgctacttgcagcttcacagattcattcacatattttttaatggagctgcccacccgaacattacccgataactatattgctataattaagatttttgccatgtctttatgtacagtctccttcactgccttttatttttttccttagacaagcctcaaatgctcacgtcactccaggggtaacacgcttcagaggcactgtgagtggtgggtggcagggcagcacacaaaggctgaacagtgccacggaactgatggttggagacaccactccctactcatgcccttgggtgaccttcgccatcctgaagctctgcagttctgggtaagggaggggcgtgcaagacctgcaaaagtggggcccttcgtcagaatatacttcctggtacacgaggaggaggccgaaaagttgatttgagattttatatatatagtagtacttttaatagttttatctcaaaaaggaaagaagaaaaaattgatttgaaataaaaaaagcaacacttgaactaggcctttgtattcaagaggcaggcaggaatacccacagtgtgtaacttggttagctagaactgctcactggcaaaaaagagagcgagtctgcctttaaaaaatactgtgtgtcctgtgaggttcatttgttcacctaataggtcaaagatacatgaagagcttggctgagatgatctgtttgctaccagggcgagtatcacagaaatgattggacttacttttgaacttgcactgctaggatcccgctgtgctgttcagcatttgggctatcaaactgaatgggctaatcaaatacaattctccagcccataagcattgttctaaagtattcattattaaatgatatgctgtgagaacaattgacagtttattttattaggccatggcctaggggaagggggccaggggactccttaagacagcctaccatgtgtcaccaattctgaaagattttccttctagtaatgaatacactcaatgggactgggcggtgagggaaaggcaaaataaaaccagcctccattcagcctctagccctcaggggaaacgaaatcaaatatatagttaaggtaccattccttaaaaaaatcccatcagcatctaatgggtttaattcatccacaggaagattaattgcttaaaattctatatttcccttctgctctggttctcagttttaaaaggggagataaaatgaaaacaggatttacttttttgttccttaaaaattgaactttgattttaatctatcagtccaaatacattcaacaatagcaaccctctgttcaatcttctggatattaaaaaaaaatccaagtgcactgccatccatttgaagtagtaagtcacaggtaaatcatatcctatcattaatgaaatgaaatggggacgaaaagtggcagaaaaggaatacgggagactccctccaacaggtctaatgtgttttctaggagaaagaatattcatgtgttaaactctcaaaagtgttaaacatccaacatcccctatgtggacatttcaacaaatatttttgccaaatatgagacaggctcactctccactgtggatctggaactttcaagaaaaactatcaccaagccaagtctgcctttttaagccaagtctgcctccaggagaatttgttgtgtttgcttgttcttactattgtgttgttatgaaaaccagtaatgagttcagcttgcaacccaggtgggaagttagagaggggaacctgtgtaagttgaagtttgtcacagtaggcagaacagtcgctttgcagcccaggcccatctcagggtgcactgcttcacagctacactgcaaagtgttaaaaatcctcccacccaccccagaatatatatatatgtatattaaaaaaaatcccctgtccatctctcagtacacaaaaggacctcatcacactgcaaaaatagcagtacccactttggtcaattaaaacaaacaaacaaacaaaaaagcatacattattttttttttaaatctgtgtacttacctataataaccaatacagctaaaagcactacctacataggcaaaacttggtattgcataattcgtataaatttgaaacccctcccccccaaatattaattggaagatgaaaaacatgaaaggttaatagaaaaaaacaccaaaatactgaaaatattgctggtcgattacaatttttaagcggcaactatacacagccatgatatgctttataaatgtgagataaaggtataactgtctaaaaaatccatgatgtcacacatttttcttcgtctggagtacaaaatattttgtcataaaaatggtaaagatttaaaatgataataaatgcagcaaaacaagtgtagtgatgtcactttgttgtatttttttgtttttttttttttgttttttgttttttagatttcaaggcaaggcacgtaatgtggacattatatcttcgtgcaaattaggattactggaaagagtatttttaattaaaattttaagagacatagaggcaaaatgtgtctgcccatgcacactatggatctgtcaatacaagaaatttgttgaacaaggctaatgtctgaaagcaccatgcaagttttcagcaccctgattacatttgttttctcaagagtgcgtttttatatcctacaccctggcgttcccagtttgtaaactgtaagctttacccttgtgacatggatttgcctgcctctttgtctctataatgcagattttatagaaccttttgtacaccctatgggttcttgatgcaaccagtaattttaaataaataaattctacctccaaggaggctgcagctaaaccaacataagtgctgtgttttcattaattttatttttctcaagcacatgatttgtcttgatttaatgcctttttaatgccctcaaaaactgaggggaaaataaattcgttcaaaattattttaaattctttttaatcccctcaatttagagtccaagggctgaaggacttataatcatgattcccctttagatataaatttataaattgcacttgcctctgttaagtgtttcttttgtggggaaaatattatattaatttttactgttgcatgcagagagaacacttcacctacatagaggcatttcttccatagagcctttgtgttcaaactgtttttttccttttttctttttttcctttttttttcattttttctttttttaagatttcaaactgggttacacactggaaaaggctgggttaagggccgaaatttaataaatctgtactgataactaaaggctacagagatttcatatattttttttaacttttagaaatcagagtgcttataaaatggctggctcatggctctgtcacccagcacctctgacgccgcctcctagccttcgttggtgagataaccaggaatagtgattccatgcgtaaacaacaagaatactaaaccaataaaactagcttatcatgcaaatattaaggcatctagaaagtcagttaaaatatattgtcatagagacagaacatctatttcccagcggacttcatgtaacaaaggctacgttgcaggggctgcgatctaccatcagtgaaatatcatcgaccctttttatgtcattacagtttcaaccttaagggaattagtgattgtaagtgctgcaattgctggtctattatcttctttcttcagtttctttcctttctgcctttgtgttgttttgtccagtcttcctcttttcctttttttttatttaaaaaaaaaatttcttaaactattgttgtgtttctttttccctcagttgcttgtttctgcttgaaggaaaggttctccaattatgttcaaaccgtaattttggacattggccggtaagatgggtgtcctatttgacacttggaaaggaaccaagctagcccaggtaccaggactgttgagaggagagaggcagcagggagggaagaaaaaagaaaaaaatacaatgttaaaatctacaacaatatgagaaatataaattccagatgcatcaaattattgctatccctattttcaaaattacagtctaatatgagataaatgtgccaaattatacatgttacacctatctaaactctatagtctattttttaaatgaaaattaagactaaagtgaggcagaaaaatccagagtaagatatataaacaattattgaattctaaccgattgaggatattctaaaatattttacattaatcaatataaatgcaatatcattcttttttgtacaggaaaaaaaagaaaaagaaaagcagcaatctgttggtaccaatatactttgccagttacattctaatcttattttacctttaattcacaagcaattcagtggtcagatgggtttcaatttcttacctgcctattgggttgaatacaattgaaaagtacggtgaaagatatttcttttctccttacaacaggaaaaaaaactacatgtttaaggtaggcccatgcataacatacaatttgaaatgcccaattatcaaacataccttaatcagagttttttagtaaagaccgaacaaataagaatcatagaaccaaaatggaacacagctttttttgttctctacagaatacccatcgtgaggaaaaacatttacaggaggccacaaaggtctctgcttgcactgattagttctatagctctccagcagttttcttattctaaccctctttaacttacttttagagagagccacagcttttccttccaattcatggttccctacattggcttgcaacagaagcctgagcatttcctgctcctccccatcagtaatgataccacatttgagctgctctgcacttgaggagtttggagtgatagatggcgggttgggggttgggggtgttggaggcagtaaatgataagattccagccttactctcatcagttcaactttcgcctatgctgaattacaggctgttaaaaaaaaaaaaaaaagactggaaaacaattctctaattgctactagcataatctccctttaaaaagtatcatatggaggataaaaaaaatcagatctacatatcatgaaacaactctacagcacacattttgggtacacttaatctaatgtattgcctgttccaacactcaaatccgaatgaatgtcagttaagtaacagctgcataaataatcatgaaccaagaaaacatcaaactgacaattcagtactcatattagtcatggcctagcatggaaacatactttcgaggttttaaatttcactgaacatcctttgctttacttttgaaaccatgaagtgagatagcactattgttgtagctatcaatctagatatgctcatttgttcatatttgaattccaaaagtacaaaaacctttacagaatatcaacctaaaggaacaattctgaattttttttaaaacttgatacatactgtttttactctggtgatacctcgatacaaaatgttgcttgttgctacacatacatatttctgagttaacatttcaaaacaatatcacaacgaccatttgtgctcaagggattttataattagactacaaactcaatgacagcaaagtccgtctctagtaaagtacctagcacatggaagatgctcaatacctttttagacaaacaaatcaattaattgtttcaaatcacacccagctatatattttcaaaagctgtcacccaagattacatatactcatgaatatgttgtgatttgatcccctataaaaagaaaataggtatctctgaatttaaaattagatctacttagcattaacaaaaattgattaagcaggaataatcacattcaaactaaaaagacacgtcctcaaaatctgatgaaaaatcgtaactcttaagaatacttgttattgaaacttttactaagcagcttaactgttttcacatatttatcttcccacacacatcttcaacaattatttttgtgctttgcaccattgattgggaacaatgttacataatgaatcatgaaacttattttaccctcaactgtgtttccactgcactttgtacatggtcctgttacagcatttattacttcataaatatctctatctgggattatcttactaactgaaaggtgaacttcacagagaaaacgacctagtcacatctatctttatagagtctgagcatagctggtgctatttcttaacaaataaaataaattacaaaaatggttatacattatttttaacttgaagtaagaagcatgtaccaaaagcaaaaggactaggtaaagcagataatccttgacagtaaaatacaatgtcaacaagcagcaaattgctttgcaaaattaacaagagtgccaaattaagtgagctcaagaaagtcatttggagattgcatgctttagggatataaagtatattttaatgattgaaaatagatgtggctccttacatggacaagtctaccaactaatggcagaaaactcagggtttattttgcaatagctctcttactcagttctttagaagagacatatgtcattattctttggaaaatgttcaataaaaataaattgatgctagtaactaacaggactcttgctgcagaatgcctaccaaatttaatttaaatgtttatttaaatctttcaaaccgcccatcctacattatgaccatatcaaaattgcagagtgcaatatatttgtcaatactgtttatgaacctttgggggaaaataaatctcaaacattaacactatgcagaccccatatatgagttttacaagtctcttattgccaatttaagttcagaactataaggcacagacattttttagagctatttttggtagtcctgttaaaaaaaaaaacttgataaaactaattcaatgactgagataacaatgtaaataaatatatttaattaaagtaatacagattatttaatttcaaaaatgcaatgtctaaaattgcatacttactcaggtaaaaatgtaatagtgctttttatacatctaactctatataaaaatcaataatcacatgtatggataaaataaacacacaaaaacaaattagttacatgtaaaatgcttaatagttttaattcatagtgagaattactatatggataatcttatgttcattccaactatctgcattccaataaaagaaatgagaatataactgaaaggatttcaaaatattcaagctcaaattcagctacttcagcaatatatctttataagtgtgcatttcctttgttttaatcaaatttttcattaccaaatcacatttgtttaggcaaagagaagatgagcatagctgaaagttgaaagcacatctttagaaaatataaagtagatataaccatttaaaaaagaaaagatataattactttgcaaaaaaatcaagcagaaaaaaacacaaaagaatttgatagtaccttaacacaaagtacagctcatcctaatgactattactatgcatataatgagatagttcattataaaatgaatacataagagctaaatcaaaattccaaaaataaaatgtttgatatcatggatactattttcttgctattttgaccaaatgtatgacatggctccccccaaaagggaagaagcaaatgaattatttagagcttaagatgcattactggtgatggtcctgcttcattttgttattggtaagactacctctgaagtactgtatttcttctaggtagcactgtggaagaaaacctaactttatggcatttacttattgaaaaactcaccaaattatgtcattgcagaacagctaagggtagacagggaagatatagcagttgatgtggaaaggaatgtagaccgcttaagcatgcttcaggttgtagcaacagcacaaaggcaaaacttccagacgatagccatgctgaggacttaactataagcatggtaccatctttggtgttttacatatgctacaccacttaattttctcagtgagctcatgagatggccatcagtatctctgtttcacatatgaggaaactgaggcaagttaagttccttgcccaaagtctcccacttagccctcagttatgactcagatctgtctgatttccctggccatttcactatattatattgcctacacaggaagtcagatgacttaacataagaaagaacttttgaacagagtggtctgaaggcaaaattaattggcttcaggagacagtgaacttttcatgcaccatacaagctggattataacctagctaatgttgcgaaagagactagtgcacagaatatgtagctggtctaagtggtcaaatgatctgaaattctatgtattcatctcctctgaaacaaatctagttgaagttctactagggtgagttctacagcgtgaggattaaggcggaagaagatacccacttcttccttttaaaaagatgcactatttctatatgtcttatcctggataaactgggcaaaatagttcatcttcgcatctacctacaaagagtaaagagctatacctttcagtgaaagaaaggcagaaattgctctcggcagccataccaacattttctggttatgtttttttaaaattatgcattatgggagtgtgtcttctaggccaaaaagaattgggcccttaccttttagctcactaacacctaggaaccacagggtgccacattaaacatgtatgaagccattacattgagccagaaaccaaacaaagtcaaagactttacatcacctattatttatttggaggtgatgaaacaataagagctattttaagaatggcaaaaatcatttattactagcctgtgtgtatttgataatggatgagataacacactagttaaacagtttatgaaatgtctaagtatccagtatacgaatatttttcaggggaacaatagtattgtccatttagaatttatatactggtttaatcatgagaaaataccatatttacttaaaagatagtaaatactctttcaagaagcttaaaaaatattacaggaaaaaagcacaaagagttgtacatattaatacatacctcaactgtaacagtagccacattatttacagatggcaataaaaatgagcaatggcccagaaagcatggggaataaataaaataagtattttaatttaaaagaagcatttgcctttagttcctttgcaacatttcctgatctccccaagatggaaaggtttttacttccttggctaaacactctaattttattggcaaaatattaacacacaagtattagcatttcttgtaaaatgcacaataaacagttctccttattaattgctgaaaacctgttgggaaaactgtgctgccctgggttgtacatgggtgcattcggactggttgcttacttcaatataacacaaaggctgcagattacgtcttgtgaaaaaaatgctcgctcagaccagtagaaggaacaaacacttaagttgaatctatttatgtattagaacaaagaaaatagtacttgataaatataccagttgctagcacttatataatgtgtattatttgccaggtactgttctacatgcttgacctaccttaaaacttttaatcctcataacaaatctatgagaaagaccattattatcctgattttacagatgaggaaactgaagcgaggaagttaagtgtcttgcccaactcgtattgctattaaattgtagaaggcaggatttgaattcgagcaatgtcattctaggatctgtatttctacccactaaacttttctcatctccccttcctgtgaagcatagtttacttttctcactggactagaagttatattatcactgaattatgcaagagactttgtgaattgaggttcatatcacaatgaaattcctgtggaagtataattcttgagcccaaaattcagcacaaataactgtgctttattcctccaattccagttgcttttcagctgaatgcagtatttgcttttgtcttacatatgtgcagatgtggctgtatgtcaataatttgtttgttgagttccacttcagatgaggctagcctggaagtgaaatacacaaagtgttttatacaggtcttgggtttcttcgatttattttcaccgtttttagggatcattattgccgtcggaatgatcctctttgcatgcaagatgattcctaatgattattactatttgtaataatctgtatcagaaagctccctggctagctcttacctgaactgcaaagtactcttgtgggctctctgggaaacaccaaatatcataaactgcaggtggctcatggaattattctaactgcaagcaataggacttcacagtaatgaaagagaaacatatttgtttcttaactaagtaggtaaatagccttctttattgctactccttggggaccaacggttttgaaaatagcatatcaaaatggtagcccatcaaacctcattaatttatattcaattgattcagaagttttttgttcttagggcacagtggattgaatgttaactttaccatgcgtgagtgctagcactttctaagtaaaataatagcatctaccattgaaatattttatctaataaagagcacagggcaagaaaaagccactccatatgggagcactgccactaaatattaaatgtgttccttataattactgcactcgtttagtaaaaaactcttacataatacttgaagccttcgatatagcaacctacacttaaataaaaacttccttaaaatgttcggtttaaacataaataagaaaaaagctcttcctcaattggccaaattaaggacttataaaaaaattgtttgatctttttcaaattttagaactgaaaatgaaagatgaaaaattattatgaagatgactaattataaataaattacagtacacacatgcatacatatataagaactcaggtagctgtgggaggttttagccaattaaaaattatacaattatcaggctcagagcaattattttatctcctcccacagaccacagcacagtggagaagcccacatgttgatttccagcctctttctgtctgtattcctctctaccctgggcttcttttcaatgctattgttaaaagtggtactgctcctcttatttgcatatgtgatgctttaacagcagataaaattctctacaaaaatggtgcttcaaaatagtgcctttcactagagaaaatcacccaaggcatactaaatcaaatagaaatataagttttatacaaagcaaaaagagattcttttataaatgattttcagttaaaagcaaaaatcagcattatttgcacaattttacctcttaaaggtgaaacttacttgtatcagaatgctgaagcataaaattacaaatgattaaagaactgaacacattttaatatcatgcttgctactctgttcacaagggcaaaagatcttacatgggcaaaagatcttcctgtgtgtgaaacaaagtgagcaagagagaataattgtaactttctgcaatttcagaatattcaaaattcgtgttcttcaattacttgaccttaagattttgccatttcttttatcatttattatgtttattatgatatttattcattcatagtctttgttatttaagtaaatatgactaaaaaaatcatcatatccctactaacagcactagcaaaaatgagaaccaaaaaggtaagctaataaatggtgcactggctgtcgagggaactgatttcttacggacgaactacatctgtaaatatggcactttacataaaacatattcaaataaagtaggggtttaatatacttcctttcactacaaagggttaatcagcaaggtttacatttgggaattttcagaatcacgctcctccctctccagtagcgctgccaaaaatcatcgacaggaaacgtaagattaagtttgtcctacctaagcgaacaaagagtgctctgaacaggccaccggtttactgcagagcgggaacttttctaatcctgctggaatctgcagtcctgctcagaaaatatcacggaaaaaagttgttttctttcctctaacatcttgtctcaggatcatctcattttggtcacactgcagatcctgctgcttctcccataaaggttaacttaaagctccaaacataatcatgtggaaaatggacattattgattcctatggtccattgttcccccaacctaagtccctgaagttcaagttcaatctggaattacatcatgtctggtttctcctggttaccagacggcttgagacgtgaccacagctacagaaaaaacaaacagccttcttcacgcttcggctcccctatcgattcaaacgtaaactttttttctttctctcaagtacgcttcaagtatggagcatggttaatttagagattaagttccaaattagattatctaatggcatcttaatggattgctgacccatttcctgtgggatggcagcatgcaagtctggctggaatacaattaatttcttaggaagtgttctgaagagtttgcctagataaaaaggaaatgtcgtgttgtacaaatctttctttataaatggagaaagttaggcaaaactacgacaaatcccaacatattattcaaaagccagaccacagatgttgtgcgtccgtgaaaaccatatcaagatcatttttaagaatggtaatgtttttatttttgatttcataacaggtgcaaataattttgatgagaatagagtaattcctttaaaaagaatattcatatacaaagacaaaagtagttagcagcccctttaccaaacaatgatcatgtgaaattttggtttttgcaattctccaccttgaaccaaagattcttccattcatctaccatatcagcatttctatcatagtcccagagtggtgctaggggcccagaatggtgtataaaaagttgaggatttgaacacactttagagctgacagctgaaaaggaaattcagcactcggagaataaagctccccccaggaactccaggaacaacccagctgttgtactgtagttatgtgtcaagataacaaactgagagcaggaaatgctaacctagtgaattcgcggggatgttctaagtgtaatgttgaaataaaagttaactctttatattacctaaggacatactgcccttatcatacgtatgccacatatatgtggagatatacacacacactacatacacacacacatatagatgcatacacacacaaacacatatatgtaatacaaacatatggtttgcaacccattattgaaagttattttttgtttaaatattcattcttttgagagcatacattttacaaagaaaatgttatgaacaaagcaaggaaaatggctgaggtgagtgttatgcaaattaagttacatggataaaatgagagctattacccccccacactttttttttctttctttcttttttcttttttttttttttttttgccctccctctcctgaccaaccagatccaaataacctttactggctgctaaatttctcttgagaaatcaagcaactctctagaattgcagtaataaacgacaatttcttagaaaaacatgtgtaaagtaactacagaatgaagtattcaacccacagaaaggaactgctaacacatgtaacacggaaaatagctgataaaagtctctttggtgccattcaattatggcatccgcagaaacacaaaaatcctcccaattattttagtaaaatcttcatttattcattatttcagaggctgagcaaatggtttgtgtaaacatatcctttggtaacacgcgcatgtttattttagccatctgaagacttcttctatgtttacataagccatcagacacatacaaccactcacttgtggctttgcgttttcttgaaaggggtgaagggagagaagagagaatgaaacaataaattcagtttctcttttgcataaagcactccctctaatgttttaaaatagcttatgtttgtattattcttggattgtccttcagctttctttttcattcaattatattgatctttcatatctgacagtacaggctatattctgactatcactttaagaaagccagccagtcagggagtaactgctgtatatgtttatgtccacataactcacatatgcaacaaggtaatttgtccacatgagacaaagcacaaacacaacagtacctaccttaagcagttcatcacctatcatcctcctaagatcttgagcccattctgactatactagaagtgagcccttcacccaaccaatattttactctgggttaactgcagttcctgacctttcacttaggcagaaaaattgactctctcaaggtgcaagcaactcctttgcacatgtgtgtgcacacacacacagttcacaaaacagttcacaaaattttaaggtcaaaacaacaaaacatcttcagggttgtaacctaataaggctgtgaaaactttcccaaagagtcagctttggttcctaagggaatgcttaagccttggggttgcgggtggatggaggaaatcttccagctttgattatacttgcacagctcccttggcactgccattttcagttccgacaagagctgcatttgacatggaaacacctcaacagggcaattagtataaagcagaaaagagggtgaccatggaaaagtgattgtacaaagaaagtaatgacaacaaacaacaatcaatcaaaataaagcaaaaccaaaacacccgttttgctttgtccttttctacaacagtctccagggattgccttttgttaaaaggcatctaccacaacaaaaataacctgtgatattttatttattccatcgtgacaaaggcaaattatttaattctttggatgaacagacctatatttcttaaatattttcaacttattcagatgattctaaagccatagccatgccctgaagattttagatgtctattatctgccttaaaagtgctagtgttacagacatttatgacttttttcaaaattctttcaatgttttaaaaataaccacaagtcataaactaaaaaagatggataaagctatcatgccaccgacaagggctatttgtattatcaaatatgaactctgttgtgtccatttttgaaaactacaacaaagcaaagcaacctatgtcatttgaatttatttattctgaactgcatcacacctagattttaagaactgtcagcattggattcaccacagcatttagcacagctcaccataaagattcaataatatctgttcaatgtagaaatgtgatggctgccattatcaattatgtgctttctgaatcaggatagaaagagaagaaacaaaccaagatactggctgggcatggtggctcatgcctgtaatctcagtactttgggaggccaaggcgagcagatcacttaagtcaggagttccagaccagcctggccaacatggtgaaatccagtgtgtgctaaaaatacaaaagttagccgggcgtggcagtgcacgcctgtaatcccagctactctggtagctgaggcgttaagaatcacttgaacctgggaagcggaggttgcagtgagacaagatcgtgccactgcactccagcctgggtgaggaagtgagactatctaaaaaataaaaaacaaaaaaacaaaaaaaaccaagataccttttaaagagcttttaggatcattaagaccattctacatgccattacctactaatcaaaagaaaagttacaatttttgagagggaagaaacattttacctaaataaattctgtatttttttctgacttactatgacctgaaactgattaccacatcaatttttcaccaggaaggggatttgtgacagcaacaatactgccctaagaactgagtttaatcatcagattcatttcctccaatacatgtgttctgagatttattgcccactcatcttctctttccatgggctatcaagtttttatttaaaaaattactgtggccgggcgcggtggctcacgcctgtaatcccagcactttgggaggccgaggcgggcagatcacgaggttaggagatcgagaccatcctggctaacacagtgaagccccgtctctactaaaaaatacaaaaaaattagccgggcgtggtggcgggcgcctgtagtcccagctacggagggggctgaggcaggcaggagaatggcgtgaacccgggaggcggagcttgcagtgagccgagattgcgccactgcactccagcctggttgacagagcgagactccgtctcaaaacaaaaacattactaataactaggtaaagttacattttaaatctctaacaacttacaaatatgctttagaggtctatcctatttttagatttagtaagccaatcaatattccacagaattggaagttcgcatagctataggtgcatttacaaacatgagtacacgtcatctggtttgcaattgttataaatatggtaagcttgtacgcagacatgagtcattttgttaactgatagagcatgaaatataagagagttattcaataaaatatggaaatattaggttattaaattcaattaccttttattaaataacatatggaaatattaggtcattaaattcaattaaataaactttaaaatgtatattaattcagaatattttaatgagatactttcacttaattaagactattaatcattaaggctatttggataagatggttacgttgagtttatcttctttttataagcatatattgtattattttcaaaagggaggatgaatacaatcttgttaaaaaaatcacaatatgtaaaaatgtataccttttaaaagtggaggttatatcaatcttcaagaagaaaagtcacatggtagtgaattaataaaaagtcattgtttttaaaaacataatctgaattatttccttaatttttatctgaattaaagtggacatttaattattttgattctttaaaatctactcttcagcagtttctgtgaaccaatatggagataggcagacgatctacaactctatctgagtatgtacctttctatagacactttccgtaaacggaggattaacatcagagcagggttggaaaattatgtcaactctatctggtgaactccttctgggattacctcactctcttctgccaatttttatttcttattacttatgattataccatgaatctaattatttaatttgtcaatttgacacaatttgttcttaaataaaataaataatacataagcgcagctgactttgaaatacttactttctaaaggcaatgcatgaaacagtatcagaactggttttgaaaatgaagttttagaatagttttctcagccaaccaaataaggtcaatcttccatgaatcacatcagtatacaaacagaaattaaaactttaacaaattccttctttagttactgattccaacaatcttcctactccaaaatttatgggtgctgtcaataacagttaaattgactaaccaaaattttttgctattttttttccctacaacaggggaaaaaaatgaacagtgaaatggcttagaattagcagtagaggaaagagttaaaataagaaaaacctacaatgtgaaaaccaatgctttatcctcaggtagctgaaaaatcttcactaaagctgtgatttcacttttcaggtcctaaaatctaaatgtcacattccaccccctcccccaccaaaaacagtataaattgtagaaaacattttatagcatttaaaaattccaatgatcagtaagcatatactatagtcccaacttaatttgacgttccatttacataagaaataaaggaggaggacagggaaagaagaatggcatagccaaaacaactaaatttttaacatatattttctgtaaagctagttaaaaacaaacactatagctcatgtaatttttaggtgtaagtgtagggttggaaataattaaaatgttacctttgccaagtaattcccaatgtatcctcactggtactggggtataaatgcctgccgttttgattcatggtccagtcacaaatcctcagctgtcaattgaaacctagcagtcagatatggatcgagcagtactacagtttttagtatttaaatgaacacatgcaaactagtactgtacatggcattaaccttactttcccaagaggcaacttaaagaaaaaaaaaaagcaaaaaaaaatcttattcttgaaaagcaaaattcctagactcttttttagaaaaagctattgcaatatgcttctctattaattaaagcatacaagagaaacaagtgcttagaacataacaattagccattattagagcacaaattgagctggaatgaaagcaaacgttaatgttcaatagagagatatattttagaaagaaaataaaaatgctttttttctatgcatcacaccaaataatctgcactgaataaaataatcaataactttaagcatgcagtttgcaaaacacagaagacatgcagtttagaggagaaaaggcccaccttacaaacattcgccctaacttgtgtttagaagcatcaaggtcttcagttttaaccttttactaattttgttttgcttaaactggcattgtttagaaagagttgataagcatttctagttttattttaaactcagagtaatggcatttaaaatactttactacatctgaagaaagtgaggaatgcactgaatacaagctgaaacaaattcttcccagatctccgaatcatcagctctgcccttcagagattgttcgagtaaccctatccagctctgcttggttaacagctgccctacagtgctagcagatttattgaaaagatatattgcttatttttattcttaagaaagtaaacttatctgggttggggggggggaaacacagtagaaaatcatcgtttttaaccttcagatggccacactgtaaattaacagcatcttacattgaaaagatgacttcttcacagtaatccactaaaccttgtttgctgcttttcagtgagaatttccagatgatgactggaaccaaagtaccataaattatcataaacttaaaatttatgataaactattttaaacatttctgataatgttgtggccaaagaaataggctattaagaatctttactttcccttttagactatcgagcttctgcacacactaagtaatagtgattcaggagttttagaaagatagtttttgctcatttttctatcgatctatgaggctctaaaaatactagctaaaatttccaaaccacgtgttttagttatttgcatatttcaggatttcaagtaaaagtgattttatgatttaaagaactgaaaaaaattccctgcatatacatagatagatcaacagattgatagacatgtagattctgctcaggatatatgtcataaagaagtcataaatcagtaaataaattagaaagaaaaataaatattctttttttttttttgagacagtctcacttcatcacccaggctggaatgtagtggcaccatctcagttcactgcaaccttcacctcccaagttcaagcaattctcctgcctcagcttcccaagtagctgggattacaggagtgtgccaccatgcctagttaatttttgttagtagagatggggttttgccatgttggccaggctggtctcgaactcctgaccttgagtgatccgcccacctcagcctcctaaagtgctgggattacaggtgtgagccacgggtgcctggtcataaatactcttaaaatggaccaaaatactcacatgaaggaaaaaaaagtacactttgctttgttttaaatcagatgacatactttcaatatttcaaagaagtaaatgtgttcagtctagcgggaagcaatatggcaagatttcttaaaagttctcaaaatgggtcgtctaatcaaatttagtgtgatggggcaaattgtcttctgttttttttttacagttttttttactgtaaaagttttaaaagtacaatgaaaacaatcaaaaaacagttcaagaaacttggctttgtataacaagaatgttaatgatttatcacttactgattctactctagtcaatgaaaatggaagggttttgtttaatttttatttgtttgttttttgagacaggctttccctctgtggcccatgctggagttcactggtacgatcatggttcactgcagcctcaacctccagaaatcaagtgatcctcccacctcactctcctgagtagctggaattacaggttcgtgccaccatgcctggctaattaaaaaaaaaaaaaaattgtagcgataagatcttgctatgttgcccaggctggtgaaaatgctagttttgaatcaaacatttggaagaggggagatgtatatttaggcatagtacatattaattatgttaattattaacttcagattagtatctatggggctctcagcttaggttggagaagttttcagaaaaataatatgctttcacaaagccaggggaatctaaataccactcactgattgcttattgtcccacagacaactgtaggaccacatctcctcagaaggatgtgttgtaaatgagttagtttttttgttgttaatgttgctaatattttgtctgtttgtttgttttacgacccccaaaaatgtcaaatgggctatctttgaccatatgctgcacacataaaaatgaacgtatttttggacttttcttttctaaaagtagtcccaaagtggataaacctgactacagctattcattatcatctatttaagatatatgcaatagaaatattttctcccaaacagaaaaatatgcttaagtacattcaaaataaacaacaaatatatttagcaataatttaatgccaaataaattggcaatatattaattagcattgaatttccttttagttactaaaaatgtaaaatataagaaactaatttatctgtttagattgtgcactaccattacaacatttcttgaactttctgaggagacacgctataacttaagccaggttacttgagcaagagcctctctcttcatgttggtttttttcaattaataaaccttcttggtcataaagcatcttggaactaacaaaactccctgataaagtgaaattttaaagtgatggtatgggtgggggatgcaattaaatcattaaaatagaaatcacttattcaccaaagatttccatgatagtaattcctaagaaaatcaatttctaatcttatttgaccaagatattcctgaccaagcaaattgtgaacagactctatatattaaaaggttaatactacatgtatttaagcttcttttggggtcatgttacatattcttgcctttagcataattcagttttcctaataaaaaataattttacattaggctttaaataagtttaacataataggtgataatcttttttgagtttggggtggtgattccttagtttctgtcctgtgacagaatcagtgttaggtaattcagctgtaaattctctttttttattttaaaactttaattttaagtggcacataaatacatgcctttcatttatatagaatttttctaagttcaaagctttaagaatgctgtaagaatttttccaagtattttttattaagaaataggaaattgcttttttctcccaatagtaatcaaatttaaaataccaagtgccactcagtttagaaattcagtctgttagaattgtctgttttcatgtggaggtggggaacaattcttatttttgtaacaatatagactctcaaaaagaactgatcatatgcatatccttacaaaaatgcacactcatataaatcattttaatcctttaatttatatgcacataccaatatgaaattctattgtctagaaaatgcccagaatttcaaaaccaaataaaaggtgaactaagaaagtaagattatcttccaaaaaagctatcagtaaagggggaaggttggaacagtttaaacaaataagaaagatgtgaaggtgaagttttcactgcatatgttcttagggtggagttctgtggtctctggaaagagaaccttgttcctggcccagttcaaatcagattgcttcaaagaaaaaaagaaaaaggataggggccatctggttcctctcaaatggctacataaaggggaaacacctaagatttggatcattatcctttcctaaactacactcaaataatcatgtaagtagcagatagccataaagaattaatattgcttgtgacttcagactaatagtttgtttattcaaatgggggtcctcctttgttattaacagggtcttttgttaaatacacagcaattagctttgggaacaaaagaaagaaggtaagcaaaatgttctattttgctagactcagcaaacaggctgaggtactaacagttcctacgatgacaacaaatctcaactgaaccaataaaccattaaactgtgaacagaacaatcaacacaggcaaatttaccttctcacttttttttctttttacgtttacaatggccctcaggagaacatcttgaaaggtatgttttatgttttcttgtgtttcttcatttctccagaccctcaatgaaacagatttttaaggggtgaaggctctttttgcggtggaaaacagatgcttaaaaggattaacactccaatattcatactttggattaggagaattttattttattgctaatattaattacctacatggagcaaattaaatggtctctggatgaatagcatgtaacctctgaaggaatggtatgaacaagaaaaatggtcagaataaaattgtgttgtatgtttcacatacaacacatgcaaaaaaaaacaaacaaacaaaaaaaaaagatactcaagatcatcctcatatcttaaaagtcacttctagtgccaatttctgaaacccatgtttcttgatatttaatttaattagcagaagtagaattaacttaaatgagtatgcatagtccatgagcagaataaacattattaaccataaatcataagataagtattagaaaatgaaagattttgtttttaaattagaggctactacaacttgtaaattttaaggtttcaagggactttggagcttatgtagttcaacctcttcattttcctttccaaggtttaaggacttgtccaaggttagaaatgccctgtcacatcaacactaaaacccaaaccttctgactcctaatccctggttctcacccactacaccagttgcctgtcattgttcctttcctaccctgtcccttatgtgcagttcaagaatatttaatgctaaaatatctgtaaataaaaccttcagaattccctctacctccctgattcaactgagatctaagttaatattttcagaaaagaagataattttttccttgtgtttctgttgattaaagttaacgttacataaaatgtaattttacttttacattaattagaacagcttatctggatattagtctttgattcccagtaaaggtaagtgaacaaaccagggaatgacaaaagacagacaatggaaggattttttgaatttaagaactagccaaagagctaaacatttgcatagccattatttcgactgaaacttcctttaaatgtgtttcctttcaagccagcatacatgaaaagtgacctcttatccacttacatacctacccagaagtcatgtgatagcgttttacgtcaagctgtcaattatgataacagacacaataagaacagcccaagtgttgatagcctgcttcctgactgtattgaaaagtttgttcatagtccacttgtgtccttttaattgcttgcctctaataaatgactacctttccaatggtagtaccaagctttggctttgccatttgccaggacaaatattataagaagatttaaactaatatcttagtttaaaaaaatcctacagaagtaatttcttaaaaaggccattttgtgtaacagaaattttcagtgtaatgagaagtactttcaaattctagttttaaaaacaaaagtgttataagaaaagtgttgaaacaatttaaatatacactagaccagtaattgaaattcaaataatagcattatatagtcatgcaagagatgtaacatgctgaagcccaagcaccaataaaatccatgcaactgtgagaagtaatgcaaagacctgaattgatcaggccactgattcattagctcttattataggtaatatatatatagtcaggagattataattttgagattatgaaaataagaccgatttcttataaactagactttacttgactttattgtctcacttagggaaggcaaaagtgagctcctaatttattcagttgaaatctcaaatatacatcaaaggttaatatgtacttcaatggcttgtttgaatggtgaacttttatttctaaacaagaagcttcttagctgcaaactttttatttccaacttacaatgagatttttaaatatatgttgatgtacaatagtaagaatttaggctcttattatgaccttagactcaaatgtaatggtgataatcaaattagccagattctcttgtattaatactaccaaactttctatgatagcaaaggaaagaggcctgaaattagcaactcactatgaggtagaccagataagaaactggtgctaattcaagtaagttgtctcttattattcatccatgctaaaattgttagactgaattataaaataatttctatatttcctaagcaacatccaacactctgattgatagttcccattttctcagggagataaaatttgggaaacgtggttccttcattgcctatcataacgaatttgcacaatgtgttcgtgaattataaagtatgagagagaaaaggatatactgcattttactgaacttctatgaagttaagtcggggcgggggggtgttccacatttctgaaaatgttccaaaccataaaaagacatttctcagcagagactaatcagttcagtttgccaaagcaggacccatgagttcttcaagccaccaaaaccatcttccaatagaaaagttaaagaagaatgaagctccaactgaagttctgattttaagatttcccccatgccaatagcgaatgcaataactaaaccaataatcccaaagacagactagttctagacttgaaaagtattcaagattgtgttaagagataaagaaaaagtctaaagtcaaatactgatcagctggtatgtgctgactattgtgactgattagagaggattatttttaatggcagattatcaactggtttacatgaacctttttgaaatagtctccaggactatgtgaatttattttttagattcaaatgagatatattttcagtgataggtgaactttcttccagtcagaataaactagtattcccaagcagttagcaaccaatgccatcagcaataattattataaaaaggaacacaaagatgtataattactaataacaattgtctgtgtaccaagtaaatgatatgaaagtgtatacttttagtattcagatttgacactatgaatgtattactcttacaggtgaagtacagggttcattttaacattagaaagcttttcatcttaatttgataatgctagtaagcttatgtattagaaaatgaccagattggaaactccactgtagtatcatcttgtggaaagattatttataaaatagtcaaaattacatgaccactttaaatttatcattaactctaatttatgtaggctctattaaagttcttttctaagaaaaacaacactcaaaactacacatcagtacttttcataacctaaaaggataaatctttataaagcagccaccatgaactgaagaatgtacctggtgacgatatttattcttaaaggatcatgtatattaaaggctatagggaatgtttaaaagaaccctctcagactaaagcactgcctttctaattttgaatttctcctagctaatataacatgattgattacctttatttcatgtaccccttgattttccttttcattcatcattgagtgctttaaaccaaatgcatttagaaactgcctctagaagaatggtctcttttaaatctttgtaaagtaatgaaaggacacagtaaatcaatctcatttctactgaaggaaagaataatctttactgaagtcatttaaactatttctgtttctttattcctggatagtaaacataaaacttcatttctataattcttttaaaatttgaaaggctaaaatgaataggcttttgactctagccttagtttactaatatacatctatagcatgatatgcatttatttacaggtattttctgcatgcctcaaaactggagttcattataaaataaagcatatatgggcttcttcaaattaaaaagcagcactaactctttcattacatagaggacaaattatctgtctgcatggtatttaacattttcagctataaagaacttttttttgcttccaaagattaatatatatcatgtatcccataagtattaactatagttgactgaacaaaacgtattcacattgtaagtggtctcgattcaatgttgtccacttaaataagtggctgtcttctttgattttaaaatagtttatagttctagaactcatagtttttaaaatatatcatgtgccagaatgctatctacattaaaattcatattttcatgatgcttgctaagttttcttgatatatttttagatatgtgaaagaagtaattcttatgttaatggactttagtaatcataattacatgaggcttcgacatttatcataagggataagaaaattaaagctgccataggttagggtagtggaggaggaaggctgcctccaaatacatggaattggtcagagtattctaactagcatttggggctaaaggtttaaataatggaggcatgttttatgcattaaaaattaactggaaattagagatgtgtcataaagaataatgcaaatcccatgagaaaaatattcctgagaatatgtgtaatgatttttaaaagaacaagtttctaaacttatacatcctgcatatgttttttaaaaaacacaatggacacatacatctgtcaaatagaaccatattctagtaattataactcatttcgtgttataacaattttagaggtgaaaaaaaagcaacattccagagaattatgttgagaagccaatggctggcaaaaccactaattattattatttggtattttcataactgtgtacagatgttttcagttagttctcactcttttggtttgttttgttttgctttttttaaacctggcaaaacatcaagtattctgaataagctatcatctttatgattttctctgagctctgcatgtggtgacctctaatatgcagtctgcccccttgggctgcaactggaaaggacttgagaactccacaccaagcacagttgaggtaggtcacaacaagggtatgtgaggtgaacagatcaagaatgaagtaagtgggcaaaagtatcttactacctacacaaaaagtcatatatatgcacaggcaacttataaataaagagcgagttagttaacaccagctctttattatttattatagcctaattttcccctatgtaatattttgcatactgttaatttcaaactgctctgctatcaaaacttgagagcagcaaacatatgcatcataaaatatatttaaattcggaactgtttagaattacgtctcttatcctgtaactagaatcgtgggatttctacattggtatggtccatgcttttgactgtggctgatctgtttataagccaccattaatcctggctgtatgttttcacagtttgggtaaacacttcatttgcattaaatttacagcattaatgagatgtgaaatttaaaatgctactagaaacataaatgatgtaagaaagcagaaccaaaaaaaagtgttttatcacatctgaaatcagtaaaccaatttaaagctattaaaataataggaatgaagtgtcgcctgagattttaacttcgtaactcatcgtcttggactaaaatacaaatgtgaggagcaaaacatctggaaaataagaaatcactcaaaaactcgaattatatactgcttctattctagttggctttaaaacagtttgcagtttttgtctttgaaagctatagtctgtaagttctcaatagccaatgagactgagaaaaatacactttggctgaaacactattactcatggatgttatcaatatatgctacagagatggaaaaggtcatgagccaatttgagaaactctactcaaagaggtgagaaacaaaggatcaatgagaaaaaattctgggaaatgaaatgatcagttttggtctcagaagccccgggagcccccttctgagtccggatctgagaggcaacatggagaagcacggaagcgaaagcgtggctacaccgtcacacctgggtgaaacttgcccacctgttgctgatgtaggaaggatgggtctcttgggcttagtcccacatatcgattggcttgagatgtgcctgaggctgtgtaggctgattaaggaagaacaaaaacaaagataaaaattgtgaactatcagaacgaacaccctgtccatgtataagaaacccagagaagtgggatttgcaaccaaaaaaaaaaagtgtcttcatttctcttctcttttgtctgagtgaacaccaagtgatagaaaagaaataataattgacttcaaatcaactagtttattccccctaaaaaatctatccagtaaagcagatctcatacttcagtgtgggtgtctcacacttacatgctctagtaactgtcctgtggaggtactaaggattggataaatagaagggccctgttcctagacgtactttttcaccagatagtagttgtctaatataaaataatcaatgatggtatatgattctaaatgtaaagcagactgaaagtccgccaggaaaaagtgacagcttttaatgatggaatttaagcagatgttcttaatgatatgggatggaaaatgtctttcttaaaagttttgctaaaaaggaaatcaaatcttactatcatgaaggagaagcctgtatcatgtagaatgaatcagctcggtattttacctgtgaaaatggcctcaagtctgataggaatgtttttgaaaaaaagtacttcccataagcacacatacaaaaatcaattacttgtaactgatccaggaagaaagctgatgcacctttaaatagttggccactaggtagtaagtatatatggtgactattccttacattgttatagtctcatttgcaagtactttttgtacaactgctttttgctttttggtatagagtaaatttttcacacacacaaaaaaaaaatgaatagggagctactcctaaagacttttgttacttttcacaaggaaaggactgaggtatcttcccagaactaggcaatcccactgctccatattaccatatattacctttattgttctgaagaaagctacactgtttggtttaaaaccaccagattaatgaggaatccaggcttcattttaaatgaactggctttctaaaaccaatatattaattctgccttgttcacttaaaggactgcagaatttgatccatggaagcttttttaggtcaactttttaaaaacagtgaagatgctcacaattcatattttaattgctcctgaataaggggacatgcaaggcagccatcagcaaccagtgacccctactcaatctccaagcctctggaattcaccacacctcacagacagccggagatgagcctcacccttacagaagagcaccaaatctatgctgctttttcttttcaactatgagaaagagccttccttggcttctgtgttttctttgaccatagtactatatcaattcaatgaccagttttttattactggtggtgcctaagaagctggagctacaagcttgtttataggaaagaaaaactactcactatgtttcttttatgtaggagtggaaaatggactgatgcagccatctttatacaaccaagatactccttttgaatattttgtaattttactagtcaaatcagatccctttttgaacaacctgtatgtaagtataaaaacaattcattaacaaacaggctgagggtactcctataagtgaactgtgatcatttgggtctgatcctctcctgaatctcttctattaataacaccacaagagtaggcatcagagtttctagaacttggttttgaccatttatcctgtgataatctttcaactacttaaaaaaaaatctttgttttctgtgtgcttttatttaaattgctgacattgtttgctcaaagatgtgaagacatccacttttaaaatgagtacttagtgttttggtgactgtaatgcacatagcaaacctctagaacaaaataatttttagtttttcctgagtaggtcgcatccatctgtgcattcagggaagtattctaagcattaagaattactgatgggtattacaagcctataggaacttattaattgacggggctcatgaattttgagaaagaaatgctgaattcactgtacaaagtattgtccatttttcttatagggttccttcctagtctttcagaaaccataaaaaaaaaagagcatctttccaatggctgagaaagaatgagtggtgcatgcctctgattgtctctgattcacatggaaatttcaagatcatggggattttcttgctctaagaaagaaaaaaaaaaggtttgaattgaagatatctgtataattggtgaggtgcatgctaattccaccaattcgatagctttatccattctacttcaccaatttgtacattccagctccagtactaagaagctgacagttgggtgaaaccacctcaaaattaatttcttctatacttctaagtattttacatgaaaaaacaaaggaatgatgcggcttattggtacgtgttaggaaggttcactggctaaatctctgacatttaaatgttatggccacactaaaaagcacagtatttgatgtaccaatgataagcaaaataatcaaaaggttttaaaaaaaaagcttgcagatagtgaaagtacaggtagcttacatgtgcctaatactaagttttgaaatgtcctcatctgttcccaaccttatgcgactgtttttaacaatgacataacctacaatgatgtaaacatgcaattaccttacagaggcactgattccatctgctttgtgaaggggcttgatttctataggaatgctccaataagtaccaattacctaatctctctttgggtgatacgaaaactttgtattctgcgttatgttactcagtgcaatttcaatgtataccttgaacaagcaggcatgacttattatttttgttatagctgttaacttaaacaagtgagcttctcccttttcaaatatgattcactgactggaatttgagaagagagagcctgtgatagcagggccacatccatgcctgctagctccacttaaatgagaaatctccatctggtcaggtagctggaaaaattgccgtgttttccaccttggatcagatatccaatggtgcctctgatggacatttctcatttcctatggaaatacttactggttgctgtaggtgaagctgcctcaccttcagtggatgtagtgatgggtttagtatctgtcatgctcagggtcacaggtcgcactgcactgggatggggagagggtgccaagacaggagtgaaatggccaggcactttccctactacttgaccactgccgttaggctacaaaacaaaaacagaatgccgggtgaagcaatccaaaaggcagtcatcttgttcaacaagtccactcagcacacacgactgtgtggatccagcacactgcgcataggcgccacacaggccctctcgagtcggagtcggagaggccagtcaatggttggtagtaataaggagcagcagcatttcaaagaaggttttcatcttcaaagcacgtcatggtataggtgaattcctctttacagcacccctgagagccaggtagacttgatcctttcatgtagtaggccaagaaactcaagtgcagacttaaatgcttagcccaaaggctaaaatggaattccttactgaactagctacagttggaacccaatgcttccttattctctgctcttcattttctataatgagtcagttttggcttttagaacacaattttcacctacatgatgatatcactgaaacaaaggacacaaaaatatctaggagatcaaatacaacgaattctggaattttcatcatttacagtcaagaaccattctcctgcatacaaaactctagctctcttacacacaggtgtgctgagatgcacacattaggcaatttagattccgagatctatggtcaacttttgatgatttactaatacaagaagatagaataagatgtaaagcatctaaaatttcagaggtcatacaatgatataaaatgctgagctacgtttgtccttacacctacaaataaaagatttccaaagtaaattaaactgtactgaggggaagcagaggacaagcaaatgagcattgttatttgagttactcttacatccatggtggtgcatggagagttacacaaaacatttcttgttgacatttgtgagaattaactgagaaaatcccctgggcaatgatagaaaagatgttactatctgagttttagctcctgggtacaaaaatagtttccgtggtaggaaacaaaatcctaaggatacactctttgaagaaatagtggaatatatttttctagactgagaatgttatttttgattatacccatgttggaattctccactgcacggtgttcatcgcaatttgctgggaggctattctcggcaagtatatagtctttataatctgaactgttaaaggcaaaaaaaaaatgaagcagaatatttttctaaatatctgcacataaattacaagtagacatttatttagagaaaaagatgaacagctaataacacttaaatattgtgacttagagacatgaactaagtcttcggttaggctcctcagaggccacattatttattctataaagaaaatggacttcctgaatatcctgattattcatcatgggtaattttaagtatttaacttgatgtcaggaaaattgaccagagttttccaatatggaaacctatgggagagttacatctttaaactaattttattcaaaatattccattgaatagcatgactgtctcactataattggtgcagcagtaatgcaattaatctcaaaattgctgtggggaggaaaaggcatctcagttgcttatcttaaaaatcaaaatcagtgcagtgctggagaatattgggaagcaacagctgactagaagtgaatggtgaaggaatactgatgtttttccatttctaaagctaaaatggtaaataccaagaattctaatttgaaatgcaaattaattggttttgagttggagttaaaaatcaaagcagatacactgttccttaaaaaaaaaatctgcagttaactataaagacccatttttcctttcaaagggaaaaagtagtttgtttctacagcaggccatccatttctggttatctgaacactggaaataagtgctttaaatatcttaagaaagaagacaggtctcattttatcattggtggtacattcaatggtaaaaatgtttctacatacagtgttcaccaaaacagtctgaaagtacctacctggaacaaaatgtctggagcagaatgacaataatttcaaggaaatgctgccaccaaatatattatcctaccctgaccattctacaaacttcacctactggaattgaacaacatgaactagtagacacttctctcatttgaaaagaataaaggtgacaaagaaagaattcccaagtcaatgcagacaactttcctaaaactcagggtgagaagaattgagggctattttctcctcagttttctactggttcaaacagatgaagctacactaaaaatttctatcttttaaggctgttaatagatgaactttcatactgtagatagaaaagagagatgtcttgtctgaaggtgaagctaacagcattaggaaaggattattctactttatacacggttcctattatacaaaatcctgagagtttttttgttgctagtttttctttttcttttttttttttttttgagatgagagtaatatgcttccttagaaggtgatatgtatcttgaaaaagtgaagaaaaactgagaacaatataggcagattatcacctaatatgccctcttaacttataaagaaattgaaatatacgtaaaacaagcactgaataattaaagaaatgtgtaacactaagggcctgattttaatttgcataatttttcccctaacagtgcctaattaagacatcagttaaaaaaaaaatccaatggaactctaagattttccacactgaattaacgttaaggacttttaatggatgtcttaattagactttgttattcatggaaattctacacaaattaaaatcagaccttgtgtgcactgttcccagctgagtctagcaaaatgctctatggaactgagacttctgaatccatgagctgacaacaaattttatttctaaacgatatactaagatcccactctcacttagctgtctttagtacttcagtcatgaaaagtgctacaacattttaacattttcttctaaaatacaaataataattttaacttcaaattcaaaattcaatattgagtttaatatctcagtcagtcaaactaaaagtaatgataactttttaagtaacccaaagggtcctggatgcgttgttattctaaattaaaagttcagaaaggaccattttgtttcattttaacaaattaagaccaaagggatttttttctcacctttctttgctaatttaaattgatagacacacactatttactagcatttcaggaatgttccaccgtagtaatgacggaatgtttgtgaaaattctccaaaatattaaaaggtataataagtggacaggagtcttagaggtaaagcagcaaagctaaatatcagatcctaatatcaaaattacattacatgttttagatattacaattattgatagccccaggtctggcacaaagactgtctacttgattgtggaaaatgctcatataccaaattcctatgaagtaacctcttggtagaagaaaccatatgtctaggggagtgagaaatgctcatgagtcactacacttacaaaatgaatccccaaaaccactgcacaatgtttccaaaaaaaagaaagacgcttctagtaatgtcactcattattaaatgtaagtcatgtctctgcaaagaatattcaagtagtcatcaaacactgagaatgtttacattaccaaagcttattttaatacctaatagttggtctataaatacaactgtaagttcttttgtgtgtgtttattttagcacataccttactcctgcctgaaataagcacattgtctctgtgtcaaaccaggtatttaagaggtgtgaactccagcccagagctttcctgtcaatgtactttctgcataaactttcccttcagtcagtgaaaatccaaaaacattaaaccatcttcacaaatgtaccctttggggcaacacacttcctacctgtcattcagccacctttaaataaaaacttattgagtcaccaagcaacttcctgaagatggatttcaaggcttgacgttctgccagacacactgtctgactaacctttgtgtctcagaattagatctgtcccatctcccttaggtgctaatcttattttctctcttatttttacctggctggtttgtggactggatgggtcataagaaggtacatagttcttcagagtatcctgaggattcaggtggggaggatatctgattgttggatgagaaaagtagctcgatggggctggaggaaggatagcttgtgttggaaatggcaacggtgaaggtggaggtggagttcgagttgagatgactgcagaagacagaaaaggaaagattgactcatcagctggttaccttattgctccattctgatcctgaagaatgctgtgaaactacaaaactggtaaccattcatttttgtccccatgatttaaccaagctctcctaaatcaacagttactttttcatttttattctcaacaccagtacggctaactacacagagataaaacatcactctagaaaattaacaatcttgcttcctggctctgtgagtggttacaaaatcagtttctcttttataggttatgtcaatacttgataaaacacttctttgagcaaagatatatcccgttgaaaacatattctttgattataaaatctttaggccgggtgcagtagctcacacctgtaatcccagcactttgggcggctggggcaggtggatcacctgaggtcaggagttcgagaccagcctggctaacatggtgaaaccccatcgctactgaaaatacaaaaaattagctgagcatggtgatgggcacctgtaatcccagctacttgggagcttaaggcaggagaatcacttgaatccagtagacggaggttgcagtgagccgagatggcgccattgcgctccaacctggtgacagaaccccatctcaaacaaacaaacaaacaaaaaacattttgtctcataagccccatctcaaacaaacaaacaaacaaaaaacactttgtctcataagtccagagcaagtcacagcattaagtagagggcaaaagagccaaaaattttctaccaaaattaaaaacaaaagtgaaattcaatttcaaataaaacgtttccctgtacatcctacctggcaattgtttagaaggaaagacaataactaatacaacatcatctcatgtcatttataattgtctggtcatggtataaatgcttatgaacattggaacatagagctagaaactctcctaatgaaaatgtttctttcaaaaccaaaagagctctattctgcaactatttttctttctactttaacttttactatatgtagtttaaaagatattgttaatataaaaccaagaataaaacacacagcaatgaaaatttaagctttcatataggtaagtatattactttacccatatatcacatattttataataattttataaagggaaatactatataaaacacatgcaatgtggacaatgttcaattttactataacttctcaacattagtattcttataatttattgttcagtttttgaaatataaatcttaagtttgaaagatggagaaagagtgtaatcgtatgatcattatctctaaaatgttgagagaaataatcatagaaatacaaattaaaactaccaacaaatatatgtagaagtgaaaagtaaatgtctttctattttaatatttcccaattcaaataataggaaattataaacgataaatgtctaatgttttatgagacaacttaaagaatatgaaaaaaaataaattttagccataacctacaaagggaaatcacctagaatgatttatttccaactttgaaactatgtgggtgggggggtgggacctatttatgggatgtattgcttacctctcccaaaaaaaactttttcagaagatataagaaattaagaatgtatagaatagaaaaaacataaattcaattttatagtcacgactttgttctctgaacgtccagagcactgtttctgaaattctctgtattgttcttacaatgcagatcccttggtctacacacagacctaggggatcaggacctctaggggtaaggcaccaaaatgtatattttaaataagtgtccatgtaatcttcctacatactgaagtttgagcatcctccatcaaatgtatgcatttcagagaacaaatgcgtatttcttaaaacaaaactctttactgaagtattactttatttaagaagtatacccatttgaaagtatcatttaaggaaatacaaacatctaagaaaaactgggcatcttttacttagtgtctaaatgctcttaatctcagctcattttaaccatgatttttgctcacatctgtacacaaaccctggaaagatatatacatagttccatcttgggtcctttagcttttgagattaatttggccttaatagttctggaggagatctattttcaagtgaaattgcagaaatcaaacccgaactcacatctatgggcaacctggcactgtgcttgcatgagctgtaggtggcctgataccactgggtaaaatgtcgtatttcaaactgagagtaaaaatgactaccttttccataaaagccattctagtcctttaaaaataagaaaagcaggccaggcatggtggctcacggctgtaatcccagcactgtgggaggtcagggtgggtggagtggatcacttgaggtcagatgttcgagatcagcctggccaacatggtgaaaccccatctctactaaaaaaaatacaaaaattagctgagcggggtggtgagtgcctgtaatcccagttactcgggaggctgaggcaggagaattgcttgaacctgggaggcagaggttgcagcgagccaagatcacgccactacactccagcctggagtaagaccctgtctcaaaaaaaaaaagaaaagaaaaagaaaaaaaaataagaaaagtaaaatacaagacaaaaagttttcctttattatgaaagaatacatacacatgtatgtgtatttcttgcatacattattgcaaagccttattgtcttctttccttcagtcttgctccttccaaaacatcctttatagtgctatgtgaattactttttaaaaacaccattataatcatgtaacttctccgctaaaattatttcagtggcttcctactgcttccagaataaaatcccaacaggtttttcagtacacacaacctcaggtactctgagaccgagtcctggatcacttctttggcttcatctctggccagacgaagatatttgtggatccttggctatatggcagttgcctgctgcaatggcctctaatgcactgatacatgctgttgcctctgcctcctttgcctgccagtttgccccttttcttcctagtttgcctctctgcctcccagtttgcccctcttcctcttagtttgcccctctgcctcccagtttgcccctctgccttccatgttgcccctcttcctcctagtttgcccctctgcctcccacattgcccctcttcctcctagtatgtccctctgcctcccaggttgcccctcttcttcctagtttgttgttccttcttgtggtgaactttgccatcacactttagctcagaacacatatcttccaggtatctaaaccttcttcaggttatctagtcatgttcagattagatgcccagccaatgacgtggccccactctctccccactatatcctgaactctttaaggacagaaacgatctttctgaacaagatgcctaacacagaccctaatatacagatacagaacaaatatcgggtgaaggaccaaggtggagggctcatctaggtctctcctgtttcgttatataaaaatatactgtctactttttttcacgttagaaataagaatattttcatcaggtgtcgtaacaaatgggtgatttgacttctcagttaattctgtccaaatattcaacattacaaacctatgaaacagttactgattttttcacctatctcaatggtataggtaataaatgcaaaagttcttataccacatttaagttgtatagtcctctctcaatttcgtaattttttaatgatagcaataaaggccatgcatttttttaagtatagcaccaacaaatatcaacatatacttacaaaccaaagctaataaggactttattttaaaagatgttacattgtttgcataaagatttaaaaaccagattcgattagtcagaaggatgaggaagtgcctaactataaatttaaaccaataacagtttcactattaacatatttatatataaaactttttccacctaaaatgcagtctactcctctctaggtaaaaagtacacagtgttaattattagctgtatctcatttttaatttttgaaagatttggtattagctgttggttaaagtacaaatgtcaaatattggattcattttcctacttaaattaagacatcagacacaatatcaagtgtactagcccaaaggatttgggcatataaaacaagtgtcaaaaaaagtaccttttattctctgattactctcatatagataaatattgatttatatgtagaaaataacatctacagaaatagtgccttacgtcttaatgcctttagaaacactctaaactcagcaacataactgaaattccatctttcccttagtaaaatatcaggactaatcctgaagctataatgaagatagctatgtacccatattttccacattcttctgataacaatctttttgattaaggtaattttaaaacacatattataaatattatttacttgtatgactttgaaaatctttcttttttctttttgagatggagtctcactctgtcgcctaggctggagtgcagtggcacgatctcggcttactgcaacctttgcctcccaggctcaagcgattctcctgcctcagcctcctgagtagctgggattacaggctcatgccaccatgccaggctaatttttgtatttttagtagagacggggttccaccatgttggtcaggctagtcttgaacacctgacctcgtgatccacccgcctcagcctcccaaagtgctgggattacaggcgtgagcccctgcacccagagaaatcttttctcataaattgagaagaaaaaatacttgatcggattgtgcccctcaccatatgggttgagaaaatatggttgccatagctctatttataaacttttgctccgtccctaagggggttaggccctacagacaagaaggaggcttctcctctatgcttgaaactcctcaccactgtgtgcaactccaggtattccgggatggtggtgctgggggaaagtgctcagtcttggggaagaatcctgtggagatgcagagctgaacaatggcttttcaggcttcttcatagtagtcggagaagacatatctgcgagaaacagagaaaaacccaaagctccatgactttcttaagctctaaggttcatgtcaacaaatgacagatctcatcttgcaacattttagtattcttatactttggctcttttacaaaatatattctgagtgtcaacgatccagctgtcttggagctctgaaatatttgttcaatctccatggaagctagcagaagccttcattaaaattatcatcagaattattcccattactaaataaatcttaaacttctaaaaacccaaagtcttgtttcctttagccccttggttcacacaaaggccttctttacctcagtatttcattctgagatttatatgattcagaagattgtctttcgacagaggataactgctgcaaatgggaaaaacaaccttcaggtatgttggtcacgatatcactgatttcacagcttttatggaaaactcattcacttgattagcaaaaagtacattccttaatttactccttctgcaaacgtttactgggtttctgtactggccaggtaaaatgaagatgtcaaagaaattaaaagtaattcctgctctagggatgctcactgttggtgaggaggaaaatgattagaagaaaatggttgtgaatggttgagaggtacaatgtgtgttgagagcagggaagttttggcatttgctgctacatcgccagctgcgatgtacaggacagatatcgtctcagtctccccaggatgaggaaggcatttctcattggtgccattttcaaaatgtgaatgaggatgacattctcagagaggaaatactcagaaaaaaagatggcacagaatacacaagtaaacagtgtgtggagtggtgaaagatgaagaagaggagcaagcctcttgcaggtcccacaggatgacgggtctccagcttcctgtacaaacgtctgaatgcttaccctcataggagaaacgccatagatgggcaaaacatgatcacaatgacagtttaaaacaattcccccagaaactaaatggagggcggactggccaaaacagagacagaaatcatgaagaccacttcagaagacagattcatcaatacattcattccataaatacttgttcaagaccgaatgtatgccacatgctgcactagcctgggacacactggtgaactggactcactttcggctcctttaaagcttaaaatctagtgaggcgatgtggacaagtaagaaggaattgcaaaggtgctgtgataggaaaagaattcagagatttcgggcttcattcactcattcatttcataaatatttaatactgccaaaagatagatcatgagagcttgaaataagaatcatgatagaactaatgcaataaatattttaacagggttcacccaattaaattattaagcaatgtagactgtcatcatcttagttgactaagagactataccatgcagtttgttggaataagcagggagttgagagatatgccttggttttaacatcttgagtgctgttgactttaatggaagtttatcaactcatagtaaaatgttataaaaatgatgagctataaaatttgtattttattatgaaaaatgttaactgtattcacaagtagacagaattgtaatgaatcctcacgtaccgataacccaacttcggcaatgatcaactcataacaaatcttatttcatctttatccccatctacactttctctccctgtggtactttgaagcaaatcccagatatcatataactttgcttctaagtagttcagcatgtatctctaaaagaaaataaatctttattaaaagaaaaaaacaccaaaactttatcacacatacaaaatgtacacaatttgcatttttgagttttcttgaaattagaaaaagaccttatggtgctattaatatgagaaactaattatcattacattttaccatttgaaaaattacctaagctctggtaaaggcattcataaaattaaatatgcattttcagcatggtggcatttaaaggatgaatatgctactgtaaaggcagtagacatcacagtctacaaaaaatgccaggcggatttgtagctgtaagctacaatttgtgactaactggctgttgtgaatctatcagaactttgatgagtcagagaaccatttctgtatatctttttcaaaaaaaaaaaaaaaaaccagaaataaattgttcataaaaccacagcaattaatgccactataaaaaaagaaaaaaaatttaaaccatggtttaaaaaatagacaaagctcattttgctatcttcaagatgccaaaaataatacttaatgtcgcataagagctatgtgatttcaaaaggtaatactacaaatataggcctctaactaatggatgtaaaatcatagacatacagattattaagaggtggaaagaacctctattctgtctttcttgttatagatgatgcaatcacttgccattccaaatttttaatttaaaattaactgtttgaaaaagaaactgggaactttttattgatactcttctgctttacctatgtttaaatataaatttcaagtaaaatgtaactgggtaaatcagtttctaaaaattccatagaataaataataaagcataattatacctcattttaaaataatttaggccgggtgcagtggctcacgcctgtaatcccaacactttgggaggctaaggcgggtggatcgcctgaggtgaggagttcgagaccagcctggccaacatggtgaaaccccgtctgtactaaaaatacaaaaattagctgggcgtggtggtgggcacctataatcctagctacttgggaggctgaggcaggagaatcgcttgaaccttggaggcaggggttgtagtgagccaagatagtgtcattgcactccagccgcgacaagaacaaaactctgtctcaaaaaaaaaaaaaaaaaaattaatgtgaccacagcttgagaaacagaacagtgtcgttctgggtatgtcatttctggagaagaggatcaattaaggcaactgcaactactgtaactatatcagacttttcattaaactcaggcaaattcatgggtctccttttgtaaagggcacataaatcaagggtgtttatatagaagttgaagatgattatgtaatttttaatgtaaattatataaattttaagaagcaaagcatttgtattttcttagccaaaatgacacacttgcttttactgagtaattattatgggtccatttattttttcaattcttttttgggcatgcacctaataataacggtacgttcatagaggattatacagaccaacacagaagaaacagaatacaatttgctgttcaagttgcaaaaggaaccacaaactctttccttaaacaacaaaagtaacttataatagtaaacataagaatgggaaggttcactgaccaaactgaaaggatttgctttagagacaggtgaagaacggtagtatcagaatataggtttaattgcctttgttttctcattaaatgaaattaattcttggcccattaataaaaatacactgctacacagcatgcagaaggcactatgctaagaacttaggaagatacaaaagtgaatccccgctcaaaaaaaaaaaaaagacaaaaaaacaaaaaaaaaacaccctctctagactagaaggggaaataaaagatcaattatctggggaaaaagtaaagatagagtttctagctattacattttaatcatgaaccaaactagtgttattttaattttaatttattttgaatgtctacagtctaaaaggcttcatgccaaggtgaaaaatgatattgtttctatgtgtaatgtgctcatatgctacaaaaaaaagtttgaagaatgaatatatagaaaagatactttaaagtgacctttctgtgaagaaaaacaaataccacgctttacacaatctactgtccctcaagcaggaagaatactacataaaaagattaagttgaaaataagttgaataataataaagttgaataatgcataaatatataataacttgaataatgcatacataataatgcataagttgaataatacataaaataaagcagctgaaaagagatgcaaaatgataggcaaaggattagctgatgtttctactggtgggagggaggcaggagttgctggtagttgaagagaaacaagtagaggccagtgatggcttaaaatcagacagaacaatttaaatttgatttagaaagtaataatttataaatgaattgattttagaagaaaaaactttccaaaaatttgactttttttttctgttctcaccgcccttttcacttgtacctggctgaaccaaaaattttcttcctagtctcctccaggccttcctctccatggcactttataaaaaccagcagctggcatcgtatccttcaaacagtatctttctcattgcaagatctaccacagtatcacatttttaaatagctctttttctttgttattccattttgtttaaacttcagtgaagctaattttcttatggcttccattaggagcaggagaaatatgtttttaactctgtgccatccctgatctatgacattcccttgaactagaaaatgaggcatttccactctccttattccacgcatagaacaatgttttatccactgaacaaacttgttttctccttaagtaatctctcttggaaatccctgagatctagatttcattaatgatcttttgtttgtatcttatattgcttgatgaatttttcattgttatttacttgtatccactgcgtatgctttttttaaaaaggtgactaatggcttacctcctaaggaacatgcttttaccaaaaacacaaaaagatgtagaggctggaagaatatgctacttgggaagagaatgaaaaaaaaaagtagaaatgaaagaaagaagaggtaaagcaggcaccgtgtctaggcagcttattttagaatctctggcatgtgaaagaaactgtattatgaagtgatgactagtagtgcaggatgagaaaaataaccatagccagtatatcttaaaattcatgttccatgaataaatatcaccagatgagaagtagctgactgtaaagcaaagagaaaagaaaatcaatcactgagattctagtaagtgtgaggaactatggctatgcatcaagatgccaaacaaaaccacgtggtccctgtcttggtgatgctcatggtttagtagagagggcagaaattaaagacagaaatgcattaaatagttgcaatcataataatactggattgcagaaagaattcttcttaatgacagattagagagaataatttttttaaaaagattcacattgatggtgttattcttcaatgtgtacacccatgtttacatttataactggaaaattagctatgactttagaaactcatcgtgtagttgaatatggaataaaagatcaccatgtaagaaaaaagttcaagtaggctactgataaagttggttcatttattcttaagcatccctttaaataagtattttgcaaaatcaaattatcacacgatttttcctgaccatactatatatatttttggcactgtaacatatatacatcctaggccttgatgtgttatttatttcacgtcatcacttcaaagagataaggacttaagcaaataaagagttagatcaactcatctcccaacaaggtaatttcatctacaaaggaagagagtcgctgtgaaacacagcgtatgtactcgactcatcggcagcttgcacaaattgcgctccagatgtatatctgttcaagtcagcccaaggcaacaattttgatcaattctaatgtgataaaatgctgcagggaaagtgtgcagaaacgtgtttacgtcagcccttaattaaactgttgttcacttccaaagaaccttaggaaacactaatgagacatgagttttggcaatttcttcatcaaagcaaagaccccttcctcagtctgtagcagcctgtcatccaagtcgctcccgggataaatgtcacatggcactccaatcagttagccacctgttagtagaacttcattgaagtcaactagtgatctagggcaagctcaaacagcaccttaacacctgcctgtctgggacacctgctcctttttcacatatagtagagcaatatgttagcttttccaatatgctcgagtagattaaggttacaaatcagactactaaagcctacatagaaaacatacaattttcttttttgaaaaattccttttcttccctatagtaacacaatttttaacaatttcaaattaattatgtaagaacacgcaagaattcttgaatttctggaagctattattttcagcaaaccatatcactaaattaaaatgtattaaccatgccagtcctatgatttagtcctttttctaggatagaatagtcctatttctatctggttaacaaagaagtaaattccttcaaaatgttttaaaagtgtaattattttacatattcctaaattgtcttccttatttacatgccatacttgtaacttgtaaacaagtctaaatgaaccctatagagacaagtcaccatttgctggctacttttattctccagtatttaacgttaaggtttgttttattgctaagtgcttataaagctataatcattgttaaaatatctacatattttctttatttttcacattatcaagctgctaaacaatttacaggattcctctttttcctttctatcttttattattgtgtaaatttcatttatttatttaaatttatttaattattttagagacaaggtctcactctgttgcccaggctgcagtggcacaatcatggctcactgcagcctcaaactcctgggttcaagcgatcctcccatctcagcctcccaagtagctaggactatgggcacacgatcacacccagctaatttgtaaatttttagtagggacaaagtctggctatattgcccaggctggtctggaactcctagtctcacgagatctcctgccttggcctttgaaagtgttgagattataggcttgattcattgcatacggtcttcttttttcctttcttcctttttttcttcatcttctttttttgttattttttggcagaagaaaactcaaagtgtaatgaaaacagttgcaaaacttctgttaactttgaccctctggtatgatactgaccagaggagtttgatacagaccagagaaggaaagaacatacataagcacacttagcttagagacagtccaatggctgggatttgacaagattatattatattgacaagttttatcaagttgatacaccctcataattttcaaagttcttcattttttggacttttgaaagtattagactttcatagattttttttaaaagagttttctagataaacaaaaactctgaatattgaaaacctcttcagagaccaaattcattgctgggtgaaggcaaaggtggtcaacacatccatcactccattgaaactctgtcaagcaacacagcactgaaagagaaaaatgagctttagcttaactgggatatttctgctttccattaaaatgttgggtggaagctggaagacaacaggaaaaagaaaagaaccatctgtataagataataatgttatttaaaataaataaggtagtaaatgacaggctaccaaatcaagtgtgtgggatgagttttgtagctgaaatctgacatttttacttcaggccacaaatccagagtcagtcctgagacaaggaaacagtttgggctctgttcccagaggacaaggagaaggcagagaagatgactgccaactgaaagctaaaaagaccacaatttctctgcctctgtttttgccctgggataaacagtgttgaagagaggaaagtgtccaggttatttataagtgtatgagtgttatgtagaataagacaactattaaggccagattggggcagcatctagcctgccagatacttaagatcccagtccaaagctttgaggtatttatttctaaggatctccatgtagagaatgacagcaatccttactttaacaggttttacctaataaataaaggactgatgatgggtgagggtgtgtgtcctgaaggaggaagaaaggagagagagaccaagcaggctctgcctttacttgaaagctttgtacaatcctttgtacaataccctctcaatttctccattttcttcacaaatggagctatcctggctcatggggagaagacacatggtgtgttccttgatggtttaaataaaattcaaatgataaaaaagaggtgcatgggtaaagtcacagggccataaagaatgttctataaatttctgtcagaggacatgctttgaaattgcttatagagccatgtgctacattgaaattattacggcttataacaatggagttaagccactcaggcactgctctagggaatgtaaattgataagatctatgccaatatttaccaaaagccttagaaatggacataagatttaacttagtaattctacagtaggaatgtatttattcccgtagcaaaatttcactgaacttctacttggtgacttcatgccaggcagtatgctagggacttgggacagtgaaaagaactagacaagaatcacccaatcagattaggcacagagttacatgcagtgatgttcactgtatctctctttataatacaaaaactccaaaactatctaaatattcatcagcaaagtagatatttaaaattctatggtgtagccaaagtgtggcatattatgtactcattacaaagtggaaggctggatggggtggctcatgcctgtaatcccagcactttgggaggccgaggcgggtggatcaagtcacctgaggtcaggagttcgagaccagcctggccaacatggcgaatccccatctctactaaaactacaaaaattagctggccatggtggcgtgcatctgtaataccagctactggggaggttagggcaggaagagttgcttgaaccagggaggtggaggtggcagtgagccaagatcacgccactgctctccagcctgggtgacagggcgagactctgtctcaaaaaaaaaaaaaaaaaaaaaaaggaaattgaaggatatggtaaaatgccattagattataaagacaaaaaaacttacaaaatagcatatatcatataagctcaatttactgcaaaaatacattcatagaaatagaacgcaccgaaatgcagaaaaatacatagaaaaacaggctagcatatatacaatgaaatactaacagaagttatctttatgtgatgagattacaggtgatttttattttcttcttcatatttgaaagtttgttttttcaaattccccacaaataactattacttttactgtaaaaactgtaaaatagatatttttgggaaaattgttgcctgtagctccacagaatactataaataattcccaaagctgggctgacaatattgaatcctgttaggtgtcccacattacactgcaagaaggaaagcttcatattagtttaggtactggatattgcaaaactgtaaaatgaaatgcttcaatgtaacatttgcaatttagttggctacaggcaaaacaatgtcttttgaaaatacagtgaagaaaaaagaatatctaaatatctgtgtctaaggactcctctagatgtaaaattttatgattgtgtggcaaatgtgaacaagtccttcccacacactccaagttaacaaaaagctctgaatgttatgacaagacatatggatgtaatcccactacagtagtttgatgatgatgccagatgattcaaaaaataattagctgccatgttaagaaagtatctccttatatatatatatttacatttatcacactctaaaataacactggaaaaaatggcaagctacgttaagaggagataagatgtcatcttcaattagatttctcaaccattttttttaaatttatgaaatcagttccttttcaaatgagaaagtatggtggtctttgtgttaaataaatgaaattcttactttaattactgagttatttaatcttaattacacttgagcatattattgtattcctcagtaaagtaaaatcttttctaatagtttaagtctctcttgccatatattttagcccaagcacggttaagtagcatgttcctacaagtctcaattttatcacttcgctataaaaaaggtctcgaggctacacctacacccaataccaagttaaagcaaacctctttgaagctcacaaatgtcttccagagacacttaaaaaaatcctttgaataatgaagaacagtgctaaaacagtgaatatggaataaatgaaaactactttttaaaaacacttcaaaatgcttttgtccactaagcaatttcattttaacagacagacaatgataaagggtcttgagtaatgtgtgtaaacctaatttgaaagagagaaaaaacatcaaacaattatgcaggacttggagcatattttcgtcacttattaaacactggcataggtaaatagctgctattcaccatgcctctcgggaaaacctcttggctatggagtcttattaatgttaagcatctgagagccatgggctataaaataaaatcaataccataaccttaactgtaaaagtcagaaagatactggaagggctctaatttaacaagattacagatgagttttcagaggagaacatttggggaaaagccatacatttaaaaacatttatgctacaagacatctcaaggtttttgttgttactaatgctgttattatccacgctggtaatggttagagttgatttaactgatgtgttactttagtggatttacaggaaagtcctataaatgatctggaacttacttcaaataaaatcattacactgaggtagtaaactaattgcttgagaacaattatgatttgatgtgatttagtgtggtagaaaaagaattacaaaaattttaaggtcatcagttcagcagctcaatgcaaatatgattactctgcacaatattctgttgctcttaatggaaaagtagtcaaaattggtataaattgtagtgtttaagttcaacctaaatctatattttttttctccaacaaatgtaaatgaagaaaaaaagaacattctgtcaatgaaattactatgatggcatatttattatcctaatggttttagaaatcatgtgaaattcatcagtaacaaaacctctatttagtaatggaccaattacatttgtgagataatgtcaatgaaaccgaatattgtcacaggataatggtctcccattgctacatccctagtcatttagagaaaataaatgttgctgtctggctgagtcatttgttttcaaagtaggagacactgattccataacaaggttctgttataataactcaatctctatcaatcatttgttgcaccagaatggtgcaggacaggacatgcatttgtgagaactgcgcattcctcaggtataaagcaaaatatacggggcctccaagcacataagcagcccaattattgttattcaatgagagtgtttaaaatgaacattcaaaaaataatttaagaaacagaaaactttctgaattttccaaaagatccatgttaatgacggctttggaaagactcaagtactgaagatcttcaaattcttggactccaatagattcaaaatctaaaatattagaacacaaatcttagtatacaactttgttattttacagatgggaaaactcaagagttactgaagttaagtgatttgtctaagaccacaccagtatttagagtttcctaatcacaattacagtgcactaggcttaaggcaaaaagactagaacagaactaaaagaaaacatatgtatgataataaatatatactttatttttatattttgacaaatatagctcattttaaactggccatatatcacacacttctactaaagacattctagaacttaggattatttattactatcttattaaatggaaaagtgattttaacctgatttcagagcaaggactacatgcatgaatctctaaggagtctacgaacccctgtgaagttatgtgcattcatctgtattgaagtttcatgcattaaaaaaaattgtaacagaggttttataattagtttgcaaaatcataaacataatatctcaatgacttatttgggatacagtattatatagcaataacgagcatgggtttcttcagcaagagagccaggggttcccattctacctctgctacttatgatctgcatgatctatgatgagtttcttaagcatgatcagtttagtaagctgtaaaatggggtttctgtcaggtttaaaagaaaaatagatataaacttagccaagcacctgacagaaaggaagggctcaataaataaatgacaaccacaaatggcaatagaatcttgttttccatgtttcatttacatgtgcttgttgaagacaatttttaaatttacatgctttcttcaataaataaataacacagaaaaaggaggcgaataatcagtgtaggctaaaaagaaggtgaaaatacaaatataatctatggactaaatttgagtcctgattcaaacaagacaacctttgagatattctagggaatttgaacatggattatatgttagattatattaagaaattaatgttatatttgttaaattgataatagtactgtgattatgtaaaaaaaaaaagttcattgttcgaaatattcagatctatttacatgcaaaatgacagatatctgggatttgctttaaaatacttttaaaaactgggagatagtaaatgcaataagactggcaaagtgttaataacagttgaagctgtgtgacagtacagtgaggttcactttacaattctactttcaatattctccaggccaaaagacttcttaaaattgtgcttaaacattcatttcaaacaaactcttccccacatttattcttcaaaagcattcatatcttcagtttattttagttgaaaaaattttaatcctggcactaataataatagttgatttatgtgtgtgtgtgtgtgtgtatgtatatgtaaaattttaccatctcaaaattttgttttgagaattctttcagaaccctgaaaactcacaaatacacctctattttctcattctagttctgttaggtctaacagagtcttccttaagctttccaagaaaagtgtccctctgggaagacttgcgaagcagtgtttaaatctcctaggccatttgtaagtttacatactgattccctaggcaggctgcaggataacagaaaatgaaaaaaatcccttgaacaaagatctaggctctgccattcattagttgggacaggacagcctctctgatccttggactacttagctgtgaaacaggagcttgaattatgtcttactaagggttctaataatttgtgatctgtacctgaaaaatcaatttcttattgtatatgatattgggagtctaataactcaaatgacactggctttccaaactacttcacaataagcttaaacatgaactcaatatgtaaaaagatttgaaataaaaccttttcttatgcagagaaactttgtatggcacactatgacattatctcccatgggtttcccacttccctattttaagctgtgttccatcaagctagaaacccagtattaaatagaaagttgttattttttcaaactaattatctattgtggtttttctgcaaaatgctgtattttcaaatctttaagcctccagagcacagaaatatgagcacgacttttccatattaatcagtaccagcccttctaacatgtatacaagtttaccccatccaaaatgctattcttgattagaacacatgaagggggaacaaacattcactaattaggaggcaatgtggggaattctgatgaaagccttcaccaacaatttattgttttcctttccattttgaagaagatcgtgttgtgatttttcaattacagcagtgtagcagtgtagttgaagaggcattcctcttcagggtggaagcatccttgaagtttgctttccaatgccagggtagtacctagaaattcacttagagttctttacttttgatattttccataataagaagctaaacaaagaaacttaaaaattgggcttgaacatcaaattcaaaccatctcttcttcacattcatccaccaaaagcatttgtagctctctttttttctggttcaaaactttggtatttgaatatttgccatttcatccctgtgatactaactgcaggaatataaggaattgttggtgttctatttggtccccaaagagaactttaaaacttcttccagtatggttactaagctgtctgcactgccattttctaggacttcatttaatgttaatgactcccagatagcagttattcaaccatctatgacagctgcttattcactcagctcccacagctctagagaaatcttgagattatatcatttgtcagactgtggtttggactagagcactgtgttccaaagtttgggcctaggattaatgctccctatggattctttgatagaaataaaaggttctgaagtcacaaacttaataaacatgttcagtcaagagccactcctggatattcacagcacacagtagcatattaaatattctgcatattcatttatgaatgaaaatagttgaaatttttgttacaaaaaaactttgcaaatttagctgaccactcttttgtatgtagcatatcttttcacattcctaaactcacattaggaaatgctggggagcctggtgtggtgcctcacacctgcaatcccatcactttgggaggcccaggtaggaggatcagttgagcccaggagttccagaacagcatgggtaacatagtgagaccccagctctacacaaaatttaaaaattagctgggcatggtggcaagtgcctgtagtcccagctacctgtgaagctgaggtgggaggatcacttgaacctgggggggtcagggctacagtgagccatgatcgtgccgctgcactccatcctgggcaacagacagagaaaaaacagaaatgctggcctctgattctggttctgtcagcatgctatcacactcttatttactgttacttatttcctgattgagcacataatactaaactggcatttttactctctagcccccagtgttcccttgggccctctggcttaatgcgtttgacatttaatactatatccttatagaactctagaaagtgcaaactgaaatttagcacaacagttaagactaccttactaatgagaatattttcaaaattatcaaaaataaatctctaggacttggaaacaaattaaaatttcagaaagacttaactgagaagacatttatataacagaactggagacttgtataaaaattagtagttttattttttagtacctaagacaccagaacacaatgcctaaatatagcttgagagtccagtttaatttttcaaactactctccaaattgtaataacatgccaatataccaagtagtgctagtttttgctaacatgccaatttattgattttatgtaaagatttacggctcatcgtccttaaaactaagctagctctaaagcatggagtcggttctctcataatcttatttattttagtccccgatttttctaaatagtaaaagttacttttccattcaggaggtcaagggctggaaacttaatttattcatatttgtgtacccaatgcctataaaaattcctccaatataatatagacatttgacaaattgttcattgaaccaaattatctcaaatcccatacatgtagaaattaataacattttactgcataaagtctttttgaatttatattttatctaagattacaggttgtttaaatactcatctggctgaaaagctgttcaaatttccatttagaaatccccagctgagggcaacccgctggggtcccccttccacactgtggaagctttgttctttcactctttgcaataaatcttgctgctgctcacaaaaaaaaaaaaaaaaaaaaaaaacaacgaaatccccagctgcatactgcaaatatatttaacatatcatattttttctcattaaatgtctattaaatgttttagaaattttacattcagacttagataaattagtgactattagaatggcagtggcaaagtgaccttataaagaattgttttcaatgttcaagcatactatttatttgtctgttaaattactgagtgatatggtttagctgtgtccccacccaaatctcatcttgaattgtaactcccacaattcccacgtgacatgggaggaacctggtgggaggagactgagttatgggggcagatctttcctgtgttgttctcgtgatagtgaatgagtctcacaagatctgagggttttaaaaacaggagttccctgcacaagctctctctttgcctgccaccatccatataagacgtgacttgctcctccttccaccatgactgtgaagcctacccagccaataaacctcttccttttgtaaattgcccagtctcaagtaggtctttatcagcagcatgaaaatggactaacacactgagcaacggaatacaactggatttagtctcatgagagtaacttgaattagacgaaaaactatgacctcttatttttcctcttatatcaaaagttacaaaagattgctctaaagaaaaatttcaaaaaaagtacatcaactagaaattgagtctctgaattgactcagatggaaaaaaaaataagaaagacaagatcttaatggaattttttatggaggaagtattggaataaaagaaatgttcaacttgcctgttgacagtctaatctggttctattcattaatcattaaaatcttaaatgaagaaaagcaatatccaaaaaagaaagtttttaatagagagagaagcagtcaggagtttaagaccaggatttacagaagagactaagcaaggagaaatattctgaaacataggaaagaaatataacagttgttggatacccctttgctagtgactcagtattattttccttttcattttgttctgtatatataaaataatacaaagtaaaaatataaatactacataatatagatgctgacaaatttaattttcatcactattcatcagaagaagcaaattatatagccccctaccaaatgcttaacactattaaattatggttagttttaaaatattcatgtctatatttgcagaagtataaattacaattctcttataatcaggaagttgtaactttttgttttgaaaagaaattacataaggacataattaatttattattgtaatatgctaaaaatactttttcattaagttactaaaattgcatgaacatattattacataaacctagattttgtgttaatattttgcctgatttattttaagaacagaatacatataataatttggtcatattatatcctttatttttgcctactcagaataaatctcaatggtttaggttggtatttcagattgaaagggaaagcagaatgccacatattgtccataattttgttatctttgattctcatatttaataaatcaattttgctaagggctatgtcaagaacagattttaatgcaaatttaacactaacagaataaggcatacccaggaaataattaatagtaaattttaaggatttctgcccattttaaacacaagcatattttaattaaccaataaatagttattgagtatcaattagtgcagggctttgtaggagaaaatattataaatacaagacatgtcaaagctatttcaatgactggagtggcactcaatatgtgctttagacaactccctccatcacagggaagtgtgtctaaagaacattagaagatggacaagaacaaccattgggcattttattttgcaaatttttaaaaagcaattttctaagaacaaaaggactgcattgggcttagcaaatttataaagatagtactgtactgcccgcatttcttcattgtagttgagtcttcttcccacaatggcttattgtgcacattacgaagtcttcagggtcttcagaattaaagtgacagagtgtgtgtgtgtgtgtgtgtgtgtgtgtgtgtgtgtgtgtgtttaaaatgcacatttgagaatggaatattcttccttcctctaaacataatatgcctttacagactcctccaataagtctagtcatcttgacaaaagaaaatcaccaagacaatacaatgttttcacaaagaaaaagaatgacagtttcccttctacttttcaaaaatgtttcataatatgatttgagattggctttattcagtaggcttaaagaggaatcaattcttacaaagtgacactctctataataaagaacacctacacttctgaataacgcatccattcccacacattcacaaggttattaccattaaaatcttctccagaagaattttctgacaaggaaagtatggctttgtttagaataagctgacaatgtcagtaaaacaagcaataaaatataaagggttgagggttttgtttttcgtttcacttctgcaactctggtaaaagtctctattatatcttgccttcactaatgagactggtgttctgcctatcaatggttcatttatacaactacttattgtactcctactacgcaccaagtgtgtgttaagtgctggttacagtaatagtcaaaatagacaaggtcccttctctcacagtgtagacagatttagacaactaatcccataaatagctatatgattacatattatgagtacaatgaaagaacagtactgggtgttgacagagaaaactaggaagacagaatttagactgaaatttctcagtttaagctgggctctgaaggatggcaaagagtttgccagatgaagagttagcagagcattccagaggtcataacttataggaaggtcccggttgttgaattcgcaacttcaagtaaagcagtgggctcaagtgcaagcaagaggaagcagaatgtcacctgccaaggctatggcctgttggtgatatgaaaagattcccattttttcctgagagcagtgggaattgactaaaggatctgaagtaggggaataaaatgctgttatttacattttataaagatgatttttacctactgcctgaaaaatagatttggtggggtctctcatgaggggagtctcagagacaaaattccgtctgaggggggggtctcacagtcaaaactctccagttgagtttcatatccttgcataaaatgacccttgccatctctattatttccctccatgtgcactgtgtccagccacatggcacacacagccattctcaaatttgcctccccacctaacacagggttatgcttttgtctcagttcccaccaccaccctcttcagcccctcacttctttactagttaaaatctcaaggagatttagatgagatttaggaatcgagctttgagtcagttgtgctaaaggaggtacacttgactcaaaggccaatgtctccatgaagatttttcactattctttaaactccatggcactcggtataaaaaatttgagcagcaaagaaggagcactgaataaagaactgactttggccttaactgttaaggcccagagttatgtgtctcctaagagtactcaacatagagtaccccaaccctcaccaatacacacccaagtcctgggctgaaaaccattattcctttcttttagacttttttttttttttttttgagacagggtctcactctgttacccaggctagagtacagtggtgtgatcacagcttactccatcctctgcttcccaggctcaactgatcctcccacctcagcctcctgagtagctgagactacaggcgcacaccactatgcttggcttacgttttattttttttttgtagagatggggtcttgccacattgcccaggctagattttttttaatgcagaattctatttaaaagacaatttaaaaatacatgtttatgctgctgacattaagatcttatttgcagacatgcttacataccaacaaaaacttcagttagctaatttttctatttccatgcttaataatctccctctgattgtgggggaaagcatggatatatctaatgaaatatagtaaatccaacagactttaagaagagctaagtctcaatccttccgggtctcaatacccatttcttaaagttatatttctcctcaaagctgccctagaactgggtcacagttttatctagaaagcatagctagattgactccaacacaaagtatcttacattacacttttctttattgtatatggtctacctacttccaaaaggaattgcaggttcctttaaatgacaactttcagttcctggcacttgcaaactgcttaaagtttggctccctgcaacgctccatagagaggagcaggcggatctaattgaatcacagtttgtggttctgctgtactccaaccaacaaatgtagacagaccataatcagtcacatacataattgtgggttctaaaatatcattttgtctaaaaaaaactccaacgaaacatgtaaaaataagattttggataaattaactttgacgacatttgactaacattatctcaaaaataattctacaggaatcattttatgaaaaaaatatacaatccatattggtttaattatgaaattttgactcaacgaaacttaagaaacgagccaacattttactcatggtctctagaggcatctccttattactcaccttgatctctttcgtgccatgttcgacttccagcagctggtgaacttggagaggggtaaaagtctcctgtaggacttggttccatattttcatctatggatatagttttgggtcttttgctgttaaaatatggcaatagttatattaatgggatttctgggaagatgtgtacattttaaagtaaatgatctgagaagatccttactgtgaaaattttcataagcacaagtaataatggtgagtataatggtgagtattgaagatatcaatagtaatagcaaatatttctagttgcatataccatttattagaccatcttatacctaacctgtctaacaaatatggtgttcattatatttatctttcaaatgtatttccaaaaaaaattccactaataaaaagtgaactcttaatgttgtttgccttctaacattaaaattgtgttattgtgtacctgactcattattattatcaatactaacaatgttccttttaatagcacttgtcattgacaatgcaatccaaagataaggtaataaagtaaaacaagagctttggggtcaagacagtcctagtataaaatcttgagtaggccacttatgaattgctaatagtaagctccttaacttatctaaactcagtttaatcatctgtaaattggaaacaataaaacctagttcaaaggcagacggttggaagagtaaaatgagttgttaaatgtaaagcttttagttaagtggctggcatttagaagatacttatcaaatagtaattcttagtaataaccctatcattaataataaaaaattatagtattttactgattataaactatttcatatattattctttactttttcttaaaacttagattattgattctttattcttaaaatcgactgtgaaaaaaagaaggccactgccaaattcaaacttttaaaatgatactttttttttttttttttttttgagactgggtctcactctttcacctacgatgtagtacactgtggctcaatcttggctcacagcaaactccacctcccaggctcaaacaatcctcccacctcagcctcccaagtagcttgaactataggtgcctgtcaccacacccagctgattttagtattttttgtagagatggggttttgctattttgccctggctggtgttgaattcctggactcaagcgatcctcccacttcagcctcccaaagtgctgggattacaggcaggagccactgtgctcagccaaaatgatacattttaatatggaaatatgactcatctcaatgaataagaaaggtgactatccagaacaaagattaagaagctattttatacccatagtggttgatatacttctttcatatgcccccaccaataaagcagacaattatgaaattatgactataaaagtgaattcttttctttttttgtttgtttgtttttgagacagggtctcactctgttgtccaggctggagtgcagttgcatgaccacagctcactgcagcctcaagctcctgggctcaagtgatcctcctaccacagccgcccaaatagttaggatcacacacacatgccaccaagccttgctaattaaaaaaattttttgtagagagggagttgtccaggctggtcttgaactcctaggttcaagtgatcctcctgcctgggcctcccaaagtactgggaatccagctgtgagtcactgtgcccagtgaatattttttctttaattaaaaaaaaaatcttattcacacctatgctggtaaaacctttttaaaaatcttcaaaattcacttttcgcagcaataataaccataatgttataggatttcagcattgaaattgacctcaaaaatcatatacataaaccaatccccttgtttttacaaatggggagacacatttggagagattcagtggactgtccagggcaagttaatggaagcagtcagacataaggtaaggacgtctgacttccgcaagtgtgctctttccactgcactgtgtttccaagcccttgaatcatgtatatgcctgagtacatttgtagatactcatgattaatatttgactcacaattctcagagtattaacgatgtagaagatggcaatttctatccatgctaagcttagtttcttcccaaagaatccaaagttagaccttacattttaactctcttttaaacatattctctcatctatgagtcagcagaaaatctgcctgaaaaacttaaaattggggacaaattacatgcataaggaagtactagagaaatgttttttaaaccttgcttactctgaaagacagtatcttatataaagtagtcaggaagaaagatctgtgttgacaacagtgatttagcagacagaatttaaaaattactgctcacattttaaatttagaaaaatcaaagcatttctaagactttgatatgtcagagactattttaataataaaccaaattatcttgctacacaatttaactatatgaaaatggtttaaccggaactgatataaaattgatcttagtttataaacatacacatgcccagtccataattaattcaaattcaacgaactttcactactgagaatactttagaaaaataaatatacaggtatccttttatttttaaaaagttgacattgtaaaatgagtgttttgctctagaattcatgtatgctcttatatttgattacacatatatttaatgctctaggaatgagatgggtcttgaagatctagctcaaataaaaaaaaattaacacatctgtaatctttattcaccctgactggcaattacaatgagaagatcaggaaaaaaaaaatgagaatgttaacagagaagtaaaaagcaaagagaactctctctagctgacccccaacatagaatggttaaaccaaatctcagggaaggtagtattttcattggtaacagagcgttaattaaattagtcaaaaaacatcaactaattgaagaacttggcaaactgtggtctttaattttaaggctaggtaaatgacacattttattttttatgtttcattatcctaagcttagatgtaatatttgggtaaaagttaccaggaatcagttataaaccagagatcattgccacagcaacatcatttttaaagccatcaaaagattttgttaacttgtagcattttaatatttcctacaacaggacaaaagtcatattaatatattttcctagttacctgtccccctgaaaaagatttttaaaactgctgtgtacaacaattacatttaatttgtaacagccaaataaatttaaccaggaaagattaaaaatctgtgtactaccagcaaaaattatttcccatctctctttacctacctacctatctatctgcctatcatccacctacgaacctatgtgtgtatcacttgagaatatgagcagcccttctttcagtacctgcttggtggagaagacagagacctctgaagattgacccccgagttcatgtcatgatagtatggttggcttgggatttctccaattgggaagttgactccagttccctgggttatgggcgctgaggaataagacaaagaagcactgggaatgacattcgtatttctgacctctattcaaatgtaataatcgagaatctttcatgcctctggtcaaagatagagagaactttcttcaccttaagcctctaatacccaccatacaacctgggtaggacctgaaaacttgctcaccttagcaacgttcaagcttggaaatttgaggcaatcagattataatcactggttaccaatttcccgaatcctattcctcaaccttctttactcactcctttatattagttgacattacatctgtcactctgctagttaaaaatgccttggaggaaacagaatatacgagtcctatcactcagcaacaccaaacaagctgctttgcactacctaggctctcgaaaaccaaatcattgttaaataaataaacagagaaccgtttcacaaaaaaaagcaaaaatcattattcacagcctcccagttaggatatgataataattattaatatcatgacttctaatccactcaaatattaatgttgatattaatgttgataatatagaataataatttttggtttgtaacacaaaggataaatgcttcaggtgatggataccccatttaccctgatgtgattattatgcattgtatgtctttatcaaaatatctcatgatattttgtataattacatctgttcacattttttaaatttaattttagatatcatgaacaaagctgtgaggcagcatattgtgttagaatcagcagagtcttgagagataaatagccttttagtttaaactccctctgtattataagttatgtgccctagtttcctaactgtaaaatgggagtaataataaccggacacataggattattttgaggatgaaatgaaataggtagtgataagagcctagaatcatgcctagtgtataacacgtgctcaaccattgtgagttcccttccttctttgctttctcctccaaacttcttccctggtagactggaatggttagcaaagatgaacagttcaaaaacgtgttaaaagcagaggaagaggtataaatgaacctgttcgctgaaaatttgttcattcaacaaattactgactgtgtccactgctggcaggtgttggctgcaatgtgtacaaaatagtctcatatattgcccttaataaaaatattgggcaacaagctgggtaagtaaaacattcatgcgaaacacataaataccaaaatagatgaaaatgaaactgtccaaattaatgacatgatccaaaactgctgtagaatttcaagggaaaaagaatccaataccagcttgaattgtccaagaagtctgcgaaaagccatagctggcactggactctggagaatgagtaagagattagagggaggtcattctaaacagggactgctgcagaagcaaaatcataggtagagataatgtgcaaagtggagaccaggcaggttggtgtcaaagaactccttaagaatagtttccatttctttacctgtcttaatcagcccttcaaaagctcacacgaaattgtactctggggctttgcaacaaaattctagagcccctgagatgcactctaagcatacgtggtctacttaaactcctcctctctcccatctgcctcaagttgagtataaaattccaaagggattgcagatttttatggaagttttcttacccctcatttttaatgaatattctaaatgtgttcactaccctttgaattgtattttaatattaggcaggctaagattaacttaaaatatttttaagaaagtatgattaggaggtacaagctttatcacagagaagtaaccacggaatacacaatgaacatctccctttctggactaaaaattaaatacatcagtatatacatgactagtaacagctccaaacttctggattatctatcagccttctgatagattgttcatgttatataatacactgtaacatcctttacacagaaaatacttgtatccaatgagtaactaagtgcctgatggcttgaattatttggacagctaaaatgtagctatgtctgttgtggcttgaggcacaccaaaggttaaaaaaatgtgaggtaagaaatcccacagtaaccgcatgttttataatttattattagaaccatgttctatatgacactggaagtggggtacatgctagaaggagtatttcaggggctcaagtgaagtaaacaatctgtctggcttcctatcacagtaatggatacaattcatagacctgagttattaacaggaaacttagaggttccaccttacataaactattttcaatttattaagctcatgcaatatttaggcaaagatttatagtttctattgaatacatatggctccatagttaacataatttgcttacccataaataaactagatgtaatttgtagtaaatgataattttaaaatcttcagaaattgtttttttctaaattttgttccagaaagattattccgcagtgtcaagacagcaataaaaacgacaaatatagcatgttctcactcatacatgggagcttaaaaagttgatctcatcgaaggggttgtcagaggtgggggagggtggggaggtgaggagatgaagagagattggttaatgggtaaaaacatacagttataatagacagaaagaataatttccagtatttgatagcacagcagggtggctacagttaacaacaatatattacatattttaaaatagcaaaaaaagaagatttgaaacattcccaacatgaagaaatgataaatgtttgagatgacagatatcctaaatagcctgatttaatcattatacactgtatgcatggatccagagatcacatggattccataaatatgtacacatattatgttttaattttgtaaagatagcaataaaataatttgtctacggatttatgcatgagcactgtaaaaatttagtatgcattctgacactaaatgggagatacagaaaggaaagtagattaacaaacacggccaaagtactaaaacaacacacatggaaattatttaatgacagagtgtgtgggaacagcaagtctcagtcagatattcctgcttaagagcctctggaagaacttacatcagacgcaaagatcagtgttagcgcctctcccagggagctacaagaaggctgaaagctgcaaatcatgtttaagaggatgccgatatcctcttagaaatgaagcaccaaagaacctcagattctaagggttagaggccaacctttaatctcccttattgttctcctcactccaaaagctgatcctaaatcaacttttaagatggagataatatcattcaaaagagagatcactatcctaatgctgaatggcttcattagctaaagtcaacatacacatcagtgggtcttatgattgtaaaaccctagaggactgaaagcactagcatactgtaaaccctcaagaagtcagaatttgtgatacacacatagtgttgtgctgaagtttatgtttacttagcaaacccctatttcataaataatgaagtttaattgtgtaaacaaagattatgatgcggatatattaaaacacttaggaggagaacttatcaggcctttcagagacacctatttacatatggaggagaaaataaatgtttgctgaataaattacgtaatgaatatagataattaatgtgctaattacaaatcagtaatgtttgttataacaaataacctaaaagtttctaggatatgacattataagttaagaatgaatgaatgaagtatattaaatttaccttggttttgaactgttctagaaagataattttcatctttgttttaatgtttgaaattcagatttttcaaaatatctatctgggcttttgaaggttctaatgtggttctcctttgacagcccttagcataatattacctatcatgaggtactaaataaatattttctgacagctgactctactgccctactcctaagaaggatgaaaatataccattgaacttgaactcagagaagtacaaatttaagcaaataatttaataagcctcctaactggagcaccataagcctttccgctaaagaagagtatggggaagacacacacaccccttcagataacccctgtcttacctgatgctacaaagtgctactggtaagtcaggcatatttcttcccaaattaaaagtgaaaactttcaaatgttggatacctttggatatcacatattgatctggaaaaacacattaaggtacactgccttggacaatctccttgcccatcgaatacacaccctggggctaccagaatacaggatatttgtgtttcttctcctacactgccaccatgtaaaaagacccatgagagaagtcttttgggcatacatttatccactctagaattataccagaaaggataaactacttaagatcttaaacgttcatatgtatcactccctgctatacatgctatttgcactgttcactttagaaatgtgagctatttgaggaactacggttcaaaagacagtcagtgatagcgtgaagattcctttactgaacaacaagactctaaaacactgcttattcttatcctcagtaactcgattactctttgttctttctggatcatcataattcttattcatgacctctaaatatgacccaaatgagaaacacaacttaggcaggtatcagagtgtgactacatcatctgaataacatcactccgaagtgtgatgcattctatcaaaatgtcaggtgaaaatatacccttcaaagttacataaataagctaaatcagtgaagggagtatgaagaaaggagtcaccttctttaacataattagtacatatagatctgcatcttggatatgtttgtacatgctagtaataagtaaaagagttaatcaaggtaacgtcccctttgcttaggtagcctgccaggtgagcttagcctagaaaaatctgatccagcctgctaagaatggtgtctcaggtgaagtggccagttaaaacaattggacattgttttggataacaatgctttctatctatatccaactacaatctgcaaagttaatttctgcatccctctacactctgcacgttagtgtgtatatcctgtgcatctccaacccccaccaaaatgttagtaaaatgaaaaagcacttatctacaggaaacttatgtgggttatcataacaacatagagtacatttaattaatcacacttcctttgatataaatggccatctatggtcatgcagagaacagtgaattaaatgaataccaataacatggcaatcagaaaaaccccaaaattatttttgtacaacaaaaagttttgatgatttgaatgcaaacattttagaaaatcaagcaaaatatattgttatttcatcaaaggttttaagattttaattcaaattttcctaatatgtggtcactctttatactacatttaaggttcaaaatataaagtattttaaatcatactgcatgcttaagtagtaacaaaacaatttacttacttctggatactcttacaagttctgatacattgaagactccagattttacaaaactatcctcaaggtaacctgaaaataaatattaaaggaaaaatgatcaatataagcagaaagtaaaataaatgattatacactagaatttaagtgttttaaagccaatggtttgaacaaaaaccaaatatgcttacaataaggactttaaaaaatgactcttaggaatgcaaattaggtttgtttaaacaaaaataaaaagtttagataccaaataatctcttaggaaaattttttcttccctttctaaaagtacaggtttattgatgcggtttgatttgccatggcccatgcatacagaatggtctgtgggctctcagtgaatgcttttgactcggtagcacctggtagactaaagcgaaaaatgaaagaaagaaaaaggaaaccacaaccacaattagcaccttgctggaataatgtcaaagatctcttaaagccaccgttcttttgtaaacccttctctgatgaaagaaaagtgaactgctgttaccagcaccccgacccttgttccagggtcactaataacataaaaagcagaacttgtatatacagcaaatacagaactttgcgttgacctatttctgggcatctttaatatacgttgcacgatttcactgctttcctcacccttgctactattccactggactccttttatttcaagaattagacaacttttctggcaaatggtggtgaatccaggcctctgggaatgccacatgacccttaagtcacaccggggcagggtccacagtggccatggagcctgcttgctagctggtctatgtccaaaactagagatgagaactcccacaaacaacagtaaccctgcacccagcccaccccattctcatctatgttaagggggtgtaatgagtgtgaggaataccttagcaggggaggttatggcctacttgcttctgtcctagggtgagaataagtttgaaaatcctcagaattgaaatacatctgagaaacaaacaaacaaaactagattctaagaactggcaatttgactggattttacataaagcttcagggctgaccaaggaattagatgcagttcagagatgtgaagcatgggtagtgcagcaacatggagcactgaaatcaaagagctgggatttgaatcctagccacagatgaccagttatgaaatcttggctaggttattagtcctctttttgcctcagattcctcacttaacaaattggagacaataaaaatcacctatcttatagagttgttactactggagataaaaatataaaccccatgataagcatgttaccaacaaattaagatcttagggccagtggaacctgcgatcagctatataccgaattacgcacactggcctccagacagtccaaaatgatccgcaaatctttattcagaaaatttaccagaacaaaaggcaccacactgcttttcaaccatacatagcatgaaaagacagaaaatcattcaattagcatatgtgtttcactgctgtgaactgaggagccactgatgtttgacatccacccacccaccttctttagaaacagaatgaaagaaggagtgagaggaagttgtaagatctcagtagggaataaaacaggtgccacattaagtcattattctgaaaaatatatatacatttttaagagtattataacaaaatgtcccaatttaatgcacttctattttaagaaactcttatttcttgagcaattaatttttaccaggttaaattcatttcagtaattattgagaaacttctaagtaacaatcactgtacaaggtgctaaaagtcatgaatacaaaaaaggacactgactgtcttgcctggtcggggaaagagatgttttgactcttctggaccactgtaacttactatcatatagaaagatttttgttgcttttgttattgtttatagttcattatactttattttatatagggtaaacttaataaagtaaatatattaagtacaaaaccttctttatcttgggaggccgaggtgggtggatcacaagatcaggagtttgagaccagcctggccaatatggtgaaaccccatctccactaaaaatacaaaaattagccgggcatggtggcgggcacctgtagtctcagctactcgggaggccgaggcaggagaatcacttgaacccggaaggcagaggttgtagtgagccgagatggagccattgcattccagtctgggcgacagaacaagactccatctcaaaaaaaaaaaaaaaacaaaacaaaacaaaaaaacaaaacaacctcctttatcatgactacagctcatatacttaaccagtcacacaagattatttttcatcacccaattgtactttgtaaatgcctacccttcatatcttcctcctgcagctccctgagatgagatggccctctttctacacactctagtctcatccttcaaaatccagcccaaccaccacccactctgtaaactgctcctccaactccttctaccacccactggcccagccagaaatctccttcctctgtacttgtatagcacctagtttgtactaattttatactttgtactttcagattttctgagagatctgttttcaagtcttgcagtcattgctggattatcagatcctttatttacagaagtgactgggttttgttcatctctatatcttccttaatgactaactcgttgcctatatatagagtaagtactaaataaacacagaacaaaattttaaaattcaactttacaaacagggtcacacattaacatcttagtcattttattacaatgtagatacagatggtttaagatttatggataattatactaacctctgttattccctagaacttgtttgctgaagagtgtatttaggcttttgggtcacatgagaaagagtaatgattagggtcggattgtatctcttactttgttgtgtactaatgtgtaatgtcaagcatttaatacaaagtaacaaccaaagaactggaagtgtttaaatagtaagagcccaaaaatatttgtgaaacacatcgatgaataagtgatgaacatttcaatgtatttacataaactatatcagaggtaatacaaaataacattacaatatctatgtgtaatctgaagttcatttccttattactccaatgagaagtcagagatccatctgctcctaagtcatgaccattaagatggagtggggtgtgagcctgttggaagccaaatcatgaagaagggatgagtcagctcaaggccaattctaccagtgggaagacagtcaggcagtcaaacacagacaatacaatgactattgcagctattcacagaaaaaaagaagacaattcagaatgtagcagggtgtttctccactccccacccccaacttcccaggttctaagaaattggaatctacggaaacaatggaaagaggtagtttaccgaaaccatgaaaagcattggaaatatatcagaacttctttggaacctactggataaaatgcaaaaaaccacagaggtcccactgggctctactcctgcatggagcccagtgagactttagtggaggaaggtttcctgaggatgagtgatgatgcctattaaccatgtacctatgggaacagggacaggtgagaatcagccaagtggggtagcctgggagaagcaccggaagcagatggctgccaccttcatgcatctctgcaggcagcatagcctttgtaacggacaggcattaaccaagacgtggcagagtgaaaaagaaatcatggatgaaatagtactcagatacttaaaatagtacttggatacctactagtgcttactcattagcatacagaagacaatacttgagggctgtagcaaaataactgagaggattttgaaatgggcaggggtcctgcagtaggatagggggtgaaactcagcaaaatgtcaggttatctgctgctaacataaccccatctgtaacctccaaggtccttgggcctttcaggaacatgtttttcacatttcatagaccactgtaaatctaaatagctaatacaacagctaaagatcttaaagcaatttggagacattcatatagtaaattcccttcgtctaccaaaggaaatatgagcatctctgaggcagagcagctgcttaatggttacagagcaatattacacaacagcttaatccaggaagaaaagaacaactctgcatttgtgtgatgctgtatttacactacatgtgtgctttttaaaaaaaataaaattgagtaggaaataaagacttctacaaactgaaaagtctcaaaggcaatatcaaattatattattttacttcttttttatttttctctgacaaaagcaacagtaaatcactactcagaagttaatatactgtttaacctcctttacaaacaataacagagggacacaatggcatatctaactgttaatatctcaaattataatcagtaccatttgaatgttaaacaacatttacatagaaaatccaaaggaagactgataatgctcatttttacagtctactgtgttctattcttgaaattaaaaaaaaagaagccacagaaagcagttattaaattcatgaaagccgtcttcaagtattcgaaggactattaatgtagatggtggatttgacttattctgcatagttccaggagctgttttttggctcaataaacagatttgtcatccaatgggaacaggcctaaaaaggcatgtgaaattttgcaaaggtagcataaccaatatattcccaacaactgtgatgaccttcacaagcaggcattaacttcacgttcaccattatcttataaaatatgtcatattattggtgttgccattttacagatgaggaaactttcatcttacagagatagtttctcagtggctataaagactcccactggatataaaaattcttgctttgtgaaggaaatctcaaaaaaaaaaaaaaaaaaaacagaaaaaaagaagaaagcatctcaaaagccactgcaacccacagattctcccttcttacacagatgttttcctatgttagttttctggcattgttcatttggagaacaaacaggtggacataagacatctataggcattttccagccctatgattgcaattgttcactttcttcaacagagtttaaaagaaggcttaattctttttgtaaagggacaagaagagattactttatactagctctttgccaatcttcatataacttcagataccacaactaacccattggtaattttctggtagtgatgttacaggacatagttctatcttcagtttctcaactgacttgaactatccatggttaaagctaaacttgtgttgaagttaaagctgaaactgtgattataaaatagaaatattaatcattgcaaagacggtgattttcttcacagagattaaatctcagcctatagcccaggttaacattcaaatattaatttagaattaagtgtatctctcaatatgaaacgtaaacccacgaggatgatttaggtgatcttggagggagtcagaaatttcccaactttaacacgccctgatagcattatatttttttcaatatttccttccagtcctttaaactttttccgcatatatatatatatttatttataaaatcaatatcaaatttaaatatagttgtatccagcttttttcctattaacattgtatctgtccttttagataaagtttttcaaaagcatgatctttatgactatatattgcatggctgtatcatactttatattaaccattccattgtttggcattttaggttatttcccaatttttaaaatataataaacaaatagcactgtaattaacatcctcatacacaaatctttgtcagccattctcatgatttccttaggctggagttcccagaattagaattacagggtcaaaggacataaactcttttaaaactcttggtaaaaactgtcaagcagctttccacaaagttgttttgccaacttacactccttagggcaagctgtgagcatgtccatctcacaatcctgctgccagacttacatattagtagggatttgtttttaattgtggcaagttgatagagaaaaaaggtcattacattaatgttacaactttcatttatttcattttaataaaatggactcatttcagatatatgagcatatttctttcaccagaacattaagaaacaaaacattttaaaaatcagaacattcataaatacacaaacattaaaaatatataaaatagaaattgtgctagcaggaaatttttttcctaatatcaatgagattgcatctacagtttcacaatgaaaatgttggctatgaatttatcactgatttttttttctcattatctgaaaaagtactcacttattcctagttttctcagatttttaaaaagttttctgacgagaatggctattgaatattatcaaattcttttttggcattagtagagattctccggtttttttctaacagcatttattggtgttatatattactgaattcgtagatttaattatctttgctcatccatggaagacagttcttaaatttactgttgaactggttggctcagtttcttctaatatttctacaggtagctggaaagcttttatggaaatttttgtattttatttgtcaagtttttataccaggagtatacacatgcttcataaaatggttttgatcattgtcccaatatgttttatgctctggaacaaaacaaaatattatttcataaaaagttattgaatgtttggaaaactttactagtaatatcatcttccttgaatctgttgcagagaagactcttagataactctgaatcgtgaatactattctacttttgctttctaatgttgagataaattttattatatattttccaaaaaaattcaatttttcagatttataaatttattagcaccgttattttacagtttactaagtgggctatgtttatttttatggcataataaaattaaatgtatgccctcttatctttttaatggatgtggaaggtatgcctctctccaacggtgttaaagcatactagctaaaaaggcagccctggggcaagactatcaccatttactatgtaaacctaaggcaagctgtctaactcttctacacctcacatttctcttccctaaaatataggtaataatcatactacctatgagtagatgcaaaaattgcataatcttttcaagtaatagtaaagcagacatctcaagagcaggaaaagaaaaagtagaatttccaaattagcaaagagaaaagaaaacacaataaataagaatgcaatcaaggcagcaaaaataagaaaataggatgtaaaaatatataataatatgaagtaaaatataagggataaaataaaatacataaatcactacaataaatgtatatggactgaattttcccataaagggagtttaggtcaactgaaaaatacaaaatccaactgttttcaagaaacacacctaacacaaaatgataataaagagaacaaaaagttgtaaataaatgggtaggcaaagagaaatcaggcaaattcaaacaaaaaggaagcagtatcagcaacggttaagagaaaacttaagctgaattacaacaaagataattataaatggataaaaggcacaattaataaagaagataaatcataaaccccacatgcaccaaaaaatattatgaatacaatctattaaaatacaagaaactttataaaaaataaagtcacagtgagaatttttactattaatgtatctttttaagaattgaacatgactgttagacaaagactaacttcatatcattcaaatacaaattatattttactgatatgttcatggaacttctaaaaacatcgatcatgtttttgaccaaagaggcaactttaacaaatccctaaaagtacagacttttaaggccatactgtctcatctttggcaaataaaagtaaataataaaaaaatgactgaattatctcaactacctagaaattaagaaaataaaccatgaaccaaagagaaaaatcaaaagggaaattataaactatctaaaaagcaatgaaaagaaaaagaagaaagaaagaaacccattacttaccataaaagaaagaacagcatcacaaccaccccaaaaattaaaaagatgaaattaaacataaaagctgaaattaacagaatagaaaaaaagaaatatttaaaaaaataaataaaacaaatgactctctaaaaagaccaacaagacagaaaaaccacttccatgcctgattaagggaaaaagagaaagtaaaaatatacaagtatagtcatgaatggcttaatggcagggacacattctgagaaatgtgttaataggcaatttcatggttgtatgaacatcacagagtgtacttacacaaacctagatggtataacctactacacacctaggctatatgcatgaaattgcatatagctcctaggctacaaacctgtatagcatactactgtactgataccgtaggggattttaagacaatggtatgtgtgtatctaaacatatctgaacatagcaaaggtaccataaaaatattataatcttatgggaccactgccatatgtaatctgtcttcgactgacctatcatgatgtggtacatgacatacaaatataaaaagaagacataaccatagaaatcaaatacattaaaacaattatgagagaataatacatacaacttattgactacaactttgaaaacttaaatgggcaagtattagtaaactaaaagtaaccaaaattgagcagagaagtgtaaaacctgagtggaccgattatcctagtgtagtggttgccaaatttgctgaacactggaaccatctgggattcttgaaagcagtttatgtttggcttccaaccccagctattctgatttaattgatatggggtgagacctggacatgagaactcttttaaaagttcccccaagtgattcaaatgtacagcaaagtttgggaatcactatgacaccacattcagaatgtggttccagagccactagcactggcataactggggagcttattagaagtgaagaagaataggctctaccccagaccctcagaatcagaatccacagcttaatgagatctgcaggtgattcataagtgtacttaaaaatttgacaatcctagaacatactagaaatgtgagtaagaaccacctttgaaaacagcaccaggtccaggcgagtgcacagctggattttatgtatcctttatctagtctttaggttccaatgttatttacactctcccaggccttaggaaataagacaagcttcctcatgaagaacactttcttataagcctctatgaggccagcaaaacttgaatacctaaatttgtagcctctctcatcgaaacaaaacaatgaaccaaccaatgaaagatcaagcacacaagtaaatgtgacttcaagatgcctaaataaaatatgaaattgaatacagcaatattatcaaaagaacaatacactattataatcagggtttattccatgaatgagtgcagctcactatgagaaaagctatcattacgatagaggaaaaagtcatatgaccatatcaagatgctgaaaatgtacttgacaccaagaggcaggcttacctaataataaatctaagcacaaatagagacaaagcaaataatacagactcttcagcaaaattcaacaataaattattctaaaaggggaacactagtctgtcattcctattttcccaacctccccagcctcctcctctttgcagcccttaaaaatgtaatctggaaaaaagccagtcacaaaaagacaaatactgtataattccacttacatgaactatctagggtagtcaaactcatagaaacaaagtcacatggtggttgccaggggctggggagagtagggaatggagagctgttatttaacaggtattgagtttcagttttgcaagatgaaaagtttctggaggttggttgcacaatgacgtgaatacatttcacactactgtattgtacacttaaaaatggttaagatgacaaatttaatgttacgcgtatttcactaaaatttaaaaatgcagtctaaaattttggacccagattgttaaccacattcttgtttacatatattcaagaacaatcttttacattgacatttatgtctgtcatcttatttataacaattacttggtcataattctcaccttaattgttactattctcatgattagtctctatctatatttttattcatatatttatggttatactttcctgttcttaatttttttattgagtcatcacattgccagtcagaataggtattcaagtaacatttttgcaaataaaatgaggaactctattttttgataccatgagtaataaagaatatatttccattgcctttgactgtaggtgaaactccttgagtgaaaaacaatgttttttccatcacaatttcaagtattctcccactgtctcctgttatttaatgtcgataaaaggaaatctagaagtaacttgtttttcatccaggacatttcaaaattttcttcatccacgaaatgtaaaaatttcaacaggatatatttagatacaagcctctcattatgtggctggaatagcattagtccttttaatccacatagataatttttagctcatcaaatttttctccatttgtctttgatcctacatcctccaatttctccacaatgaacacctaaataaaccttgaattttctattctctcatcatcaacccttttctcatcatcttaacctctgtgtttcctctgcttctggaataagtatcttggggttgtcctctatatcaatgcttttttccacagtatcagtgctgtttcttactcctccgatgcaattttaacgctatgaaagcaatttagtttttcttgatattcttcctcatctcacagaataccgcatttattgaagctattcttttgtaggttcacttttcgtataagtcttctgggtaaacattttctctggaatttttttctagttctttattttcaaagatatgtcctcgtggttcttgatcatatcccatttcccttgttcctccatattttctcaccaagggcatattgttgtgtgtgtgtgtcggggggggggggttcccctttttaacatattcagtaatgtaaactaattggaagagacagaaaacagatcaataagtcatctgaagatgagggtagacgaaacctttgggattagaggaaacgtcatcatccttgagtgtggtactgatttcatgagtatatgcatacgtcagaactggctgggtgtggtggctcatgcctgtaatcccagcactctaggaggccgaggcaggtggatcacttgagtccaggagcttaagaccagcctggacaacatagcgaaaccctacatctactaaaaatacatagcatggtggtacgcgcctctagtgccagctgctcaggaggctgaggcatgagaattgcttgaacctgggaggcaggggttgcaatgagccaagatcacaccactgcactccagaccgggcaacagagtgagatgctgtctcaacaaaacaaaacaaacaaacacatatgtcaaaactcatctaactgtacactatatatatgcaacttattgtatgctattatacctcaataaagttagcaagtgacctataaagagtggtttccaaattttcaaaaagtgctatttccacagcacaaaaagaatcacaagtgaatcagaaacattcagtgtaatcaggaatatttttgaaggtatgaattacaacagtcaggtatttttttgcagcttctagaatgttatcttaccaggttcctcattcatggtcaagtgaactctaagaacactgtagtatactccctagtaaacaaaagcacaaaagcagcaaacaggacttctctataatttgtcaaactgggagaagagaaactctatccacctgagattagtattctgaatcagcaattatattggagtgctacaattctcagtcagatacctctctacaaaattcatcatcagtatgctacataagatgaggagttcagaaaaatattccaaataatcatgtctaggatgtggtatacctacagggcataagaggatcactgtaagtatctccgcagaagtacccgctttttctaggcctaggtcaggttctgagtaagggaatgatcccacacactgcaagaacaggttatttatttagtctattattggtctaagcctctgcttcataaatcttggacattgtctgtaggtaggcattgccttggatgataggtatacaaaaaagaagaatgcaatactcacccaaaggggctcagaattcattaaggggagtagatgcgaaaatagagataaaatagtgcactaaatgctagtactgtaaaacagcactgcagagaggctctgaagaagtctcactgaggaggtgacaagggagtacaagcattctaggcagagaaacaacatgagcaaagatacaaagaagcagcacacggctaacgctaaaggcatagtccatgtgtgcaacggacaaatcatgaagggtcatattgtatgtcatgctaacgagctaggcttaggctagagtggagaccttggaaccatacaaggaggtgaatgaaataatcagatttgcacatcaccacagacctgtaatggatatatcagagggattaagacatgaggcaaaatatcgctacagagattaggaaatgattaaaatgatctaggtgagctagttaaagaggcaaagtgtaaaggtttttaaagagttattaagattcagcatcaattaccttctttttaaaacattttgcccctctcatcagcagcctgagcctttgtattcattcctctgttctttctacattctttctcccaaaagctcacaagtactcccttcttcacccatcaacattatataaggtaacattattcatgtgggctatttttggatatcaatttggacatggtaagcataaaatagcagaatactttatcatgtcccaacagacatgatcatcttctagttctatcttacttatttagaaaatactgctctgcttagaaagtacttcaattcagaaaatgacagcagtccaaaataccaaattttaaaatgaaaaatccattgcattgaaaacattactgcaaaatacacaatggagccagcatcttaccattcatcatgtcactgtttgtttcatgacattaacaagtggaagtgatgattttaataagatcaaatctgaaagtcaagtggttttcctgtcttcttcctgctgaatactgcaggaacacacatacatgcaaggtatagagcactgcgcaaggggaagatatgtctagtggaatcaggaattaaaatatctcagcaaaaacaggagtttggtatgaaagatgccaaggtccctaaagagcagaatgtaagtcaaaagaccccaaaaagatttgtaacaactttgaaaaccaaaacctgaccattgtttcttaaattcttctatgatcaatgacattatcaagcaaaagctaataagagtcagctgggtgtggtggttcacgcctgtaatcccagcacttgaggaggccagggtgggcggatcacatgaggtcaggagttcaagaccagcctggccaacatggcgaaaccccacttctcctaaaaatacaaaaattagccggacacggcccatgcctgtagtcccagctactcaggaggctgaggcaggagaattgcttgaacctgggaggcaaaagttgcagtgagctgagatcatgtcactgcactccagcctgggcaacagagcaagactccttctcaaacaaacaaacaacagtcaaattaacacacaaaagtccttgcttaaattattcattacctagatacgctttcatagtcacggagaaggaaagaaaaactgagactttagtaggagatttgtccaagatctttaaatcacatcctttaatcctataaggtagaaaaagattaaaactcctcgggtaattagacacatatctacttaatattttattctgtttgcaatatattactatagaattgtactctctttttaaacattatgcttaaatatacaagtgagagttgccttagtgcctggacagtttagtccagcgagcttaacttctgcaaagttcagtgattttaacaagcctagagcaagtccactatatttgtgatacaaaacaatcccagctttccgtctgtgaggcagaaaatgctttgcattattaaattgtagctgtatgtggcaaaagcagatcttgtaaatatggagagggaaagaatttaaactgagaggaaactttggatgcaggaggccaccgtagaaggaacctgaggccaggcatggtggctcatgcttataatcccaacactttgggaggctgaggtgggaggatcacttcagcccaggagctggggaccagcctaggcaacatagcaaggctctgtctctacaaaaaaattaaaaattagctgggcatggtggcacatgcctgttgtcccagctacttgagaggcttgaggtgggaagattgtttgaacccaggaggcaggctgcagtgagccatgactatgccactgcactccagcctgggcaacaaggcaagaccccatctcggggagagggggagttacatgagatacttgggtaaaagccatcactacaacactgcccagaacagcaggtaccatcacaacctcacctagaggaatttatgactcagacgtcttttcacatgaggattctgaccctcccttaaggggaacctagacattcaactaagaaaaatataggttatagcaatagcctttaaaatttagcaaattacaagctatttctgtgcaagccctcttggaagttttctggaactaggtacagtattaattaagtgcctacatcaatatattaaaattttacttggattctatgttaccttatgacaccatttcagataacacgagaccttaaaataccgttgtaaagttaaggaaagtttgaactaactgtagcccatgaacgagtcctttctctgacagcattgtgaaaggagagtactgtgttgaaattaactcttctccccattctttctttctctgacctgtatattaacacaagtcatgaaacacaaatctgacttgctgaaaaacccctgatgactcactacttatgaacctatattctatgtcacggctttaaatgctgctcaagccttgctcagacaccaagttcccttcctttccccttcttccatgtgaaatgctctttcctcggctaggactatatccaccctacaacctcttgttcatccttttatccaaactgttccatgcatcttatattccctgggaaggggtagacatctctgactccactatgactgctcctttaaatataaacttgtgtgcacacatctcttgcccagtaggcagtcacattttttaaaggtttttcctcaatttcaggcaagaaacagtgttcagaggtcaaataagggtaatggtaactgagaggtaaaagtaaattcaagagacctttcaaagtagaatatgaatgaatatgtggaggataaggaagaaaaagggttcctgggaaagaaatcatgagcaactctaaccaagggtatctagataggattctggtgactccaggatatcttaaaaagggaaaaagcaaaaacaaagaaaacaaaaaacccaagtctggtaaaataaaataaatttaactttggaaatgttaaattggagttaaccatgagacatctagggaaacatgtccgaaaagtagttggacacataggtctaaatcattaggagagagaggtatttcaaaggtaaacatctaggagaaaaggttaatatactttaaaaatcgcaaggtactgaaaacacagagaattaaagacaaaaatctgattaagaagacagaagaaatcaccatatgcaatttttaaacataggaaggttcctggattaccaggagaggtcctgttttcagaggcacgggcaaagttttaaacagagcatggccaactaaatcaaataaatattcaggaatatggaagcaagaacaggacagaaagaaaccactggtcatggatttaatgagaatcatttcagtggggacagaagctgagaagaaatcaagatggaatttcaggggaaatcaagatgagactttgacatccttcatgccatgttacgaagaagaagagagagagatgagacacttggttaaaggggtttgtccaaatgaggaacaaaagatgtatgttttaaaataagaaataagttggtaggtaggaatcagtgaaataagaggcagagtaagagggctaggaaaagtaaaggacagacagaagtttcaatagacacagaaagttgatggcttcataaagtagaaacaccatggaaaggaaaggaggggaaaaaaattatacaatgttaatacaagcttctacaagataaattcttggtaggaaaaaagtaatctctaaagatacatttgtaccttttctcatgtcaatactgagatttatgtaacaaaagtcactccacctttccttttatgccaataggcttataacaacatttgctttctaaaaattacaattctatttcatcatgagacttgaaagcatctgtttcttttgcctcctttataaaatctctaacattctattcttatgcatcttctgtaacttcggtatgtcatcttaagcctttagagaagagcagtataaaaattcaacactttttttttttttgagacggagtctcactctgccacccaggctgctgtgcaatgacatggtctcggcccactgcaacctctgcctcccaggttcaagcgattctcctgcctcagcctcccaagtagctgggactacaggcaagtgccaccacacccggctaatttttgtatttttagtagagacggggtttcactatgttggccaggctggtctcaaactcctgaccttgtgatctgcccgcctcagcctatcaaagtgctgggattacaattcaacacatttctatttgattccacatcaaatgatactttctgcaggaagccttcttgatcaaactagctgaagagaaagtagaatgaaaaaacccctcacttttatcaagcacctgctatctgtcaggtgtgctcccctatgtgatcctcacaactggcatgaacataattgactgcacaaagcggttggctgacttgctcattctcctgatgacccttataatcattcaagggaaaattttaattccaaagttcatgctcttttcactccaccatgccacctacaatggtgggaaacagtatttcacaactttgaactcctacaagacctgcatcgtaacactaatatttagtctttatcttaaatataaatacatatgtaatatacatttcatatattataattatgtatatattattttgtagattttatgaacaaaaacatttgggaaaagcaaggttcatgtgtaactcacatttttatcttctccagtatctagccgagtgtgatgcatacaatagatgctcaataaatatctgctggctgaaaaatctacctatagacagctctttctgaattgtttatggttcttggtataaaatggtgtgtattttacacaagggcaaatggctgtctctgcttctaatgttgagctgactcaaatgtagtatttaattgttaactcagcaatcgttaggcaattaatataatttgttatctgatagagtaggtgactggggagacatggaaaaatctccttctctcaggaccttacaagacattcctaaattgtcccctttttttgactctttcacattaagtattacaaataatcaggctagaagcactgtggaggctgggcatggtgccaactgctatgtagatcaacctttcatgagtgggctgtatacaagttcccataatgtaccctgtaaaattatgtagctgagggctatgcgttcttctggctttttaagagtaatttgtgaaagaaacacttccctcatcctctcttcctttactctgaatcctattctaaatttgaacatttaagaactttattgaatgtgacgtctccaaacaagttagaggataaagaagaaaaatgttttaaaacaaaatacattaaaaaaaaagtcctttgattttagcactgacccatacagacctcattctcaaattacttaaaggttttacctacgatgtcaggtcttacctgccattaaccagtcctttcagcatctttctccaaatatttttatgaatagagagcctatttatagtcgaatgcacattgtctagtgccaaagtttaaaatcaccttttaagtatcatgaaatagtgcatttttcctcattaaaaacatcttgatcctaatggacacaataaatgaggacatgagaaggaatagacatgaatttattaagaagtgaatgaggccgggtgcggtggctcatgcctgtaatcccagcactttgggaggctgaggcgggtggatcacgaggttaggagttcaagaccagcctggccaacatggtgaaaccccatctctactaaaaatagaaaaaattagccaggcacggtagcaggcgcctgtaatcccagctactcaggaggctgaggcaggagaattgcttgaacccgggaggcagaggttgcagtgagccgagatcacgccactgcactccatcctgggcgacagagtgagactccatctcaaaaaaaaaaaaaaaaaaagtgaatgaaatatgatttgaaaaagccagagtaaatttctcttttctttgactttgactttgaacaccatattccaagataaaacgtggtatgaggtcctcaaggacctatgcgaatttatctgcctttatgtacagattaaaaagtactaagtttgtcctaaattctaagatctgaaaaatcaagcaaatatcggctctagtgatctcaacagatgaacaaatgacaatgaatactgaagattttgaactagttttcctaataattatttggtttgtttctattagttttatgacaaccttctgttggctttgatttcagtatctataaaataacattggagagagagctatctcaaaatttttatgacttaaagaatttcttttttttttttttttttttgagatggagtctcgctctgttgtccaggatggctggagtgcagtggtgcgatctcggctaactgcaagctccgcctcccaggttcacgccactctcctgcctcagcctccccagcagctgagactacaggcgcccgccaccatgcccggctaatttttttgtatttttagtagagacggggtttcaccatgttagccagaatggtctcgatctcctgacctcgtgatccactcgcctcggcctcccaaagtgctaggattacaggcgtaagacaccacgcccagccagcgacttaaagaatttcttaagtgcaagataagcacatagctatcattaatagataatccttctttgatttactcagttatttatttagtgtcatccttgctccagagaggatataaggtggcttacttgaggtacacccaatatataatcctactggttcccagaggtgttgccacactacatgcataagtcaacacacaaaatagcacaagcacctataaaacctacaaaaaggaaagtagcatgttaagtccatgttattcccggtaagaaagttctgcttaatgatactagaaaggccccaaaagtttatatcataaaatttgcaaaaactgccctagcatttaacatgtcttcgtcatattaccagcagagaattccccacaaaactaccagccttcctgaactccaaaataagacattagtttggaactgacttagaagcaaaaatctgaattctagattgctatgttttccttggattttacccattctaggattagtcaagggattgagattgggaaatcttaaagatcatagtccaaagaatgtagacacacaaaataataaagcaagtcaaagctaatttccaaagattaccatccaatcaatcacacatttcctaaaagtagcagtggagtttttaattattaaaggtaaaaagagattcatgtctaagtcccaaaattaatggtttaccctcatttggtccacaagagttgtttgctataaccaagagaggacatttttagttctattgcttaggagggattaacttgttaaaaaaaaaaaaaaaaaaacaaagaagaagaagtgaatataaatatataacttctgactctatcataaacaaggcaaatgtgtatccctagaaaaatgaagtgcttagcgcttctcagccaaaattgcaatgccatgtccttgggtgctatctgagttgtagagcaccttcactccaaaaagattacggtgcccacccctgccacgtaacaaagaatgcaaacaaaacatttaagtcacaaatcgtttaaagaaataccataaaggctacttaaaagctctataaaataacaaatgacaaaaaattacttaaatattttataaaataatatcaaatattcctttccaaaaatgcgttgcctttgctgcttgtgcttaaatactaattccaacacagaaactcaaagtaagaactaaaggcctatctgtagatgtccatactatagtttgaagagctttagggtcacccttcagaagttctaagtcagtaagaaagtagtctcaaagtcagacattcaagcctgatgctggagaaaagccaagccagaggaggtgttaagtttgtgggtaggcatatgcatctgcacttataggatgatcggatgggattccaccttcaagtcaacagtggggaacagatttcaaagagcctatatctccaaaagggcttgaatttttgccatctcttcccaagctgttggggaataaacacaggaatagacggtagcaatttccatgggttgcacatctcccagtggaaaactaccagtgataagaaagtgttggtattcaaggtgatctttttcaaaagcttagcttgtatttggtataacaattcaagcagcaaagtgatttgattgtttcattgcttgtggtggtagactgaattttctcatacatggatcgtgccttctcaagacacaaaatctcaattttggagatttcatattttggccaaggcaagaatacagagataaaaagagcttcctaaagataaattatgtcctaaaataccaaatatgcttatacttaaaaaagaagcttttaatagaaagtataatttactccagttgactacaaaacaaaaaccttaataagttctagttgttcacatttaaaattagaaaacattttatattctaggtttaatttatttcgaagtattacaaaacaaactcttaagctcataaaaaattctttaataatctctatcattaagtccaaaatagaattccttaataagccttatggttgagttcatagtattataatacacaaggcatattaaagtcaatattttacattctggataattaaataaaattctaattatattccatttaagttgggtataatgtgtattttatattacattctggctctaaaaaaatagaatcaacgtacgatttacatatatacaattttcaactaatcataaaatgtatttatctgtagcatcccagtttcaggacacagtctcaaaaaggtttgagttccaaggaaaatttaaaagggaaaaaaattagaggtgttctaccttggttgtttttgtttgccatgttatatgcaaacagagaaataaagagatgctacatcgaatgcagcaaaaatgaaattttaaccaagcttcttgacaaatattgaaaaattgaatgatgttacataactattcaaggattatttattcagctcaagtagagaacagttttaggtgagtataattccttctgtacatgttcagaaatgaacttcaaacaataactgctttattagtttcaaatcaagctttcattcaaatgcagaaaacatatccgttgtttagtccgacttataatagctatcaactctttttctaccaaaggttcccctcttctcccacctcattctttgtaagatgagtaaggagacttttaaaaaatgtttggataaaattcattttgtctatcatgcaacacagggaaaatatcagttaattaaaaagaaaaaaatctttgtaaagttaaaagaccctataagttaatgaaatattctgaacttctgaaaatttttgacaaaatttattatattctaagtagcctttttggaaagataactaaaataatatcaatcctccattcacacacaacaaaataaaataaatttaactgggaattacattttaaattattctgtttttaatgttttgctctcaatgtacagtaatatttaaatgatttatgaagaaaatgaaaaatcaacttagcatacatttttaaacctgtgtttaattagaactttttatctttgaagtgtatactacttttgtcaacaatatgattttgtacaatacagaattaataaatatttggaaaaagataatttttctgaaataaaaaaacataggactcagaaaaatatagtctgttttgattttgcatttttacttgtatatctacttgctgtatctttctaaaatcattttaagacaaaattggtctgataaactttcttgcaattttggtgttcttctggtatttcagcctcatattagctaagcacgacttcaaggaagatcaaacgatggaggacctaaaaactaagtctacctgaggaaacttttcctattacttcatataaactttctggtttattttcaacgaaaggacagatgagattgtttggggaggtggggggcatgtgtagctggttcggggtttttgtgtttggttttgtttttgttagtttattcttagagcactcttttactaaagtcaccaatataattcacattcttttaataatgaaaaactgcttgtgctagttttatctcatgagaaaaaacactgttcctaaatcaaaagcaaaatgttgtatgttcagagctatatgaagacagccaagttataaaagcccattttcagatctggaacaacttctgaaaacaaagagggtatttgggataccttatgctaaagaaaaaaaaaatcctgctttcattatttcctgattctggagatccaataaaaactttatggaataaaaagtcttgcaaaaatccttcagtgaaaacacaaccaaccactcccacccccaacccccttctaaagtaatgagagttgataaactataattgcagtatggaaatttttacattttcttatgagttttaaaagaaagattaaaaggttcattggcttttcaaacagcaattattttagcacctaaaagatacacaactaaaatatatgcgtatttattttcaaagaaacaccaacaaaaattaaaacattggtgattaggtaaatactgatgacgccaatataaaagtatttgccactgcaaagggcctaagcacaatcacatcttgtcccgatcatacctgcctgccagaacaaaataggcagctgaccaattatggggtgtttatctatacagtggtacctttgttctccaacaatgtcagattgcaaatgtcctggaacacatatttacctggaggattcttggcaggatcattgtggcttggacttcctgattgtccagaatctgtaaagaaatcacagaaaatgttttctttttaatttgttttgaaagaatttcacaatcctcaaaggactcgaaaaaaaaatttgaaggtataaaaatgaagttgagtgcttaaataaaatacactttcccaagacttttgatagaaacattttactcatcaaactacatgaatgcatatacatatttctatgtcaaaagaaaaacacaagtattgatctataattttcttgggctagagcaaggtttttttgaaacaaaagatctggctacaaagccattgaagatggtttgaaggttaggcaaatattgaggcctgtcagtagcaatatgaaataaagcagatatattctcttaaaaatgcaatctaagtgtaattaaacgtgcatttaaaagcctgaaagtatgtttttattcaatgagtaaaatacacagaaatgagagtccgcttttccatgatttcacacacaagtacacatacccactccaataatctcccaacctactggatccaggcccagatttatctacatcccataatagcaatcgatttgcaaacagcaaggaaagcataaattactaggtagaaaccaacatggctttgtggagagcaaatggttgaatcaatttaatttccatccatgacagatggacagactttgcaggtaaggaggaagagatcaatgtcgtatatctgaatttcctaccccatactattcctcattgatgctacagaaagaaacgtggaagacatacaactgttaggcaacatgccctttcggactgatctgacactgttgtgttttgctcactcctcttccctccttgtaccctctccatttatctgtgtcatttgccccatattattatacacttacttgcgagttgctttgtaatcttcttttattggttctagcatttaagttttgtcgccccaactaaattgcatactcctaagcagaggcagagattctgtctacttcttttgtgtcctcctcagtgtgctgttcatggctgtgaatgcactaggcttgcagtaaacgccggaggaatggatggctcagctccagcagcctctttgcttgcctagaaaaggcaattttgaacttgataatgaatttcaacaaaatttgataggtggggcacaaatgacggctctgtcatgtactgccatatactgacaagtctcttcccccaaaccttgccattatacttgagccaagaaagtgatttggttaagcaggaaaatcatatgctggtttttttcatcggggttattctgtccttccaggtaagtgattaacatactgaaattgctgcttctactattaaatgcaagaacatcctgttagtttcttctcatataaaacctggttatttatttctgccctttgcctcatgcctgttagcttagatttaatgctgaaatcagaattttaccccttcatcccatttccttaattgtctttttggttttattctagaacagatttcatgagatcttggcaggcatatttagtgattcccacattttcctccaattgtttcctgatttttcaaaatgaaagtaaagaaactagaaatgaccattcttcatctggctcgagtctcctgaagacagtcagagagctgagaactctctgaaaatctctctcatctcccatgaagtcctcttattactttttctgaaatcaaggcaagattcagtgacttataaattaggagatcaatcttcttcgttctacattcctttaaaaaactggtacaatatgggccactttccaggcctggagtatgatagctacataaaaatgataaatcataactttttgctatagcatcagctatttttaccttgagttcctctgacaaatgtctctcagcattgatattacattccagtttaatttctcaagcgattctaacattttttaggaattcctacttatgtataatacacccactgaccagagcctccctatgttttactttccctccaaagctatctcactcttatgaaggtctagacatgcacccctcaaggtggctaatgccaagcttgtgatgacacctgagatagttaaagttgtcaattgttgcagcagtcgccttatttcaggagttgtagactctgcatgagccttagcatgtttagttacagcaacttcaaaatggtgccgcaaaactcttttccatcatctgttgctaaaatttgggtccagcagagaaaagaatgaaaagtctcttccattcgtaagaaactatccagctagaacaatggcatcccctgttaccacaacatcccacttgggaaactctattcttttctgctataaattactttttcttctcatttccaacaactgcagaccaacttcttcgattgaaaaaatatacttactaaaaaaaccacaagcatttgagggaaagctgaagtagaccctaaatttgaggcacacattggctttttgtaacaattccactttctaaaatgatctggtgtttactggcacacaatgacagactccttcatatgccaaagcccataccttctcatgaaataaagcagtgtatactgtgtctcagaaacataggagagggccctctcagtgagcaaatgatagagcatttacttttcagactgtaaattctaacactataatctactcttaactcttatgtcaccttatatcggtcacttaattccaactgctggaaaaggaagtaaccagggagtcgtggttggcagagaaaccaaaaatgaactgttattgtggttgacttcagagaaggaattattcagaccacatctaaaccccttccaattcaccacctaggtcaaattactctatacccaaaggttttatttaaccacttccatcactttgctcaacaccccccacctctctctctctctctctctctctctgtgtgtgtgtgtgtgtgtgtgtgtgtgtgtgtgtgtgtgtgtgtgtgtgtatttaatatgttacagtgaagcctggctctgtccctcactagtgacatgatcttgtacaaaattacttactcttaagagtcttggtgtctggatcttgaaaactgcaataatattatctaccttgtaaaatcattgcaagattctatcacattaagcaccaaaagcattgggtcagacacagtctacattatcagtaaataaaagatattaatattaagcatagagccacatttaaaatgattaatatatttaatggtttaaacatattaaaatgaaaaaattaatcatttttaatgtggctctatgcttaataacaactaacttttaggaagaaagggagaaaagggacataactaagttctgtccatcccaacacacgcatctgaaaatgactggtgggatgactaagcatggagaagtgtgtgcctacctgagaaatcctgtgtaaatgctttcacccctcattccccaaaagggaggagtccactgctcttcaaggctcttagcagctgtcatgctcaaaaggcagtagataccagccagttgatgaaaattaccttccagaaggctgaagtctttgaggaacaaggctgctaagagttgtgagctgcccagcatactgggtctggtgtctgggaaaaaaaattttttttttttttttgagacagagtcttgctctgtcacccaggctagagtgcagtagcactatcacagctcactgaagcctccacctcctgggttcaagccattcttgtgcttcagcctcccgagtagctaggactacaggcgcacaccaccacacccagctagtttttgtattttttggtagagacggggtttcaccatgttggtcaggctggtcttgaactcctggcctgaagcgatccgcctacctcggcctcccaaagtgctgggattacaggtgtgagccaccacacccagtttagtgtctggaaagattttgatgcagtagagaaaaagagaggagtttttggaggcagccaaccaaaaccagtcctccctcattctcttccacctctcattttatcttcctcgatctcaatctctattttccccattctttaagtgtgggtttcatgttccccattctttaagtgtgggttaaacatatgtttattcttctaaaaaaaaagtaatgaagttatttctaaattactatattttaaactcaatcagttccttcttctccaggttaaagattctccaggaacaagaaaaggttcacattcatgcacgacccttaccaacttttcaatcctttcgtccactccttttttaaaagcggtcaatctctcgtggctcttctaatatctaagcttacctaaggagtgagcagtttttcctatgacccaattttatggaagatcctaggacacataagtgatcaaacggcttgtccaaagttgcatagcaactattaaaacttatgttctctatatggacagcctattcagacacaatacttcttgaatcgttatgatgcaatcctaaaataatgcgaagctaaatgatttttcagtagtttaaatgtttctgggaaacttaccttcccctaacctccctcacccttcccaccattcaccaatacattcaaaatctttttcagaatctttttttaaacctttagctattttctatatctaagttggaagcaattattagtatcactgaactctatatactaattgacgttttaaagagaggccaattctataaatcaaatttgtctccattaagcaaaggaaattctaatgttttatggacaatctggtggaagctctgtaagatgtgtgttaaatatatatgacaataaataagtaatagcctgtaaagtatttcttactgagcactaactttctggagtagatacactgcaactatctgaggtagataaatcatcaaaactgtcaaattttttttgtaggtcattaatgtaaacatcatttaaatgtaaatcaattaagatttatgctcacgcctgtaaatcccagcacttttggaggctgaggcaggcagattacttgaggccaggagtttgagaccagcctggccaacgtggtgaaaccccgtctctaccaaaaaatacaaaaaagtagccaggtgcggtggcacacacctgtaatcccagctacttgagaggctgagacatgagaatcacttggacctgggaggtggaggttgcagtgagccaagatcggctcatgtattccaaacacctggtaatgtttggaacacagtaggtgctctgtaatgcttattaaatttatatttaatttacaataatgacctttaaatattgttttaaaaaaagtatactctatgccatgtagaagctcagaggctgcctgaagagacagaaatatacaaataaaaaaatacataaatcaagaggggacagatgattcttcctaggaaaggtgggcaagggcatatcataaaagatatcaaaagaaggtgaccttaggaacaatgccgtgaaaaaacgacctgatttcccacctttctaagacatatttcactcttttaccaagaagatctttataagacccaaaactgattaagctaaacatctgctaaaacctttacatatattctgaaaatagtatgccattcatggcaccttgatctggtccccatcagcacctgggtcatactttagcctttggactccttgtgtgtctcctgcatttgatgtctccaagtctgtgcataatgttcccccttttttctccctgaagtcccccagggtgaggtcatcccctttacatcctcaacaatatgacacgaagtctattattgccctatttagccttatagccctaatctttgggatagggcctggcacatttggttaagtcaaatgaacagaaaaccatcagtctataaactataaaagtgcacaagaaagaaagacaaagcataccgctctgtgtaaaatcatacagtagaagtcaaacagataaatttcttgtggcaagccagggaaacagacacacaattcccagggctaagtctctcagtctaatgtaaggctcaatcctacttcccaacttcctgaagaaatatttggaaacaagatagggtggataagacatactattttgagttagaaattattttttgtccatctcctataaagagaagaaatgtttgttgaaggtccatgtccctactttgcaagcactgaggcaagaaagttttaatgacctttatagataaactttctactcctagatgaaacttcttttaggaactctttttattctctgacaccatggcttgaggatcaacagaaaaagacaactggaaaagcataattttaatttataatgagtttggtgcaaagaaggagctgtacaaggtgagttttcaggtcccctgtggctctaaaattctatgattccataacaatatagcttttatatcaagggatatcagaggagtaaatgaaacccacaatgtaacctgttaacctacagatagcctcttgctagaactaaacttagtcatcctgtgataaagggcccttttgtcatagttctttgccttaagcaggtgaagaaatagcccattgtcaatgaaagaataccatgagattttttttaaggctcagaacagtctctttctttctctctaaaacattattaattgataatataataaaacagtatatttttacaattaaatatatagcatgccagaaacaagacgtaacaggtaagaaacaaaagcttgacggaaggaatacaaatgcatgtattttatagtagggaaataaaaaggtaaaacaaaaacatctatattattaagggtaatggagagcaaactattctccttgggccaaaccttcttctctcttcccctctctctgcccaaagttttctacctcactctttgcagtttactgtctcccatgactgattccttgggatttacagaacactagctttccataatcaagtttcctattacataatttggcttttttttttccagcacagttaaaacaccaggcagcttcagttttaatggaaggttgcttcattgctttgggtgacacaaaattatagttctacattattttattttctctctattagatgtgtattaaaataagacaacgaaagaacatgggaaaactgagtgttttccttgcctctcataagcatgtaaatgtttgggaaatggtttctctctctctctccctccttcattcttcgctcctgtgtgtgtgtgtgtgtgtgtatgtgtgtgtgtgtgtgtgtgtgtgtgtgtgtgtgtgtgtgtgtgtgcctgtgtctccctttatctcctgtctctctctgcttctgtctctctgtctcttttcaatagggcattaaattatttggagtccacttcactgcaaaacttaacttaacaagctgttcatgaaaagttttaactttatcactttgttaatggaatccctgatcttgtttgttgtttgtttgtttgtttttttagtgaatccgtactcctcctaaacccagttctgagcaataagagaaattagacctctctgaatattttggcagaaccaatataatatttgggagatgcagtttcctgcatattttaaactatttactatttcaagtatgaagacctatatcttcagatccctctttctgttgtttaacattgattttaaaatatacgtttgatttagcaaaacgcatagtttaaaaagatgttgctacacttaagatcttcatgataaagtaatttcattaaccaaagaaaactacagaacaagagagtagatatacgatatatcctgtttcattcctgaacatcccagttgttttatcattaagctttcttttaaagagccacttttttgcttaacaaggagattaggtacaaagagtcatatcccaaggattaaaataaggatttgttagcgctcaagactgaaatttgtccacagggaattaactgaaaaaataggccactgaaatttaaggtggaaaaaaaatcatattatcaaaaatcatatatcaaaaaaaatcaaagcaaatcattctaccacaggggactactaatgaatcccctgcaaatatgaaaccctgcacaaaaagtgttaaacctgccaacatctctgaccagagggctgtggtacttcattaagtagtaccaacccaccccccacaacaatgggaagctaggataatcatatctgacctttctgccctaacctaagattaagttcaatgacttcctactgatctagggattgagtgaaccaaaggtcataatcaggatcacctacagttcttgcttttgaaggctttaacctacagaatgcaaaaacaccgtactggtcattgtcaagattgctgactttctacagtgtgttttcaattaagtaaataaaatgtggtaattaaatcaagattgcataatatgtttttgatttgtaatcttatttaaattaattaactgactcaatccttgcttagtttttaaactggtcgagttagggaaagagtccctgggagcaaatccagttttctatctttaaaaacaaggcaaagcaatctggcatacttaaaaatatacattaaatgcaccagcataatataaatacagaggcaagggtgctaatgtagaggagggaagagttttatggcacgattttgactaaaagaaatagctctcgcactagagagaaataaactaaaacattatttattcaaaacatttcttttcgaattttatgaagattgcatatttgttggaagcaaaacatttccagctgtattttaagtttctgaagagggttgtaagatttataatctttcataaatgctgcccatatcttataatattagatgaacacgccactgcgtactttgaggaacaatttgccaacgcagtttgccacatgaaaataataaagtcctttccaaaacccagccagatccagtaggaaaagatgagatgaatgttctttcttttccatctgggagacattttggatttcagctatactatgtaatatacattttttccccttggaaaccaagaaacctgcattttacaacaaggtatgtagtgcaaagaaaatgctggtgaaataagaatctgaaaatgaaaaccagaatgtcatcagactcaagaacataatcatgaaggcaaatcgaaaaatcaatgcagaatttcaacataaaacaaatgcaatgtttatgatcctattagtcttaaatttttctcttaaaaggaaagcatagaaaaataagtgctgttttacctccaaagtcctgaacagcatttatgttactacctagcaccatgacttacatatctggtttatcctggagtcttcacgcattattctaaatcccacacatacaacactcctgtgtacacatggcccctctgtgctatgtcacttcatgtattttcccaacacttaatatatctaggttaaaatcagacataagactttctaatatttcattggcaatctttcttctcagggagcaggacatgttctctccaaactgcctggagagtcaggactctgggctctatccggcaactgccaagcactagcacgctgactctaagcaaaccatttcacgcacgaatcagttttcatcttgcccagtggcaactagttaatgaaaggtaagagtttagtcttagttgttttcaaaggaattagaaatactaggaaaaaaataatttcacacaacagtgaaatatgcacaagtatttttgtggaaaaaggctatgagatatatatatttaatgttctttaaggtttaattagtactcctcctccccctcctaaaaaaaaaaaaatccccacctacttggttgcactgccccttgcaaacgctgacaacacaggtaattgaagggctgggttagagtgcaactcttctgctacattttaaaacccatggggtcaagaaacatgttagtcttattcactgccctagcatattcctggcacatactagatgctcaatcagtatgtgttgaatgactaaccactgttttacagagaacaagatgatgactggtagcagttaaaacagttcatcttccttaaattacaaacaaactgccagtaataccaatcataactttcagtttttgattattatctacacatattctaatttttaagtttctacaacctctctacaaatacaaatgtagtgattgactcaatgaccaaaaagtcatattcttattttttcattgctcattttttcataggcatatgttcctaaaaaattttttaaattggatacagatttctctatcatgttagctaaaaagatactttgccaaatcattaaaatgtttatgtttatatccttatgtgagcttagagagaagaaactggatgggttttttatatcttatgttacttacatgtgattaataaccagtccttgttttattattaaattatggctcttaagtctgtgatactatattcatataaaaataaatgtatacatttaaactcaagatgcatagcaattaactggataacagagtaagatgatgcatagcctactttctacaaaggtaaagtagatttgtacgtggggtattcattactgcttctgttcataaaataactttatcaaaatattagaggaaaaaaatcagataagtcatctgatgaacaggaagcttgctgatgtggcagataatagtattaaatgtcctaacagttccttgataagtggttcaaagaacttctgtccccatgttttcaaggcaaaagttaatataccaggaataaaactacttgaataatgcatcattgaaccaacatttttgaaaagggataaaatgaggaaacaaatgaggagacagtaatttcctcttgcaaattaaaactgtgcaggcaaagaaaggaactcaattatactgataaaataaaaacaaaaaaatagctgacatgattttcctttttgtaaaaagagaaggtcaagaatattctaataagtgaaataatgggtttgaaagaactttgaaaagtttacaagctcacagagacatgaagatggggcattttatggggcaatattctttcaaacagtcacttaaagagaacagtttaaaatacagataatcctggccaggcacggtggcatatgcctttaatcccaacactatgggaggctgaggtgggtggataacctgaggtcaggagttcaagaccagcctggccaacataatgaaattccatctctactaaaaatacaataattagctgggcgtagtggtgggtgcctgtagtcccagctacttgggaggctgaagtgggaggatcacctgaggtcaggagttcgagaccagcctggccaacatggtgaaactccacctctactaaaaatacaataattagctgggcatagcggtgggtgcctatagtcccaactactcgagaggctaaggtgggaggatcatctgagccctggaggttgaggctgcagtgagctgagattacatcactgcactccagcctcggtgacagagtgagcccctatcttgaaaaaaataaacaaaaataaaaaaaatacagataattctaaccaagaataataaagaataacagaagcccaccatgaaatctactactcatcactatggttatttgggaaatgggaaaataaatgatgacgggcatgttcacttgctatatccattttaaaaaagggaactgagagtatactggtgcagagctatgtaccaggtgctcaaaattcctcccattttgtcttgttactcattttatctttaatagagattcaaatcaattccttatgattcaaaaatgcctaagccaaatccaaagagtatgaaaaaatcaaggttctgcataatgtcccatccatatgccttaaccctgaatgatatcaaacctatgtaatcttagacatcaatgccttccagatgtgacaaaattttaacacagaccaacttcaagctttttactgcagactcatctcccatgctcataaagattattttcattgcacgtaccattacatatggctaatgtttaattttccaaattgattattatgctgccatttcaaaactgacattgccttccaatccaatcaaaaaacaaactatgctgcatactcaacctccaacaaacacatacacaaaaacaagaaatcacatcattatttccaagttctagatagtgcttggttacaagaccagttgaacttttccttgtccactcttggtacctccaaaagatggaaaaggggaaggagggatcatccaattctttgtcagagttaattgccataggaataatttgagcctgtcacctgttgtttttggtcttaaagattgcttctaatcagacaagatcaaattcttcttgacatttaaagcatgttaaaattctaaaattaactaacaagattgttcatggatattttgcaaaaccatctaacagcaaggccatgacagaaatgtataaactaaattttcagataggatttaaaaaattagtaactcaacaccagtaagaaaaactggtgtgataaagctttggatgatattatgcaaacttaattcccctgccccaaacaattgctttgaatcttacctaaatctcatccctccacccacccccaaaattagaattgccctgtaacggtaacttgtcctcagatccatcctgaactctgtttctgcaaaccacctttcccagctccattaactattgacttcaggctaggtccaaccaacaggaggcaatggtaggagtttgggaatttggagggtgggaagaaaggagaaggagaggtattccttccctcctctgctttgacatttgtctccaaacagtggtgagttttcctcttgtgattcttgcttccactgaacaagttcctccctctgtgatgccctcccttcaggcagctccagctcaatttgtgtagtagattcctactgatgctaatgactgggtgacctcactgcccattcagcttttcatctattctaacattactgtaactggccttgcccatgaaattcctcctattggactatctggtagtttattttactcaaatctgacagatacatttgtttttttgaatttggcatatctgtcactctaaaatacgtgtcaggtaatagaattaagcagtattagacaaatataataacttttttaaaaaccaatagatttcacgtgtttgttatgattctcatcttttaaaaaaaagatgagaaagcactgccaccattcagtactaagtacaaaattctgtatcccaaagttttttgtaatgcatactgatacataaaaataatcaagtttttaaaaaaggcaactagatgctcaatgccatgttctaaatatatctcttccaggaggtcttctgataatcctacccatccatccaagtttacttcttctttttatcatctcctagtctctctaaccaatttttaacaagttttttcttgtgcatgtgtttttccttcacacatgactgtatgctccttgactggaacaattataagtttgattatttttgtaaaatatgatacatttacttatatttcatgccacaaacaacttcgaaatgcttatcaattgtcggaataactaacagtctcatggggataatcaaaaggttttcttaaatatgcaccactatacatcaacgtaagaataatccctaacaggaaagagaaatgacttcaacattactctgtttcctttaggaaatggttcataagtccccactggacatgaggcattttacataagaaaaattacaaaataagacaaaagtatttttcccatcagaatagtaacactctatagtgttttgctaaaacactctacgaacaggagaaaacaaaaatatttatgttcatacgcacagggatatatatgaactcacagtaccaaaactttagaatcacatatgcaaacagtaccaatatacttaatgttttaaactgtgctagataacagcccggctagaggcaagtgacataacggaaaaacatacagcatcaattcacatgttgccaactttttttggatagaactaacaggatgacactggtgatggatgtgcacacttagctgccagcattgcaccctatgcaatgtccctctacatcctctctctcaatcattttgaacccccacccccaagatttattttatgtctctttttaaaacattattttcctagttggtgacagtcaccaccaaacatcatacagagatcatttcaactgaaaatacatgtttattattttttaagcctgtgcctgaaatgtattttagtcaatctatgccacataaggcaaacttctaatgcacatttatgaatttaattcaataaatatttactgaaaaaagaaaatgggttggagtctaaatagacataaagtggccatgaagtaagtctagcaataactttcactttttatgttttcccaccaccctttactttccccaatgagaaacttatagtgtgacaggtaagctaagagacaatctccataaatatgacagcagacatattgcacagacactaaaaaccataggaataatgctgagaccacaagacagaaatagcccttgactttttctcgtaatggcaggtagaatgggtgggacagggagcctaaagccagataggaaaacgaatccaacttttaaccaaattttttattacacacatactatttgaaacttaaactttcattctaagttacagtcaaaaaagaaaaaagacaataagaagaaataaaaattatcccagttcttccaatgtactgtatatgtatatgctatgatttaagaattatgccataggaatagataattcaattaaagccaagataaaacaaatgagatacattatactaagcagatagcaaattatgatataatttggctgagaaataggttgaaacaggcactatcttagaaatgggatgacagcaaagaactaagctccaccttcaatgtatttgaaggtctgtttggagccaatttacacaaaatatccacttaccaatttcacagaagatagaacaaaataacactgagataacgtattaggaaattattttttaatattggaggtgcactctaccacctcaatccagcacacattctctctctctctctctttcacaaaagagaaagagatcccgtaagcttctccacaatgttctatacctgaccctggaaggaaatcctattcttctaggcttgcttaagccaataaggtccccagagaatgctaactggggtggttatgtgcccaagaattgaactgaaaccattaatttacttcataggaccaatcaactggcaaaagaagttaaaaaaaaacaaaaaacaaaaaacttttggtagaactgacctacagagaatttaaaccgccagagatggcaaggtttgatgttacagcttccttcatccatctgcaaagctctgtcactacctaataaatgcacaatgcttctctctcctgtggtgcttttaggaaataatgcttgtcattttccatcttattgacaaaatattgtattttttagaaaactccatatctaaggaatactttaatgaaataaagatgggttaaaacatcaagctaattttgtgagcacacgaaacagagaaataatctcaaagaaaatgataaattctaatttttatttgaaagtataaagcacatatgagacgacttttattgtgttgccacttcattcttgtttatttaggtttctttattcactgtcgatataaatgactgcagtgaagccaggattgcagaccaaatctgaatttggaagtttggctacagcaatctggatcccaaagccaaagcttcctcctcacattagactcccattcaaagctatcactgtgttttcaaagtgacaacactgttcaactttcttttcacagagcaggaatcttttatggcattaagggtatgtatgtcacaccatgaaaaacacaatgacattgcaaacatagacaaaggaatctagtaagggcattgggaggaaaaagggggtggggtatttaagaaaatgttttttaaacttttttttttgcaaaagaaaatgcataataataaaataataactgaaagttccctattaatatcatccagcaattattaaaaatagaataaattagctgatatgatccaatcacctggtagggaacagcatgtgtctccttagtccattggcagtgctaatggtgctcctaaatgaaggattttttttttctatgttcacgctggttgaacttaattttccgttcacctgtttacctggattagttttcagcttaacattcattaagcatcaagacataacaagaggtgcagtgatgatgagataaaagtctcaaggccattactcctcccatgaggcactcagggaggatctataagtgaaagatagcttcactcgcttgggttaaagtgaaaaaatatgaacccactctagaactttgaaaatcaaagagagctttaaaaagccgtgtgtttatgttttgcctaatttttcactttttctcattagaaggcaaggtctgactaaatgtgggttatttctgatatctcagcttctagtttgcggaagggggttcctgtttaagggagggaatgctgccaccccctactctccccagcagcagcacactggacacctgagaagccaaaagcgctacaccaaaatataccacctttaatcacaaatcaaacaacagtaattaggagcatcaagttaattgtgtctactccccacagaatgtgtcctccaaggctccttgaaatcaggttgaaagattagtagtaattttactcccaattctcttattctaacttaaaaaaaaaaaaaaaaacagagcctaagttcatcactcctaccctcagaactatggagtctacaagtaaaaccttaaaaagaaaaatcagactacttaattaagtgttttcttaggccgtttatgtaatcagagtaactttgatctttggcttcttaatctgttcaaaatttgttgtcaaatcgtatggaattcctttaaatccagaattataaatgttattttccatttgtcttttattaatgattaagacaacttggcagtttgaatccaatcaatcaagaatgtgcaaaatccatttcatatacattggtacaattagatactgacaataaggctctttcttaccttccatttgtactaaatatgataaagatagcaagaataccttagctattttcgaggcattttcatctacattactttgcaatcccgaaataggttgtgctttattctgaccctttacaattaccagaaaggaatgcagagcttgacaacttgcagagtaatagaaaaaccttgatttttcattgcatttccccttctgactttcttaggatctgagggacgacccttaacctttctcagtctcactctcctgtctcaaacaagctataataaaactttattccagtccactggggtattagaacaatgaatctgataggatgtccctaacacactgtactgtgatctctatagggaaagttgctataaaaataaagacactgttgttattcttccaattgagttatttgcaaatggatcttcttgatggagcccagccctccgatatagaaaagaaaattctatcagtcctctagggtacaattgccttgtggcaattatacccataaccacatttccttattactatttataaaagactgtggagttcaaggggaggcaaaaagggagcttaagaaaaaatatgctgtttattttcaacagaagatgctgaagttgcaaatttggaactcaaggctataggtaaactttgacagaacatgtgttccaaattagtgtggtgtttcttagctgtgtcagaaagtcagaggtgtccctgaggctgcagcgctttagcaaattttggaaataacttggggaaaaaaaaggtaaattacacagttaatctggtcctcactctacgaatgctacaaaacaatgacgaaaaggttcacggctagaccattctcaccaagaaagacagcatatctcgaggtacaaaaggcacaaaagaaaattaaactgagcttaggaagaaagtgctatggacaattttacatgaaaagccaaaagggaatgttggggctacgttgaactttcctggagtctacagacagaatacacgttgccccctatattcattaccaacagccataagaattagtaggtggctcaggtttaggcactttaagaattccatattcctcaaatggaattttttcaaagtaaataataaaagctttgctttatgaagtattagagaaatggggtttcccttccataacagaaatcactaggcccatcacactgcacgtctccaaggagcatgattcacagtgtgggctacggggagggagccttctaaagtcgtttcggatgttcactatggcattctacgtgtcattaaaaaagccttataaatcatcctaaaatttagagtttaaacctggaacaattacttggataaagtttcttatgttaacaggtttttaaaagttcaattttcagaaaagtgtttgttgtcagtggagatctgcatataatctagattccaattaaacacagagctccaaaaagaccaattaaaggagaagtagaacagcttgccgtatcatgacaataaatgctacttgccttattgtcatttcacaatcagtgacattcagtccacaaattctagtgagcatcagattcacctgagatgcttgttagaaattcagattcctcgacctcacccgcaatgactgggactcgtacagcaatgctggggccaagaaagcgctctcaacaagcaccccaggtaactcccgcacattgttctcagccagtgtacaagggacttggctgctgatgcttgctcacagacaccaaactggaaagcaaaaggcagtatgtgactatagagtcctgaaaacacaaacaaacaaaaatgcagtccttaagccaaaaccaatctccacttttctccctctccctgccatgtgatgcaccagctttggccaaaaatcacatgtgtacagtgaatcctaaaaagcaactaaatccaaatccacactgaaccattctgaactctatcacacttcacagagctttaaatagaattctactcaaaacatcacaccctgactggccaagggattctttgggttctgttgctttatccaagtgatccaaagtgacccaggttccattctgcaagttcgcttctacagctttttccaagtcgaacacagaaggattaaaaagaaaacacaaatattggcataggtgacttgaggttacttgacctttctgaaggaagattttttggcaattgtgttctggcagctccctggaaggcaaggccaggacacaaagaggaagacaggaagccgggagctggccatgtgtccttggcaggcagtagtgcggcagggtgaaccacctcatccctgccaaaccagaaacagtggggaaagcccagctaattggcaactcacagccggctacagtgtacatcctcggctttagatgcctgataaagttaaatggcctgccagaccctaatctacttaaacaggatcctcctttactttcaaaaacttaactcacccatttgtgtttccttaaggaagtggtaaggcagcatcttagaatgttaagagctggaaaaattaaaaacaaaacagcaaaaaaagtaaagatgtgttggagtctcattatgcttatagccgttttactttgtgaaagggccatgtatgtttgtgcttttggttttagctaataagacttccacttggtcatttatttttatttaaaagaaattctcaagtcaacattgcagactgattatgacttcagttcattggaggatccaggatccattttttttttaatttcacaaaactcctgaagatatccaaggagactgcagagttgcacccagtttccactcagctattgtttttacttacacattagttggctcaatcatatttgctaaggtatttctgtatgtactagcataaaatcaccactttctgagtcttttacagctaaaatagggaatcacgcagggagaacaggagcagaagggattgtccaaataaactgttccttactgctgctgctaacagagtgaatccagggacctggagcctggagcataattttgcccctaggtctgaaggcctggtaagagcaatttaaaggggtgtgctcagtagttgggcatatttccttctattttctgtgaaactgttcatgccttcttcaaaactcaaagcaaaatttcaaattagcttctcctccttaaaatatagtagtcaatggtgaaatttgatgaagaaaatgcaaatttcctctcagaactggtagaagagaaagattacaataaacataatccactgttttcatcagaagtttcttaaagtctacagaatattcatcctttaagcaacccaggaccccagaatctgtttcagtgaagttagaccaaggaataaaacacaataccaaaactcacatactctctgatcacgatgtgagataagaaaataataatcctcatgcccaacactagctctcaggatcggtaagtctaagtatgtgtttcagctccaaaattactattttttttaaaacacgacttgactttcccagactctacttagttgacttttcacactaagtatccctagcttttggaaattctccttcccttttcctttagggcaccactcctttcttaggtccaatcctctatttctgagggctgctttcctgtcttgatggctatctccttctcttctgttggtcccttatatgttggtgatcccaaagacgatccatccaacttggccatcttcttgtctttgtacattccccctcagcaaactcagctaggtccatgtttacaaatactacccgttttttgagaactctgtatctccatatctagccctaacctcttctttaactgcaaaactcctcctgatgttgctagtgcacaacctttgtacactcttgcctccccgcaaccaatccatatctcaattaatggcattcacagccattcagtttcccaagctgaaaatgctcattccagaaaccccaactccccaaagcttcacattcagttgtcagcccagactctatcttcctttcaagcctatttccccatctccatcccaactggtgctaagtcccttattgagcttcacatttttacctcacaatagcctcagcctcctcaggccattatgattcactcttcacactataaccagactccatcctctgcatagccaccaggaatcacaacacttcactccttaaaacaccttggtggcttccaattgctagctaggataatctacaacctccttagtacagcattcaaggtgctccataacctggccccagcctagcctcactctcacagaaaccatcaccctttaccctccccctcacacccacacccaacttcctaatattcttcttaacagtcctagaatatgccgtgcaactgcaggtctgtgcccttgctcataaggtttctatgcctggaatatcccttatttgatgcaagacaaacgcctaattcatctttaaaagctcttgaatttcgtctgttacaaccttcctgaaccttattgccccatctaatgagaccaccctctggggcccacatggtcttgctcacactttagtgcagggcccgaccagtgcattatagttggttgtttatacattacttctctccaagattgtgacctcctgtatcccaacttaccctgaataattttgggaatctatttaaatggcatacaaatttatcttggatgtactatccatgaagaaactgagacaaagagcattaattcccaaaagaaagacaaagtaaccttaaaaaaaaaaagtcataatgagctatcaatttatacaggtaattaacattcaatattctgattgtgacatatacagatgatatttatccattcgtttatttttttgaaaaggactgaacacctacagtggtccatgtatcatccttggaactcagtctacaacagtcaataaaagatgatttgttcttgtcttcatggagcttatggtttcatttgcacaatgttgactttcattcacttgctagcaggtaaaatgtgctctctatacaatttacaaataagcagaatctgtaatcattatattttgaagataaaattgatacttttcacacacacacacacacacacacacacacacacacaaagatttagcagtgggacaaactttttcatttaatttttgtttatagcaactaaaacatgagagactaaaagccacagactgcaaaagcattgtttagctgtgataagcagaatgtgtaaaggtggtatgatggcacaacagctattgcagcatgaaataatgagactataaaataatgagaccacagttttaaaattctccgacttccattatctttcagaatagatgaaaggggtctactgactagttcgggagctgaagagtcaaatactattttaggatgaaaattactttgtggtcacatcccattatagaatattgatggagccacactacatgaaagtctcaaaaggagtactgagagaaaacatcgttaagaattggttttctgctactcaaacccatcctcaagaaaaaacaaaagctaatttaaaaaaatcatcaccaaagcaaagtttctaaatggaatgacataaaaatatcggttctacgtttcttgtcttttagaaaaacgacccatatgtgtagtattttatatggttttctctaacgtatctgagaaatgggtaagcaaatctatgcaaagagatatcatggattgtgatgtcatatttcttatgaaaaaaatcaccttcacaatgtcaattaataccaaatttagctttacaactccatgaactctaccattttttaggttagctgaaaacgatctattgactagctttgtgagctgaacagttgaatgctacttacatagaaaattatttctttcactccataagaataattatcatggcgatcacacaattattacaattacatctgtaagaactgttactgggaatttatctctgaaacagtctcatgccttgcaggggacatttatctttttgaatgatcatcaacacgagtgtctttttgtagctatataagtgatttttacctccttctattaatatcctcttgcatgctttagaagccaaaggagacagcccccacattttttttttcctaaagcaattgtttcagttaagccaggcccatggcatcttttgagacagaaagctaccctttccattcacggcaacataacattcacaatgtgctttcctaaatggatggaaaacccctcaaaaaagcccctcaaatctgtgtttcataaactgtactcttagcaataaagtttattacagacctaaagtatctgcataaacccggttaattgaaaagtgggtggagaaggctgccaaattaaatgtttacattagcacagctgtattgtaaaaacattctgccccctgtgctttgtaattataagatatttctggactgtgtatctctacaaagtttatctccactgccaagagtgtcttggcacggagcgactgcagtttttggcagccaggagctctccgcgcgggcaggatctaaaatggctgccaagcggcctcctgaaatgtcgccggcctgggcccgcctcaccaagggcaaaggccaaccctgctaccaaggcagggtctaaagtctgtctcacaggaagtcaaaatgtgtatttccctcataaataagacttggtaccacaacttttgtgttgcagtagttaaagctgcttgaaaaactaactacaaaggaatattggaatactaccagatagaaaatggtgacaaggggtcttttacgaaattctgctgacctcaacatttcaatcacacataatgcccgcaatattttctgctgattaaagaaactcatttaatttgtggggaaaaaaaaatgttaaaaaaaacctcaacaaattctgaccatattaaaacatactacagagaagcataagcaaagccaacactttcccatttgcaatggcatgattttgacataaacttataatctctatcaaagcatacgtgtatgaaaaatgaaaaccaaaaaattaatttgttttcttctcatcctttaacaggctatgtttgtcttacaacattaaaataacattaacaaaagaaaaccttttcatacctttctatggcacaggcctcaaaatttgaggaatgatctctcttttcccgccgtccactgcccaagatgtggaaaggaaagaaggccaaggggaagaaggtggctccggcccctgctgtcttgaagaagcaggaggccaagaaagtggtcaaccccctgtttgagaaaaggcctaagaattttggcattagacaggacatccagcccaaaagagacctcgcccgctttgtgaaatggccccgctatagcaggttgcagcggcagagagtcatcctctataagcgactgaaaatgcctcctgcgattaaccagttcacccaggacctggaccaccaaacagctactcagctgcttaagctgccccacaagtacagaccagagacaaagcaagagaagaagcagaggctgttggcccgggcggagaagaaagcgccggcaaaggggacctccccactaagaacacctgtccttcaagcaggagttaacaccatcaccaccttggtgtagaataagaaagctcagttggtggtgattgcatacaacatggatcccatcgagctggttgtgttcctgcctgccctgtgtcgtaaaatgggggtcccttactgcaatatcaaggggaagacaagactgggacatctaatccacaggaagacctgcaccactgctgccttcatacaggttaactcagaagacaaaggggctttggttaagctggtggtagctatcagaaccaattacaacgacagagccaatgagatccgtcatcactggggaggcaatgtcctgggtcccaagcctgtggcttacattgccaagctcaaaaggcaaaagctaaagaacttgccaccaaactgggttaaatgtacactgttgagttttctgtacataaaaataatacaaatttcccttcaaaaaacatctgaggaattaactatgtctgtggcataaaactgaaaaaaaccgagatcagatacatagtctctgtgagtgagttccaagggctgaccaaaggaacaaaaattggaaggaagggaggggaggggagggggaaaaaagaagggaggaaggaagggggagggaaagcagggtgggagggagggaaagaagaaaggaaggggaatgaaaacgtgggagggaggaaatgatggagacactgcatggaactaaaaatacatactgatttgttcatagtaggaatataaaaaacacttgaagaattaaaaatacttcataagtacaccttcataagtacgatatatacacaaggtatatattgtctctgtcctttttttctctgttaaacttaaatcccagctaacaggctatgttcacagcagccaaatactgcataatgaggtcagtggatttttctttgagactgttccgcaagtttaagctcaggttgagagacacattaggcctggtgtactcctgtaatcatcattggcagtgattactgtttggtaatctaagcttcaactgaatccaacattcttgcctctgctgaaagataattcagaggtgaaagatgaattccataatgctgacacaaactggtggtattcatcatagtgcttattcactgaatgcccattctagcttgaattatatgtccacacactcagcagagccacaccaatattgtttacttaatttttttaagtctccattttaggagaagaaaatctaatgtctctttaatcgtatattttgaataatgtctattctccagtagtcacctgaaaaacacacacacacacacacacacacacttttcctggacctttttacagcagaataatttctcagcattattaattatgtttctgcgtaaaagacatttagggacttttatcctttgtttaattagttatcaaaataatcagtcacacagctatttaataatgggccactcttaacagacaggtgaaacagagtggttgtgttcaaaaaatatttctagttcactagtaacttactaactctctctctcttttttttttttttcttctttgagatggaatctcactctgccactcaggtgcagtggtatgatctcggctcactcgcaacctccgcctcccaaggttcaaacaatcctcccacctcggcctcttgagtatctaggaccacagatgcacctggctaatttttttgtatttttggtagagacagggtttcaccatgctgcccaggctggtctcaaactcctgagctcaagcaatcttcctgcctcggcctcgcaaactgctgggattacaggtgtgagccaagcacctggcccttactaacactcttaaaacttgagctaatttctttcctttcatgagattttatggtctgacactgctgacttattaccttttcttccttgagagtttccaaatactaaaacaacaatctgctcaacaaacagaagaattcgataaatgttgattgaccatctagtacctgcaaagagaccctatgctatcatatacagagttatgagattcagacaacatgctttacaaaaaaaaaaaaaaaaaaaaaaaaaacctaagggatggtttcagattttgcctgtgtcttagtttcagtcatgtttggtatatattgccaagtagctatattttatatccccaactagaatacaagtttttggagatcatgctctatgtcttactgactgcacaagacagtgcaacgcatataaaattgtcacctacaaatgaaaggattccagtgaggctaaatggtgattagctgtgtaaaaccccactattccatacattgtatgtgcttacaatgttagcttatcctcctcttagcagcaaatatcttctaggtgaacagtaataaaataatagtaaggctaacagtcattgagtatttgtttacatgtccaatactgttctcaatattacggtatccatagatttcgtccttgcgataacactaagggatgctattattattcccattttcagatgagaaaacttgcctaaggctatccaactaataactgaaaaagccaggaattaaacccaagccaaactgaccccagaatccaaactaaattactgtcttcccaaattagaggtgtcaccactggacagaaaaagagatacagtccaggtagaggttgcacctctgcaattacagggctccttagtcaattttttctaatttttgacacataccttcccaattttcctggcaaaagcctcccttgagtggaggccactgactgtggggagtttatgttgtggtttggtaatgtgtacaaactgggaggaggatgagaccagaaaaccccttttgcccatagcatgccacaaattgaggactaagtcagtgcatgctgctgacaggcaaagggccagctcggcatgagcagctccgtgcagggactgcatgtgacaccagacaccattttcaaagccactaccttcctccttccccacaaacctcttcatctcccaccaaagtcctgaagcttcaccacaggatcaagtaatccccctctaagccacatctcgtaaatgagagtctaatttctcccacgtgtcatttttcacatgaatgttactacggtcttggctgtacttaaccagagttcaaggtctgatggtttatctacagagacaacatgaccacagagaagagcccgtttccattgccacctgaaagacagatccaccaacacaatgttcaccactttctcacacagggctaaatgagactcaaggaaagagcccaaggtcaaacatttccttggttgaatttaggtggtgggttcccatacagagcacagcaccatcagattcacaaggccaaatgcctcagcatgatgacttgaaaagatgacaagctgcacacaatgttcaaaatctaaattcaaaggtcacttcccactccctaaatagttttataccccaaaagtcattttagaatcatctttccacttttattccatatttgtaatctgattttaatgacctcagggtaggccatttttttaaactccagacaggttctaattcatctatacaacaaagcaatacgtggtgttaaaaaaaagactaagagagtaaatcgatacgtgttcagtgtagtggcagtttagattttttttctttcaattggcaatccttccgacatcaaggttaaattgtactaaaaaagaaaaaaattacacctcattccaaatttgctaattcaagaagaactgaattattctcacgtctacttgtggcaaaacaagaaattactttatgtctcaaatgtgagtatgaattacgactaaattcataaaaacagacgtgacttaagtttttattttactactttgaagttgtaatgtgttcattttcctggtatttttacttaaaagagcttttttttttttttccttaaggactcttcacaagtacttttgatagagtggtataaaattatcctattccaatgaccataatatgaaaatcattttgccaaaaaacatcctggaagtttccctcattttaggtacttgggattattctcataaactgaggaccattcaacaatgttttgaagatatacagtattctattcagaggacaaagcatatattcaaaaaaatgcaaaaatattcatcttttctcaaacaactccagtattaaattcatctagacccactgattcactcagtcttttttttaagtttagtttccaatatgatattatttctgccctcatctcttccttgcaacaccccacccataagggaaaagaagaaacagtcagagatgaaagaacaacaaaaatgtacacaaaaatgaaatgttttctgataagtagcatgtcagagtaaacaagttatttttttccactatcactttcttacatgatctacagcaaaattatgttgcctctgtcttatgaatcatcaatacatcacagcccagcctttttcatatatagtgggaaaaatgctgcagattataactactgtttctgacatggagatatttttaattcatttttatgacatgcttatgttcttttcatcactgaataattgctcgtttccaatactaagctggtatttctttaaagttcacgtaattgcactactggtaactttaggatttggaaggaaaaggatcacaatcgataagcaaatgcaatgacgggcactgacaaagactcaacatttattagaaggcaattgctagagaatgtggctttaattgtgcatacatatttttattcattaagatgaataaccaataaaatcccacactatggtgtcccagcctcataacacattaataaagtttcttaaaggttttggcagggggccagcacagtccattaactctttgcaagttgtaaaaagaagtaaagtcatttcagtttgttttgtggttatgaatgaaacagcaggcagcctgtatggaaacgtcactttggatatggtattggtaatggacgctttgctgcgcaatcagaacagtgtggggagaagttaatgcatcctaccacaacccaagcccagacgcactgaaaagctaatttacttaaaagtggagggaaaagagcagaggactacaagtttggaagatctatttattttgctaataggctgtcacactgcctctgggtaaacttgcccactgtgaaacccaaaagtacaggatacattttaaatgactagaactgcttttcctgattatttttttttttcctaaaaaaaacctggttgcttaggcattcacttggtgagggctggatcataaattacaaaaatgctttttatttaatacaagaagcaaaattctatcctttctacgtttttgttttacatacttgaattaagtcatataaataactacaacaattggtagctatgtatttgtctccgactttgcctaacaatttgaattgaagcgctacacatctccccaaagctttacaatgccatctgttctcatttttcatgacactacaaacattttcctttggaaaaaggattctgtattttgcttcctttttagaatgaaaactggaaaacttgaatgaaactaaatatatagagaggcatccaagttgtacgtgtaaagtagtaaatgtagagggtatttaaaacattttttgtggttaagatctctacccttttcatctgttccactctagagataaaagttcttttttactttaagatttttgcaaaaaataattcaaaactttaaaaataacgaaaaatgaacttaaaaagtgattaaaacccttgagtttgagaacaccaaaaaaaacagaattgctttacaaattgtttttggcacttcacttacgaagaaaatacgctaaaatgtaagtatacatacacacatgtgcacactcacacaaacacacacccacacccctccattaatccctaaccaaatataaatagcatcgttagtcaattacttctgatggttaaaaccacaaattggttacaatgatctgtcactttatatggccaaataataaaacttcaagcagaagagatgattactataagtacaatagaaaacatcattcactgttttaatttgttttgaatttttactggaaaaaaacagaaagaaaatttttaactttcaaatgtaaacattcatcactgagtcctaaaaaaacttcccatttcaaatttcatttgtgtcagtgctaatatgtatcaaaatagccgcatctcttgtacactgtggattttctgggaagttactcacctttgattataggaaagtaaaggaaagtctaattaataggttgaaaccgtactgaatttctgcttctctgtatacatgatcatttttgtctctgtttggactgaaagccagatactcaacaatcattccctaaaaatttaaagtattaattacatacatgtatttgtacaatgttaagtatcactgcaacctggaaaaacttgcggtaaaattaaaatttttcatttcaaaacaacagtgctcttagcttaatcctctacaatattgtattcaaaaatagtttttctgtgtgattaacagtaatattacctgggctatttttaaaatctggaattagaattcaattttaaaaactgcactcaaaaaacatcctggattcagatatgaatggacctgggaagtttcttaaaagaaatacattttatcctagatcgatagtaagaaacagcaaggaaatgcacagaaacaggatatagggaatacataaattgggtctacactggttaagaaacaaagttaaaaaaataattctactcactttaaaatgacactgtgctgaaaaataatgagaatagataaaagctttgaccactcccattgtctaccttaaaaaaatactagtatagttactcaaggcacggaactggacaaactgcaatttgaatccagaagacagaatccagagccagggacaaaacaagtcaaaggagttggtgaccagggcaatggccagaagtttacccgtttatatcagattctgtgccatccaccctgcggggccgtctgagctgtgcttccccagctggtgggcccctccacgtcagccctctcgtagactccaaaaggaaatcagagttgaacagtatagcatattgttattaaaagtgatttgagttgtgacatgaatattgtactttcaataaaggaggtatacactttagaaagctcttcagcctctagaaagaatagacatttaaaagattaaagcgtttaaagaatgatctctccactgaccagaatacccacatcaaaataatgtaccactgggttttattggtagctgcaatttagcccatatgaaatggaatatggccttagtgttaatgcaaatacgttgccatttatcataaaataagtgtcatctctaaaggtaactggactttccttaaaaatgaaccattctaacatgaaagaggcataaattaataaatccctgagaaagcctagcctacggctgtaaggaacatctaactgcttaactgggcaaccaaaagactcatacaaataattagaatacttatttccaattgatgaaagcaaaactactccaattcacattaaggttgatgagtcacataaaccactcactgacttaattttacttagaaattgctcatgcacttttgttgctttcctggaaggttatacaaatgattatatactcatttaattattaaactgaatgatctccttaagggcaacattaaacatactaaagtacagtacaccatgtcacaatgtgcttaagtatccctactaaaaataaaaattaaaacaaggttagaaaacaactaacaactaggttaaattcaatccaaaatatagatttgggaatttctaataaaattgtccatattgtttgaatgggttcaccactgagtaatagtgtgaataatttaggtaatcatctcaaaaggttataattcctctgggaaaaaaaaaaaacatgtttaaaactctacacttacaatatttcacataatataattaataaatgtttgctagatgattggatttaagttatatgataaaaaaatactgctcacacttataatgctttaaatgctttacaacttacaaaacactttcacataagccaccttacgctaacaactgtgttaggtagatattactatccccatttcatagataaggaaattgaggctcacagagattaaatgttttacccaaggtcatagccctagtaaattcactgcttagagaataattagcttaagttaagataacagctacttcctgcttccccattccagtctcagagacacacaaacacaatatgcatcacatataaaatgtgataaaatcaaaaattatacatcaatcatgtttatgcactacattatttgcctatttccattcgtatttttgtaagcgctgtttctgaaaggtaatatagcatataattacacctttctttttaaaatgctatgataatcttctcactgcctgggaagtttccatggcagaaagactgggcacagtcaggtaactggtatttcttgattaccatccaccagtaggttgatctttggaaagttacttatctttggaaagttacctatccaccagcaggttgatctttggaaagttaacgcgggcccccaggttccttgttagtcacataagggatctgtaataaacacttcctaagtcaggtccaccatccattctccacagcagtggttcttaagctttaacatgcacaagaatcacccagagagcttgtcctaacagagtttctggcccatcctcagagatctgatttaataggtccagatagggcccatgaatctgcatttcccagaagctcacaggtcagaccagtgctgctggtcgtgggaccaaactttgggaaccactgctacacagtaacatgggaaaccgaaatacttcagaaaatgaaagtctgatgtagcttctctccagaagccttcagtggtttccccatagcccttagcataaagtccaaagtgctaaatgaataacagtatgtggacacccaggtctccacccagatgcattgctcaggatctctttctgggcctttcctgataccccaagctgctgggctgagttttatgtccctcatctgtgctcttaggaaaatgtgttccctgtgtcctaaaactgtaaggaactgttatcacatgcttccttgcctctgttctcaacattccagaagtggtttgtaaacatacccccaactcccactgctccaaatttaaggggggaagagtcccctcatttcacctcacatcattttacttaagaatcgatgccaccttcgggctatgcatcaggtctcgtttccaatatttctagcagagccctcctcaacccttctttattactccccactctgctccccaaataggccacatcctagccccccattaattccccttcctgaagaagcgacagagataaggaaagcccaaagagagaacctgcacttctctgagcacatccctgaatgaggcaccaacttccccttccccaccagcctgctcttctcctcacaggtcctgagcatgctcaaggatctcaaagcacacagggccagtgtcaggagcatggacccatgcagtcacatagagccccacttacgtggtccccatgcttggcttcatgctcttctgtcaccatcttgaaactcttaatttttgaacaagaggcccacacattagggagctggtcctgaaggcaaattatggaactggatacatctcagctcctcagcaagcacacattaccacatcccattttcacccacactatctcagcagcacagctcccagcagcctaacagaaaagtcacgctttcctctaagaaactgccatacttccttccttcagagtaaaacaaaatcatattatggattgtatcatgctttttacataactaccaggaaactttttaaacacatgatgctaatttagcagccaacatttttgaacttcatggtctataaatttgtactgtttcccatattttcagtctctgtttctattttcttggtcctgactctcttttccattggaaattcatcatttattttactgaatatgaatatcctgctgagagctgtttatcccacagtccagtacacacaggaaggaggcacacacagtgcagagagccatcctatacaattggaatttaaagagatctgacttcataaagtacgtgtatacacatgcatacctatgcttccatgcccattaagaaaatgtggaaacaagaaatttaggcttgggagcaacggccaaaggagaaacaaggagaaggaagagatttacttttcacttttacctgtatatagtatttaattattttctgtaagtatattacttataatttttcaaagtaaatagctcagtaaaatgatcttctgtcaagctcaacaattgggtgcttagcagagcaagaaatggaaaaataatggctaaagcagcttttacgtaatctccaaagacatcaactttcacatcagtttctcatagactgtccagcatattggaaccgaagaaaaagagcaggcataaatactcagaacaataaacttgaaaaatgtaacctctggtatacatttaatggtattaaatgaaaagcagtgaaaatgaaaaccttaaacatctgcatatactaagactatgttaagaagaaacgattattaaaagttaactaataaataagtaaaagtttgagtatttgggggtgaaaaattgtcagaaagcaaatgtgtaaaaagatatatggtcctgaaaatcctcgcttattctaaatttaaaatgcaccttgattctattgcaaagaaagttgaaagtatgtcatcaaaaagtcatttaaaaaaactactacttaaaaagtgatcagataatttacaaagattattctcaagaagtcagataaagataaagatgccccatttgttaacagtactttttgttcttctggataatgtactgaaaaccagtctagcttcctatggtatgcataacttcctctgtaatactccaattgtattaccaaaagcaaacattacttttgttatcaaagcaaatttaataaagaattttcaactatcttgcccactcacttgctttgtaattcagataaatgactcaacatctccaagcttctttcatcatcttgtaaaaggcaaatagcaatctctcccaagcagcactgtactgagaattaactgaattgctttatgtaaattctcagcacgataccttgttcatggggggtgggcaataaataggaggtatcatcatcatcactcttggtaatgacgataaagctggtatattttcaattctattgcatacagtagaatttaaatttagtcaaaaataatgttcaatattaagaaataacagacttcatcttcataacaaaagataggttggcaatggctaccttagaagctacctaattgcctggtcacaattttttctttgtgtactttcctaaaataaatttaatgaataacaaactatataaataattttaactgataatcatgtgcaaagaaatacaatttggcactcaggctgagcttatcccactggaaaggtgtgcattaacatggtggcatgtattcgtttttcaagtcactttactggccactattaagtctctgtgtggatgaagtagaaactaaaaaaggtctggtttgagaaaggccggaagcaggaggcaagtgggctctgccaaggtgcatctgtatccacaggtaagaaggaaggttctccattctttctctctctctctctctctctctctctctctctctctctctctctctctccctctgtgtgtgtgtgtgtgtgtgtgtgtgtgtgtgtgtgtgtgtgtgtagcattgacaagggggtaagcccctacaaaagagagtgaacctcagaagagagatgctggagagacgctgtgtcctccaaaggactcatgtcaccacagtcaccatacccaggtcaggtctacctaacagccacttcaattccatctttctcatgtgacacttaaggctatgctgactttgccaaaattgctttcagccaaattttctaaaagaaaggaaaataagcatacttttctgatgaaaactgttgtcagacaggcctgtaactaaagccatttcatacagaatatcctggccaatgtttagcacatggtgctttacactgaaaactttaaaagctagaacagctatccatatccatcttctaaaataatgttgtaacagcattagtaaatggtgaataatgtttgaacagtgtctactaggaaggacttaatgaaataaagtggaagatatgtgaaatgactaacatttgaattcataaggatgttatgccccaaaaccttatttttggtatcaaggtggccattttgattaatttcctgatgatacttaagaaagaataacattaatttctaaagcttccagataataactttttcccaggttacagcttttatatatgttatatgcaactcacactaattcacacttaacagcagatagaatctaaattagatcttcttataaattatttccagaatgggcaagagcaaccaaaagataagatatacattatctaattattcaataatgctaggaaattcttttaaaatatacaaactaggctgggcgcggtggctcacgtctgtaatcccagcattttgggaggccaaggtgggtggatcacctgaggtcaagagttcaagaccagcctgaccaacatggagaaaccttgtgtctactaaaaatacaaaattggctgggcgtggtggcgcatgcctgtaatcccagctacttgggaggctgaggcaggagaatcacttgaacccaggaagtggaggttgcggtgagccgagattgcaacattgcatgccagcctgggcaacaagagtgaaactccatctcaaaaaaaaaaaaaaaaaaaaagacacaaactaagcaaactctaaatttatattattttggaagactcatcaaaaatcctgctccaaacactcatattgctaattatctcattcaagatattacttcaccatgtcaatattgatttattattttatactttgtttctttcccccaaaagacatgagaacacttacaaaaaatactcctgccactgagataaaatagataggtaagtaaatctgggttaagtcagaatgaaggtaagaaagtaaatatatatgggcagtggtagagcacaaaaatgtaagcttttaggtccctgatcctttgccagtaaagctgtactttccatcccaggctcagtttcttccgtgtttgctgggagttcctgtattactctgtagatttcatcgaacttttaagaaggcagtggttgctttgcctagcaagggaataagaataatgagctgagagctccaaggtggtatttggaaggcatactttttcccagaggaaaaatactgaagaaaaaggccagttgtacaggaaatagggacagacattatcaccatattgaagccaaatagaaaataaaatgattttttttaagtttaaaattcttttgtttccatgatatactcaagagtctgactccaaataacaacctcaaaaccttgtttctgttttcagtgccttcctgaactaagtgttttccctcaagtagcaccaataaaacccagattccacccactggcattctgtctaagccaacacagcttttatcaggtgcttgaaaaagactttgcatacagtaatgtgagacgctgaaggtgcatggcaaacagcaatgcactgctgtagaactccaagttgggcttctaacctcctgagagactgatgactatagatgtcacccaatcaatgaacaaatgaattttcttcagtatttaatagtgtattttggtatctggattactgggaattttaccaagggccaaaagagcctattgctaccaaccagatttggttgggggtttggcatctgaaatgtactcttttccccaggagctgaaattggaagtggacttatttaaatgcattggccttgatcacagtggatgcctagatttctattaacttttagccttgttaagtccaggtaatttcagttattgatgtaccctccttttaacttctccatcatcaaaagacatttattaagtacctatttgtttaccttactcttcgaagtaccacatggagaaacacttcttgccctctagggaacttaaaatcattcctctcatggtctccttctggctttaactagataccattaaatagttgcctcattctcctgctgcaaaaacatttcttcagtgctggctcttcattaaggggtggctaatgaagctcatgtagatcacccaatttggtagaaactctgatggctttagcccttcatctctcctaaatgctgcaccttatgaagtttggcacagcctctcacaactccctatctgccatgtttaaaggagttttgcatttgtttgtttttgattctacgtatttaaaactaccagtattttcaacaagaagagcaaatctaagatgcagataaattacgttactttgaatattaactattatatagattgacaaatattgctattttatctccagagaaactttaatatagagtcatcttgtagcactagggtaaaaaaaaaaaaaaaaaaaaaaagtctaagttgaagagatttttccaaatacgatgtaatttagggttacaatgtcaaaactgtaaacctaaaattaaactactaactatttttgtttgcaggcttcttttctcaaaattacaaccgcattacatttgttgcaaaagaacagattcaagccaggattttgttcattcacatgttattcctgctttacacgtattttatggaggagttacttttgctggcattttgttttgttttgtttcttttactaaatggtgagcaatgttagagataaatgtaactgtctacaaacactccagagcaaaatttggaaagaaagcttgagcaaataatactacatttgatgggatataagaaattaagagttcttcagatgacaagaaagtggcatattctttttaacacaatggaattaaagctatggtgaataaagcaatatattaagaatcctctggaaagccaatatcttgaatcattacatcagaatctacactgggactcttataacaaagcttccatccctgggaaaatgaagaacttcactatgagaggatggaactacaccaaaaaaacttttccaactccagtcttgggagcgcatcaaagcaacaggccctcgtccctggtaaactgtaatctaggcgtactacactttctgcatgttgagccaaggaatttcctcctagcaacaggctgtggtctgatgggctcgtccacctcctttccaagtggagagaaagcaaaatcaggaacaatatcccctgaattctcttcatcaaggattatcagacacctgttttaaattttaatctcattagttattattgataacaaggacaatgtagatccattgcaaaggcttataccacaaagaaaacacaactctaattagtacacgcttcataaacaaggcaaaggtgcctatctgaagctattttaaagcccttgttgtggttcataggcttagagagagatgctttgaattctgcttccatgtattgtactaggggaaagacatggcattctccaaatattattgagaggcatctttaccacaaggcaggatagttctgggcatggggctccctttcgaccatacctagagcaccaagaaaccaggagccccgcctgggagccccagtttcttctctgctatctctctggatgctggacttgcagtctcctcaacagtggatcacagcccatagctctcacatctttttatacccaccaatcccacactctcaacctcgtaaacttcacctccccttcactttctcctcttcctcctgccctctcccttatttcccattcagaaaacccccttcatcaaggtgtaacttcctcaggaagaactgcaaagaatcagcccagtgcagatgaggttccaccacccgaagtttctgctctatatccagtgaaatcaatctccctacacacacacacacacacacacacacacacacacacacacacaccacatcccatcttcttcctattcctctcaccccctcccaaggagagttttctgctctgaactacgttatatcctacctactagcccatctactccctcacccgaaaagtctgaactcctctaaggcctccatcagcagcaagatactaaactctgcatcctgaggtcaagccaagccaaatgttgacataccaggagtctctgcccctccgaccccagcttctagttgatattcccacatttcacttgaaattcaacatcctctcccttacaacctggctacttccccatatcgcaaagtaaaagccttctccagctttaaaagttaaccgctctacctaaattccagattccaaagtttcctattccttgaataatattgcaaatagttactaagatgccatactgattaagtggcaggaactatgctagacatgcattatctgacacagaaatcataagaactctataaggtataaatagatttggttgaatcacacaatatttgtaatacgcagctagatttaagccatgaaataattattttgtatttatatgtgcattattattagctccattttacagttagaaaaactgaggctcatgagacaaagtatgtttcccgaagtcacacagctcaagtatataagaccccaaggctcacagccacataccacactgcccctcaagcttatctgactccccaattttgcacagagctggtcctgtcttctgacctttacttaagtaatgctcatgtcctctccataacttattttaacagccagggtaagacccacattctcccatgaagctgtcctgacaaattccaagccaagctggccccagcctcccttggaatccatagtataattgagcaagctgcccttcttatgccctgtatgccagctaatcattctttaccagtgagtcatctcttctcaaactaaactgcatagttggcaaagcttagaaactctggtaactatgtcattttccctttctgaaccaccatatctcaattattaaatgagggtgttagaaaaaggctgccctgtttaagagaaagcatgaagagcctgtctgcttagcactacccttcattacctttccctccgcaaagcacaaaggaagcaaatcttggcttaaattagaaggtagcaagttgtcctctttttgatccttggatccccatttccaatgcactggtgctctcagatcttttgatattgcaaagacttcctcccttgtcaactgtttccagttcatctttccaaaacactttctacatcccactaatactaactttcaagaacacagcttggaacatgtaacttcctttttcaaacactggcagaaactccccattatctaccatggaaggcagaattctaagatggcccctaagacttcctgcaccctcatctacaagccctgcacctactgaggaaatccattgcatcagatggcattcagggtccttaagggtcatttcctggattccaggctcaggttacctgacactaattcatgcacctcaagctccaggtaaactggtaatctgagcctttgcccaagctaatttccaggtaaatctgtccctttattcattaagtttagaaatctgcattccaggaccaggcacagtggttcacacctataatcccagcactttgggaggccaaaatgggaggctcagttgagcctaggagttcgagaccagcctgggcaacaaagtgagaccccattgctacaaaaaattagccaggcatggtggcacacacctatggtcccagccacttgggaggctgagctgggaggatggcttaagccctgggaactcaaggctacagtgagccatgatcacaccactgcactccagcctgggcaacagagtaagatcctgtctcaaaaaaaaaaaaaagaaagaaagaaaagaaaaagaaatccgtattccttgcagaccagctcaaacaccccttctttcctactctttggactcaacattaatccatttcttctttccactgctccctcaagacattacctggaattctatctagtggcttatgcagctaaatcaggggtgtccaatcttttggcttccctgggccacactagaagaagaattgtcttgagccacacatacactaacactaacaatagctgatgaacttaaagaaaagcagaaagaaaaatctcataacgttttaagagagtttatgaatttctgttgagctgcattcaaagcgatcctgggtcacatgcagcctgcaggccatgggttgaacaagcttgagctaaataaaagctcagggagggtagttgctatgcttagatgatagagcagggacttcctgacagaaatctatagcaggggcacacttatgattcccgcaggtcactgagctgatctactctgaccttgtcctcgccttactgataagtgactactacgtaatactccagttcagactcatgatactaataacttctccactgcattgcttttctgaattgcaatctatttgtaataattttagcaagtccaattctcacccattagaaacaaatttaaatagaacaaagcttaaaaattagcattccaattttttttagggcatttgtctataaaaatgtagaaaccactaattatttaataattacactgactctttttatacctcaagttctcctcttgtgcaattcaataggagatcaatcaaaagttaaattttttgagaaatcatgttttccctcaatgtgtaaaagaggaagaagaagaggggaagatgtgttacatgactggttagaggccaatctaatttcaaggaaatgcaaacgcagaaaaatcttatcagctctagctcaattcctctaaatatactaaatcaaaatctaagaaggaaatggaaatacctgtgattgatagagaagtacaatactaggaatccacctggtctcctcaagggcaacggtttgtttccttctcagccacactatatcctatcagccaccctaaccgcccactacactctagttggccaagaagtcactgagggctgtcctgtgtatcttctcaaattttgtcccttgagcaaacaggattccccctgccttccaaaataatctaaaacaatattaaaagaaataaggtcacatcaaaataaaacaaacagtaaaatgtccctcgtccaattacgccttccagtccccacacttattatgtttgcctgaacaattaacagcttttaagatatttctggctgacccagaaggccatattcaatacacaaaaaggtggaaaacaagtgataggctacacagaaaattgtgccatcatttgctgaggcttctgttcactaagatcacagctatttttcagtttccacatgatgttctgtgtagaaaccatatatccctaatattggaagaccatgatgatcttatcactaaaacataacagctaagaactaaagagaatatttagattgaaagtgtcctgagaaaaatcaaggtgtagaggatcacagttggatgttctgccctatcttagtctcttccagaatgatgtacatacacatgggctccgcatacatgaattcaaccaaccatggaacaaaaatattcagaaaacaaaaattccacaaacttacaaaaagtaaaactccaatttgctgcacactgagtactatgctgaatccactcaaatgaagtgatatgtaggcactgtattaggtattgtaagtagagatgaattaaagtatatgggaggatgtgcacaggttacatacaaatactatgccattttatacaaggaacttgagcattatggtgtttggtatccccagtggggcctggggttggggcggtcctagaaccaattcccccaaaataccatggaacgactgtattttccattgtcgtattttctttacctttaaaataggaatacagtatcttccctgagaggataagtggtttctcaattttataaatttttctttgaaagaacctgttggcttttttaccttttcttataggagagcacatgacatttactttcttagcgaatttccagtatacattacaatattgttaactatagtcctcaacttttgcattaaatctcaaggcttattcatcctacaaaactgcaactctgtaccctctgaccaagatctctgcatttccccacctccccacctcagcaccattctactctgcttctaagtatccaacattttaaaattccagatataagtgagaacagaaggtattatttagaacaaaaactgtaacctcgttttttaaatacatttgctttggatatccaagaatcttcttatctcaagaatgctataaaaaaatatataaatcccattcttaagaagccagttattgtttggtactaggttcatccttacactacattcctcctcaagaagaaaataggtgctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaagaagaagaagaaaataggtaatatgatagatttgaaagcaatgattgagcttgtgctgaaatgaagtgatggattgtgcctggaattttttggtttaatgactttagatttaggataaaatttcattttatagaaacaacatgaaaaaatcatcattgcttataatattaaagtctgatatagaaagtaatagtaagttttccagcataggcatggggcttaaagggagatttgactctatcagagtatcaggattcactctcaactttactgtaattctccagaagagccaaaagaaaaaaaatccagaaatacagaacaaaatatttaaagatccaagccaaatgttttttaatgatttttttcttttatgctgactgtatatataacattttgtcattctgatgaaatacatgttatttccttttgaaatctgaatgaatcacatttcagaaaaattcattgaaatatgatttagaacagtgatcaggtaaaatttttaacactaattcagatttaattattatagtctttaattccctgtcattgttaaatacagcactaacagaataattaattgggaaggtatgtactatacattttaaagagcatttttttttttctaaaatctaaatgatgacaatttggctttgtaacacaggctgaaaatatttattcattgagatacggatcatctcccttttaacaagctaataaacaatatttggataacttttttttggctaaagtctattaggtaaaacgaccatcaacaaaaacaatgaggctaggcacagtggctgacccctataatctcagcactttgggaggctgaagcaggagtatcacttgagtccaggactttgagaccagcctggaaaacatagtgagatccccatctctacaaaaactaaaaaattggccgggcagggtggcatgcacctgtagtcccagttactcaggaggctcagatgacaggatctcttgaacgcatgcggtggtgcctgcagtgtgccatgatcatgccactgtactccaacctgggcaacagagcaagaccctatctcagaaaaaaaaaaaaaaagcaatgaatatataagcatattagtcttaaaaaatacttcttatgagctttattaatataagcatatatttaaaaattagtccagataattgctaatcacattttaaaaataaatattagactaatacagccaaagaaaccttagaaataaagaactgtagttattctggtaattctgtcttttcgatggactaataattaaaatcaccttttttgtttggattccaaatggtttcccaatttatcataaactcacatgggtggggaagttgtggaagagagtaagaaatcttggccaggcacggtggtgcacacctgtaatcccggcactttgggacaccaaggtgggtggatcacctgaggtcaggagttcgtgaccagcctgactaagatggtgaaactccgtctctaataaatacaaaaaaaattagccggccgtggtggtgcatgtctgtaatccgagctacttggtaggctgaaacaggagaattgcttgtacccaggaggcaaagtttgcagtgagccgagatcacgccattgcactccagcctgggcaacgagagcaaaactccgtgtcaaaaaaaaaaaaaaaaagaaagaaaagtaaagtaaaagaaaagaaatatattctaaacatgtgcagaaaactactaccaattttaaaagctaatttatcagttgaaagatttctgccacctatcattgtctaaatggattcccagtttgctggtgagatcttatttttagactgtgatatccttgaggatagagcctgtgcttttcatttctaggtcagtatagggcatgaaatattaggaagtactcaaaactatctgttgaataaacaaagcatggatgaattttttaaaaaccaatgaattggaaaacattgttcttgaatatctctccatagacttgaaatatatcatactatggagaaaggcacacctactttggattttcatgaattagttattttccctgaacctaagtaatatgaatactggcatgaaaatttacaacggtactgtaatcatggtttttttaaaaaaaatttattttctccaatgttgttgatgataataaccaccccttacatatgtcaattgtaagcaagctttttgtaacaagattcacaatgtttcactctaattctcaatacaaatcatcaaggtggatactatcatcaactccatcttacaaatgaagaaagggaggcctcaatgggtttaataacgtgcccaagttaatattgctgtttagctgcagagaggaaccttctgaacctctggagtctaagctccagccactcaacctctcagtattttgaagtaattcatgtcttattatggtgttaatttaaatcaattttacataatttatttttatatacttcaacatcattttcaagtatccaagtttttatttttaactcattaataattcatttactcttcctttaatcagatgactcatacaactttgcattttctatcttttgaagacatatagtaaccagtagaaggaatctaaagctattgtgttaaactactgactttaaaaataattatataggaacagaatcatatgcatcaaagatattagattattgaaataataaactttatgattctttttttttttttttttgagacagggtctcactgtcatccaggcaggagtgcagtggcgcaatctcggctcactgcagcctccgcctcccaggtttaagcaattttcccacctcagcctctcgagtagctgggattacaggagcacaccaccacgcctggctaattttttgcatgtttagtagagataaggtttcaccacgttggccaggctggtctcgaactcctgacctcaggtcatctacccgcctcagcctcccaaagcctcccagaaccgcatccggccacgattcttaatagtaattcccacatctaaactatacaatgttccactcgaacccatttacaaaagccacactccattttagtggtcaaaacagtaaacatttaattgttcatttaatttatttgggctatattaattccacataaattcaaattgcttgcaaattgaggtatgcttgattttgaaaatattctaatgaaaaagcttcctttctagccaggctttaccactacgtaagaaaggatctgactgtttggctttttcagtccatctgagatgtctctttgtaactgtattttaattttattagagtgtgttactcatgtggtttctctttcacatgaacccaaaccaaaactaatttaatgccatgttccaggtgactcaatatgaaatggggacacataaaaagatcttatctttttggaatcttagaaattcctttatctcttttacttctttttaaattttcaggtagttgtttttattataatcattattatatgtaccacctacttgtaaaaacgctttgggcaggtttacagggaaaaaaaaaaaaacagtagtagagaaattcacttaaactaagtatgagaaaagaagtgccctaaatatcacaggaaaatcaactacatacgatttcattttataatatttctacattcacgtacaggtaatctccaacttactattgattcgtgctctaaaagctcatcggtaagttaatggtcggaactcaatgaattctattgaaccaataacatattaggtgatcaggttgttacaccagcacgcaaagcccaattcaatcctgaatgcaactcaaccatcataccaatagtaccaacaggaattctgagtctaaagacgatggccttatgaagaattatgccaaatgggagatcaagtacttctacaataaattcattcattcagtagacattaattgagcaccaaaaggctgcagagtgtcagctttacatgtactaattctggaattaaaaaggcctggctcctaaatataaactggagataaaataatgccttaaataaaataatgtatgtaaagtttgtggcacataaaaaaatctttactaattttaactctcttcctttctgctgaggaagaagaagaaagaaacagagttctcagctttacataaattcttgaaggaagccaggcttaatttcctcatcatttgcactcctctccaccttcccttccgggcttcagggcccagtgcaagaccctcactgagccaaccatcttagacctctctctgttccaggctctaaaaatatcccctcccaacctgacttttattcccatcctgcagccactaacatctgctaggtgataaagaaaagcagatgcaatggcgcgatctcggctcaccacaacctccgcctcccgggttcaagcgcttctcctgcctcagcctcccgagtagtggaattacaggcatatgccaccatgtccggctaattattttgtatttttagtagagacagggtttctccaatgtcgttcatggctggttttgaactcccgacctcaggtgatcagcccgccttagcctcccaatgtgctgagattacaggcgtgagccactgtgcctggcctgacctgatgaatttctaattagtggtatttttaagacagtataaaagaatggtataaaataattcaggcagagtacaattataatatttggggacagggagaaagccattcatttattaattcattcaggttctatgaattgccttctatcttcctggatagacatatgtcagagatcatgtcctcatagagctttgagttcatcagggaaggcagaacttgtccaagctatatgactatttccaatgggtattaacaaatatttgtttaacagagtgaataaaatgctatgaagaaacttagagagcaacagaaatgcaaaataaagggcgctaacagaatggaatgtcaaggaagacttctttgttgaaggcttctcctagaatgtaagtcccatgagagcagagatatagtctatatccaaatgaaccctgaatttcaagaacccagaataatttcaggcacatagtacgcacttaactaaaaatacatgaaagagaaaaggaagattagcttaagcttagacttaaagggtgaataaaaattagctggaggaaatgggattaatagaagtgaaggcatttaggtagaaaaaagtagcactttttgacaaatttaaagaggaagcaggttgtacagacgatgaggcagaagttccagagagaaaagtgagaaacaagtttggaaaggtgggtaaaatccagatcaaactgggcctttcacaatgtgcaaagaattggagacatttttcctgagactgactagcctactgccctggaaagcccagcttggattgaactttccacaatcatccctcagaacagttctgaggcagtggcatgtggattctggtggcgaaaggcaaagggggagcggagaaatggagttcgcaagatgagtaactgaggatcccaagctgtagtggcagagctgccactctgtcactagaacaaaccactaagaaataaatacaacagggatatctgagtccttggcctacagtttttccatggggaaaaaaaaaaaaaaaatatatatatatatatatatatatatatatattcgttgagacatttgtttgtaagttcagattgctatctaagcatgctgggagaattcactgggagaaagccctgaaaagaaaaactatttgctcctgaatttatctgtatgagcaagtatgtgtgagagagacagagagagggagagagacaaggaaaggcagagagagggagagagaggcagtcctgtcagagggctgactgtaaaagaatggaggattacacacttcactgttcaagggtgacagagggaaaacgaggctggcaccaagcaggaagcccaatcctgcctgaataaaacactgcacatttatgcaatcccgggtaccagatcttttatcacaaactattttgattgcatagaaagaaaagtgctaagtaaaaattatttactccaggtctattatgaaaagaacagattaactccctaacagttcgttctttttgaaggtatattttctaccttgctggtatgatttatattaatgagaggtttaaaacaggttttaacttaagaatgattgctgatggtgaagtgcagtaattatacaccttatgacaggacacgtgaatggctcctacaagagaactgcataacatgtcaagctaatcctccttgcataaaaagagagaatactttgcaagctggccgattttaagctccagttaacaaaaaccctttttgttggagtctaaaacaagaatgggttaacaaaagcaaggaggaaaaaaatctcatttttccccttcttcacaaaatatactattacaggacttaaaggttttgaaaggccacagtgtggctgaaagacttgggaaagaaacaaggtcttcgccaacaacaccacactcaaaagatcctaaggtaaatcgcagtctcttatcagtatggaacagtatgattttactctagttttttgttgttgttctgtttttgatttttaatgagttaaaggtgtagcgagggaaggagcgacaccatggctaggtaagaatgaaatgggttcatggatgttaggaagaaaaaaacgtatgccatggtgggcaagtcaatagtgtttgtgccttttctgcatggctgctttttctcatacaagagccacttctggacaataatgagaccccgtaaagcatctgcttagggattacgaccccgtcacactgggaatgttcagttaacacagagcagccatgggcttaactccgtgtgtgcctgtcttcctgctgcaaaacgcaccaaatgcacagtggtcctggattcttctaaatcatttgccaccaggaaagaagatactcagctactgacacaccacctacctgctcaaggaaagcaaaaattaaataaacaaaagccatcagatttacttcacatcatggaacttgttaagacaagggagacaggaagactaaaggttgccaggtgtgagaaacgaagtctggaagtccattttaaagtattagagggctaaggatcagcgtcagtgttaaattcttttctaagaattcttttcaccttggaaactttcaaatgagaaatttaaggagcagaatccttatatttttctatgactcttaagtgatttacagaatcctaaagtgtagcaagttcttataatgagttgaactatttaacttattttatttaaatgtttatttcaattgttttgcctatgtactatagtctgtaactatcctagtctataatcaaagaaatcaggagtgcccaccacctatttgcagaggtctctaaagcagagtccacagtggccagggcccatctagcaaactggcatgctcagtgggacaggtcaagagggcgggtctgcctctggcttcctccttcttctaacacatgctgcacttgctcttgataggatagagcaaaaagtcaccactttttaagaaaaccaaggcaaagaacagaaagtttaactcgtggtacctcctaaacaattgatgtcattactgctcttcaaaagatctcttacagacatgtagtttagccataaagatagtacgttgtgttgaaaatgcaaaatcacacaaatattgccttaaatattttatttccaaatgtaagtaatagttaaactatttatatcccttcatgagaaactggaagctgaaattttcagatgtgaaggaatttctcagaaagtgatcctaaaaattttcaggaaaaacatctaacaatttaaccataaagagctttggtgaagtctgacacccagtatttagctcttttgctattattcttttttttttttttttttttttttaagatggagtctcactctgtcgcccaggctggagtatagtggtgcgatctcggctcactgcaacctccacctcccaggttcaagcaaattctcttgcctcagcctctcaagtagctgggattacaggcccaggccaccacgcccagctaatttttgtattttgtagtagagaccgggttttgccatgttggccaggctggtctcaaactcctgacctcaggtgatccactcgcctcagcctcccaaagtgctgggattacaggcgtgaaccactgggcccagacttgttttgctattattctttaataactgtttgcaaactacaaatattgaaaggtgagcatatgtacaaagacaaaattaactagtagtctgagctgaaatattgtagcttaattctagtctatcaattttgatctgaaataataactctgagggcagttttgtcaccatcagcactcattccaatattcaaaaggaaaatttttgtttaatttatataacatcttacttatagatgctttacttatagaaagcacctatcaattataattagcaaaacaggagtcaagggcattgttttattgtgttacatgtcaaggaaaggagacttagagctaacttctgtgactcttggaaaatccaggattgaagcctgcagtcctgtgacttattgaacagtcaaacctaggagaaattatcctaaggtaaaatgtcagaggattactctctagattggatggcagagagagattagcattctcagcatcaaaaaccagatcacaaacccatctgcaacagaagtacatgcaataaaagtactagaacaaaaatcaccacatttaagagagaagctacctcatggtgtagtaggataagaaggaatgagattgataagaggaggcatgtaggtatattatcattactctttttttttttttcttaatggagtcttgctctgttgcccaggcttgagtgcagtggcgggatctcggctcactgcaacctccaccttccgcgttcaagcaactctccttccttagcctcctgagtagctgggattacaggcacgcaccaccacgcccagctaatttttgtatttttagtagagacagggtttcaccatattgaccaggctggtctcaaactcttgacctctgcccacctcggcctcccaaagtgctgtgattacaggtgtgagccactgcacttggtctactcttttttttaacattttgttagttatgctttgtaaaactagcatatttttaatttaatttacatcaatttaactaaaattttattaaacattcttaaacttggtggtgctggcatttgttcgttgaaattttttttttggttttttttttgggtatgttttaactatttcaacatacgtttttaaaaaccagatccaagaggatcagaataacaatagtgaggtgaaatcactggatcaaccaggggacaaaaaaaaatagcttcacatatgctcatttggtctttttgaacaaatgttgaataaccaaatcttttagacttttaaatcattcattattcttgcagttcaaatgtggcaatcttaactatttagggtttcacaactggtaggtacttaataagtatatgcctatagaggataatgataactttactcaaatgggacattacagaaaatgttatacgattgaaaacaaaataaagaataaacaccaagctcagaaaaaaagacttcacactaattcactccatctcattcctttaaaattcaggcttaaaaattttttgataaaggcgatctgatgttcaaaggacatcatttaaaacttgggaggcaaactgatagaggagaatgccttttgtgtttaggaactcccagtattgccagccccgaccttgttcctcaccagctgtaaaagcctgtgtgagaccttagtgctgaaggcctcagcttccttatctgtaaatgattagaatagataataaaggcaacaaccaagtttatacagtttgcctgacaactttgacatatactatctcaccctaaaagatccctttgggttttcatgggctatcatcttggttttatacacaactcttatttggttatatgtcacttacctaagtccaagaattacgaagcacagttgttcagttaatttatttcttatttttaaaaaaagcactgttgtactgctgtagatagaacaactctaatcttcacgtactgctgaattacaattaggtgctaaatcaccttcaaagaatgaacaaccttttgttttgaggctcgtccagaagcatcactaggacctgatatgtacaagaaagaaaaaaatagtaacctgggcagtaagagttttgtcagaaggaatgcttgtccttatcagaaacaccacttatccccaaggcttgaactttaactatgaaactttacccactgggtttttaacacaattactactgcaagctcaccattatgtatttaaactcacaataaagaatcaatgcctgatattgcattatttcctaaaagcagattttgatggaagacaagaggctgggctccagtatcaagagtgtacaggatattttttaaagacatatttaaataatagcattgatcataacacaataatcactataccctcatcttccattcctacaacaaagccccttaacaaagacatgtgtacgcattatagctaccagttttatatggaactgcccactaatagctaaattggcatctttatgaatttaaggttctctataatgttgattatggctactgcttttgactgtatttttcaaaactgaccacaaaatagaagcttctaacttctctctgcccttgtgtttgcaatctccagagaaagcactccttaatttcatcatagtggtcagtaatctttagtgattgagacagaaattaaaattgattatttgaattctgacaagctgcttatgtttgtaattaccataaaactctaccacaaatgccctagagtccacgggtgtgagtgaggggttgataggaaatgatccattttcatgtatctagatttaggacgatgcatgtggaattgtagagccacttaagatcacactcatccgtgctggactaactgaagagggaagtcactatcctctcttaatagaccagacagtcctcacgtcattgctacaattaaattccagagaattttttggattctatttaatgaataaggatatatttttcatgtggtgtcattgtttcactacttcccatgtttatttggacagattcatagcactgggtaggaaatgtattggttggcaacttcagttttggaagagaaagtaaacacatgctgattagcaaacagtaaactctactgtgtttaattttggcttctctttaaaaaaaaaaaaataaaaacacaaaaaagccactatttggtgttgtgttccaagtaggagcatttgtccctaagttctttcctaaccccttactggagggcttccagaattgctctcatttttttttcttcttcccctaacaccagtggcaaacgccaacattatttaagaaaatacttgtgcatatggtatcctcctagcacagatttgccatccagttgaacagtagggccactaacccacacaaactaaactgcaaaattatgaactgcataaacataaacaattgaatttagccctaataaattcaaggtaaaatcacacttctgaaattcctaaaaggctacgtcactgaaaactatcaggtctgagaactgaaggtggtaaatatgacaatctaaaacttccaatgctctctttagagccaatttctttcatctatctcatcctattgatttactgtgactccccaaattattctccaagctttagccattcttagccctcttctcatccatcttcagaagatcatcaaaatccctaacacccaaaaagtgccgaaggccagcacacacagggaaaagcttggccacctaagatataccattgcccactgagcacaaaagctcttcattatgtctatgtaccttctcattaaacagagctggtgtctgatcttttcactgctcatgattactactcattattaatcagacttcccaacatgcttccaaggtatgcaaaatctcgtccccacataccagatgggaaagctgaggcatccaaaagttaaataactcccaaatagcccaatataagaggtcagcaacatctcttgccgatctacattgtttcttattcaataaacatttattattgatctaccaagctcctcaccctgctaggtataacagtgtgtgtgtgtgtgtgtgtgtgtgtgtgtgtgtgtgtgtgtgtgtgtgtgtaagctcctcaccctgctaggtataacagtgtgtgtgtgtgtgtgtgtgtgtgtgtgtgtgtgtgtgtgtgtgtgtattctaccatattctgggttctgggcaaaacagcagattatcaaagtcctaacccacatgaggcttacggtctaggaggggtaagaaacagtaaaccaagaaacaaatgaatatgaaatatgtgaggtagctatggggcaaagagtacagcagggtaaggagaaaaagacctgggaagaagagagtggtagctggagtggtaggagattttgggggcacatgtaatttaagtcttcctctgaatgaggtaagggagcaagccctacctacgatcatctgagaaaaaaacggttcccagcagaaaggacagacagagcaaagtgcctgaggctcagctgtactggagggatggtagtattgctgctactgaaagggcaggcagagtgactcactggggagagggaggcaagggtcagatcacacagcacctggaagtcaccactaaaagtaggggctacaaatataaatgagactactcaagagagacagtcttgtgaagagtttaatacgtaaggttacattaaaaattcactgcattaaaagcagttgatgctttccctaccatcacataaaaagtatatgtgcacaaacagacagaagggtgcatgcgctgaattttatatagtctaggaaacattttcacattggttgtttcagtcaaatacaaagaagttacagaacagcatcgagtacctaagagagaccaaaagcatttccttctgtaaagccctgcagctgagggcttacatccgcctggtccaatcagttcatttccaaacaaaggtaggaaatggctgcatcctagtatttcattgtggactcatgactcagtgctttggaacttggtatctttgggagtgagtgtctattctccacgtctcttgccacagggggaaaaaggtacagataaacagtaacacaatttcacccaaccgagatataaatctgtgggcttctccacccttctcaaaaataaatgaatgaatgaaggaaattcagttcctgcttttttttcttcccttctctgttttgtttcctaattcccaggactccctggtgtctcctaaacagcataaggtcaactgatggtgaaagtacatcacatgataattattcaaaagctgttatgttatacaatatagtttataataggaaaaggagttacatttgattctgcaagagcagtcggtaatatgcccattacatagggattctaagaaactaaaattaagaaatttgtcctaaagaacaaattgattctcctccatcatttaaccaaaaaggtttgtagtattttgtattcacaatgttacacaggagaacagtaacttaactttgaaaactgttttcacacaatggtcacaaagaaaataacacataaatcccattaggtctttttgtaaaaagcttccataatttccaaatccacggtgtagagaggaaaagaggaaaatggcatgtgtatatgttctaagactattacttcaaatgaataaggtttagaggtatacttaacatacaaactgtttccttcaggaaaaagtgcaggaactcctggatagacacaatactcatttctgatgaaagttacagaagaaactaccagttgtgtatgatctaatactacaagtcacttattatctatgaaggaaaacagaaagagaaaagataagaaaacaacatttaaataagaatgagaaaggaatctctgttctaacttaaagatacataaacatataaatccaaatatgagccaaattattttataatgatatccatgtgatcaatgaggcataaccacaagaaccttacacgattataatgagagaagcttcgaaacaggaaatttctatctacaaaaagtacaaattattttcagaatattggaggaatctggggttttctacccagcagaataaattatgaaaacagtgaaagataccctccagagggagagagtgcaagagtttatatgttaaagagaacattacatttcacttttccaatgtagaaacaaactgaagaaaatttagaggggatggtgaggatgaagagaaataaaatcataaaaaggaatgagtaaaaaatgtaataaaagaagaggaatatggtttccacttatattagttttgtccttccattaaaaattataccttaaagtccattactcttgactatattgccaatttctcaaataatacactggtcaagttccaaaatttcattaaatatataaattgcatacataaaagttcctgtgtagcctatggaaacattttaaattttcttcagcaaaattgggcctaaagtttggaaaaattcctagagagtgaaattaatctctctgtccccatctctccctctctccctctctctttctctccctctctctcaatagataatattaccctactatatatcctgccatatatctttatactccaatttcctacctagtcccctattcagacatgcataatgcttccattttgaagcatatggctggggagccaaaagaatttaaattgccttcaaaatgtgcatcgcattataaatggtgtgaaaaaagatcttactattcagctctcaacttggagcataaagcaaagaagaagcaacacaagactgcttcaaactttatccaaaaactcaacagcttcacttgtttatagaggtacaaaaagtatgcgacacagtttataaaacaagaacgatgtactgtatgcaaaagtaaagttaaaagcaaagtatagtaacagccctatctcgttacaaacacttggcagcatgtctaaagtaccatggtcaaaaacatgataccgtctgcgttgtacttctgccagaaagcactccctaagtccaagtctctttagccatcatcaccacctcatttggcaaactctcccaagcctcagttcatctactcaaaattactccacagaaagcagacaaactctctagctttgtaggctgcaagtatcacaatgaagtagcattggcaagtgacagcgtaagatggagctctgaggttagaaagccaggaccaactaaactgtatcctcaaagcttatttgcatatcaagttgagcagggctgtcttcattttggtaattcagggtttcttctctactctcacagtaattccaatgggtctttctgaatcagccgcagctgagaaagaaagcacatggcaagaatacactcaggcaccgaataccttttaggcaaatgaggggcaaatgtattcggcaattacctgccatttaaccatttctggccaggtcttttgaataattccagaacctcaaaaactgcctcaatagttatgtatgcataacggaccaggccattaccaaggctaagtaaatacaagaatatgcatcaaggtttaggtaataagtagataaatagactatatcagtatcaacatccatatctacctgtggcatttataactaaaaaaacagcagttcataatacataagtataaatgtggcagtgaaaagatgactgataggacagaagtagctgcatgaattattaattttcctagggcacgtaagaattggcttccaaatttttctttaatcgactttctccaaagtagcatattacataattcaaaaaaaaacagatattgtcatcttaagtttacagcttgccatatttcctagaaaataaacaataattaacaacatatctcatagttgttccctccccacctttcttcaagaaactttacactctgaaatgtagatacataagctacttttggatcagggcccacaaccatatgcttccaaaggaataatatgtacaggttagtctggtgtgtaccagatgttaaaaaaaagcaaattcaaaaacagaaatatcagtattcaatgcagaaatatattttaaattaaatcccattcttcctctccttatagacacagaatcaaagaaagccaattgtatgtctaattttttaacctttttcctgaacaaaaatcccaatttgactcatgactctagattctttatatacataagatcacaagacaagaaatggtcatttataaattatcctgtctcagagtgagcctcctaccatatgctgatattcaaccagaagaatttgtttgaaaaggcaaaaaaaattccagaagttaagcctataaggcaaaccagccagcaaaaggcgacagagtccacatgtctatcagatatttaatatgttaaacctcaattaccaaaagttttaagattctctgtaaacataactagtgagtctttatttttcagatgattctgaatgcaaaatgagcacattatctgcacattgaaagaatttatgtgttttttcccacatatggaaatatgcatgagtattaaaaaacaaattacaaatatccactctctagaagtttgaaaagtctaaagtttgggctgtatttgctttttccattgcaaacctacaaggattccttcagacttacaaaagttattgcaagaagtcctgcaggaagaaacagattggggatttagatcacccatgcctaactttttcagggcatcatgatctctccccttgttctatacatcagagatgtcactgaagtgaaagccaagttttactttagaatttaataaaaattgattaagcatcacagagcacaaacaaagctgctccataaatctttcaggcctttttgtgctaggaagaaagcaagcactgtctgctgaagcagatgacagatgctggcttaaagataagtattatttatacttctgtaccagatttcttcttatgcatatcttatcatgcatgggtatatgatcaacaaagcaattattttatatcagtcaaagacattcaaatgtaccctggctccataggaatgctttaaagagttcaggtctagggttcaattaaaccaagatggagagaaaagaaagtttggaaagaaaaacaaatattgaaatggttgtgatttgaaatgtactttcacacacaggctaatgaatatatatgtactgaaaataactttgttctgaacatatgcctatgcattttaaataaatgatgcatgtttgaaagataagagggtttaccaaatctaaacacatcaagatatatctatattaaactgcatttatttgtacagtatgtcggtaaggaaacagccccctgaaagaaatccaatagttatgtaaagagatagctgatttaaccaagtttgagaacattttagtcatcaagactagagtttaaaaatttaaatgacattccttccctccctccttagaaagacagaatatatgaaaaccaatcacttaatgaaaattcccagaggtttctttattgttttacttctagcatatgaagtggaaaaaagataactaattatttgaaagagaagaaaaagcaacttatattaccttctcaaaaaatatataatattctgcatcataaggcatttgaaggtggagaagctggcatgtgattccaaaacaaatctggataagtaagagaaataaatcaggtgggctgtcttgaccattttcttctaccccgattcctaagtcccttgagaatctagaagaggagcaggtttgggggtggaattgttttgttttattgtgtttcatgagggaagacaaactggaaataaatgagttttcaagtccagccagaaagtcaacctatggttagatttacctaattgggtattttttaaaaaaaaagtacaaaaacaaaaacctgtgctcatccatttttttatggtatcttattgtatttcatttttttctcagcatttttcttcgtaaaagttcgtcctaagaaatcccaacctcgtctcagatagcctaaaaggcagaaatgttcatccactcaaagaccaggaaaccctaagctgcatgacatcatgtgggagtaaaatgactgagtgagctcaagccaggatccttgctgctggagggtttcctgcacaagggctagctgaagccacagatatggctgcaactgcattaaaatgacattggtagcagaattaaactgtctggtttcatggaaattaccgtatactgtagttatcacgtgagaattagcaatgcactaaaataggacacacaaatcagtactattatgtggtaatactaatctatcatacgcaataatttttctttcctgaattatatatgaaaacacatccataagggtgtagcaattatgagcaaatattttcaagaatggctattgtgtatgtctcttttaagcatgcaactccacatagaagcactaaacaaagtaagtgcttaaagatattcaggattctctttcctatttaaataatcctctctattatataaaaattcagtttgtacaacataagcataagaaatttgtagaggaaatgataggtcagaatggtttttaaatgaccttatagtagaaaacaaagttaaaatatataccatataccagtgcagtcagatatattggagtcactaatacattctgaatctgctgattaaatgagagacattcaaaatgaatgaaacttacccacatactttctcatccatgtaagcaggaaagaattacatttcttctgagctaatgggaatgagtatagtaagctttaccgataactttaatctccacaatctccatagacagatccccaccaaaaaataaaataactgcttagtaactttgcagcatatcaaagttcacaaaccatgcccagttccaatacttattagccgttggccttagacaaattactgacctctctgaatttgaatttgtatatctatttaaacaaagataataggctcaaagtttgaaacaaatgggatatgtagaaaaaacattgagcaaaatgcctggaacacaataagtactaaaaaaatagtaaatactattattgttgttcttgctactgttattattattacacagtactttcatgataaaagtctctggccatacatcagcctagattagtgcagcatgtgcctaatttctcatctctgattccatgacattggggtgtccggattctcctcctacttatctgacttctcactatcattctcctgtattaactccaattcttctaaaagtcagcattcccctggttctctttatcaccctctgcaacctcaatcaaactttggcttcaaaggtttgggataacaacagctaaattcagacctgtattttcatttgcctgtcagacatcaacacttgggtcatgcctacccaacctagaagaaaaaaactgaacaactcacctccaaactcagtggttcttccactgcctctgttaaggaaactaacatttacccaggtgacgaaattagaaacatcacagtcacacccaactccttctccctacatccataataatatgcctccttctttctattcctaccagtacaagctttcctatgtccttcttgctgctctcctgactttcacagaagtcttagcttggttatgttcaacaaacaagaacacctaagatatgccaagcaccatatactctgaatgcaaaccaggacagaacaaaacaaaacagaaaaaaaaaaccaacggcaacaaaaaaaatgcaacccttttgctctcaaggttcttcaagtagtgggagagatacgtaaacacatgattatactataatgtcatacaagcaataataagtacacatggccgggctcagtggctcacgactgtaatcccagcactttgggaggcaaaggcaggtggattacttgagatcaggagttcaagaccaacctggccaacatggcaaaaccccatttctaccaaaaatagaaaaatcagcagggcgttgtaatgcacatctgtaatcccagctacttgggaggctgaggcacgagaatcgcttgaacccgggaggcagacattgcagtgagccgagatcgcaccactgcaccccagcctgggtgacagagcgagactctgtctcgaaaaatgataataataataagtacacataaattataaaagtgggacagaggagggagtgattattccatctagacaggtcagaaatgagtttactgtaaatatccatcactctagaggagtgttttgaagaatgaacaggaatgtgtggttgcacaaatgtgtgcaatgaacaggaatgtgtggttttcctctctaattcctgagaattagagaggaaaaggcattctagatatcagggacagcgtgggttagactctaagctctctaatcaacatgtttacacttaaaactcgccagtctaaaacccagacctaattttaacactttcccttttccataagaccttcaagggctttccactgcctctaggataaaatccaataccttgcattggcaaggcactggtattctaaactccgacccattagatgggaggaagctcccactgctctccacatccctttgtcttaggtacaggaagtcactacaccttcatacaggactgtgctccagccagccaccaaaatgcctctctgcccttcaccctgcaaaatcccatttaccctgggatatcaagtttaatttcactctgctgaagtccttcctaatcaaccctgcattgtgtcctcctctgagccttcagtccctttgttgatagctctatttccacacatctcatacatggatttgtagagtgaatgcccatatgtttgccatatcatttttgaagagcttttgctgtaaatgagaacttcagtgagtaatttccaattactttcccccaaattaacaggcaaatattaggaaacatcctatgccaaaccctcttatttggtgccactgacagtgctaacaggctagagtgaaatatcaaggtatatgtgtggttcacagaaaaccactaatatcaccctgctattgactgaactgtgtccctgaaaatgcatatgctgaagacccaatccccagtgtaactgcatttggagacagggtctttatggaagtaattaaggttaaatgaggtcataaagttgaaggcctgttaaaacgggtttagtatccctacaaagaagagatgccaatgtgcctgatctctctctctctctcttgctttctttcactatatctctctctctctctgctttctgagacacaataagcaggtggctgtctgcaaaccacgaagagagccctcaccagaatccaatgatgctaattccctgatctcagactcccagcctccaggactgtgagaaaagaaatttctaccatttaagccacccagtctatggtattttgttatgacaacccaagctgactaggacttataccatagtcaagagaacttgaacagtccacaattaagtggtgagactgtctctggtatgatgcacaatgtatttaactttacaaacagactcattaatctctcaaaagcttaacactgtcaccattttacagacagatccagctaatggttggaggccttccatgcgccatccaataatgcagggagaggcagtgaccatgcccagaacaggattctaaagtcctgcctttcaaatccctgacctagaaaaaaggactactccatttctcacaggaaaatgtgccagtcatggaggcctacatggcacgtctctgcactgctccaggtcaggagggccatctgacactgcacaggcaccactgcagggcaaaaggatgatcaagcatccaaaggccaccgccaccactgactagctgaaaaaccatgaaaaagttatataatttcactggatataaaattaaagcaagattttaatacttaccttgtagggtcactgtgaagatcagaaataaaatacagaagtacatggcccactgcttggcatacagtcaagactcagtaattagtgggtactctgcatgctttgatgtcacctcattaacagtttcacttctacctaaactaaaagcaggaacagggtgttcttattattttttaaaatctacagtagatatctgccctgtttgtttaggtgttgtctacacagtatctactaattttttctttttttctttttttttttttttgagacagggtctctccctgtcacccaggctggagtacaacggcataatcaaagctcactgtaactctgaactcctggactcaagcaatcctcctgcctcagtctcctgagtagctgggactaaaggcatgcaccaccatgcccagctaacttttgaatttttttgtagagatggggtctccctatgttgcccaggctggtcttgaactcctggcctcagcaatcctcccacctcagctctacttctttctttctttccttctttcctcccttccttccatcctagcaatcctcccacctaaactgcccttccttccttcccacctaaactgccctgccctcccctctcctccactcccctcccctcccttccttcctttcttccttccttccttcctgtagccttggtctcccaggctcaagtgatcctcccacctcagcctccagagtagctgggattacaggcatacaccaccatgtcggactaatcttttatttttttgtggggatgggatctcactatgttgtccaggctggtctcaaactcttgaactcaagcagtcctcctgccttagcctccccaaatcctgggattacaggcatgagccaccacgcccggcctctattactttttgttagtaataacaataattttcctctgggaagccactcttccccactttctgagatcatgtagtttgggtgtctcgtgatcctcctctagctcctctccaagaacaggcaggagacttaagcatagccaaagagaagaaagcaccagttcagcaacaggttcaggggtagtccaaggagatccagcccaggaacgtctgcagggactagtgaggaagggaacattttcctccccactgggtttgcttggctaatagaatataagccttcactgtggaaagagaccctctttgcccgagaagtaagggaacaaagagaatggcataggaagagaatcagagaaacattcccagttacatcatttgaacacctgaatcaaactgtacctgcagataaactggacttttaaattacatcagagaataatctccctttctcacttcagtctgtataacttcagtttcttacacttgcaattaatatacaaaccaaatagcagcaagaatttgacacctttcagtgaccaaaaggaccactgaaataagaacttagtgataagaaatacctttcattaaattctcactgtacgtcaactaaatatttcaaatttagtatttccaattacataaactgaggatgggggtagatattattatctctgctttactgataagcaaattatgagtcaaagagcttaaacaaattgcccaagtttaaatagtaagtggtggagatgagatactacctaagatttagcttttttcttttcttaagtattaccaagaaatagtattactcggaaatctcacatatttataagatccctttgttttatgctcttatagcatcatgtgccttttcaccaaatgattcaccacaattgttcattctacttttttttaagattgcgtctcactgttgcctaggctaaagtgcatttttgtgatcctttgatttgggaaattgttttctcccattatcttataaacttcctcagtttacgtctatcatgattattgcatatcattgtgcattcactgacaatagtagatacttagcaagtactgtaaaaaaatagaaaggaaggaagagagagagggagggaggggagaagaagagaggaaggaaggagagtaaagggaaaagaaatgaggaaggagggagagggcagaagagagaatggaaaagtgagaggggaaggtaattccacaaccccttcaccacccttaagccctttcttgagataatttagggcctagcaatagacagtggtgacactgtcctcatgcaaagggataaatagaggaattccggaacaaggcaggaatatcatcataaatgccaaagtcttgtggataccatttctgactcccccaaaaccccacacagtaggaacaaacatgataaaaagtttcacctattcctaactccttgttcaaaacccctcgagtctctttcttcttttcttgataagtcttagggtaacacaccaagttttaaaactcagttacaaatttgcccttaactgagcatctgaaaggttatcacgcaggatttttagctctaacagggaggagggtcttttgagtttatggcctgttgagcacttttgtgctgagtcaaggaagataagaggagtgggaaacaggaagaatccattagacagtgtctgtgcatataatatctttttttgttttctttatgtaagttctctgatggacaataatgtccccaggtagctaatgtcacaaacctcttaaacatgagagagaaattgtaccatttctcaaaggcagctttttggaagggaagatcaaagaggaggcagaattaaagccttagctcaaaaggaagacagatttccaaaacttcagcttttgccattaaaactttcaggtgtgtcccaagataaatgatacatcattggctactacatccccacagtggcctcactactacctcaatttgattttgtgaaggagtgctgaagcactatcaaagaactttggtgttcccttgcttatgtcatagttacctagagaaaagagagtatgccttaggaaatattccagtttaaagcaacattaaacataccaaattcatcaccgggattacagtatatagaatattttaagtcaacctgtatatctctgtcaattatattttattttaactatgtgagagaaggaataaaagttactaaggtatcaccttttctagtaaaagataaccaaataaatccattgagaagtcacgtttattcaaaagaattggtttctctggacttatgacatttgagtatagtacctcctttcttctagaatactctgagttaataaaagtttttttgaaaatgaaatccatgggtatgtgtcataataagtaaatactaaatgcttgtagtttttcagagacttttcttaggtgatgtctattcctgaagtatgatcagaatgcaacatctaacattttacataattaaagattatagtattttgttttaaaaagcaaactagaaacctcaagaaaaacctatccactggcattcctttgaaacatacatacaaagaactttacggtgtttttccttgcctttgggtgtttgttttacaagagaggaactccaggtgcaatcactgaatgaggaattagaacctccctccaagctttcatctgattgcataccaacacataacgaaggacatgatatatttacagtagctaaagagttaatctttagcaactctgcttaaaaatcctaatggcagactgcccatcattcttttagacagagcttgtcagaaaaactagggcagcttgtccagctcagcagtcaactgattactagtgaactcaatggggctcccagccaacccctgagattgctgccagccccttgggtattcaaaggccaagttccaatgtggtttactttgccagaatcacatgatgtcagtgctattttctcctgaccagaataaccagtcattcaggttactgcaagtggtatcggtgaactaggcatcacttcactgttagaggtcacatacacaccaaggctctgctccttctcaccacggccgaggggccactggagcctcctgcaggaggtcagctaatcccagtttgtcagttccagccacccaaatcctgcacgggcatcctgcacaccgcagtctgctccaaggaccaggaattacacaggcgtgctgcacatggcacacttagagaacaaaacaaacaggtccaacttttataaagaacaagctggagaggaaaacaacagaaaactggttttggctttcacttatattatattactcgaggtttagtaggcaagccacacaaattctgtgggatttagtcaccgttatccacctatgcccacattctttgcatggtagtaagacattaattaatttttacatctatcaggagatttttcagttgctacaggatttgcaagggtacatgcatgtaaggagtagccagtttttaaaactgtgattacccttatctttcggtgagagaaagtatttcactccctaatgcagagaattaaaaaacaagatccactttttaatctttcttcctccagaagaaaatacaaacatcaggaatagcaaacgggctgatatggctggtggactctgttttcaaagtcttgaacatatttcccaatgccttaaaaaccttgaaatatttttaatattcctcattacttctatggcactttgcatttatttatatgaattcattttaaaaactcactttaaagagactaaatctttaaaatatgacatttaaaaatactgtagattttctatatcattatatttatagtttttcatcctttcttttttctgtcagtaaagtaataaagttttaactgctgagaaataatgggcagcaaggtaaagaagtgtcatgatttttaaacatttgtatttgttaaaaaaaacagaaactgcttcagttataatatgtaaaagaaaaagaactgtaatgactgcagtaactactattacgtaaaagacaatacatgtttcagaaataatagagtcaatgaactatctgttactactggatacatccttattaatattaccttggggaaacctctaagcaaagtgagaacaagatcacgagaacaggcgtcttaagatctactgatgcagctttacatgttcctgccatacaactttgtggaggaaaaaaaaataatgtctttccatctcctgcagcaaaatattgcacccatgacggtcacccgtattaaactcaggtaaacttctacaagaagtccatctgtcaaggaaattgtacagtaagaaaagactggtgatggatgcatggaaggaaggaaaggagggaggaaggaaggaagggagggagggagggagggaaggcaggttggtttctacaaagaaaaaaaagaccaaaaacaattatttttacatcaatgcttcataattttcattcattccatccatgaagaaagtttaagcagatctgcaacaacttcaaagccaatgttatcatgtttttcaatcaaaatcaggtgctacagttagtgttccctgatggttacagctcatctttgactattcaacatgtcttttgtcctggtcttttatttccttctcagatgcatcatatcctactgctaacataacatctttaacgaactaacaaatgtttgaaagaaagagacttgctagatacaagttctctggtgcaaagggactgagtggtcaccaccaattagattatagcgggataatttcacagttctcgagatgattgtttcaaggaaggctggaaatgtacagaggcagaatagcctggaagtgtgtggttttctctaagcagaccaaaacagcccacaaaactcccagaaggaaaaaagcaagtgagatttcgatcctttggcaatgaagaaataatgcacaaataaaatgttttagcctagcacaggggctcacacctgttagtcccaactacttgggtggctgaggcgggaggattgcttaagctcaggagttagggaccactctgggcaatacagtgagaccccatttccaaaaataattttttaataaaaaaaagaaaaaaatgtttaaaatgaagttgtcagaaatactcttttgagactacgtaataacctgggtgctgcctctaggtatctttgcggaattgttacagtaagtaaaactctctcaagccaacattcatggctctccatgaagtaatctctatttatttttttcacgtggcctccagcacatcatgggtcttgtattccagctacactggataacttcttgtacattttcctgccctttgacttttgctcatgctgttcccctggtctaaatgcctccccagcacttgacaaaacccgtcttttaaagtcagttaaaaacataatttctcaggccagtcatggtagctcatgcccgtaatcccagcactttgggaggctgaggcaagcagataacttgaggccagtagtttgagactagcctggccaacatagcaaaaccccattctagtaaaagtacaaaaattagccaggcatgatggcacacacctgtagtcccagctactcaagtggctgaggcataagaatcgcttgaacctgggaggtagaggttgcagcgagccatgatcacaccactgcactccagcctgggcaacagagtgacactgtctcaaaaaaaacaaaacaaaacaaaacaaaacaaaacagcatttctccataagatgctccctccacccctagaaccagatatgagctcctccactgcatctcagtagcttcacatttatacagtacttctcttaaacactgacttgatatgggcttgcgttacttactgatcttatccctccaccagacataagcacataagcatggagacacgcatcttcagggatgtgcactcaataatcgtttgctgatttgaagtgaaatgatgaggctaatttattttacagtactcccgtgcactggttctctaatagctgctcaaaggccctccactgatccaaaagcccatctgctataatattagtgttaataatgatacataggttcctgagataaataatttaattatcacatgcttattagggtctcaccaagagcagagccatttacctctttatttgaataagacttctgaaaaatgctttgtagttgggattctgtgtgtgtgtgaatctatgcatgtgcatatatgtgcatttacaagcaaggtctagaggcctaaataataataatgatcttttgctcctcttcagtgaacttcagacaagtaccttaaagctacaagctttaaagtattagcttatgaaagcgccaaccatgcttccaaatttcaaaacaaaataaccttcgctaagtcaggaagatcacttgaggatgggaattcaccaccagcctgggcaacatagcaagaccccatctcttcaaaataaaaataaaaatagccaggtgtggtggcgcatacctgtagtcccagtttcttgggaggctaaagttggagaatcacttgagcccaggagttcgaggctgcagtgagctatgatcacaccactgaactccaacaaggatgacaaagtgaaaccctgactcaaaaaaagaaagaaagaaagaaaaaagaaacttggctgaaccatgaggagttaacacttggacattttttgattctgcaactgtaaaagaatcttgctgaatttgttgaacttgtgtctctaacagattactgacatttccttaatgtaagatcacctggggattaaatctcaactgtagcacatatcaatgactgtgagcatctgactttaccttgttttacaattctcatgaaatggatgtatggtcaatgactgaggggatgataaactttatattaaccaaacatgatataaaaatccagggcatactgatgaccagatatgggctggtaagaattagttctaatataacatggacatggacatgcttcagtttatataaattgctctataggtagtgacagattaaccctcctaacatccttaaaaaaagataataaaagttattattcacttttattgatgaaatacttggagtgtttagactctcacaaggtcactataaataaccttttaacaatccagctcactgatgagtcttggtgtgttttgtgaagcactcaactgactgtgagaatcacatataagagaaatgatcaaatagcctgaatgcctttggaaaacattgaattcaactctgtcctgctccagaatccacacactatgctagcatagtattactgaagcgcaaaacaccatgctagcatagtattagtgaaatacaaaacactgtactcaaggcacctagtttaaatccaccacctattagctgtgtgatcttgagaagtcccttaattctccctcatgtgcaaagggaagctaccaatggtgcctgccccacagggctattatgagtataaaaatgagacattttatgcagcttctgttttaccaaaaatattcattttgacccactttttctagaagcctctccctctaacaatattcatatgtaaaaccaacaaaaacactaatcaaattccagagagattgaatttcagggtgagggaggtcttactgcatttttgccttaataatctcagtttcatctttcattccataccaaaacatggttacagggaaactatgttctaagaaaaaaaattattaattatatacccattctgcacatttagaaataaataattttccaaaaacttttacctagacaagaacccctccttacaaacagaagttttctctttagaccaatttcactgctaaccataaagaagaaaacatataagtaggatgagatagaagaaaaatcagaaagcagagaaagactaattagaagatagagaaaaaaaggaagaggagtgaaatataatattcatattctagctgccaatccactaacttccaaaaaggaaagtgaatatgccagaccattaaaatatttcagcaacactagcttgtttggcagtcagagtctcagaaccatgagaatcacagttacttaatcactgtgagctcataaaactggacccaaagtgacaagaccattgggtgagaagggtgagagggagctgagcagggtgatctgctccaacaatgcaccagttccagaggtcctctgcagaacttgaagagacagcacagcatcctgaggccgttaacttcctgactcctgcctttgaaatagaaccaggaactgagcttccatggcctagtttgacctggctttgtcactaccccagttctgatgagattatgatctgctaccctagaactaagcagaggtgagagccaagatgcctttctatggcctagagcacaagaagggcccacatagtaacaaaaacactgtcacttttatggattaggcagtattgcctaaaggtttagcacccaaggctttaaagccagactgtcctggttctaaatctgactttgacacctactaactgtttaaccttggttaagttggttaacacagaggctcaggttcctcacctataaaatgaggggaagtacgaggttactctgaatattaaatgagatacacatatataaaactgagtatagtcctagaacatggtgcacacaaggtgacagctgtgccttattacagctactgcacagctgaaaaaaactgtgaaacactgaaagtcactcttctacaagctggatattagactgtgaattccccaggaccagcaaaacccagcattcccaatgcctagctcagtgctgaatgaacaagagagaaaacctcaaaaatctttcagtaatagaaagataattctggacaggtgcagtggctcacacctgtaatgccagcactttgggaggccaaggtgggtggatcacctgagtcgggagtttgagaccagcctggccaacgtggcgaaaccctgtctcttctaaaaatacaaaaaattagccgggcatggttgcgggcacctgtaatcccagctacttgggaggctgaggcaggagaatcgcttgaacccgggggacagaggttgtggtgtgccaagatcgcttcacagcactttagcctgagcgacagagcgagactccatctcaaaaaagaaaaaaaacgaaagaaagaaacataattctaagactaagaccaataatgtgccagctatggtttccttgtcattgaatttattaatataagtaggcagaattatttgttatcatgctaaagaaaaaatgagatttttttttaacggacaaggttttcttaaagcatcatatcagtatctcagtatctcctataaatagattttgtttaaataatacaatttactaaactgtctgagcagtgtggacttcccccatatttatgtttttagtggctgtagctgttgtggtggtcaaacattgagtgttcttttatgaacatagttagcataaaagaaccttttgatgactcgtattagaacatgaatttaatagaagcaaaggtactgcttatcatcactgagaacattcattcagatctaccacagttttataactgctctgatctaacagagcaatttattccaacatgcaatttaaccaataggctgtttaaccttggatacttattagtaagggaacaatgctttcaggattatgctgaataattcagcccttccagtcaaagaacttttgctggtgggtgagaacagcatgttgtctaagtatctgagaacatttctacacatctggagtatgtggccctgtgctgcctttccaggcctgctctcccagccagaacttcttctgccatggggcaagacagtggaatagaactatcttataaacttttttgaacaaagacagatgatgttgcactactacattccctgtgaattctttctgctgctgccaacttatagtatttttaagtttgctcctaggtgttttacagtagaagccattccaaataagattttgctgaaggttcagcatgaactatgcaactactctgagaaataatcccattatttcaactgtttacttttccattataccccatttccaaaatacgtgcttttaaaagttttacatcctctcttcataaatcaagttagtaaggatgtcattcctttttaaagcatgttgcatagaaacattataaaaacaaaatacataaacacacatgtatacgtgcacacaacacacttgctcaacttgaaactgagccccaggactaacaaacacacagtccagggctctggttactatgccttctttctaggatctggcttcatttggaggctcatatcccataccagtgctcctcaaaccacgttctaaggtccatgaaatattaataatagttctatggggagtgggggagtggtataatcaaatttgtggttttgccttaggacaaatctgaatcataagcacataaggctcgtgagaatctctttggtattgagtgaaccctgccaactattcaacattcacatctcattcattgttacatacaaagctcatgaagtgataacatttctttgttttaaaaataaaagagcactgaaaaaagaagtcaattgcttgtggtggtgatgaaagtgaagagaaagtgaaaaggcctaaggaagtgatggttcttggaagaatacagatgtctaggaaagaaattatactccaaagagctacctgtaaatttagaaactcatcattatctctggacaaatctttcataaatgtcaaagacctgctacatatcaaaatggtctaagttcctaagcatcatagaaataaactggacttgactgtggattctacttgagcaaaagatcctatggctgagtcttgggtatgaagagggagaagtttctcacataagcatgggcccatggggcttagactctggaaagacagctccaggggtactgccatacattgatgttggcaggatcttctgtttaaaaggtattggtggccgggcgcagtggctcacgcctgtaatcccagtactttgggaggcaaaggcaggcggatcacttgaggtcaggagtttaagaccagcgtgggaaacatggtgaaatcctgtctctactaaaaatacaaaaaaaaattagccgggcgtggtggcgggcacttgtaatcccagccactcaggaggctgaggcacgagaatcgcttgaacctgggaggcagaggttgcagtcagctgagatagcaccactgcactccagcctgggcaacagagtgagactccatttcaaaaacaaaacgaaacgaaacaaaacaaaactattggtgaaaaacagatattttagttgactggggcttaatgctgagaagtaggcctccaatacaacctgaagatggattcgtggtggtacaagtttgccttctgtgagggtctggaggaagcacttttattaacaggtgccaagtagaactgctgggtcctgaaagaacctacaagacactggggtgagaacacgtagagaagagtccaagtgcactgagaaaagtgaggcgcactgacttcagagaatggatctagtttctttcctgtcagtgaaaactgaagctcactggagttctgagacagcctctggtctcctggtccaccccaggatggctcaatatctgtaatgcagaggctgaatatgtataaatgcagaggcccaatccaagcactcactatgactcaccaaggacactatgaaatgtgaccaaagtcttccagacaaaattgcttttcagtcatgtaaatatccttttaattcatgttcttacttagtttatgtagcttatgtgaaactcgtttgtcactttctaaagatttacttttgtcggactccaggaaggattgtctaacttttccctaaatctcatggtgcttcaaataataggaacttttccctcctctacggttttgatttcccatggaagacagccatttaggaaagttacctgcatgcagatatatgcacagctaaggtaacatggaggtgtgccagtcgagcatatctgaactggccactgtctacctagagtgacaaacaaaatgtagaatcttgcaggatagctcagatcctaccatcttgacaaccaatcacagatctgtcttctatactgggttcaggcaaggcagcatgcttattggcctatatggggcatggattggcccaaaggacctgctttttctgaatttgaaggcactcagttcagggagctacacagatggtggcaaaaggtagccacatcattggttcttgcctctccatcacaatatgtcttagctttttaatagcaagaaacctgtaggtatactaaattggtggaatccaggaaaggaggagggaaaaaagtcaagacaacagcatttaagactgaaaaggggccgggcacagtggctcacgcctataatcccagctctttgggaggccgaggcaggcagatcacctgatgtcaggaatttgagaccagcctggccaccacagtgaaaccccgtctctactaaaaatccaaaaattagctgggtgtggtggcaggcacctgtaatcccagctactcaggtggctgaggcaggagaatcacttgaatctgggagagggagggtgcagtgagccgagatcataccattgcactccagcctgggcaatagagcaggactccgtctcaaaaaaaaagactgaaaaggcaaacttgatgaaaaggaagaaagaagaaactcaaaagcagtcacatctcaaaccttttgtttgaagataatatataccattcatatcacatttcagcccgtaataaggcagtgtagttgagtccattgtaggggccaagggaaaacatcccctttgctctctaaaagtttgttgaaaattaactcacaaaaggcagattaagaggagaaatggcatataaatttattagtgtgcaagggggagaatgcagggatgactgccccatatcccaatggggtacagatgcttatatacactccttcttagaggaatgggagatggggaagtctggatggttttaaggggacagtaaatgatttttaggggaacttaatgaacttaaagtggcctgggacaaagtctgttgggcccacacagcagacaatggtttgtgacaaatgtctgtccagatgtgttgacaggcttcagtgtttctttacatgctatgagctcagttaatggaaattcggggaaggaaccagagataattgttttattctttggtgcatccgaacttgaggcagataagggaacttcagggaacaatttcctcctttgctttgggagagacagaggattgcaaggcaggaggtggagggggtacagtgtcagagagacctaaggctgcttcttcagctcagcatgtcaaagtgccacattttggtgtatcggtttctgagccctgacactatcatgtcacttttcacttatctacacagggcactaagatgcactgcaccggccctcaccatgactcctccctcttgctgcccttctcactccaggctcctaaacacaggccacctatttgatgggatatttcaaacctggctttgattgtgagggtcagtttggcatacaggtgatttccttgtagattaagaacatttactttcttcctgctggatccctcccagagataccatcaaacctctacctacgcaattagttttcacaggtggctgttttgcctccagtaaaactactttctttctccttctgcaagtcaaagcacagcgaatacacacgaaaacatttcagatatgaaataaacatgttcataaaggcagctatgatgtaatgtatcatttttgactgatccaaattatggaatgaactccccacaccaggattaaagtgagaagaatcatttctggaagaaggagcgcaatgggattgtggtgggctgaaggctagaaaaaagggttagaattgagacaaggaaaaggagccacaatttatgctggcttataacggctagggttttctgagatgccttctcctttcgtaaattctgttactgttgacaatcctaacttactagagacagaaccgacagcggagaaagaaaagatgttcatacgcgtcaagagtcactggtaaggcagctgtttgttttttgtttatttgtttgtttgttttttgttgttgttcctgctgcaccagaccagtttcaacatgaaactggcaagttttgagatgtagctgtttctctggtcctttttctagtaaaaggctcccattttagaggcagccatttccaaaggaaaaaaaaattcaatgtcgacataaatcccttgaactaaacatctgtttaaactgtttctaggtcaggagtctaaaactgtgaaacactaggggtgcagacatgatttctttcccaaggtctccaagtactgcggcatgcacatatcctgccatattgtttaaacatctggctcacttccccctaaaagaaaagggctgatagggtgggttgttatggctttttgtcttaacctataacatgattttgttatttgtacagtctctaaaacaaactactgttaaacaaggttttttttttcccttactgcattatttaaaggtggatgtttcaatggcatttgaatagcatgaggggattttttttttttcataaaagctacgaactcaaggatgttcatgaagaaatagtttccttcagttcttccctatgaagaaaaactcttccagaagttccactttcaacattccccttcattaacaaaaccaagtacgtactcttgtttttaaaagtctgtttccatacccgtatttacctgtggaaaaagactgtgttcaaaatattaaaacataaacttattttaaaaagatgcgaagtggagagagttcaagtgcagctttcccaaaagcctggctcaaaccctgtatacatatggaattctgcactgcgacctcagaaggatctgagtggctatacacaggtttgccatctagattcttcacctttactactcaaaatcacccaaataatttgtgtgtgcatctgtgacgaagaacagttatgagcctacattatcaaattcagaattggagtttagggatagcaaaacgaaaactgagctgcagacaaataaagtggcccattcaataaaagtgaaagtatatggcgtaatccgtgaaacccaaatatcagggtttgtcctctgcatctggcagttacttatcctcctcgtacaaactattactgctcctgtgttatgtccatgtctctcctaaaacttgctggaggcaaaaaagcaaccctgaaaaagttcccagtttaagtgagaaagagtgatttcactgacagggcagaacaattgcccatggttgtcaaatataataaaaggattagagttttgttttgatttattttaatgtacaaaggaagaaaggagacaaacttcaaaggttttgcctctagcccagacttctggcctcagggaaacaaatttcctagtgaatattacagaaatatagaaacgactatttaaaattgaccaaaaaaaaaaagcaaatagatatccctactaagactagatacgtatttcaaaagtccaattttatttttccttcctctctgttactaagagaggtggttcaatatccactcctggccttacttcacctgcccagtcaacaaccattcttttccccatggaaggttatttctatatttaggtcatttgttttttaattcaaaagtacgtgcccaataaataatgttctaggaataaagaaactgactaaaggaagatactattataaaaatagaaaccaaaggaacccctactctctgtgcatttaagagcatttaggtgagaaaaagacatattactgtggtttctttaggaaagtaaaaacactcaatgatgaatttttatctatctgaggattacccagattacagtaagacaaaactttgcattaaccattcaaagggtccgatctgctatatgtcccctacaatattaagtacatacttctttcctggatctgttcttattttcaacagactctatttctagaatgtagaggagaaaaggatttcaaacagtctggaaaatatcatttttaagttccaatcagagaacgttaaagccaataaggaacttgaaaggaaatctgggctatcccccaacctaaggcaaagccacactgatagcaacccaagcagataataatctaatctaactttaggataagttaggttccgtgacttccctcttaacatgttcctgtgcctgacacccgtctactcatgaaatttcttttcaagctgcagcctaagcacattcagttattatcaacagtgttaagtgagtagaaagagattcaggggacaacatgagacgctctgcaagatcagtcatgagaacaaacccaaagacctactggacccgaatttattgatctgggaaaggtatatctaggtctcagcaatgttctttggatcaggatttggagaaaaggttgtatctaccactatagattggatattatatcctatttgcaactaggactatctatctctctataaatgatgaacagtattcagctacaacggaggtgttacagactgaatgtttatgtccccccaaaattcacatgttgaagcccaaccccaatgtaggcagaacagggccttcatatttggagataaagcctttacggaggtaattaagattacgtgacatcataagggtggggccctaatatgacagaactagtgtccttatcagaagagacaccggagagcttgcttgctccgtctctgccatgtgagaacacaatgagaaggctgccatctataagccaagagaagaagcttcagaataaaatctaccttgccagtgccttgatcttggccttcccagcctccagtgaggaaataaatttctgttgtttaagcaacacagtctatagtattttgttatggcagcccaagttgactaccatgaacaccaatatgttgaccaccatatccctctctctgagacagcattcctctcccttctaggatgaattcagttattcacttaacaaacatgtattgagcatcacctatgcatcaagcattgagctacatgctagagacacatttttcaatgagtttgcagtgtagtggagagaaagagttcatttagcaataagcaattctagcattctgtaatcagtcttatgttagggaagtagaaagtactacaagagtccatagggggaacagccagcttcaacaaggggagatcaacttactgcaataccaaatgtctcagatgggccctgaagaatgaatcagaactaattagctgaaggatgggatggtcaggcaaagggagaggatgtttggtgtgatgacagtaaaaaggtcctgagggctgaaagatgtgggttcctctcccgtactcactcactgtagacctctctcaagggtccatctgtagccctcagattccctcaagaagcaatcccttccttgacagctccactggcttctaagtcttcaataacacccaaatctgcattcctaattataaccattcccttatgctcaaacactctttttaattgactactagctattgcagcagggcatgtgatctatggcttatttaaaatccaagtcttagccaattgtggtgactcgcacctgtaatcccagcactttcagaggctaaggcaagagggtcgcttgagtccaggagctcaagaccagcctgtgcaacatagtgagacccccatttctagaaaaaaaaaatttttaaatagcagggtattgtgtcccatgcctgtgattccagctactcaggaggctgaggcaggaggatttcacgagccagggaggtggaggctgcaaggagccacggtcttgtctctgtactccagcctagacaatagagcaagaccttgtctcaaaaaaaaaacaataaaataaagtaaaacccaagtcttcatgcttccctcggatctcctcttcctcttatatgccccatttttgtggcccatctcagcattgattcagtgatgcagtcatcttcccctcctccctctcccttaccctctacatctatcatcaccaagttctttttcctcaatatctccagaatctatccattcctgttgtttctgttctcggtcagatcctaagcaccaaatctgaagaatgatttttattgatttattattacaaataatgacttaatactttaattaatcaaaagtttcaataatccactaatataaaacaaaatgcaaaatccaagagatgaaagcagacaggcagtagaaaattcacagaatcagaactggggaaaacagacaaatgaaaacaaattttgggctgtgagctttctagcatacagggaaaagaagaaaactagattgcatacacagttctcatcataagatgaaaagaggcatgccaacttatcagaaaaagaaaatttgtttcctggaagggatttttcagagaaatatattgcaggggagttgaataagggacactgaacacataataggaaaaaggtagttttatacaaaagcaaagatctgcatatggatcttttacatataaaatatttttaaatatttaattcacggtgaagccaacctaaggttaaatcatgattccacaaaagtagtctatagaggaatacagcaaaatgcttcttatagatagctttctgataattatgaaaggttaacctgtccctgaggttatctcaataaatgcaaatggctcaaagggccttttaaccaaagctatattcataactgacgtcacaaatgagtactgaaagtactaggaaactgggttaattctcatcttttcctatttcatttcctcagaaagactttcccaaaagaccttagccaacaaagacccccataccccattttcactttaatctatgtattatctatgaccctattagttttctcatagcatttaacacaatcggaaatgacttgcttataaatttgttgaattgatttgttgttccctgtgaatagacagtgagccccctgagggcagagaccatgtctgtcttgtacgctactgtatccaaagccattaggaacatcggtggtatgacaggtgctcatttaaaactttacaacctttcaaatgaataaatacgtagcctgttttaggttctaaatattcagggctgggcgcagtggctcacgcctgtaatcccagcactttgggaggccaaggtgggaagatcacctgaggtcaggagttcaagaccagcctggccaacatggtgaaaccccatctctacaaaaatacaaaaatgtgcccggcatgatggcgggtgcctgtaatcccagctgatactcaggaggctgagacatgagactcacttgaacctgggaggtggaggttgcagtgagccaagatcacgcctggccgacatagcaagattccatctcaaaaaaaaaaaaaaaattatatactgtacccaaaaaatatggagaagacaaagataatattttacatgaaaatttaaaagcctggcttaaaacgacctcctcccttcactccattttcttccttcattccatcctccactttgctgtcagaattgtcttctaaaggaccacctaaatataacagcttgaaagcttgatgatctaccctctggaaactctctaatgtggcatttgaagccctcagcaaccctactctttcagcctagtctcttacaactctcctccacttcgcctacacaggctaaagtctagtcaccctcccctgatggttcatgacccccaactaccaacatgctttccccatccccaatgacttaccttttcttgtgctgtttcctgcctccaggacccccatgcctcacatcctcgtctaacaaaacggtgctcatctttcaagctcatttcttgagtcatgagaaccttctttggattcttgtgaattctgaattgcctcctctgtactccaatagctctttttatgtatctgtgtggcattgtctactatctgtttcatatgaattaggtgcttagttttatgtttctgtttccactgctagattagattagaaactccttgagaacagggattacttcattggtcttcatatttctctaacctttagcatgctcctagacatgtagtaagcacaaaacaaatgttcactgaattagacatacccaaaattagaagtactaaagagatattgatggtgacggctttgggtttcaattgtaaacagttgaagacctaggtacagtacaaccatttattaaattacagatagtatcaatctccacttaccactaactgtgccttattagcaattgtttcatgtagtccttgtttcaggaaacttatttatgttctagtacatatgagtaaatatacattttaaactttttttttttactaacagtggctcatgttacgaggtcctctactatattaaaaacattttaatagactttgtccacagactgaacttttactttttaatgtgatatcacatataataccacatctcattctctacagattctgaaatgattcagggacttttaaatcagcatttgccaataaaaagacaaatttttcaaattctgcatcatatgtaaaactagctctttttcctttcctttttttaacattacagaagacctaaaaccttatatttgatgaaggttctaagtacaaggatcaaactataatcgtgtcatttcttcaatactttcagtactgctccccgaccaggatttagtttgccaaattacgacatcattttcaaagtgctactaatcaacagagagggcaatgaatgaattcacccatatacatctgtcaggctattgagcgataaagcatggtattgagacatatgtgttcttaccatctgcacacattacagcaatgcactgcacacatatatgtctgaacctaatgttacacgtgaaaaagaaaagcattcatgccaaccctcagtacaattcacatcacatcagttctacaattggtggctttatgttactctacatatacctatatgtcccgatttttttttcttgtgaaaaatgattaagacacagaatcagatatactctttaggagattagcttcaatcttatgctaacaaaatcgcagtcaccctcaaatggagttatggcaagcaaatttgctttctcagaactcataatttttactttactcctctgaaaactacagagcggcaaggaagttgaactgaataaaaacaaaatggcaagctatatatattgattaattttacattatatattttggaagggcaaattcattatttatacaggtgctacctgacctccatccagcaagttattcattttaacctattaacaagcacactataaacaacaatgaaagttacatgaccttacacagctgtctcaagccactgtacttccatcattaaggaaactgttagatgaccctgttgtcagaacacactaaatctgtctgaataagggaaaacaaaactttgtctccaaagggtaaaaaataataataataatcctaggcagagttcctgttcacactgtacagttactattattatttatcatttcttatttacctgtgtttttagtataaacattcctggaagcttttatactgcttgtggcacatagtcagttgcttattgccaagggaaagactttttccccagaaaggcaatctgtgcacatgctaatttgaaagacagggtaggagctgcaagtgttttaatagcccattatcaaaaattatcccttggctataaaatccccagaccattggcttgagatcagctcaaagaaaaatgagattacagaatttaatctagtgaaggggagtgagagatgagttctaaaaagccttagatcacaaaaaaaaaaaaaaaaaaaaaaaaaaaaggcagaggacagaaacaacatcagcttagattaaaccttccacacatttacctcctacaaatctgacatgttccaagactgattttaattttaaaaagtaaggtgtctctttgcaacattttaataagtagggaatgctcagtgaaaaattacatattgaggtgacaggaaacaaaacagcattttgtcttaaatttgcacaacctaatttatagcaataaagcagaacctatgagttctggtaaatgtcagggcagtcatgtccattacatatgtggataggtatgaagctgagtctccgtaggcccttcaaaaattgcacacagccgccctaatgcaaaccagaagtctcaggctgctggatgaacactcagattcgctcccatgtggatatttagagagggtctcctccacccccatccccattctcacgtatgcatgttttaagagaccaaccagaggccataaccatggaggtggctcattagaagagacctcccaccccaacaaaatctggcccaaccccctgcaaagaaagcaccagcgtcccatagaacctccccctctccccctaacctctactctcttacttctcctcccccttctcctcctccctccccacacccctccccatgagcatctgcctggcccaatctcgcctgggccagctccaataacaacatctgcttggcagcttttcaagcccacggatagttatctaactgaggcttttgtgctgtactgtttattctatgtgaagaaatgcctccttagttgaaagagtactttagaaaaactgtgcagctattagcaagtgaagcacaaggctaataacccccacctgctcatcaaattaattatgacatctgagtcattataactcagaaagaaaacacgactgcagatttgtcacatgtaggaataaacatgtattaggaccgggaaaaaaatcagaccaagagactcagctggacgaaacacatgcttccacctttcagagactggaaatatggatcctatctttccaagtgaaactgacgaagagggatgaggtggttggccagataaccacactgctgttacatggagcaaaatgagataaagtcagggattagggaacctcatggaaaacactgtaaggttgaataataatttatttagaaaaactaaaactctatacaaagccatttcacagagcaaaacaaaacatactgcccacaatgaacgtgaccctgtgtcatctggtccatcttaaaaacactcataagaactctgggtagagaatttttgtccctaggtacaaaagaatattttaagggtgctaataactttagcaaagaaataccttagaagtaaaaataaaaacttgtcatgaagttattgcatttcctaaccatgagtgcataagactagtatttttaaaaggcaaattccatccagtggccattaaaaaattacatttaatagtcagacatgtaacagtatatctcgtgatcagtaacattttgctaatatttcatactattaaaaggcgcaagtttccattatacgttttgaacaaacttaaaatagctactaacctcttttttcccccacatatttctggaacttgcaactatagcatacatgttaaaatatcttactcccaatttttcaatctggctttttgtcgtaattttaaaatgcaagtaaattttaataaaggtaaaattattttaaatagaacatgacttaataggatgatgacccatgcaatagagccatgacatttttccttgccattattttaaaggaaataaattataacatgatatttgcatgaatcataaaatgctatcatttaaaaacactcctactgaaaatgtttgcagctataaatttaaagcctcttcatcttcctgcaatatctttagtattaaaagaactttttaaattcttttctagcatttgtgctgccagtttcataaaacataaatccttctatgaaagcatatgactcttgctaaataacatcggcctgctccactttatcttctacctccaggaaagtcatccacagtagcaacagctataatcaattctcgcaaaaaaaaaaaaaaaaaaaaaaaaaaattctatctttttataaaagcaaaacccccagaagagttaattttaaaacagaacatgctacatttttaaatcctttgaggtttaatatattatgaaagcaaatctcaggaagcaatacaattagtcttttctctcggtaaacaattttgtgttagagtctaatgctgagttgatttatgtaaatgtgttacttagcctcaacttaagatataaatccagagtaaacataacaatggcaatcccgacagtctgctttgccaaatcagaagatttagtcagcctagactaaaaatgaattaagattatattgagagtgtcagtcctaagtcaagaaaacatgcccagccagggcacgccagggagaaagaagatcactcattaacgagccagcaatgctacaaagcttttgctcgtctgggaaaacatgttcccagttttaaactccacagcaaatcaaggcactctttttaataagtacattttccgtctctttccccctcatcaatcccaaaaagaaactcagcttctctgtgtattatctgtgtaactctacatgtcaaactacaataggccttgtatcctttaaggtaacatgggccagtgtctgaggtggagtggaagactcggggctgtggggagttaatgcctcccttctcaaaataactttcaagttgtctattaacaactagttcccataattacatattaaatttctttaccatgataggttacagttatacatcccaaataaatctgactgtggagtacctgccggcagatttctgtctctgtttccccagacacattgacacacagctcagagacaagctggtcaggcacgctacacagaggtccgtctgtcctcgcctaaaaagtaaataaattattttgtgaaaaatatccttagcaaggatcagtattattgtcagtgtgactttaaaattctaaaggcatgccagaaagagggctacataaaattcagcagtttccagatcatacacagtacagagattctcatacccacttaatctcagcacgcatctccacccctacttccttcccaatggtatgtggtcttgaaaacacaaatgttcacgtttcctgaagctgagctgcaaaggaaaagtctcctcccaagaggcagagctgtaggcttttggtgcccccgaaattgttcactacagtacaacataatgtgacactcaccacaattagccacagggaaacagtctttttttcacctctgatgtcatataatagatttgagatcacatcagtgagcaatgttatctacaagtatttttggaagtcttgttaaaagagccacgatactgcaagcctaacttgaagtgtaaatggtgaatgcttctctatatctcatcttgaccactactttactgaagagtgaaaaatgacagatgcaaattatttttcagaaagtagacatttccactggtagttcttcctcctaagtgatcttttcttctctctcatgctctaccccctttctctctctagcattcttcctccctacacacacacacacacacacacacacacacacacacacacgaagacatccattaatattaagaacagtcttccgtaatgtttttcagaatttctcaggggcttaggagggcggcagccgtgccaaaattacaagctttcctctagtcagaagggatgtcttttcaaagcccagccctcatttttcagtctgatgtaagtaaatttacctctgtgtgctgggctgagcagcttttctttgtcgtttttgtttttctaatagctgctgctctggcagagctattcatttcaaagggaagttagaagcattcttcactcttccccttttagattatttgcagttactgactcttctgaaatcttagatttgaacagaaacctaaagcacagcaccattttaaaacagcaaatcaccagcattcctgggatcacatttctctagagcaactatccaacatgaggcacaagaactaagtcgaactgggctaaaattgacaaaattaaagacaaaagaattatctcttttaaaaattggggcctactgtgctctgacagcatgctaaaggacaaccatcgtttggaaacattgtttcagaaccagagaagaggtggtggagttctgtttgccagttagctaaattaactgatttcttaagaaatccaagtgaactgtatagtaaggtggtcaatttttggaaacattgtttaggcaacagataagagatagtgaggttttgttttgaagttaatttacttcatgagaaagtcaaatcaacagtcatagaccatgaagctgataagatctatgataaaatccagtgggcgaactatcagtaagttcttaatttgcccacgtcccagtgtattcaacgggcttcagttggcaatggctggaccttgctcttgttacttctgaagggagttgttttacgtggacaaggccaggatcatggtctctgagtgctccaaggggttaacctctgtgaattctacttctgtgtcacatatttaaatgagtaacttagagttcaatatctttgtgttcaactaaagtcaacttcttctttatcagccaacattctcttactctaatcgttgaacacacttgaattcatatcagttctgggattttcgtaaccatcaatcataaagtcatagtaagaagaagaataaagcgatatcagtgcagttgaggcaaacagggaagaaaaagtgcacggcgccatggttaggatatcatgccaggctaggaagactctcattaacatctcctgagtcatcccattcacaagcagtatccttgaagaatgatatctgtgtatataagtgaaaaccctatcacacccaggggcttatatccttggcatcttaatttcctagttgtgagtacttatctaaaaggacatgagtataatgctatcctatatggcatactaagaaactgatgtaaaactaagtctgcaggagaaaagagatgctacattcctgtggcaattttcaaatggcactaaaaatagataaatacggcagtaagaactaagtccctcctccctcacttccctatctctatttttcttttacatttgtgtgaattcagtaaccataatctatctaatcctattatgccaaaagactaaaagttgttgatgttcaaaactctaccagtataccaaaaactctgaaactaggaaggaaaaaaaaaaaactttcttacccttaaccaaaaatgaagagtctctcaagcatatatggatagcttgacaaattaccaatttatactgaaatatgagaagatgttcactaagaattacatgactagatactgcaggggttttttgttttgtcttgtcaagcaaaaaaggtctaggtttgccatactccattttttggtatgaggtggtgaatcaagcacaaattttctttggacttaaaacatttaaaatgcagtggaaaaacagttggggaaaagatactgttcttaatccccagatctagactatctgttggggtagttgcttcccaatcctattttctcaattgtaaaatggaaacaatatcttatccaattgaaataaatattaaataagatactttaaacaaaagataaaggtgctttacaatttacaagtatgaggtataacttaaacagctaactggaagacattaacataatctacatagaatgaccttcagagcaatatggtttgcaatttaaggaatgaaaggaagataaattgtaatacaaatgtacctttctcagagaaggctgaaaggtacaacgccaaaggcattatctgcggactcaggcttcagattacctttgccacttcctacatgtgaaatactgggtaacttattgtaaaattctgtgagctctaattttctcatctttagatgagtaataataatatctatcttgtgaaggttcctgcaatatttaaataaaatactacacatagaagtatctgactttaaaaataatattcatgcgagggaaagctgatcacacgaaaggtttcttagggactgtttgccttccatatctgtcttattaatatagcttcatgcagtcacctaaatatcttcaagtattgtaaactgaattcagattatgtgcttttttaaaaagtacatcttttctatatcaagcagaaatcaggccacaaaaaaatacttctgtaaaaagcttaggaaagaataatttttcaattcaggaaatttcttcatggtgctacgaagaacttttcttgtactgaactgctatttgtgatccacctgttaaaaaaagctcaaaacacatttcaaaaacaaatagaatgcttaaactttcttaaaagacagaatgttttacatgttgtattttgaggagattttttttaaataacaagtttttacttactcatctttaaaataaaagagaaagtaactgcccaagaaacagccttatcttttgctttctacaattcagaattttgaaagaaatcctcaaatcctccaaacaagtgtaatacacatggtttgctggcagaatttattccaagcatctccaggcaatatgcatgtgcacccgcgcacacacgtgcacgcacacacagacacacacacacacacacacacacatttttgaatcattaagtcatttggaagaatctccagaagtgtgccgaggcatgtttttggtgttttgccaaattatgtgcttctgtttgtggctttcaaatatggattagacagacgcacaagcatgtactgtttggcaagtagcgacaatggtctagtctgaatttagtaatttaagcttttcattagtcctcgtaggtgaaagaaagaattaacaacaacttgtttgagctctatctttatatccctttgtcatccattcctgttcacttgccatagattagaagccaaaggaatttcagatgtcctctgcagatagacctaaagtaagggcttcaaacagggggttcaaatgtcaagtacatttaagctggaacttgaacttttactcatccttactctaaggctataactctgcttttctgagttccccattgtacttgaacatccagtgtaccctccttttttctcacaaaaagtacagatagaaattacctaaagagataaaaggtcacttgagatttctgtttctcgtgacttgaaattaccatgcacaacagtagacttctacatggcaaagcgctcacaaagatgtttctgtctcctgtgatgatctctgggggaagctatgtccctgccaccctgcctcatgctgtagtcactctaaacttcagagaccagcatcttacgaccatgagttttggtgctaagttcagaaaaattaatcctaaactgtcacaaccatcctgatgaccagtatgtctttctaattagaatcaatgcagtaatcattataattggcagtccctccccagatcacgtggagaacaccatgggaagtgcagttgacttgcagtatttgatattttcttctgttggtaggtaaaagtaatctgatgtccaacagaaaagttcacaggaaccatgaggtaaaaaggaccaaatgttgacagtggtccattgttaattgagtcgtgcgaagctacagaaagattagtttatacagctgctgttatttgtcataacattcctaacaagatacacatgttcaatcagtcttattttgcacctccaaaactgggccatccaatggtctgaaacatgtggaaatcaaaagcaacagtgtacagaaggaagaccatgtatcccctcaggctgcctcaatggctgaggaaagaaaagaggcgagcccctgagtgagcggagcctagaatgtttgggtttggaggttagtgagtaaaacatgaacaatgaatgtgggcgggaagctgggacagaaccctgttagggtcattactaaggtataatgttattgactgttttgtggggaatttagacttttaaccccaccatgattcagaagcagtgactttcttgggacaaactgaaaaacgaactgggggaaaataattccagtcagagcacaaagctaaccatgtcacttgtccactgtattttccagcagtagaacttcacgctacttataaactacaggcatactgaggggaaaaaaatgtgttaactaactttaggaaactttcactcaaacacctaagctgaaagtccacaataggttcaatacaaaaacattatcagtactatctataaaacaggtgttaaaaataaggtgtttcttatcctcaggaatttttcattttagtgaggtagggagaaaaatatatgcatacacacacagagagagagacggacacagagagagtgtgcctacaattcacaaagccctttcacacacgttatcaaaatttatcctcaggagtgattgttaacaatgccatcattatacagacggcaaaaccgaagcacaagtcccagtcactggtaatggaaccaaaaatggaagccccgtcttcccatcatatcccctaccttttctacgataataagaggatattacatctactaatcactatgatgaaaaaagtacatcatgcctggaaactgaatcctgttttcaacactgataactagattctccaagttgtatccccttcccactactttcacacaaacattttacctaagacttgaccacctgagattgagaccttattaaatcctcatcaaaaagggaaattaaggctaacagtgatcagactgctccatagagaaggcaggtcaaaaggtacgacttcaaagaaagaccctcaaggcaacagagatcgatataatttacttcagacaataaaacataaatctaatttgaaggatgttgctcatctacaactcaaagcacctaagatattttccaggatggatatttatgggccacaacatgtactgctgctagtctgtatttgctccttctgcacactcctttcacactcttcatctctggttccttatcttattatgaactggttgaagaggccatctcagacctcaatagaaggtacacttaccataaagctcccaaatgtaaacaatggtcctgtaataatgatgtgaactcagaaggtaagaatgatgtttagattccttttgcatatttctcatctaaaacaattttccttccctcacatctttcgtgctttgattaaagcaccaaaacacaatgacaacacaaccagcgggattgctctgatagcagctgaagtgcccattccaatcgtattaacttgatccaagatggtacttcaaaatgacacactttggaaatgacaggtagaatccaggattttatttcccaggaagaggaattaatctgagtcctgtatatctagtttagtacaaagtctgctaaggaggttagtcctatcctggatcagcctcactaagccagcttaggggctgatctaaaataatagtttaacaaaatgcctgtgtccaaaggctgattccaccacttgctagttgtgtgaccctgggcataatttttctgttctttcgttccctcacatgtacaaaggagatactaatagatcttgcctcatggggctgatgtaaggaatagatgaaaatacgcacacacacacacattcaagtgtttaaaagagtatctacattcaccacccccttcaagcctttacttaaatgttgccttaccaaggaggacctatcctaatcattttttaaatacctcaatcttctctaaccctacactcacactttacttattttaaaactagattagaggcagtattttctatcagattagtgctcctgtggtcagtattcaatttataacacaccttaaaagaataaggcaattcattgactagtcttctcctgtaacaagtagctcccagggaattccacttccacaggagacaacgttaggcaaggggggactcaggatgacagctcagtgtgggtgcataggaggtgtctgtggttccttggaggatgcacctattttgtaaataatgaaatttactattttacgagtagtaaaatagggaaaagaatcctcaggtatagaaggtggccagggagactacagaccgaactgataactggtttccttggaggaagactaggattcttttatatgttatatagttgtgatcatttaaaaaataagactttcttataattttctggagattcattaaactacaatacttcatatgcaaaggcaattatggcaatacataagttacatagctctttgtgccacaatatgtacggtgagccaaaatgggatattatatttttctagaaaaatcatttttaccctctcaaatggttgtgagagcagcaaaaataaaaacctaaaatctgtattgtggttgctaacttgaaccatgccaatgaacattcaaaagattaatcaaaggcttgacagttgttaacagttcaacatggttcccataattatccaattaaacatataatgcaaataatagaagtcttatgggttccatagagcatgaatatcaggctgcttcagaaaactattaactgtaatgtactgtctgctgagtctgaagaaagtgaaaggagaactagtacatttataaaggaaggcaaggagtagaaaaatagagtggagagacacgtaactcaagcactctttatgtggtcatataaacacaacagacagtggtaaaatccagaaaacaaaatttaagtaacaattattgtaaaaccaaaagaatgtagagaaatgactttaccctataattcctactggctgcactatatccacagcatacttcaaccacacttttctagcttgctgctaagttagaaacatggatgtaattacagttgttggcttttgactctgtctataaaccatgcagagataaactgctattagtgaacataccaactccatatagttgtgttttgacattataggtaaaaacaatgagaaggaaaactaaccacagcaattataaacagcatgctccagggcatgtcaggtcacttatgaccttgactaaatgattataatccttaggttgtgttctcacacgttcacatgcacacacacacacgtgcacaccccacacgtgttttttttagggaaattaattcagtgaacataagaatgactaaatcccatatttataaatgcccagaggaacaaaaaatggatgctgcataggtcaaatatctgtactttaaaaaatcttattatatttcaaaaaaccaatgtaaactttaaaggaaaaactttgtggtaagtgttcattctaaaaatattctattccacagctctgtctactcagggggcaagaagaattgcagaaatttgattcagtacaaaaacttctgctactatataaattggatttaagttacattatttggagggcaatttttaaatatttaaaccattcccttacactgataacattttttcagtaaccattcaactatttacctcattttatttgctacagacagaaatgctgcattcatttctttttgtaaaagtcagtcttctcctcccctactaaagtggtaacaagcaatatcaagagggcaataaatatcccataaatattattaaagcatgatgttctcagataaaaaatcgtattgtgtttaatgacttttcttctaatatacaaaattatttgtacaatcagtaacagtagagatgtgaaaattaaaataatgttatattacacatggtggaccactttgcaaaagtccaaattacaagtgatgtgactttctaatgtgattactcacagaaatggcagttgataaacatagtctttagagtgtgctaaggtcattaaaacagtctcatctatttgcgtatttcttcaaagtgtacttttttaatgtgcctttcttatttggtcttcttaacaatctgatcaggaaggcaagagtagttgtcctttttacagatcaggaaacaggttcctgaaggagggcgactttcccaaagctaccagactaatgagtttctgaattaggccgcacagccaggtgagctcctcatgcagggcttcagacctgaacacctgggttcaaatacttgttcctccttttaaccactgttgtatgaacttcggtcatgactggctctctctttgtctgagaactttactttccatgattataatagcttccacataagttagttgtgagaattaaataaaacatgctatgtgatgcccttaacacagtcccaggcacatagtaagtgcttaataaatattagatgttgcggctgttgttactgttactatcatcttagaactactctggctaagtttggcaaggttaaaggattaaataaataaccacataaatatcaaatccagagattaacatttagcaaacattttagtgcacatttttaaagagattaacatttagcacacattttaaaagaaaacgaactgacataactgggtatcactgtgactccggactaggggctcttggggaatgactcgcatcagccattcttaaaggttttctagcaaaacgcttgtgtatttgtatcattgcaccactcactggacacaggttgaaggaatttagattgagaaaaactatgcaaatcaaaactgtggtaaaatgcaagcatactagtgtctgtatccactttatcttggggatcaaagttcctctgttttaactgccacattccatcctggacctaatagtttctgtgtaactaactggcaagtctagcatcttgactgaaagttcacagttaagggctctgacataatgtccttgaggacaatggactcctctttcagggcaagagcagtcctgatcatgctcagggctgcatgaactcaagttgatttggcctgagccatcactgctctttttaaaggaaatgaaatcagaagagaaaaatatccatattcacgttagggagcaaatatataaagtcagtatgtttaaatgttgtgcgttggcatccaggaacactcaagaaagctctgttgcttgtagctcactgagggacagaggaacagtgtctgtaggacaaacagatgcacatctaagcaagtagaaagaagaaacatttacagtagacaggaaaagacaaaccatacaattatttctttgtctaggtaggtaggtaggactacactgagatctcatgagagttctctaactctgcttcatacacacattattataaaatgtagcttataacccttggagatgcagagaagacccttttttaaaaaatagttttactggagaagtagtgggagtgaagctgggaatatgagctgggaaggggcagtcatgggttgaattctgactctgcctcttactagctttcggattggagagttattcaagatatttaacctcaatttctttatctattatttgatgagaatacctagttccctgggtaactgtaatcattataataaataattaatggggggaatgggacattttgttgtttttactattactaatattgctaccaattaatactaacataattataaaacagtaataataaggaggattgctgtctttcagaagagaaagggaagtcatttctggatctttccatacatcttctttctcactaagattcatagccttatctaagaagaaaatcaatctttgaaaccaaaaaaatgaatgtaatgtataggaataaggggtggcggaatttttgtcctgcaaacttatgatgatttacaaacctcataaactcttatctaaataatccacaaagtgagcactcaaaattcaaaagtttttgaattaaaaatggactctgtttagaaagatgcaaccaaaaaacttatggaaactaaaatatacgttctttgttcatctatttccttcagaaaactttcataacagaaagagcccagagtccatttactcaagtgtacatagatattttatttgaaaaatatcccaacttttcaaatcaataagaaaaacagaagaaaaatttattctaagacttctaaggaaaaccattaatctagcatagggtgagtgggatagggaagatctttatcataagtcaacaatgaagaccatgatacctattcttgaacagttggattcctaagtatggctcttgacttgcttaatcctctctttaaggacattttatttgccctatgtagcctttgtggactgcacaataaacacatccaatttcaaggtctcctacataagcagcatagagcaagagaaaacaaaaaatgagaaagactgcttagtttaaaagatttgcttggaaatcactaagattttgtatatcaaaattaataaaactgaaagcagtaactcataaattaaagataaaacaaatgattctttccaattttcttttcttgagacagagtcttgcactgacacccaggctggagcacaagggtgcaatctcagctcactgcaacctccacctcccaggttcaagcgattctcctgcctcagcctcctgagtagctgggattataggtgcacaccaccacacctggctaatttttgtatttttagtagagacagggtttcaccatgtcggccaggctggtcccgaactcctgacctcaggtaatcccccacctcggcctcccaaagtgctgggattacaggcgtgagccatcgcgcccagtcctatttcaattctttttagtgtgtcaataagtgaaatgagttttttttaatatgtagaggttatttcagactatataatattttcttttgtctcttttaccctactggggccagaggaagttcattatctagaattacagttaagaaagaagtccagcgataactgcatggatcaaaattctgactctgtcacttaactagcttgccctcagagttctcatttgtgaaagggcagtaaagtatctacctcatatggttaccagggaataaaggagtcaaacaggtgactttgcaaacaatacctggcgcatagtaaatgctcactaaatgttagctaaatggcaatggtcacatgtggaaaagcaccacagctagaaaatcctacccaccttaagtgggtatcacttaagcatcaggtcactatgtaaagccttaacttgtaagattggtattatctccattttacacaagaagaaatggagcctctgggacttcaaaacacttgctgaaagttatacagttaaaaaatggcaaaaacaagattttagatagtactcctgatttccaactttttgactatttccagggctccttctagcaagttccaacgccatgcacacctagtcaccgccccttgatgatgggacaccaccagactgacatgttcactgcaaaacctgcaacaagtctgctgacatctgaggaattggagaaattattgggtgtaccccaatgccacattctattattctttaatttgttccattaagtgcaatcatcttcaggaagcctaacacatactcactattcctccaagtttcattacagttcttgcttactcacttttgaatgggagggtgctagggccactcagaacccaatgcaattgctccagttaggagcagcgcagagtccagaaatacatcctgacacatttccaacctcctgcaaaaaaagctacatgctacaagatgtcataacaagcatgcttgtatgcttgttatgtataactaccatgtacacactacaaaaatattttttgtcatacagagaaaattatacttgttcatcacaataatccattctcatgatctcactattttctcagaagttgtcacaagttttcatgtcatttctttcagatgatgtttgtataatcactaccattactctttttataacttattaagcacttaatgggaacacttaagaaaaaagaacaacaaaaattgggtaattcttcttaaactgtctctcactactataaaatctgtaaaatgtctgtcttctctatattgcaattttaggacctggcagagtgcctgatacatagtaggtgctcagtgaatagttgttgaatgaataagccgcttcactgcagacagaatggcttttaaatgccatcataaaggggcaaactgagaaagatttctttttaaatgtcagtgttcataatctccctacatgtgcacaacataatcaacactgaactaaagaatcaacaaaacccactgtatatcaccttataagagaacaaggggaagagaagtatgaaaataagaaaacctgatcactgtcatctaagaactttcattcactttttatttgcctgaggagatggggaagtacagaggaactgagaatttcacaaactaggttcaaatctatctttgggtatatgatttgtaaccttaaaagattgaaagctactttaaaagagctattataggccgggcgcggtggctcacacctgtaatcccagcactctgggaggccgaggcgggcggatcacgaggtcaggagatcgagaccatcctggctaacacggtgaaaccccgtctctactaaaaatacaaaaaattagctgggcgtggtggcgggcacctgtagtcccagctactagggaggctgaggcaggagaatggtgtgaacccgggaggcggcttgcagtgagctgagatcacgccactgcactccagcctgggtgacagaccgagactccgtcaaaaaaaaaaaattgagacggagttctgctctcgttgctcaggccgcagcgcaatggcgcgatctcggctcactgcaacctctgcctcccgggttcaaacgatcttctgcctcagcttcccgagtagctgggattacaggtgcgcaccaccaggcccggctaattttttgtattttttagtagagacggggtttcaccatggccaggctggtcttgaactactgacctcgtgatccgcctgcctcagcctcccacagtgctgggattacaggcatgagccactgcgcccggcccacagttttcattttacacttttttctgcaattacctatgaggaaacacctatattctggaagaggcatcatttacagagaacaaaatatttaaagctgggtgttattttattgttgggtgtgtcactagatcagcccattgcttttagcagcaaaaaagtataaatttgcatcaggtcagatattttagtctgacaataaaacatacctcatcaaacaaaaaccattttttcttctgctgagttcaacagccacgcttgatttttaaaataataatgatagtcatgtaaactggatgcaaaactcaactcagctaacttaagaatatttttaaatacagtatatttgcagaatattttgctttctagattttttaattgcctatagaattatcttctcaattccaaaatatcttaaaacaaattattgacacatgacaaatatatattgacaattttgattcaagattatataacataaacaattgaaataccagaattagttttaaaagatactttacgaaacattttaagacaatgtgtataggacatacactgaaatctaagagctaaactatatttaagaataatttagatatcagagttcaatgttacgattcaataataaaaaagagattaatcaatcaaagccatttagtattaaatattttggcatctgtgttaaaattcctattagattcttttattaacttttttttaacagaacaccaaatttgtcaccaaaacaaacattcccaaaacagtatatatcaatgccaaatgcagttaatttatgtgaaaagtagactcttggttatctgtttcattttgttttggttttgttacataacccctgagaaaactctgcttaacactcacctcctctccgtgacctttccattgcagtcacacagggttccctcccagaaagctccgcaaatctaactatatatagtagttggtgagagggttagttagttgtatacttgtcccactatctttggtatttttgtttttcataaacactgcaagtgaccatgaccctctcatttctacttgtaaattactcggacaaggccatcagtatttcaccgttttttcctagctccttaaaatattgaaaacagtgctcagtacagtgcttccactccataaatgcatttctcattttttcacctttagttcaaatgttctatattttccttgaaggatatattttcataaatccacaaatgcctacttctttgactatatgatgatacatacggaatcatattaaacacataccaaaataaaaggatttaatataccacatatatattatatcttgtccttttttattagtcattagattttccaaagcgtgtgtgtgtgtgtgtgtgtgtgtatgtgtgtgtgtatatgtatatatatatatatatacatatatatatatttggtatgccaaatatataatatttaccaaaatatataatatataccaaatatataatttggtataccaaatacacatatatatatgcatacacatacacacacacacatatacatgtacatacattaatatatataatcaacactgaactaaagaatcaacaagcccactgtatattgccttatagagaacaaggggaaaagaagtatgaaaataacacctgatcactgtcatctaagaacttatgttcactttttatttggctgaggggatggggcagtatagacgaactaagaatttcacaaactaggttcaatatatatttggtataccaatatttggtagttggtgagaaggttatattttcctatatatttggtataccatatagatatagatagatagatatacacacacacacatataaatacacatatatatgcacatacatatacatacatacatacacacacatataaatacatatgcacactttgaaaaaatctaaagactaataaaaaatgacaagataaggattattatccagggacttaattatattaccagtgaaatgattttttaaatgatgtgtcatttttaatgaataagagaaaacagtcaaaattattcttcagagaataatcttactcataatattgagatatttcttccaaccttatttgtgggactaaaagtcagtgctattggaaacataaaggaaaaaaataaacacatcaccattccagaccatgaaaatgtttgggattttaaagtcttagttccttgcataaataaataccatcaccttgaacactccccgctaggcaacagttacgagtatgttcacttttatctcccattatgtttgtgcctgggattgtcttatacccaaatgaaagacctcatgaaaaatggatagtagtaaagtatactggattgtaccaggaaatttatacaagaatctatcatgtctttgtactctagggaaggttatttccttaagtaactcacaaatattgaaacaggcattgtgattagctgtggctctataccattcacattaggagtggattttgagacattacatagcaattacagtatttaaatttttgccatatacctaggaaactggaaaatttgccaaatttaatatttttctccgcactttaggcatagcattgcccttaacttaaagctctgcccacaaaagggagaccaagtcttctggaaagctcagagaaagtattgcacgtctacaatacggcaggtgcggcggtaagcacttcacaagtattttctcagtttaccctcacaattgccaaataaagtgcatgcctactccagagctcaggaaactgaatcttagaaaataaaactaatttacccaactacatagtgaatagtataaaacaaacattaaaactcacagcaagattccagaatacgtgctattgctaatacagaccctgtaattcacatggttttattttactcattcttaacattaaaaatatacacataaagtggaaatgtatttctaaaacagtgaccaatcactagtgcatatacaaaagaaagaaaacaagcctcagtaaaaaggagattttcctagtttgaggaactttcttgtgttacctcagtaacagtaatctgatttgcccctaatgttctatattcagtataaataacttgcatgcattcatccattcattcaacaaatacatattatctattttatagtatgctctcataacatttctattgattgtggtttcctgtacttgcattgtacccatcttttgttcacctatttttccatcaacaattgtgcctgaaaaacatgctttcaaactttcaccatatactgtcaaactagaaattagctactagaagtagctgatattaaactttttctaatactctaatatctctgtttcaatgtgttaatctttgccttattccagagtctcttgatatacataagcacacacagggcatttctaaaacataaattatagacaactctttcattttataaaagaattcttggccaggcaaggtggctcacgcctgtaatcccagcacttttgggaggctgaggtgggtggatcactcgaggtcaggtgttcacaaccagcctggccaacacgatgaaatccagtctctactaaaaatacaaaaattagccaggtgtggtggtatgcacctgtaatcccagctacttgggaggctgattcaggagaattgtttgaacctgggaggtggaggttgcagtgagccaagatcacgccactgcactccagtctgggcgacagagactctgtaaaagaatttctaccttaacaaaaagattcattgaaagttgctttttgaaattaaattccccttgtaaatttcatatgttttatttactaaatattaaactaataaaaaaattctcagaaacatctcttaaataaaagagatatggatgtttgttttaaacttaaaaaaaaattctttaactgagatgatacatgccacacaaaggaaaagggagatgtagtaattatcaagctaatcggaaaattacaaacacccaaaagcagaacttctaacagctcctcataactagctctgaccttttctttaaaaatctgactttcagttaaaaaaaaaaaaagttttcttataacaaatctcaatcatcttttcttatgttattggaaaattggccatatatttttaatgggtcctttctgtttttcaaccagcatcaaattttggtattagttgagtgcaatttagtgtatcttccatccacacacaaaaaaagagaaagaccatggctgcagattgatttcgttagaatacttcctatgaaaatgtataaaagaaaaaacctagtctcttgaattaatttatcttaattacaaatgataatacaagatgtttaatcattatttttcttctattttcctttaaaaattgctgccatgttttcacgaaataataacctttcattattttttgataatttacgtttatttttcctcctacagcagtaaaagtaacgcatccaaagaagcactgggcctctcttagactcagtatcccaaactgtaaagtgagaagatctgtagggattttcccggctctaaaattctacaagttaaagacctctttcttaaaaagtaagcttttatctacattgaaccaaatgagttaactattggactttgaaatgagcaacatgaaagtgttactcaagagtcaggttacacattttctatttctctttaataaataaaatgtattaaaaccctaaatttaacaagcatgtgctaaactttattaagtattgcttactatgaagaggactgctctctgccaagataaccagaaaccaaattcctaggatgctagagctaacagggatagtggatgtcctctaggccaattctcttccctgacagatacagaaactgagttactgagagggacaaagtttcccaagcacctgcaaacagtaggaccagcaatgtttttctcttccacttcagcaagctgcttcaatcactatatggcgtagagtgaatctctacatcagtaaacaaaggaatggaagaaggtaattccattatcaggtcactaaataatttagagtctaatttttctttttttaatgtaaagaccttatgttcagaaacttacatttcaaagtacattaagtaaaattatgtccatacgcagatatgtcttctcctatatgcatcttaataaacaaaaaaaattatcgtcatcccctacaaaacaaaaactgaaattaaaagaaagaatagagtaaatctaaattgtatattttcattccttctaaaaggattaaataacagaattctaaatggtttgtttgtactttccatgcaatatgtagattaaccatgaaattctgtttgggacactttgacatctgttttcagtgcgttacaatgaaatctggggacttgatacatacatttgctgtaataaaactgtcactaatcagtgttttccaaaatattgcccataactattactattcagtagtctcatttgcatgatctaatattgttgctacatcatgtttttccctgacaatgtgttagctagtcccaggcacatggtcgaaaatggctgcaaaccactcaataatcccagcatttccatagtactctgtatatatgcacgcaatctgtcctagaattgaaccaacacttcatccttcatgaaatattttctctgtaactggaacacccaaggttgaattcacatccctgagtatgaaaaactcaacaataataaagaagcccatggtgaggaggaaattacgcctcatgggccttccacaacaggagacgcaaacataatccttactcagaagtcccttcaacaaagctgtaatgatgatgctttctgaacataagtgcggagtctatcattaacttagaccatttctatgaactaaagaataagactggactagactttaaaacggagtctacttccctttctctaggattagtagacagccttatcaatgccagataccaagagccacaagttcacaagatattaacacaaactcctggatattagattgaaaaactgtttccgtttcatattgcatatatctggtatgtcatgtacaaaatatggatctcaggggaaaagtaagtctgacagcccaaacatggtattcaccaaaaaacaaaaccttactaaaaacagtctgtctacctatgttgattctaaatgaattccgtattttatcagtacttggcattatattcatattgctcaacagtccaaaataatttcatcttgtcctcccatgaactcatcttaaacccaaaatatgtttctccatgcacatgttttatattatacgaatgttggacacgaaaagcagattaattgtaggccctaatgctgtgtttgttagtactaagaagtcattccaaatgttccaaaagggattaatgtagtataacaagtctatttaattactgtaagaccagtgatcctcatattactataagcagcttttcccttatttggagactgtaaatagaacagaaattgttacatgataactataagtcatatcctaaaatgttgatgctttaccatcaggaataaagaaatatgcaagcatctctgagaggctatgaaaggcaactagaatttaacaaccatgtatacgctcccactttaagtgaacatcaactttaaatcataagtgtaagcaaagcttttcaaatacattagaaagacatcatatcaaatctttctgccatcaacagcaatcccagtttacatatgtttaaaaactgtggctgcactttgtttcatgtatatgattttcgagttttgtgtatcccatgaacagaactgctactaaacaccagtgtgttatcaaaaagaaaaggaatgccacagattattaaaaattatgtgccagaatccaaacaagctaatcaatgtactgatcctgctttccgtacaccctagttaccctttaactaatggacaaacagtgaaataacttttcctattaactcctggctagaacccctaggtacgtgatacacttattataaagtgctccatataagaatatgatgcctttttaccctacgtcaatgtgacacgtgatttaaattttcctagtagggattgtggatatgagctaatctctccactttccaaacctcctgtgcaaagtgaggggtgcagttcagtggccgtagggaaacaagcaccgaaactagttcctccaaggacctccatggacacaaccaaccagagctactgaagtcaaacacggtgatcccaaatcacagtttcgtaagaagtaaatgttgtaaccattctccacttggcttccagttgttcttagcaaaagtgaagtcaatttcagtaataaatgttaacttatttcctacggagctcatttaattatttaattttcttaacacgatagaaaaggaggaatgggaaagagtgacttaaaggagaaaaattaaatggcaataaaatcaaaacaattcatgcaactgattaaacggtttgaggttttgactcaactaagggtcatttttaaatatgatactttcggactttaaaaagagtctgaaaaccagcagcatgcttttttaaggacaatccagttggccgggcgcggtggctcatgcctgtaatcccagcactttgggaggcccaaggcgggcagatcacgaggtcaggagatggagatcatcctggctaacactgtgaaaccccgtctctactaaacatacaaaaaaaaaactcagccgggcgtggggaagggcgcctgtagtcccagctactcggcaagctgaggcaggagaatggcgtgaacccgggaggcggagcttacagtgagccgagattgcgccactgcactccagcctgggctacccagccagactccttctcaaaaaacaaacaaacaaacaaacaaacaaacaaagcactatcccatctagccacatcatcatcacttctgccgaaacaaatctaaaacgtaagtgtagttctcccaaatggtggcaatttaatttttttgtacatgacagttttacacttttattggagtgcagtgaattacgagtacttgataggacaccctttacccacaccaaaattgagttatttattcagagagccactaataaaattatttgattccttcccttcaaatatacctagattgatcaataaatttagtctctggtaaatctgagacaaaaaggcttctaaaaccatacaatcattctaatttaaatgggttttaaaactacacacaactagctaacttcatgtgcctacacaaagagttttcactaacaaatattcacgcgcactacagtgagcaggacttcgatttcctctttggtatgtcttgttacctgagataaatatgaactaaatgatgaccctctgcttcatatccagtcattcctttttttcactactggatagtctccctggcagtctacattatgctattttccttcatatatagtagtaattgctattattaacattattgcttttacttacatgaattatttcatttaatcctaaagcaacacagtgaagtaggcattttaatcctcgatttacagaacagaaaagcaaagcacatggagctgaagtgacttgaccaaggtcacaaagcagataaatggcagagccaagactagaaccccaaatgtcaaattctatgcacatgatttttgttacaaaatgaatgtttgggtcttccccaaattcctacgttgaaatcctaacccccaatctgatggtattaggaggtggggcctttgggagataattaggtcatgagattggagctttcataaacaggattagtgcccttataaaagagatcccagagagctctcactcttttgctgcatgtacggaaacaaggagaagttggcactctgccacccggaagagagccctcgctggaacttgactatgctggcactctgctcctgggcttccagcctccagaactgggagaaataagctttagtgtctgtaagtcacacagtttatgttattttgttatagtagcctgaactaagacattttctgtgctctacaaaaatggaaaaggcagaagggggatatgctgaacgtcttaagcaattcaaaattcaaaggatgacagaatactttaatttgcacattatttactcttcagtctaagaataagccatctttcttaagtaattcctgcaagatctaagccccgcctttctctttttcttctaacttcacttcttcaactccctacaacacgtgtgtgcatgcgcacaccccctgctccctgcccacacacacacccaagttggataacacacaagttggactagaaactttaactcaacaggtgagatcaccttaaaattctttcgatgtaggaactgaggtagacgtctggagaaaactaaagagatttttaaatcctctgggctggctgctgttctcatatcacagtctcactgtcatctgaccccttagcccaccaaccacatctaaagccaactccacattggcgctgcccctgaggatgctaatgaaccggcagaaaggcaaaagagatattttctattctagactagtttttacaggagaagagagaaaaactgaggccatggactaaaatgagattcagagcacttcattcaaccttcctcctttgacccctatgattctggattatcaacatgattcattctgaaaagcatttaaattccttgatcttgtgaacattcctgggggaaaaacagtttaaaacacaacagtaacaaacaaacaaacaaaccagaaagaaaagaaagcctctcacctgctattttcagatattttctagatgggaatgcagaaatctactgcttttttcccaggttctagcgcctgtagcacattgtctctcatctgtcagtgtatctacacacatgtataaacagtacgcaacacgcaagtaaggaaatgtacattttaacttaaacttccttttttcctctaataatttaaaaataaaatgtaacagcttggattttaaatatttaatctggcaaatataggaaaatcatgaactataatgtcatatttggcaaagaagagtttggtaggataaaaatatctgtgttttaacattttagaaggcttttccagtattttaaaaataaaattatttcactgcttcagaagagaagaacggaggtaaaattcgctatttttgcacatgaggttttcatgaagagtagaaaaaaaacaatttttatattcattaaaataaatagttatttttacatgctggcaaaagtccccacagaaataaaatcttcatatttactaatggttctctactatgtcatgaaatttagctatttaagtcacaaaagataggattcccttaaaactataacataagatggtatatataaagttacaacattaactcatttgtaaagaaaaaaatgttggttttaccctacatgtttagtatacagattttttcagtactagtcaaagatttatagtgttaagttcaaaagtcagttgttttcacatcggtaaccaacagcataactaaatttcccacttttacctcatattatgacaataaaatatttttatcgtagcagctgaaaatgctgaaaagtaattattaaagaaaccataaatataaaaagctgaaaagtcaacctcagacgagtgtggaaaaggaaattgtgatatgtaccatcataaaacagagaaactgaaaatctaagcagaaaagatctaaatccctccaaatgccagaatactatgccccacctcttgtagcaaggagggctgcaaatttgtccccatcactgtcagcaaacaaaagaaagtcacttctacagccagaccatgtcaaacagaagacgtagctactgcagacggacgccttgaatccactggtgtgtaaagggcgggcttgggcctttttgtcagctattaccattaaagaataagaggaaacagtgacattattacacaatagaaaggtcaaacagcttgcagccattccatgacccaaacaagtcaaggtcaagggattcaggtagcaacttagccagggcgtaagttacagcgcaaatgaattgttttaacacatcagctttggtcaattaaacctaacaaggcaagttgcatcaggtagcagggttcctgacaccaaggccagaagctgagaccgacctcataaaacaaggcttttaacatagcatagcaaatttaaggtaatccaaccagaaactgcagatgtcagaataataaaatacaagttgtcctacgaaggaacattttttacacttcagaattcactaatagaggggtatagacttcatattgacgtgtcattagcataggcataaatgtaatccaccactcacatgaattacagaatataccctacttcaaataactttttcctaatatctgtgctcatgattagattttttgtcccaagctctaccattccgttagcaccaatacatttatccatgtatttttttcaaaatgagtatgaaaaatcaggtttttaaaaaaacagttcatcttcattcagcatgagactatatatgtgtcgcttaatattaatggatgcttgttaaatgcttttatgtagttttatgagagatgtgtacttcaaaattcaatgaatactattaagttgactattttgagaaatagactattttgaatggagttgaagctaactaaaattttaaaactgcatgtatttaacatgaaataattcttttcttaaaggtaattcttattttatttcgcacttgtttaaacaaattccattttcaactggtttatgcttcatcaataacttactacatgttctgaactgccttaaaataggattctgaaaatacacaacctccaggcaacttttgatagtaaaattacttcatccatcaccccatatttttaattatatagtccttgttcagagatctttaatttgtcagtgattcatcagtgctgtcctgtttaagctatcatcataaacagaatatgtgtatctaagtgttttactataaacaatatagttatgcatgtaatcatctgctttcccattttagaacaattaaattttgaaggttttttaaaaatgtgtggctttcaattcagcctcaaggactttccacctcacttgttagccatttcttccaattttctgaataatataacaaccaaaaagcccaaccattcaagtcctattagtctcactctaacgttcaatctaatacaagctaatcccacagactcactccttactacaacgcacttagttttcacaagttctctgcagtttgatgatttattctctatgccaaattctaacaactaaattcagttaaattaaccgcatcacaaaactggagttcaaggtcccaagaatttactttaaaatgagacaacataccacgttgccacagaaaagtgagcatgatcagaaggaagcgtctcttcttgctatgcttggcactggggcatgcagccgtaataactcaagtttccgatcgcataaccactagtccttgagatttctaaaattattcctccttcacaaggatggagggaaaaaggctggaaaatttgctttgaacattatgttggctaatcatttgctccgccatagcacatacataggaaaaccccttaagtgccgcaagttctactttcatcaacttcaaactggaaaatgctattctttcataaaccaaagagaaacatttacccagaagctagtttcagagccagggatcgcctttgcccataattttcaggtatttaataattgaccattttaatgagtgtttcatgtgctctttgcactctttgcaaacttggagcttcaaacaaagcaataactacttctttgattataagtccattatcatgtaagccaccatgataacagaaatgaaaactaacttatctcaatttttaagaaatcctgtgaattctgacataaccttccgttgggtccctctctcttcaggtgctgaaattctaactggccagcagtgatggcaagagcgctagtgtcagaaagcaaacggttttatatagcctaccagtctagtttttcagtttaatctggctgagtgagagcttatgaggagaaagaccttgctatattgggtatcttggattgctgtttcaaattttaagtgccaaattcaaaagcaaaaagttaatggaggattacaactttaacttccttatgacagcttcttcctaaattccaaatttagggaaaaacaagtaagtaaatgaaaaatcctaccaaatctattacgaatcttcatgtttggaagtgcttcttaggtaccaccttagaaaacagtaactttaaagaactaaagctgtagcaatagatggcctctctcaatggctcctacccagctttaagtctccaggcacaggcactataactgtgcctatcaggaaggcattcttcaggagacctgaccgtcactcctgtcactgcaatgcacagtcctctccaattaccacgattctcgaacaatgcatattattttggttcttacaaatatggagatatttggaattattttaccacacaagagacattgtgcactaaatctgtaaatccaaatacataatctaactatttttcattacaaaatttgtagtgctgtatatacagggtggggggaaggatgcctaatgctgtcagtagaatattttaccaacctttgctgcctccagaaagtggggcactatatatttttaaatatttgaaaatcataattgatgtaacaaataagcgtcccatccctccctccctctctccttctctccccccacccttccctttgaaaaatgagatcatattaactgcaatgcaagagcttagtttgccatatcggaacacagatgccaagcttccccagctggcaactggggcctcagagtttaactcttaaattgtctgttaaagctatcttgtggcagagacctcatggcatagagggtgaacttctggtgggagactgtgttttcttatcagtgagaaaattgctaagtatcttatctcacaatatatgttcccacaaaggtctcattaagcctaggagcaagacatgccaataagagcccttctttatcttgtgaattgtgtatgagccagaatgcaaacaaatgtgcactagagttcacaagttcagtcaaggacaagttgctagatgggaaaacttaacagtgctcccctaaatcaaacatgcataccaagtatttctcctacacacaaactcttatgttcccagagcatttcacagtgcagacacaccaaatcatcctagagagcagcctcattttaatcaattatgaaagcttattttttcccataatgggaaatacctgcagatgaagtgaaatctattaaaatgttaaaatacactgccaacttgcaaacaattatctacttaagcttttcataaagaaataattgttacccaaaaggattctgaaattcagtaactgtaggaagaaaataattcttagcatttgcttcctcactaatgatatgtgacaaccaggaaggcttctatttcaaaaacagtaataatgattatgacttcccctgtaaataagtcacatttttcacaacttcaaaatgtacttcaattattataacatttaacaataaagcaacaaaagtggccacccaacaagagatcataattttaagggttcaacaaggctaaaggaaactactttttcaggatagcaatgaggtttctgggctctctttaacactccaaaacatgtttaataagagtgcaaagtacagtccaaaaatcagttagggtgactcattttaaactctaatctgttacatacacgacaacagttgctatctcttgagatctttaaatgtcttggtgtgttgtgacctctctcttcaaaacgctttcctgcctcagagaaaggccaatcccactcccgccccccgactcccaccaccaccaccacccccttccttttttccccttcagacaggacacagtctggcaactcaaggcctcccataggccagacttccttctgtgcagccctttgggtagaactgctaatccttcttattaattaacgagataacggtggttaactgaaaagcaatattaacgctaactatctaggaaactttaaccaaaattattttaggcttttggttgattttcccagtgtacaaaattgtgcactgagaatttcgtaacagtgtggtgcagaatcgagaaattccagaatgactgattttacctcagaccttaacgcataggtctcctctttaaagttttctctctctctttttaaacatgtattctgttacacatttctaactagagaggaaaactgaagtcctctcaaaatgttactataaaatttgcaagagtggcaagtgagggaactagaaattgcatagcaaataagcagtgatgtgactgagagcaacagtcagtcataatgaatgcatcacatatcattacgttaggtttgtcctccacacacttgtcatagcacaccctgcatcctataggacacttacatcccaggaagctgtgctgtgcaaggcttgcctggtttttgtttggttttgtttttgctttgctttcatgaatgcagtaacaaaggcaatatggggaataggtaacacctgcccaagaatcattggacgtctttaatatctttgggaaaatagataccatttagagctattttttctttaatctgtcccagtttttttagacaaaacctaaaaaaaggaagagttttatattagctaagatttgctgcagcaaacaagcaagcagctttcattcagggattgtcaaaaactttccagtgtgcccactgcaatgcggatgccaaccaacgaatcaaaggcattcagcaactagacaaagagggtctgatgccaacctcggtgccactggcaaccattattggcatcaaacacagtgtctgccttttttttccccctcgcctggcacttcacaaacaaaatggcggttcttgtagcaacgaaacagccgaagcgcagccctctgaatcaataacatcaaatgactttatggatttaaacgcagttactcccaaatgatgtgtacattttaggtgaagtgcagggagacatttaattttataaacaactatattgaacatcagcctttgctaatataaggaaatagcaaaatggactgaattgcggtcaaccagactacatgcatagtagccgaataacaaagagatttagctttaaataaaatactgcctcatggccacgtgatgcaaaagtctaatgaactatatatcaaaaatgatttcaaaaagcataaattttttcccaaaccatatcagatgcagatgtagcactatagcttgtgtcaaagctctggtaactcttcccacatttcagaaagatgaggctgctgggcatgaagaaggaaaaaaagtgtgggttgaaccaaaagagaaagagggaaaaaagaaaagcataggaagttggtcaacaatgaaactttagtacatgttggtctttatttcgtcttccagaagagatgcagtgtgtgatcttgtataaataaccaagaggactattgacatttctagatctggaaattgtcaatatattgtaacatcactccacactgcaatgcggatgccaactaacaaatcacaggcatcctgagctaaacaaagagggtctgatgccaatcctggtgccagtggcaaccatctttggcattctctctgttctttctcatgtttttctcccagtcatttagaagtggggagagagaaaaagggggaaacgtaattttgttgctctttctgctgcaaacattacatttctcttttctgatttttctttcgtgttttcctttatacttcttttcctgatttataaaacagacttaggtgagttatcatgtacttagaagacaaataaaaagtcatcactcgcgatatgcagccctctaactgaccggagaattatcttttaaaatctgccttctttaatcaattgcactataaaatgacataattaacctacacttgacaaagaagaatatataaattttgaaaaggggaaaacacaaaagcatcctgacgtgagtttttcaaaggaagaaccaacagatgttaagagaagatgatgcactggcaggtagcagaggatacaagttatatacacaagataaaataatgaaaagttcttacaatagagattgttgaaccaacaacaaaatcaatgttttatctaaaaccatggtctcttaagagttgcttaaaactttatagttatcatgaccagtggtgcaacatggaaggcatttatgcgttttttttcttttttcaatctatctctacaaatctttattgtcagttcatcaaaactaagagagctggctgccttccccaggagtaaatgtgcatgcaggcaggcacacctcaaaacctagccttcaagcaacttaaaatgtgagcagtagtgaagtggttgcaaatcttccctccctgcactaaaaagttacatgacccactttttgaaactttacttccatccttgactttcacaacacagttacaacacatttatagtcaatccaacacatatatacagcccaccttaaagtgtcacctcctagacatctgtcaatcaaataagtgtcatgtgttactgagttttattttaggacacatgggacaaaaatattattttccccaaaccatcattatttggactgtaattcttaaatgcatggaaatattaaatgcaatgtttcattttttcaggaaaaggtaatatttctaaaagtgcaatgtccaacaccattatttaaaatcagactaaaaattctaaaatgacacttaagcctatctccaaagctacaagaaaatcaagacaaaaagcacatagtgagggcctagaattcagagtcaaaaaagtaattttgatttttttgaataataaagctcatagcagtttattaagtcccacatttatataacaaacctcaggtaacagtctgtcacctggctatctgcaggccatttttcctcccaccaggccaagtttggaaatgacctaccatctgtgacagctcaaacttcagtctacttttggtatgcggctttgtaaaatgattgttttactatggattgttggtaatgcaaggacatctatatcttgatgcatttatttgaagaaaagaaattcttacctacttaaggaaaatatattaagaaaaataaaaataataaacatttcattaactcaaatattcagtaataacatcatcttttttaattatttaggtaaaatgtataccattctccttctcaggtattttaaataataggtatggtatgcagtttctgtattctttttaagatttatcttaaaccagtgtaaccagtccactttctgttttttgttctgtaagcagcgctgcgactttcctcctcggtaagttttatgaatttacatacaagtaaactaacattattaagtgttcccaagtaactctgggaacatactataaataatttaaataataactcaattccatttaatcgacagtgaatattgcacaatcaaaagtgatgatagaaatattaaaattaagtaaatctaggtctacgtaagatatacttttgatattatctatcttaagcattttgtaatagtaaacattagttctattttcagtgcgataccactaagttcataaacaaagtccctctacctcattaattaataaggttaatacaaaaattatctaggatggtttggctattcataaataaagttatattttcaaatcaggaaaagattactagattagatgcaaaaatgtagcctacgacagaaagtatagtgtaatgaactatatttgttagactaccctatgtctttgaaaaacagtattattttaaagatacttgaaaacgcacctctttgtggtctttcttaaatatccaagcctatccaggtacgaaagctctgtgtctatttacatggctcgcacatggcagcggacatgtgagtgaaagcggacaccctactatacccagagagggtggaggatatctaggggccttgaggaccatctaactcaagccagatactctgtctacggagatttgtaggcggtgtttgccgtgctagaaaaaagaacaatctgctcctaccttgctcctgcacgtagtatgccaaaaacaaatcaagctccttaactgatactgtgatatgatgtggctggacacaaagtgctgggtttgtgcaatgtggggatttcatgagccgctctccatcggtactttccaaggggatgcctttgaacaggatcaccatgactagatccagacgccagactttgtctgcctgtcgcaggcagtcgattctcctaatcttacccttctggtcgggattggataagacacagcacgggtgcttcttgccagtcacggtgagcacaaagtcctctcgatactcctggcgaatatctttgcgcagtttggcaaggagcctggatgcccacttctgtttgatttcaggcttttcactgagaagctcatctttgactgctctttcttcatcctttgacattcgcttctcatgctttttaaagtacttgcgttttcgagcctgcaggttgaaccaagtataggcaattgcacggacatgtggaagaagtgcctcgatgaatgggtgaaattcatcctgtggaagacagaggggtgaggaaaagatgtgcatagtcagtttaattttaaaagctcaaaaaataagaaaagaagaccacaacccgtttccaattcagtacaaaaagttatacatgaaaataacattcctttcttatttaaaattatcaaaataacaggacaagaagaaagtaaagtatgcccagctgtcccctttccaccaaaattcacaggtcaattctccctcctataaaggaaataaggtttatattttgtattacactctggccccatcccccttgtttccaccccaatgccatgcattctacattctttaaaatataggcaactaactaaggtgcttggcacctaatatagtatttcaatatttgattgaccaactaacactatgcagtaccattttacaaagaacacagtgagattttttttttttaatcggagtagagctgttcagaaggcaggagcgatgccacagttcatttctcttctctgtggcacagaaacacaaagcatatagatgctcagtgtaatgccacacagttcccgcttttggagcatgctctcagcaagaggctgctggtggcacaaagagcatgcgccattaaacttgatccattttcttatcaaacgtccaacattccaacactgaaacagcaccattccaaaagtggtaactagagaaaccggtatacagtgagggaaagtgggcaaaggacacagctcgtcgtatcagtgtcctgaacagaaggtttccatactttgagcagtgcattctctccccacactaccaacgccagctcccaacacacacacacacacacttgcactctcctgctttctcacacacactcttgcatttttaaatagaagttttcaaactggaaaacaaaaattacatgaatgttcttccatcagcttccctatagaatatgcagccccacagagtccgttaatttgttcaccgatcacatgagtatagcaattattctaaacctcttaaaaatcaatctgaggtgaacaatgaaaaatggcaacttggcaccaactttacattctttgtgtctctgcatgctgtggtggggtgacactgctggtcagttactgcttttgtggaatctatacaattcatttgccatgtagatgaattatcagttagaactgtgggtgcatatatgcatgtgcatgtgaatttgcagatacatagattatagagtaccaatcttttgaattaagtagtttacctttaggctcctgcatttttcctgcctgtttcatccaagccctttttttaagggaggggatcagtgaggaatggtggataatctttacctacagatatttcaagttacttcccagtgcagtcagtttcgttacttcctgatttaggtaaaacctgtcttataagcttaggcctattactgttcaaagagaaagagcttaacgtcctgtacatgcacaccgcatgtacgcaataagccaagatttgaagcaaatgagaacttccaccaccaccacttttctgatcatattgactatactgtcagcccaacgacaaaataactctctgattgtatcccaagttagaatttacatactcatgttaatcaccctgaactacgtggaataaattctatttaacagcagactgactaattaattccattaggtaaatatgatgaaagtacaactaatgactctttaacaaagaaggtgtcaaaaatccaatatagatatgaatacattttgaagaagaaattcgaagttttaatgctacagactgcaacatgttagctgtttgcacttcagatatggaaggagtacatgtcccatccaatcaataatgtagttatcaagtgttctaacattgctgtaagtgttccttcaccagaataagtatgaatcaaaattttataacaatacagaatgctgatgattacatcacagcatgaggcatacccaaatgccatagaggaaatcattaaaccgatcagtagtttccagcagagatttgaacaattcagttactatgcgagcacattaaactaggccatggaaagagttaaaccacaatctgttctttgtgtgggaaggcagccctgctcacagcaaccacatcccatgataagacctccctatctccatacactttctgatgccatgcttttagctttcactgtaactacaaaaactttgtttatcccctttaggaatatatgcaaaaggaaagcctgctcaaggaaatgtggacttaaatgtgctttggaaactcacttcctataatcttttactacgatttattgatatgactaaaaaacacacatatatgcactcacaaaactaaaaccttgagaatgtaaagagcacatgaggtggagtgggtgggctctgtctcactcattttacccttgccatgctttttaaaatgcaatattattttataaatattaagccatgtggtaacacgtaagtacttacaccttaagtactatgttcagtgacatttcattttcttataaagacatcaaacacagttttgattaaatttgagtttcaatatttgattataaatataatctatcacacaagaaagctcaaaattttaatgagttattttaaacaaccaaaattcaaatttgaaggttgaatttgaaaattcttagcaaatgcacacagtttttaaacgttcctttgactttgctgtcaatgctgccaatattgttttaaaacatgctcttttttttgagaaataaaagtagcaaactttctcaggctgccagtttgccttattgatatcgttcagggtttcactattatgtgaattcaagtgaagcacttatttgacaaggggacatatcctccaaaaatgactgtaaattgaggtttgctgtaagtcgcatatatttctgtattaacatgcctaaatgtcatctcccaagtgtgactgtttcctaatgctgagtaacactagagtcttaaagattatgagtgacatgaatatggaacataataactgtcctgatacaaaaatatttttttaaaaggtgattaaggttttcaaatatcctaactagtagtggattattacaatagcattaagcaatcataaattctttaaaaaaagcaaaacatataagtgatttaaaaccaaacaactgtatacaaaggtaataggcaactttgctctttcagaatttttagtaaaatgcattgatgttcagtaattctcttttaaaacttcctttagttgaactaaattgacaaagtaaataacaaagttaccaatttcagatataaaaataaagagtcttaattccactaggcatatttatttttcttccgtttccatgaaagggatggataatttagaccaacatagaggtagaagagtaaatactaggtgctcttggcgcattgctatataacaacaaatcatgcaaaaaatgtacctaaagaacttaaaagcaacgaaagaaaaatatatttaatgccatcatgccaattgaaagttatattattaatggtttacattatttttaaacatatattaaatcatatgatagttcttaatttttcctttatatctgatttatactggtgtataaatattggttattgatatgctgattttgtagcatactattttgctaaacataacatttaatggtaggtccttttaaattaagattttttttctaaaacctagataccttattgcaacaattgagatacttttaaaagtttataaccaattaagaatgatactctattttgcaatttacatgtcctgagacatgtttttctacagctactaggctcttgtgatacaaaactactgatctgatacaaaagtgacactattaatgtggcctcacttttataacacctatattacctgcaaagtcacatggagcttagtgaagtgaaaattcttaagctgaaattccttccctggtgtaggccttgttttaatacataagcctagatttatattattaaaatagtagagaatattagtcatcacaagttattgttgttaagtgtgtatctctgaatactaatgtgatagctgaatgattatgctgtatatgatcccaacattccctgtctcaatgctgcaatattatctttaacttacacaaattaagataaaactagtgacttttcaatacatatttggaggatactaaaaatgcaatgtaattgctagcaatgtttctgaaaagctgatgttagaaatatagagaaatgcacaattattcaatcttttacaggtgagaataagtgatgctatactctgtaagtgaaaatcttgctttgatttgttttatttgatcacggtgtaaaaataatatcaagttaacacagcttatcagaaagagaaaaatatatccagccgatgggtaatattaatggtaacttttacaagtaaaggcaattcgttatacctgaaacagtttcatcatatttattggctattatcattcatggcttttaaaatacaaatagctcagcaactcatttttccagttttgttaaattaaagtgcgtgtttacttgctgaaaatagccatatctaagttaatcatactcagatgccaaacaaaatataaacaataaaaaatgtgtcagccaaaaagctacaggactgtatccaatcactgaataagccttatcattgttttcatcttcattcacaatttatgaatgcctcagtccttttgaatcacaatggcttctaattgtcatacaattgaaatcttaattatttgtccattataaaaatgcatcatcgtgatattagatgtttttaaaattttaacacgcccaagactggctgacacttctttatatgactagttttcatggcaatgtcaaagaaaatagttatcaattaccaatggtgacacatcttccgaaaagctgaaataagctgccccatacctttagaggtttaaaatactgcctcaaataacagttctgggctaagatattttagttactttgtcagttgttagttccctgggcagcgatgaaaactgcccccaggtaagtctgttgggtctcgccgcttttctatttgaccgtctggcttaaagtgatacaaatcgtgtttctaaaaagtataaaaccagtgttttatttcataacattattcctaaggtcttaggacaattctcaaagtcgaaaaaaatgaccttacttctaccagcattacttaaaatgccttacgagctacgcccaaatatcgtcaaatgaacaggtttccacaaaaggaacacgttctaaaaactccttaacaatcaccaagaccaactaactcgtgtcaacgtaaatactgcctttgtggtgcggtcactagaaaccccaaagtgcagcaggtcactatggaccagggtttcagatccccaaataaagcaaaggaatgggtccccggaccacaacctccgactcgattcgtcgcccgcccaccgcctgcagcgcagtccagcggcgcccacacagactcgtgctacagtcccctcgcccaagttcactggctgtttttaaaagcttagtcccccgtaaagtcctccaaagcccgagtccacctcaacgcgcgagctgctgagaggggctacgggcaccccgggcggggatgccgcaccacaacgggcacttgaggggccgcacggggcctcgcacttacaggtcccggccctgcccaccccccggcggccttgcccggcccagcgcccgcgctccgtgcccagggcgcggggctgggcgctcgcagtggccgtggcgaggggccgctcccggctcccacgccgccccgcgacgcccgctgcaactccgggccacttctccaagggacggggatgtgcggaggttaactcaagccgctaattgtccgcaacaaaacaaaacaaaggcatttcgggccagagagaaagctcgagaaagcgaccgagacatgtacctgagtgagacagatgggagaatacatcatgacttcgccttaaaacgcactttccgggagatgcccaagaaaatcttcgagaagcaagaatttcatctattcattttacagtcatctgagccccgcgatgcgatcaatcaggacggggctctgcgctggatcaccgcaacttcacaacaaacccagtcctccttaaatagccaaagattcaagttcactcggcgtgctagatttccaggggtgaaatccaatctacacttttaaccctcttgcagtccgagcgcgctggccgtgcttgccgaggccgccgccgccgccggtgttggctgcttttcgcctgggtttggggatttgttttctattttgcagttgttgttgttgttggggtgtagggggtgcgcgaaggttcggtgtgggttggattggggtggtggttggtggtaaaatgctttttcaaaaaaggcggggaggggggcgcgggagggcgcaggagggcgagcgggcgggcgggagggagagcggggagaatgtgtcaccgcgctgggaaagttcaaggttacagccc

SEQ ID NO: 157 - DNA, 317142 bp, Homo sapiens
ccagagtctgtagcatagctcattttattgtttaaacagtttttgcataggaaatatatccgcttccagtaattgactgcagtatgagcagctgctagcagtataggctggatataacagtaacaatcacattaagtcaagcttgatttacaccagtttaaaacttgtggcaattgagttcatttgcaacccacaaaaagtacccaaagaacgttatcctccaaccgggcacaataaaaccttcactaacattctggcccagtctggggttgatcccagaggcctgaactctagaaattaagtaactgtcgtataatacatcctactgctaaaggtttgttacatggagattgtgcatgtgcctccttttgtaaaaaaatttaattaaaatacaaggttctgtatttatggcccatgaggacaaaatgccaaaagttttaaaatggatcaaccctggtgtgtagctagcaagcaataactgactactcgtcacctacagttgtactaaatgtatctaaagaaacacacagtcctacaaaagttgttctcagagaaatatcattgaggtgggggcagctcttcccaggatgctaaaagttctatatgatataagcacaaattaacagcttgatgaagacataatctactgcagctttgagaaacctatgcctgggatgtagttacccctcacattctacaatgttgtagagattttttttcccaagaaaatgtcatttgaaacatatttacaactgaactcaacagagactgtgaaattgaacaggcactgctcatttgtttgagttttttggtaaacattttgctggttttttttttttgtttgtttctttcttgttttgcatcaacttttatcagtccatgcaacttcaatgccctcgatgaaggatgcataaaaagccatacttcttaaaaaaaaaaaaaagaaaaaaaaagacttccttctgcataaagagatatatttgccacatcagtccctgtagcacagttttcaaaaccattctgtcaaaaatacagtaatacaagactggctttagtgtcactagcttacactgcttttcatgtatttaggccacctgttgttcctggtactgtatcatgcaataagtcatcaagggcttagtctagtgtaccggtaagctagtggcactgaagcgcttttcacaatctcaacatacatttgaattgcaacacacagatatttctagagtattaactagtgaacccttttattattaaaaaaaaaaaaaaactacttacaaccattgaagaaaaaattgcaacaaaaaatgtaaaaattgaccgtctccaacttgtcccctttactattaacaatgtgaccaacagatctgtggcacggacacagtacaaagagttgtcatggcaatgagtttggctgatgcaaaggtcattgtgcagggtcaaagggcaaaatcagtggtccatgttaccccccaactgcagggctccactccacccacacaattttagggaattagaaaaaacaggggaactaccagaaagtgcaaaatatgaagaaggcagctttcagctccttcagcatggagtagaacattcatttttgagcttttactattgaacttgaatagcctgcacattaaaaaaaaaaaaaaaaaaaaagttttctatagaaacccaatttcttaaagtccagaaagcatgcagctggttaatgttaacaaaagaccttgacaggaacatgtaaactatattgaatgtcatgcttggggcctatctgccagcaatattgtagagttgtttcattaaaaatgaatactgtacactgaatatgggataactttctgcagccttcatcatttcacacagtacatagaatttgaatctaggtaaagaacatgtcctgctgtcacaccgctgaagatgtccctgtgcaatctctttcgttgagtccttatgaagctacaagtcacaaatccaagattctgctccctgaggacacgttatgtgagacatagcactgttttagttttctgcctatcctgaatgctctgtgaaacttaaccttaaataccatcacgtaacaatcacaaaaacttttgctaaaggccgtatatactaataaaaagacagtggtgcttcgacattctgaaatgctctggaaaccaacttttccaatactaaatacaacaaaataaccttcataaaatataacttttctccatttacacttttttaaaggattagtatcctatgcttttcaagcacaggaatctgtgaaataactcctaacatggacagattttctttttaatacataacttaagagactggagagttttaactcaagtccagtctctaaacaaggaatattcttgtttactttaaaaatggaaacaacatatagttccattataattgttaaaaagttagctttacaaacatgggaattttaatttaaaaaaaattcttaacaaaactatacagtgtacaaattactgtctacaaggtaggcggttcattaagaagacctttcgctcttctcgctacttgcagcttcacagattcattcacatattttttaatggagctgcccacccgaacattacccgataactatattgctataattaagatttttgccatgtctttatgtacagtctccttcactgccttttatttttttccttagacaagcctcaaatgctcacgtcactccaggggtaacacgcttcagaggcactgtgagtggtgggtggcagggcagcacacaaaggctgaacagtgccacggaactgatggttggagacaccactccctactcatgcccttgggtgaccttcgccatcctgaagctctgcagttctgggtaagggaggggcgtgcaagacctgcaaaagtggggcccttcgtcagaatatacttcctggtacacgaggaggaggccgaaaagttgatttgagattttatatatatagtagtacttttaatagttttatctcaaaaaggaaagaagaaaaaattgatttgaaataaaaaaagcaacacttgaactaggcctttgtattcaagaggcaggcaggaatacccacagtgtgtaacttggttagctagaactgctcactggcaaaaaagagagcgagtctgcctttaaaaaatactgtgtgtcctgtgaggttcatttgttcacctaataggtcaaagatacatgaagagcttggctgagatgatctgtttgctaccagggcgagtatcacagaaatgattggacttacttttgaacttgcactgctaggatcccgctgtgctgttcagcatttgggctatcaaactgaatgggctaatcaaatacaattctccagcccataagcattgttctaaagtattcattattaaatgatatgctgtgagaacaattgacagtttattttattaggccatggcctaggggaagggggccaggggactccttaagacagcctaccatgtgtcaccaattctgaaagattttccttctagtaatgaatacactcaatgggactgggcggtgagggaaaggcaaaataaaaccagcctccattcagcctctagccctcaggggaaacgaaatcaaatatatagttaaggtaccattccttaaaaaaatcccatcagcatctaatgggtttaattcatccacaggaagattaattgcttaaaattctatatttcccttctgctctggttctcagttttaaaaggggagataaaatgaaaacaggatttacttttttgttccttaaaaattgaactttgattttaatctatcagtccaaatacattcaacaatagcaaccctctgttcaatcttctggatattaaaaaaaaatccaagtgcactgccatccatttgaagtagtaagtcacaggtaaatcatatcctatcattaatgaaatgaaatggggacgaaaagtggcagaaaaggaatacgggagactccctccaacaggtctaatgtgttttctaggagaaagaatattcatgtgttaaactctcaaaagtgttaaacatccaacatcccctatgtggacatttcaacaaatatttttgccaaatatgagacaggctcactctccactgtggatctggaactttcaagaaaaactatcaccaagccaagtctgcctttttaagccaagtctgcctccaggagaatttgttgtgtttgcttgttcttactattgtgttgttatgaaaaccagtaatgagttcagcttgcaacccaggtgggaagttagagaggggaacctgtgtaagttgaagtttgtcacagtaggcagaacagtcgctttgcagcccaggcccatctcagggtgcactgcttcacagctacactgcaaagtgttaaaaatcctcccacccaccccagaatatatatatatgtatattaaaaaaaatcccctgtccatctctcagtacacaaaaggacctcatcacactgcaaaaatagcagtacccactttggtcaattaaaacaaacaaacaaacaaaaaagcatacattattttttttttaaatctgtgtacttacctataataaccaatacagctaaaagcactacctacataggcaaaacttggtattgcataattcgtataaatttgaaacccctcccccccaaatattaattggaagatgaaaaacatgaaaggttaatagaaaaaaacaccaaaatactgaaaatattgctggtcgattacaatttttaagcggcaactatacacagccatgatatgctttataaatgtgagataaaggtataactgtctaaaaaatccatgatgtcacacatttttcttcgtctggagtacaaaatattttgtcataaaaatggtaaagatttaaaatgataataaatgcagcaaaacaagtgtagtgatgtcactttgttgtatttttttgtttttttttttttgttttttgttttttagatttcaaggcaaggcacgtaatgtggacattatatcttcgtgcaaattaggattactggaaagagtatttttaattaaaattttaagagacatagaggcaaaatgtgtctgcccatgcacactatggatctgtcaatacaagaaatttgttgaacaaggctaatgtctgaaagcaccatgcaagttttcagcaccctgattacatttgttttctcaagagtgcgtttttatatcctacaccctggcgttcccagtttgtaaactgtaagctttacccttgtgacatggatttgcctgcctctttgtctctataatgcagattttatagaaccttttgtacaccctatgggttcttgatgcaaccagtaattttaaataaataaattctacctccaaggaggctgcagctaaaccaacataagtgctgtgttttcattaattttatttttctcaagcacatgatttgtcttgatttaatgcctttttaatgccctcaaaaactgaggggaaaataaattcgttcaaaattattttaaattctttttaatcccctcaatttagagtccaagggctgaaggacttataatcatgattcccctttagatataaatttataaattgcacttgcctctgttaagtgtttcttttgtggggaaaatattatattaatttttactgttgcatgcagagagaacacttcacctacatagaggcatttcttccatagagcctttgtgttcaaactgtttttttccttttttctttttttcctttttttttcattttttctttttttaagatttcaaactgggttacacactggaaaaggctgggttaagggccgaaatttaataaatctgtactgataactaaaggctacagagatttcatatattttttttaacttttagaaatcagagtgcttataaaatggctggctcatggctctgtcacccagcacctctgacgccgcctcctagccttcgttggtgagataaccaggaatagtgattccatgcgtaaacaacaagaatactaaaccaataaaactagcttatcatgcaaatattaaggcatctagaaagtcagttaaaatatattgtcatagagacagaacatctatttcccagcggacttcatgtaacaaaggctacgttgcaggggctgcgatctaccatcagtgaaatatcatcgaccctttttatgtcattacagtttcaaccttaagggaattagtgattgtaagtgctgcaattgctggtctattatcttctttcttcagtttctttcctttctgcctttgtgttgttttgtccagtcttcctcttttcctttttttttatttaaaaaaaaaatttcttaaactattgttgtgtttctttttccctcagttgcttgtttctgcttgaaggaaaggttctccaattatgttcaaaccgtaattttggacattggccggtaagatgggtgtcctatttgacacttggaaaggaaccaagctagcccaggtaccaggactgttgagaggagagaggcagcagggagggaagaaaaaagaaaaaaatacaatgttaaaatctacaacaatatgagaaatataaattccagatgcatcaaattattgctatccctattttcaaaattacagtctaatatgagataaatgtgccaaattatacatgttacacctatctaaactctatagtctattttttaaatgaaaattaagactaaagtgaggcagaaaaatccagagtaagatatataaacaattattgaattctaaccgattgaggatattctaaaatattttacattaatcaatataaatgcaatatcattcttttttgtacaggaaaaaaaagaaaaagaaaagcagcaatctgttggtaccaatatactttgccagttacattctaatcttattttacctttaattcacaagcaattcagtggtcagatgggtttcaatttcttacctgcctattgggttgaatacaattgaaaagtacggtgaaagatatttcttttctccttacaacaggaaaaaaaactacatgtttaaggtaggcccatgcataacatacaatttgaaatgcccaattatcaaacataccttaatcagagttttttagtaaagaccgaacaaataagaatcatagaaccaaaatggaacacagctttttttgttctctacagaatacccatcgtgaggaaaaacatttacaggaggccacaaaggtctctgcttgcactgattagttctatagctctccagcagttttcttattctaaccctctttaacttacttttagagagagccacagcttttccttccaattcatggttccctacattggcttgcaacagaagcctgagcatttcctgctcctccccatcagtaatgataccacatttgagctgctctgcacttgaggagtttggagtgatagatggcgggttgggggttgggggtgttggaggcagtaaatgataagattccagccttactctcatcagttcaactttcgcctatgctgaattacaggctgttaaaaaaaaaaaaaaaagactggaaaacaattctctaattgctactagcataatctccctttaaaaagtatcatatggaggataaaaaaaatcagatctacatatcatgaaacaactctacagcacacattttgggtacacttaatctaatgtattgcctgttccaacactcaaatccgaatgaatgtcagttaagtaacagctgcataaataatcatgaaccaagaaaacatcaaactgacaattcagtactcatattagtcatggcctagcatggaaacatactttcgaggttttaaatttcactgaacatcctttgctttacttttgaaaccatgaagtgagatagcactattgttgtagctatcaatctagatatgctcatttgttcatatttgaattccaaaagtacaaaaacctttacagaatatcaacctaaaggaacaattctgaattttttttaaaacttgatacatactgtttttactctggtgatacctcgatacaaaatgttgcttgttgctacacatacatatttctgagttaacatttcaaaacaatatcacaacgaccatttgtgctcaagggattttataattagactacaaactcaatgacagcaaagtccgtctctagtaaagtacctagcacatggaagatgctcaatacctttttagacaaacaaatcaattaattgtttcaaatcacacccagctatatattttcaaaagctgtcacccaagattacatatactcatgaatatgttgtgatttgatcccctataaaaagaaaataggtatctctgaatttaaaattagatctacttagcattaacaaaaattgattaagcaggaataatcacattcaaactaaaaagacacgtcctcaaaatctgatgaaaaatcgtaactcttaagaatacttgttattgaaacttttactaagcagcttaactgttttcacatatttatcttcccacacacatcttcaacaattatttttgtgctttgcaccattgattgggaacaatgttacataatgaatcatgaaacttattttaccctcaactgtgtttccactgcactttgtacatggtcctgttacagcatttattacttcataaatatctctatctgggattatcttactaactgaaaggtgaacttcacagagaaaacgacctagtcacatctatctttatagagtctgagcatagctggtgctatttcttaacaaataaaataaattacaaaaatggttatacattatttttaacttgaagtaagaagcatgtaccaaaagcaaaaggactaggtaaagcagataatccttgacagtaaaatacaatgtcaacaagcagcaaattgctttgcaaaattaacaagagtgccaaattaagtgagctcaagaaagtcatttggagattgcatgctttagggatataaagtatattttaatgattgaaaatagatgtggctccttacatggacaagtctaccaactaatggcagaaaactcagggtttattttgcaatagctctcttactcagttctttagaagagacatatgtcattattctttggaaaatgttcaataaaaataaattgatgctagtaactaacaggactcttgctgcagaatgcctaccaaatttaatttaaatgtttatttaaatctttcaaaccgcccatcctacattatgaccatatcaaaattgcagagtgcaatatatttgtcaatactgtttatgaacctttgggggaaaataaatctcaaacattaacactatgcagaccccatatatgagttttacaagtctcttattgccaatttaagttcagaactataaggcacagacattttttagagctatttttggtagtcctgttaaaaaaaaaaacttgataaaactaattcaatgactgagataacaatgtaaataaatatatttaattaaagtaatacagattatttaatttcaaaaatgcaatgtctaaaattgcatacttactcaggtaaaaatgtaatagtgctttttatacatctaactctatataaaaatcaataatcacatgtatggataaaataaacacacaaaaacaaattagttacatgtaaaatgcttaatagttttaattcatagtgagaattactatatggataatcttatgttcattccaactatctgcattccaataaaagaaatgagaatataactgaaaggatttcaaaatattcaagctcaaattcagctacttcagcaatatatctttataagtgtgcatttcctttgttttaatcaaatttttcattaccaaatcacatttgtttaggcaaagagaagatgagcatagctgaaagttgaaagcacatctttagaaaatataaagtagatataaccatttaaaaaagaaaagatataattactttgcaaaaaaatcaagcagaaaaaaacacaaaagaatttgatagtaccttaacacaaagtacagctcatcctaatgactattactatgcatataatgagatagttcattataaaatgaatacataagagctaaatcaaaattccaaaaataaaatgtttgatatcatggatactattttcttgctattttgaccaaatgtatgacatggctccccccaaaagggaagaagcaaatgaattatttagagcttaagatgcattactggtgatggtcctgcttcattttgttattggtaagactacctctgaagtactgtatttcttctaggtagcactgtggaagaaaacctaactttatggcatttacttattgaaaaactcaccaaattatgtcattgcagaacagctaagggtagacagggaagatatagcagttgatgtggaaaggaatgtagaccgcttaagcatgcttcaggttgtagcaacagcacaaaggcaaaacttccagacgatagccatgctgaggacttaactataagcatggtaccatctttggtgttttacatatgctacaccacttaattttctcagtgagctcatgagatggccatcagtatctctgtttcacatatgaggaaactgaggcaagttaagttccttgcccaaagtctcccacttagccctcagttatgactcagatctgtctgatttccctggccatttcactatattatattgcctacacaggaagtcagatgacttaacataagaaagaacttttgaacagagtggtctgaaggcaaaattaattggcttcaggagacagtgaacttttcatgcaccatacaagctggattataacctagctaatgttgcgaaagagactagtgcacagaatatgtagctggtctaagtggtcaaatgatctgaaattctatgtattcatctcctctgaaacaaatctagttgaagttctactagggtgagttctacagcgtgaggattaaggcggaagaagatacccacttcttccttttaaaaagatgcactatttctatatgtcttatcctggataaactgggcaaaatagttcatcttcgcatctacctacaaagagtaaagagctatacctttcagtgaaagaaaggcagaaattgctctcggcagccataccaacattttctggttatgtttttttaaaattatgcattatgggagtgtgtcttctaggccaaaaagaattgggcccttaccttttagctcactaacacctaggaaccacagggtgccacattaaacatgtatgaagccattacattgagccagaaaccaaacaaagtcaaagactttacatcacctattatttatttggaggtgatgaaacaataagagctattttaagaatggcaaaaatcatttattactagcctgtgtgtatttgataatggatgagataacacactagttaaacagtttatgaaatgtctaagtatccagtatacgaatatttttcaggggaacaatagtattgtccatttagaatttatatactggtttaatcatgagaaaataccatatttacttaaaagatagtaaatactctttcaagaagcttaaaaaatattacaggaaaaaagcacaaagagttgtacatattaatacatacctcaactgtaacagtagccacattatttacagatggcaataaaaatgagcaatggcccagaaagcatggggaataaataaaataagtattttaatttaaaagaagcatttgcctttagttcctttgcaacatttcctgatctccccaagatggaaaggtttttacttccttggctaaacactctaattttattggcaaaatattaacacacaagtattagcatttcttgtaaaatgcacaataaacagttctccttattaattgctgaaaacctgttgggaaaactgtgctgccctgggttgtacatgggtgcattcggactggttgcttacttcaatataacacaaaggctgcagattacgtcttgtgaaaaaaatgctcgctcagaccagtagaaggaacaaacacttaagttgaatctatttatgtattagaacaaagaaaatagtacttgataaatataccagttgctagcacttatataatgtgtattatttgccaggtactgttctacatgcttgacctaccttaaaacttttaatcctcataacaaatctatgagaaagaccattattatcctgattttacagatgaggaaactgaagcgaggaagttaagtgtcttgcccaactcgtattgctattaaattgtagaaggcaggatttgaattcgagcaatgtcattctaggatctgtatttctacccactaaacttttctcatctccccttcctgtgaagcatagtttacttttctcactggactagaagttatattatcactgaattatgcaagagactttgtgaattgaggttcatatcacaatgaaattcctgtggaagtataattcttgagcccaaaattcagcacaaataactgtgctttattcctccaattccagttgcttttcagctgaatgcagtatttgcttttgtcttacatatgtgcagatgtggctgtatgtcaataatttgtttgttgagttccacttcagatgaggctagcctggaagtgaaatacacaaagtgttttatacaggtcttgggtttcttcgatttattttcaccgtttttagggatcattattgccgtcggaatgatcctctttgcatgcaagatgattcctaatgattattactatttgtaataatctgtatcagaaagctccctggctagctcttacctgaactgcaaagtactcttgtgggctctctgggaaacaccaaatatcataaactgcaggtggctcatggaattattctaactgcaagcaataggacttcacagtaatgaaagagaaacatatttgtttcttaactaagtaggtaaatagccttctttattgctactccttggggaccaacggttttgaaaatagcatatcaaaatggtagcccatcaaacctcattaatttatattcaattgattcagaagttttttgttcttagggcacagtggattgaatgttaactttaccatgcgtgagtgctagcactttctaagtaaaataatagcatctaccattgaaatattttatctaataaagagcacagggcaagaaaaagccactccatatgggagcactgccactaaatattaaatgtgttccttataattactgcactcgtttagtaaaaaactcttacataatacttgaagccttcgatatagcaacctacacttaaataaaaacttccttaaaatgttcggtttaaacataaataagaaaaaagctcttcctcaattggccaaattaaggacttataaaaaaattgtttgatctttttcaaattttagaactgaaaatgaaagatgaaaaattattatgaagatgactaattataaataaattacagtacacacatgcatacatatataagaactcaggtagctgtgggaggttttagccaattaaaaattatacaattatcaggctcagagcaattattttatctcctcccacagaccacagcacagtggagaagcccacatgttgatttccagcctctttctgtctgtattcctctctaccctgggcttcttttcaatgctattgttaaaagtggtactgctcctcttatttgcatatgtgatgctttaacagcagataaaattctctacaaaaatggtgcttcaaaatagtgcctttcactagagaaaatcacccaaggcatactaaatcaaatagaaatataagttttatacaaagcaaaaagagattcttttataaatgattttcagttaaaagcaaaaatcagcattatttgcacaattttacctcttaaaggtgaaacttacttgtatcagaatgctgaagcataaaattacaaatgattaaagaactgaacacattttaatatcatgcttgctactctgttcacaagggcaaaagatcttacatgggcaaaagatcttcctgtgtgtgaaacaaagtgagcaagagagaataattgtaactttctgcaatttcagaatattcaaaattcgtgttcttcaattacttgaccttaagattttgccatttcttttatcatttattatgtttattatgatatttattcattcatagtctttgttatttaagtaaatatgactaaaaaaatcatcatatccctactaacagcactagcaaaaatgagaaccaaaaaggtaagctaataaatggtgcactggctgtcgagggaactgatttcttacggacgaactacatctgtaaatatggcactttacataaaacatattcaaataaagtaggggtttaatatacttcctttcactacaaagggttaatcagcaaggtttacatttgggaattttcagaatcacgctcctccctctccagtagcgctgccaaaaatcatcgacaggaaacgtaagattaagtttgtcctacctaagcgaacaaagagtgctctgaacaggccaccggtttactgcagagcgggaacttttctaatcctgctggaatctgcagtcctgctcagaaaatatcacggaaaaaagttgttttctttcctctaacatcttgtctcaggatcatctcattttggtcacactgcagatcctgctgcttctcccataaaggttaacttaaagctccaaacataatcatgtggaaaatggacattattgattcctatggtccattgttcccccaacctaagtccctgaagttcaagttcaatctggaattacatcatgtctggtttctcctggttaccagacggcttgagacgtgaccacagctacagaaaaaacaaacagccttcttcacgcttcggctcccctatcgattcaaacgtaaactttttttctttctctcaagtacgcttcaagtatggagcatggttaatttagagattaagttccaaattagattatctaatggcatcttaatggattgctgacccatttcctgtgggatggcagcatgcaagtctggctggaatacaattaatttcttaggaagtgttctgaagagtttgcctagataaaaaggaaatgtcgtgttgtacaaatctttctttataaatggagaaagttaggcaaaactacgacaaatcccaacatattattcaaaagccagaccacagatgttgtgcgtccgtgaaaaccatatcaagatcatttttaagaatggtaatgtttttatttttgatttcataacaggtgcaaataattttgatgagaatagagtaattcctttaaaaagaatattcatatacaaagacaaaagtagttagcagcccctttaccaaacaatgatcatgtgaaattttggtttttgcaattctccaccttgaaccaaagattcttccattcatctaccatatcagcatttctatcatagtcccagagtggtgctaggggcccagaatggtgtataaaaagttgaggatttgaacacactttagagctgacagctgaaaaggaaattcagcactcggagaataaagctccccccaggaactccaggaacaacccagctgttgtactgtagttatgtgtcaagataacaaactgagagcaggaaatgctaacctagtgaattcgcggggatgttctaagtgtaatgttgaaataaaagttaactctttatattacctaaggacatactgcccttatcatacgtatgccacatatatgtggagatatacacacacactacatacacacacacatatagatgcatacacacacaaacacatatatgtaatacaaacatatggtttgcaacccattattgaaagttattttttgtttaaatattcattcttttgagagcatacattttacaaagaaaatgttatgaacaaagcaaggaaaatggctgaggtgagtgttatgcaaattaagttacatggataaaatgagagctattacccccccacactttttttttctttctttcttttttcttttttttttttttttttgccctccctctcctgaccaaccagatccaaataacctttactggctgctaaatttctcttgagaaatcaagcaactctctagaattgcagtaataaacgacaatttcttagaaaaacatgtgtaaagtaactacagaatgaagtattcaacccacagaaaggaactgctaacacatgtaacacggaaaatagctgataaaagtctctttggtgccattcaattatggcatccgcagaaacacaaaaatcctcccaattattttagtaaaatcttcatttattcattatttcagaggctgagcaaatggtttgtgtaaacatatcctttggtaacacgcgcatgtttattttagccatctgaagacttcttctatgtttacataagccatcagacacatacaaccactcacttgtggctttgcgttttcttgaaaggggtgaagggagagaagagagaatgaaacaataaattcagtttctcttttgcataaagcactccctctaatgttttaaaatagcttatgtttgtattattcttggattgtccttcagctttctttttcattcaattatattgatctttcatatctgacagtacaggctatattctgactatcactttaagaaagccagccagtcagggagtaactgctgtatatgtttatgtccacataactcacatatgcaacaaggtaatttgtccacatgagacaaagcacaaacacaacagtacctaccttaagcagttcatcacctatcatcctcctaagatcttgagcccattctgactatactagaagtgagcccttcacccaaccaatattttactctgggttaactgcagttcctgacctttcacttaggcagaaaaattgactctctcaaggtgcaagcaactcctttgcacatgtgtgtgcacacacacacagttcacaaaacagttcacaaaattttaaggtcaaaacaacaaaacatcttcagggttgtaacctaataaggctgtgaaaactttcccaaagagtcagctttggttcctaagggaatgcttaagccttggggttgcgggtggatggaggaaatcttccagctttgattatacttgcacagctcccttggcactgccattttcagttccgacaagagctgcatttgacatggaaacacctcaacagggcaattagtataaagcagaaaagagggtgaccatggaaaagtgattgtacaaagaaagtaatgacaacaaacaacaatcaatcaaaataaagcaaaaccaaaacacccgttttgctttgtccttttctacaacagtctccagggattgccttttgttaaaaggcatctaccacaacaaaaataacctgtgatattttatttattccatcgtgacaaaggcaaattatttaattctttggatgaacagacctatatttcttaaatattttcaacttattcagatgattctaaagccatagccatgccctgaagattttagatgtctattatctgccttaaaagtgctagtgttacagacatttatgacttttttcaaaattctttcaatgttttaaaaataaccacaagtcataaactaaaaaagatggataaagctatcatgccaccgacaagggctatttgtattatcaaatatgaactctgttgtgtccatttttgaaaactacaacaaagcaaagcaacctatgtcatttgaatttatttattctgaactgcatcacacctagattttaagaactgtcagcattggattcaccacagcatttagcacagctcaccataaagattcaataatatctgttcaatgtagaaatgtgatggctgccattatcaattatgtgctttctgaatcaggatagaaagagaagaaacaaaccaagatactggctgggcatggtggctcatgcctgtaatctcagtactttgggaggccaaggcgagcagatcacttaagtcaggagttccagaccagcctggccaacatggtgaaatccagtgtgtgctaaaaatacaaaagttagccgggcgtggcagtgcacgcctgtaatcccagctactctggtagctgaggcgttaagaatcacttgaacctgggaagcggaggttgcagtgagacaagatcgtgccactgcactccagcctgggtgaggaagtgagactatctaaaaaataaaaaacaaaaaaacaaaaaaaaccaagataccttttaaagagcttttaggatcattaagaccattctacatgccattacctactaatcaaaagaaaagttacaatttttgagagggaagaaacattttacctaaataaattctgtatttttttctgacttactatgacctgaaactgattaccacatcaatttttcaccaggaaggggatttgtgacagcaacaatactgccctaagaactgagtttaatcatcagattcatttcctccaatacatgtgttctgagatttattgcccactcatcttctctttccatgggctatcaagtttttatttaaaaaattactgtggccgggcgcggtggctcacgcctgtaatcccagcactttgggaggccgaggcgggcagatcacgaggttaggagatcgagaccatcctggctaacacagtgaagccccgtctctactaaaaaatacaaaaaaattagccgggcgtggtggcgggcgcctgtagtcccagctacggagggggctgaggcaggcaggagaatggcgtgaacccgggaggcggagcttgcagtgagccgagattgcgccactgcactccagcctggttgacagagcgagactccgtctcaaaacaaaaacattactaataactaggtaaagttacattttaaatctctaacaacttacaaatatgctttagaggtctatcctatttttagatttagtaagccaatcaatattccacagaattggaagttcgcatagctataggtgcatttacaaacatgagtacacgtcatctggtttgcaattgttataaatatggtaagcttgtacgcagacatgagtcattttgttaactgatagagcatgaaatataagagagttattcaataaaatatggaaatattaggttattaaattcaattaccttttattaaataacatatggaaatattaggtcattaaattcaattaaataaactttaaaatgtatattaattcagaatattttaatgagatactttcacttaattaagactattaatcattaaggctatttggataagatggttacgttgagtttatcttctttttataagcatatattgtattattttcaaaagggaggatgaatacaatcttgttaaaaaaatcacaatatgtaaaaatgtataccttttaaaagtggaggttatatcaatcttcaagaagaaaagtcacatggtagtgaattaataaaaagtcattgtttttaaaaacataatctgaattatttccttaatttttatctgaattaaagtggacatttaattattttgattctttaaaatctactcttcagcagtttctgtgaaccaatatggagataggcagacgatctacaactctatctgagtatgtacctttctatagacactttccgtaaacggaggattaacatcagagcagggttggaaaattatgtcaactctatctggtgaactccttctgggattacctcactctcttctgccaatttttatttcttattacttatgattataccatgaatctaattatttaatttgtcaatttgacacaatttgttcttaaataaaataaataatacataagcgcagctgactttgaaatacttactttctaaaggcaatgcatgaaacagtatcagaactggttttgaaaatgaagttttagaatagttttctcagccaaccaaataaggtcaatcttccatgaatcacatcagtatacaaacagaaattaaaactttaacaaattccttctttagttactgattccaacaatcttcctactccaaaatttatgggtgctgtcaataacagttaaattgactaaccaaaattttttgctattttttttccctacaacaggggaaaaaaatgaacagtgaaatggcttagaattagcagtagaggaaagagttaaaataagaaaaacctacaatgtgaaaaccaatgctttatcctcaggtagctgaaaaatcttcactaaagctgtgatttcacttttcaggtcctaaaatctaaatgtcacattccaccccctcccccaccaaaaacagtataaattgtagaaaacattttatagcatttaaaaattccaatgatcagtaagcatatactatagtcccaacttaatttgacgttccatttacataagaaataaaggaggaggacagggaaagaagaatggcatagccaaaacaactaaatttttaacatatattttctgtaaagctagttaaaaacaaacactatagctcatgtaatttttaggtgtaagtgtagggttggaaataattaaaatgttacctttgccaagtaattcccaatgtatcctcactggtactggggtataaatgcctgccgttttgattcatggtccagtcacaaatcctcagctgtcaattgaaacctagcagtcagatatggatcgagcagtactacagtttttagtatttaaatgaacacatgcaaactagtactgtacatggcattaaccttactttcccaagaggcaacttaaagaaaaaaaaaaagcaaaaaaaaatcttattcttgaaaagcaaaattcctagactcttttttagaaaaagctattgcaatatgcttctctattaattaaagcatacaagagaaacaagtgcttagaacataacaattagccattattagagcacaaattgagctggaatgaaagcaaacgttaatgttcaatagagagatatattttagaaagaaaataaaaatgctttttttctatgcatcacaccaaataatctgcactgaataaaataatcaataactttaagcatgcagtttgcaaaacacagaagacatgcagtttagaggagaaaaggcccaccttacaaacattcgccctaacttgtgtttagaagcatcaaggtcttcagttttaaccttttactaattttgttttgcttaaactggcattgtttagaaagagttgataagcatttctagttttattttaaactcagagtaatggcatttaaaatactttactacatctgaagaaagtgaggaatgcactgaatacaagctgaaacaaattcttcccagatctccgaatcatcagctctgcccttcagagattgttcgagtaaccctatccagctctgcttggttaacagctgccctacagtgctagcagatttattgaaaagatatattgcttatttttattcttaagaaagtaaacttatctgggttggggggggggaaacacagtagaaaatcatcgtttttaaccttcagatggccacactgtaaattaacagcatcttacattgaaaagatgacttcttcacagtaatccactaaaccttgtttgctgcttttcagtgagaatttccagatgatgactggaaccaaagtaccataaattatcataaacttaaaatttatgataaactattttaaacatttctgataatgttgtggccaaagaaataggctattaagaatctttactttcccttttagactatcgagcttctgcacacactaagtaatagtgattcaggagttttagaaagatagtttttgctcatttttctatcgatctatgaggctctaaaaatactagctaaaatttccaaaccacgtgttttagttatttgcatatttcaggatttcaagtaaaagtgattttatgatttaaagaactgaaaaaaattccctgcatatacatagatagatcaacagattgatagacatgtagattctgctcaggatatatgtcataaagaagtcataaatcagtaaataaattagaaagaaaaataaatattctttttttttttttgagacagtctcacttcatcacccaggctggaatgtagtggcaccatctcagttcactgcaaccttcacctcccaagttcaagcaattctcctgcctcagcttcccaagtagctgggattacaggagtgtgccaccatgcctagttaatttttgttagtagagatggggttttgccatgttggccaggctggtctcgaactcctgaccttgagtgatccgcccacctcagcctcctaaagtgctgggattacaggtgtgagccacgggtgcctggtcataaatactcttaaaatggaccaaaatactcacatgaaggaaaaaaaagtacactttgctttgttttaaatcagatgacatactttcaatatttcaaagaagtaaatgtgttcagtctagcgggaagcaatatggcaagatttcttaaaagttctcaaaatgggtcgtctaatcaaatttagtgtgatggggcaaattgtcttctgttttttttttacagttttttttactgtaaaagttttaaaagtacaatgaaaacaatcaaaaaacagttcaagaaacttggctttgtataacaagaatgttaatgatttatcacttactgattctactctagtcaatgaaaatggaagggttttgtttaatttttatttgtttgttttttgagacaggctttccctctgtggcccatgctggagttcactggtacgatcatggttcactgcagcctcaacctccagaaatcaagtgatcctcccacctcactctcctgagtagctggaattacaggttcgtgccaccatgcctggctaattaaaaaaaaaaaaaaattgtagcgataagatcttgctatgttgcccaggctggtgaaaatgctagttttgaatcaaacatttggaagaggggagatgtatatttaggcatagtacatattaattatgttaattattaacttcagattagtatctatggggctctcagcttaggttggagaagttttcagaaaaataatatgctttcacaaagccaggggaatctaaataccactcactgattgcttattgtcccacagacaactgtaggaccacatctcctcagaaggatgtgttgtaaatgagttagtttttttgttgttaatgttgctaatattttgtctgtttgtttgttttacgacccccaaaaatgtcaaatgggctatctttgaccatatgctgcacacataaaaatgaacgtatttttggacttttcttttctaaaagtagtcccaaagtggataaacctgactacagctattcattatcatctatttaagatatatgcaatagaaatattttctcccaaacagaaaaatatgcttaagtacattcaaaataaacaacaaatatatttagcaataatttaatgccaaataaattggcaatatattaattagcattgaatttccttttagttactaaaaatgtaaaatataagaaactaatttatctgtttagattgtgcactaccattacaacatttcttgaactttctgaggagacacgctataacttaagccaggttacttgagcaagagcctctctcttcatgttggtttttttcaattaataaaccttcttggtcataaagcatcttggaactaacaaaactccctgataaagtgaaattttaaagtgatggtatgggtgggggatgcaattaaatcattaaaatagaaatcacttattcaccaaagatttccatgatagtaattcctaagaaaatcaatttctaatcttatttgaccaagatattcctgaccaagcaaattgtgaacagactctatatattaaaaggttaatactacatgtatttaagcttcttttggggtcatgttacatattcttgcctttagcataattcagttttcctaataaaaaataattttacattaggctttaaataagtttaacataataggtgataatcttttttgagtttggggtggtgattccttagtttctgtcctgtgacagaatcagtgttaggtaattcagctgtaaattctctttttttattttaaaactttaattttaagtggcacataaatacatgcctttcatttatatagaatttttctaagttcaaagctttaagaatgctgtaagaatttttccaagtattttttattaagaaataggaaattgcttttttctcccaatagtaatcaaatttaaaataccaagtgccactcagtttagaaattcagtctgttagaattgtctgttttcatgtggaggtggggaacaattcttatttttgtaacaatatagactctcaaaaagaactgatcatatgcatatccttacaaaaatgcacactcatataaatcattttaatcctttaatttatatgcacataccaatatgaaattctattgtctagaaaatgcccagaatttcaaaaccaaataaaaggtgaactaagaaagtaagattatcttccaaaaaagctatcagtaaagggggaaggttggaacagtttaaacaaataagaaagatgtgaaggtgaagttttcactgcatatgttcttagggtggagttctgtggtctctggaaagagaaccttgttcctggcccagttcaaatcagattgcttcaaagaaaaaaagaaaaaggataggggccatctggttcctctcaaatggctacataaaggggaaacacctaagatttggatcattatcctttcctaaactacactcaaataatcatgtaagtagcagatagccataaagaattaatattgcttgtgacttcagactaatagtttgtttattcaaatgggggtcctcctttgttattaacagggtcttttgttaaatacacagcaattagctttgggaacaaaagaaagaaggtaagcaaaatgttctattttgctagactcagcaaacaggctgaggtactaacagttcctacgatgacaacaaatctcaactgaaccaataaaccattaaactgtgaacagaacaatcaacacaggcaaatttaccttctcacttttttttctttttacgtttacaatggccctcaggagaacatcttgaaaggtatgttttatgttttcttgtgtttcttcatttctccagaccctcaatgaaacagatttttaaggggtgaaggctctttttgcggtggaaaacagatgcttaaaaggattaacactccaatattcatactttggattaggagaattttattttattgctaatattaattacctacatggagcaaattaaatggtctctggatgaatagcatgtaacctctgaaggaatggtatgaacaagaaaaatggtcagaataaaattgtgttgtatgtttcacatacaacacatgcaaaaaaaaacaaacaaacaaaaaaaaaagatactcaagatcatcctcatatcttaaaagtcacttctagtgccaatttctgaaacccatgtttcttgatatttaatttaattagcagaagtagaattaacttaaatgagtatgcatagtccatgagcagaataaacattattaaccataaatcataagataagtattagaaaatgaaagattttgtttttaaattagaggctactacaacttgtaaattttaaggtttcaagggactttggagcttatgtagttcaacctcttcattttcctttccaaggtttaaggacttgtccaaggttagaaatgccctgtcacatcaacactaaaacccaaaccttctgactcctaatccctggttctcacccactacaccagttgcctgtcattgttcctttcctaccctgtcccttatgtgcagttcaagaatatttaatgctaaaatatctgtaaataaaaccttcagaattccctctacctccctgattcaactgagatctaagttaatattttcagaaaagaagataattttttccttgtgtttctgttgattaaagttaacgttacataaaatgtaattttacttttacattaattagaacagcttatctggatattagtctttgattcccagtaaaggtaagtgaacaaaccagggaatgacaaaagacagacaatggaaggattttttgaatttaagaactagccaaagagctaaacatttgcatagccattatttcgactgaaacttcctttaaatgtgtttcctttcaagccagcatacatgaaaagtgacctcttatccacttacatacctacccagaagtcatgtgatagcgttttacgtcaagctgtcaattatgataacagacacaataagaacagcccaagtgttgatagcctgcttcctgactgtattgaaaagtttgttcatagtccacttgtgtccttttaattgcttgcctctaataaatgactacctttccaatggtagtaccaagctttggctttgccatttgccaggacaaatattataagaagatttaaactaatatcttagtttaaaaaaatcctacagaagtaatttcttaaaaaggccattttgtgtaacagaaattttcagtgtaatgagaagtactttcaaattctagttttaaaaacaaaagtgttataagaaaagtgttgaaacaatttaaatatacactagaccagtaattgaaattcaaataatagcattatatagtcatgcaagagatgtaacatgctgaagcccaagcaccaataaaatccatgcaactgtgagaagtaatgcaaagacctgaattgatcaggccactgattcattagctcttattataggtaatatatatatagtcaggagattataattttgagattatgaaaataagaccgatttcttataaactagactttacttgactttattgtctcacttagggaaggcaaaagtgagctcctaatttattcagttgaaatctcaaatatacatcaaaggttaatatgtacttcaatggcttgtttgaatggtgaacttttatttctaaacaagaagcttcttagctgcaaactttttatttccaacttacaatgagatttttaaatatatgttgatgtacaatagtaagaatttaggctcttattatgaccttagactcaaatgtaatggtgataatcaaattagccagattctcttgtattaatactaccaaactttctatgatagcaaaggaaagaggcctgaaattagcaactcactatgaggtagaccagataagaaactggtgctaattcaagtaagttgtctcttattattcatccatgctaaaattgttagactgaattataaaataatttctatatttcctaagcaacatccaacactctgattgatagttcccattttctcagggagataaaatttgggaaacgtggttccttcattgcctatcataacgaatttgcacaatgtgttcgtgaattataaagtatgagagagaaaaggatatactgcattttactgaacttctatgaagttaagtcggggcgggggggtgttccacatttctgaaaatgttccaaaccataaaaagacatttctcagcagagactaatcagttcagtttgccaaagcaggacccatgagttcttcaagccaccaaaaccatcttccaatagaaaagttaaagaagaatgaagctccaactgaagttctgattttaagatttcccccatgccaatagcgaatgcaataactaaaccaataatcccaaagacagactagttctagacttgaaaagtattcaagattgtgttaagagataaagaaaaagtctaaagtcaaatactgatcagctggtatgtgctgactattgtgactgattagagaggattatttttaatggcagattatcaactggtttacatgaacctttttgaaatagtctccaggactatgtgaatttattttttagattcaaatgagatatattttcagtgataggtgaactttcttccagtcagaataaactagtattcccaagcagttagcaaccaatgccatcagcaataattattataaaaaggaacacaaagatgtataattactaataacaattgtctgtgtaccaagtaaatgatatgaaagtgtatacttttagtattcagatttgacactatgaatgtattactcttacaggtgaagtacagggttcattttaacattagaaagcttttcatcttaatttgataatgctagtaagcttatgtattagaaaatgaccagattggaaactccactgtagtatcatcttgtggaaagattatttataaaatagtcaaaattacatgaccactttaaatttatcattaactctaatttatgtaggctctattaaagttcttttctaagaaaaacaacactcaaaactacacatcagtacttttcataacctaaaaggataaatctttataaagcagccaccatgaactgaagaatgtacctggtgacgatatttattcttaaaggatcatgtatattaaaggctatagggaatgtttaaaagaaccctctcagactaaagcactgcctttctaattttgaatttctcctagctaatataacatgattgattacctttatttcatgtaccccttgattttccttttcattcatcattgagtgctttaaaccaaatgcatttagaaactgcctctagaagaatggtctcttttaaatctttgtaaagtaatgaaaggacacagtaaatcaatctcatttctactgaaggaaagaataatctttactgaagtcatttaaactatttctgtttctttattcctggatagtaaacataaaacttcatttctataattcttttaaaatttgaaaggctaaaatgaataggcttttgactctagccttagtttactaatatacatctatagcatgatatgcatttatttacaggtattttctgcatgcctcaaaactggagttcattataaaataaagcatatatgggcttcttcaaattaaaaagcagcactaactctttcattacatagaggacaaattatctgtctgcatggtatttaacattttcagctataaagaacttttttttgcttccaaagattaatatatatcatgtatcccataagtattaactatagttgactgaacaaaacgtattcacattgtaagtggtctcgattcaatgttgtccacttaaataagtggctgtcttctttgattttaaaatagtttatagttctagaactcatagtttttaaaatatatcatgtgccagaatgctatctacattaaaattcatattttcatgatgcttgctaagttttcttgatatatttttagatatgtgaaagaagtaattcttatgttaatggactttagtaatcataattacatgaggcttcgacatttatcataagggataagaaaattaaagctgccataggttagggtagtggaggaggaaggctgcctccaaatacatggaattggtcagagtattctaactagcatttggggctaaaggtttaaataatggaggcatgttttatgcattaaaaattaactggaaattagagatgtgtcataaagaataatgcaaatcccatgagaaaaatattcctgagaatatgtgtaatgatttttaaaagaacaagtttctaaacttatacatcctgcatatgttttttaaaaaacacaatggacacatacatctgtcaaatagaaccatattctagtaattataactcatttcgtgttataacaattttagaggtgaaaaaaaagcaacattccagagaattatgttgagaagccaatggctggcaaaaccactaattattattatttggtattttcataactgtgtacagatgttttcagttagttctcactcttttggtttgttttgttttgctttttttaaacctggcaaaacatcaagtattctgaataagctatcatctttatgattttctctgagctctgcatgtggtgacctctaatatgcagtctgcccccttgggctgcaactggaaaggacttgagaactccacaccaagcacagttgaggtaggtcacaacaagggtatgtgaggtgaacagatcaagaatgaagtaagtgggcaaaagtatcttactacctacacaaaaagtcatatatatgcacaggcaacttataaataaagagcgagttagttaacaccagctctttattatttattatagcctaattttcccctatgtaatattttgcatactgttaatttcaaactgctctgctatcaaaacttgagagcagcaaacatatgcatcataaaatatatttaaattcggaactgtttagaattacgtctcttatcctgtaactagaatcgtgggatttctacattggtatggtccatgcttttgactgtggctgatctgtttataagccaccattaatcctggctgtatgttttcacagtttgggtaaacacttcatttgcattaaatttacagcattaatgagatgtgaaatttaaaatgctactagaaacataaatgatgtaagaaagcagaaccaaaaaaaagtgttttatcacatctgaaatcagtaaaccaatttaaagctattaaaataataggaatgaagtgtcgcctgagattttaacttcgtaactcatcgtcttggactaaaatacaaatgtgaggagcaaaacatctggaaaataagaaatcactcaaaaactcgaattatatactgcttctattctagttggctttaaaacagtttgcagtttttgtctttgaaagctatagtctgtaagttctcaatagccaatgagactgagaaaaatacactttggctgaaacactattactcatggatgttatcaatatatgctacagagatggaaaaggtcatgagccaatttgagaaactctactcaaagaggtgagaaacaaaggatcaatgagaaaaaattctgggaaatgaaatgatcagttttggtctcagaagccccgggagcccccttctgagtccggatctgagaggcaacatggagaagcacggaagcgaaagcgtggctacaccgtcacacctgggtgaaacttgcccacctgttgctgatgtaggaaggatgggtctcttgggcttagtcccacatatcgattggcttgagatgtgcctgaggctgtgtaggctgattaaggaagaacaaaaacaaagataaaaattgtgaactatcagaacgaacaccctgtccatgtataagaaacccagagaagtgggatttgcaaccaaaaaaaaaaagtgtcttcatttctcttctcttttgtctgagtgaacaccaagtgatagaaaagaaataataattgacttcaaatcaactagtttattccccctaaaaaatctatccagtaaagcagatctcatacttcagtgtgggtgtctcacacttacatgctctagtaactgtcctgtggaggtactaaggattggataaatagaagggccctgttcctagacgtactttttcaccagatagtagttgtctaatataaaataatcaatgatggtatatgattctaaatgtaaagcagactgaaagtccgccaggaaaaagtgacagcttttaatgatggaatttaagcagatgttcttaatgatatgggatggaaaatgtctttcttaaaagttttgctaaaaaggaaatcaaatcttactatcatgaaggagaagcctgtatcatgtagaatgaatcagctcggtattttacctgtgaaaatggcctcaagtctgataggaatgtttttgaaaaaaagtacttcccataagcacacatacaaaaatcaattacttgtaactgatccaggaagaaagctgatgcacctttaaatagttggccactaggtagtaagtatatatggtgactattccttacattgttatagtctcatttgcaagtactttttgtacaactgctttttgctttttggtatagagtaaatttttcacacacacaaaaaaaaaatgaatagggagctactcctaaagacttttgttacttttcacaaggaaaggactgaggtatcttcccagaactaggcaatcccactgctccatattaccatatattacctttattgttctgaagaaagctacactgtttggtttaaaaccaccagattaatgaggaatccaggcttcattttaaatgaactggctttctaaaaccaatatattaattctgccttgttcacttaaaggactgcagaatttgatccatggaagcttttttaggtcaactttttaaaaacagtgaagatgctcacaattcatattttaattgctcctgaataaggggacatgcaaggcagccatcagcaaccagtgacccctactcaatctccaagcctctggaattcaccacacctcacagacagccggagatgagcctcacccttacagaagagcaccaaatctatgctgctttttcttttcaactatgagaaagagccttccttggcttctgtgttttctttgaccatagtactatatcaattcaatgaccagttttttattactggtggtgcctaagaagctggagctacaagcttgtttataggaaagaaaaactactcactatgtttcttttatgtaggagtggaaaatggactgatgcagccatctttatacaaccaagatactccttttgaatattttgtaattttactagtcaaatcagatccctttttgaacaacctgtatgtaagtataaaaacaattcattaacaaacaggctgagggtactcctataagtgaactgtgatcatttgggtctgatcctctcctgaatctcttctattaataacaccacaagagtaggcatcagagtttctagaacttggttttgaccatttatcctgtgataatctttcaactacttaaaaaaaaatctttgttttctgtgtgcttttatttaaattgctgacattgtttgctcaaagatgtgaagacatccacttttaaaatgagtacttagtgttttggtgactgtaatgcacatagcaaacctctagaacaaaataatttttagtttttcctgagtaggtcgcatccatctgtgcattcagggaagtattctaagcattaagaattactgatgggtattacaagcctataggaacttattaattgacggggctcatgaattttgagaaagaaatgctgaattcactgtacaaagtattgtccatttttcttatagggttccttcctagtctttcagaaaccataaaaaaaaaagagcatctttccaatggctgagaaagaatgagtggtgcatgcctctgattgtctctgattcacatggaaatttcaagatcatggggattttcttgctctaagaaagaaaaaaaaaaggtttgaattgaagatatctgtataattggtgaggtgcatgctaattccaccaattcgatagctttatccattctacttcaccaatttgtacattccagctccagtactaagaagctgacagttgggtgaaaccacctcaaaattaatttcttctatacttctaagtattttacatgaaaaaacaaaggaatgatgcggcttattggtacgtgttaggaaggttcactggctaaatctctgacatttaaatgttatggccacactaaaaagcacagtatttgatgtaccaatgataagcaaaataatcaaaaggttttaaaaaaaaagcttgcagatagtgaaagtacaggtagcttacatgtgcctaatactaagttttgaaatgtcctcatctgttcccaaccttatgcgactgtttttaacaatgacataacctacaatgatgtaaacatgcaattaccttacagaggcactgattccatctgctttgtgaaggggcttgatttctataggaatgctccaataagtaccaattacctaatctctctttgggtgatacgaaaactttgtattctgcgttatgttactcagtgcaatttcaatgtataccttgaacaagcaggcatgacttattatttttgttatagctgttaacttaaacaagtgagcttctcccttttcaaatatgattcactgactggaatttgagaagagagagcctgtgatagcagggccacatccatgcctgctagctccacttaaatgagaaatctccatctggtcaggtagctggaaaaattgccgtgttttccaccttggatcagatatccaatggtgcctctgatggacatttctcatttcctatggaaatacttactggttgctgtaggtgaagctgcctcaccttcagtggatgtagtgatgggtttagtatctgtcatgctcagggtcacaggtcgcactgcactgggatggggagagggtgccaagacaggagtgaaatggccaggcactttccctactacttgaccactgccgttaggctacaaaacaaaaacagaatgccgggtgaagcaatccaaaaggcagtcatcttgttcaacaagtccactcagcacacacgactgtgtggatccagcacactgcgcataggcgccacacaggccctctcgagtcggagtcggagaggccagtcaatggttggtagtaataaggagcagcagcatttcaaagaaggttttcatcttcaaagcacgtcatggtataggtgaattcctctttacagcacccctgagagccaggtagacttgatcctttcatgtagtaggccaagaaactcaagtgcagacttaaatgcttagcccaaaggctaaaatggaattccttactgaactagctacagttggaacccaatgcttccttattctctgctcttcattttctataatgagtcagttttggcttttagaacacaattttcacctacatgatgatatcactgaaacaaaggacacaaaaatatctaggagatcaaatacaacgaattctggaattttcatcatttacagtcaagaaccattctcctgcatacaaaactctagctctcttacacacaggtgtgctgagatgcacacattaggcaatttagattccgagatctatggtcaacttttgatgatttactaatacaagaagatagaataagatgtaaagcatctaaaatttcagaggtcatacaatgatataaaatgctgagctacgtttgtccttacacctacaaataaaagatttccaaagtaaattaaactgtactgaggggaagcagaggacaagcaaatgagcattgttatttgagttactcttacatccatggtggtgcatggagagttacacaaaacatttcttgttgacatttgtgagaattaactgagaaaatcccctgggcaatgatagaaaagatgttactatctgagttttagctcctgggtacaaaaatagtttccgtggtaggaaacaaaatcctaaggatacactctttgaagaaatagtggaatatatttttctagactgagaatgttatttttgattatacccatgttggaattctccactgcacggtgttcatcgcaatttgctgggaggctattctcggcaagtatatagtctttataatctgaactgttaaaggcaaaaaaaaaatgaagcagaatatttttctaaatatctgcacataaattacaagtagacatttatttagagaaaaagatgaacagctaataacacttaaatattgtgacttagagacatgaactaagtcttcggttaggctcctcagaggccacattatttattctataaagaaaatggacttcctgaatatcctgattattcatcatgggtaattttaagtatttaacttgatgtcaggaaaattgaccagagttttccaatatggaaacctatgggagagttacatctttaaactaattttattcaaaatattccattgaatagcatgactgtctcactataattggtgcagcagtaatgcaattaatctcaaaattgctgtggggaggaaaaggcatctcagttgcttatcttaaaaatcaaaatcagtgcagtgctggagaatattgggaagcaacagctgactagaagtgaatggtgaaggaatactgatgtttttccatttctaaagctaaaatggtaaataccaagaattctaatttgaaatgcaaattaattggttttgagttggagttaaaaatcaaagcagatacactgttccttaaaaaaaaaatctgcagttaactataaagacccatttttcctttcaaagggaaaaagtagtttgtttctacagcaggccatccatttctggttatctgaacactggaaataagtgctttaaatatcttaagaaagaagacaggtctcattttatcattggtggtacattcaatggtaaaaatgtttctacatacagtgttcaccaaaacagtctgaaagtacctacctggaacaaaatgtctggagcagaatgacaataatttcaaggaaatgctgccaccaaatatattatcctaccctgaccattctacaaacttcacctactggaattgaacaacatgaactagtagacacttctctcatttgaaaagaataaaggtgacaaagaaagaattcccaagtcaatgcagacaactttcctaaaactcagggtgagaagaattgagggctattttctcctcagttttctactggttcaaacagatgaagctacactaaaaatttctatcttttaaggctgttaatagatgaactttcatactgtagatagaaaagagagatgtcttgtctgaaggtgaagctaacagcattaggaaaggattattctactttatacacggttcctattatacaaaatcctgagagtttttttgttgctagtttttctttttcttttttttttttttttgagatgagagtaatatgcttccttagaaggtgatatgtatcttgaaaaagtgaagaaaaactgagaacaatataggcagattatcacctaatatgccctcttaacttataaagaaattgaaatatacgtaaaacaagcactgaataattaaagaaatgtgtaacactaagggcctgattttaatttgcataatttttcccctaacagtgcctaattaagacatcagttaaaaaaaaaatccaatggaactctaagattttccacactgaattaacgttaaggacttttaatggatgtcttaattagactttgttattcatggaaattctacacaaattaaaatcagaccttgtgtgcactgttcccagctgagtctagcaaaatgctctatggaactgagacttctgaatccatgagctgacaacaaattttatttctaaacgatatactaagatcccactctcacttagctgtctttagtacttcagtcatgaaaagtgctacaacattttaacattttcttctaaaatacaaataataattttaacttcaaattcaaaattcaatattgagtttaatatctcagtcagtcaaactaaaagtaatgataactttttaagtaacccaaagggtcctggatgcgttgttattctaaattaaaagttcagaaaggaccattttgtttcattttaacaaattaagaccaaagggatttttttctcacctttctttgctaatttaaattgatagacacacactatttactagcatttcaggaatgttccaccgtagtaatgacggaatgtttgtgaaaattctccaaaatattaaaaggtataataagtggacaggagtcttagaggtaaagcagcaaagctaaatatcagatcctaatatcaaaattacattacatgttttagatattacaattattgatagccccaggtctggcacaaagactgtctacttgattgtggaaaatgctcatataccaaattcctatgaagtaacctcttggtagaagaaaccatatgtctaggggagtgagaaatgctcatgagtcactacacttacaaaatgaatccccaaaaccactgcacaatgtttccaaaaaaaagaaagacgcttctagtaatgtcactcattattaaatgtaagtcatgtctctgcaaagaatattcaagtagtcatcaaacactgagaatgtttacattaccaaagcttattttaatacctaatagttggtctataaatacaactgtaagttcttttgtgtgtgtttattttagcacataccttactcctgcctgaaataagcacattgtctctgtgtcaaaccaggtatttaagaggtgtgaactccagcccagagctttcctgtcaatgtactttctgcataaactttcccttcagtcagtgaaaatccaaaaacattaaaccatcttcacaaatgtaccctttggggcaacacacttcctacctgtcattcagccacctttaaataaaaacttattgagtcaccaagcaacttcctgaagatggatttcaaggcttgacgttctgccagacacactgtctgactaacctttgtgtctcagaattagatctgtcccatctcccttaggtgctaatcttattttctctcttatttttacctggctggtttgtggactggatgggtcataagaaggtacatagttcttcagagtatcctgaggattcaggtggggaggatatctgattgttggatgagaaaagtagctcgatggggctggaggaaggatagcttgtgttggaaatggcaacggtgaaggtggaggtggagttcgagttgagatgactgcagaagacagaaaaggaaagattgactcatcagctggttaccttattgctccattctgatcctgaagaatgctgtgaaactacaaaactggtaaccattcatttttgtccccatgatttaaccaagctctcctaaatcaacagttactttttcatttttattctcaacaccagtacggctaactacacagagataaaacatcactctagaaaattaacaatcttgcttcctggctctgtgagtggttacaaaatcagtttctcttttataggttatgtcaatacttgataaaacacttctttgagcaaagatatatcccgttgaaaacatattctttgattataaaatctttaggccgggtgcagtagctcacacctgtaatcccagcactttgggcggctggggcaggtggatcacctgaggtcaggagttcgagaccagcctggctaacatggtgaaaccccatcgctactgaaaatacaaaaaattagctgagcatggtgatgggcacctgtaatcccagctacttgggagcttaaggcaggagaatcacttgaatccagtagacggaggttgcagtgagccgagatggcgccattgcgctccaacctggtgacagaaccccatctcaaacaaacaaacaaacaaaaaacattttgtctcataagccccatctcaaacaaacaaacaaacaaaaaacactttgtctcataagtccagagcaagtcacagcattaagtagagggcaaaagagccaaaaattttctaccaaaattaaaaacaaaagtgaaattcaatttcaaataaaacgtttccctgtacatcctacctggcaattgtttagaaggaaagacaataactaatacaacatcatctcatgtcatttataattgtctggtcatggtataaatgcttatgaacattggaacatagagctagaaactctcctaatgaaaatgtttctttcaaaaccaaaagagctctattctgcaactatttttctttctactttaacttttactatatgtagtttaaaagatattgttaatataaaaccaagaataaaacacacagcaatgaaaatttaagctttcatataggtaagtatattactttacccatatatcacatattttataataattttataaagggaaatactatataaaacacatgcaatgtggacaatgttcaattttactataacttctcaacattagtattcttataatttattgttcagtttttgaaatataaatcttaagtttgaaagatggagaaagagtgtaatcgtatgatcattatctctaaaatgttgagagaaataatcatagaaatacaaattaaaactaccaacaaatatatgtagaagtgaaaagtaaatgtctttctattttaatatttcccaattcaaataataggaaattataaacgataaatgtctaatgttttatgagacaacttaaagaatatgaaaaaaaataaattttagccataacctacaaagggaaatcacctagaatgatttatttccaactttgaaactatgtgggtgggggggtgggacctatttatgggatgtattgcttacctctcccaaaaaaaactttttcagaagatataagaaattaagaatgtatagaatagaaaaaacataaattcaattttatagtcacgactttgttctctgaacgtccagagcactgtttctgaaattctctgtattgttcttacaatgcagatcccttggtctacacacagacctaggggatcaggacctctaggggtaaggcaccaaaatgtatattttaaataagtgtccatgtaatcttcctacatactgaagtttgagcatcctccatcaaatgtatgcatttcagagaacaaatgcgtatttcttaaaacaaaactctttactgaagtattactttatttaagaagtatacccatttgaaagtatcatttaaggaaatacaaacatctaagaaaaactgggcatcttttacttagtgtctaaatgctcttaatctcagctcattttaaccatgatttttgctcacatctgtacacaaaccctggaaagatatatacatagttccatcttgggtcctttagcttttgagattaatttggccttaatagttctggaggagatctattttcaagtgaaattgcagaaatcaaacccgaactcacatctatgggcaacctggcactgtgcttgcatgagctgtaggtggcctgataccactgggtaaaatgtcgtatttcaaactgagagtaaaaatgactaccttttccataaaagccattctagtcctttaaaaataagaaaagcaggccaggcatggtggctcacggctgtaatcccagcactgtgggaggtcagggtgggtggagtggatcacttgaggtcagatgttcgagatcagcctggccaacatggtgaaaccccatctctactaaaaaaaatacaaaaattagctgagcggggtggtgagtgcctgtaatcccagttactcgggaggctgaggcaggagaattgcttgaacctgggaggcagaggttgcagcgagccaagatcacgccactacactccagcctggagtaagaccctgtctcaaaaaaaaaaagaaaagaaaaagaaaaaaaaataagaaaagtaaaatacaagacaaaaagttttcctttattatgaaagaatacatacacatgtatgtgtatttcttgcatacattattgcaaagccttattgtcttctttccttcagtcttgctccttccaaaacatcctttatagtgctatgtgaattactttttaaaaacaccattataatcatgtaacttctccgctaaaattatttcagtggcttcctactgcttccagaataaaatcccaacaggtttttcagtacacacaacctcaggtactctgagaccgagtcctggatcacttctttggcttcatctctggccagacgaagatatttgtggatccttggctatatggcagttgcctgctgcaatggcctctaatgcactgatacatgctgttgcctctgcctcctttgcctgccagtttgccccttttcttcctagtttgcctctctgcctcccagtttgcccctcttcctcttagtttgcccctctgcctcccagtttgcccctctgccttccatgttgcccctcttcctcctagtttgcccctctgcctcccacattgcccctcttcctcctagtatgtccctctgcctcccaggttgcccctcttcttcctagtttgttgttccttcttgtggtgaactttgccatcacactttagctcagaacacatatcttccaggtatctaaaccttcttcaggttatctagtcatgttcagattagatgcccagccaatgacgtggccccactctctccccactatatcctgaactctttaaggacagaaacgatctttctgaacaagatgcctaacacagaccctaatatacagatacagaacaaatatcgggtgaaggaccaaggtggagggctcatctaggtctctcctgtttcgttatataaaaatatactgtctactttttttcacgttagaaataagaatattttcatcaggtgtcgtaacaaatgggtgatttgacttctcagttaattctgtccaaatattcaacattacaaacctatgaaacagttactgattttttcacctatctcaatggtataggtaataaatgcaaaagttcttataccacatttaagttgtatagtcctctctcaatttcgtaattttttaatgatagcaataaaggccatgcatttttttaagtatagcaccaacaaatatcaacatatacttacaaaccaaagctaataaggactttattttaaaagatgttacattgtttgcataaagatttaaaaaccagattcgattagtcagaaggatgaggaagtgcctaactataaatttaaaccaataacagtttcactattaacatatttatatataaaactttttccacctaaaatgcagtctactcctctctaggtaaaaagtacacagtgttaattattagctgtatctcatttttaatttttgaaagatttggtattagctgttggttaaagtacaaatgtcaaatattggattcattttcctacttaaattaagacatcagacacaatatcaagtgtactagcccaaaggatttgggcatataaaacaagtgtcaaaaaaagtaccttttattctctgattactctcatatagataaatattgatttatatgtagaaaataacatctacagaaatagtgccttacgtcttaatgcctttagaaacactctaaactcagcaacataactgaaattccatctttcccttagtaaaatatcaggactaatcctgaagctataatgaagatagctatgtacccatattttccacattcttctgataacaatctttttgattaaggtaattttaaaacacatattataaatattatttacttgtatgactttgaaaatctttcttttttctttttgagatggagtctcactctgtcgcctaggctggagtgcagtggcacgatctcggcttactgcaacctttgcctcccaggctcaagcgattctcctgcctcagcctcctgagtagctgggattacaggctcatgccaccatgccaggctaatttttgtatttttagtagagacggggttccaccatgttggtcaggctagtcttgaacacctgacctcgtgatccacccgcctcagcctcccaaagtgctgggattacaggcgtgagcccctgcacccagagaaatcttttctcataaattgagaagaaaaaatacttgatcggattgtgcccctcaccatatgggttgagaaaatatggttgccatagctctatttataaacttttgctccgtccctaagggggttaggccctacagacaagaaggaggcttctcctctatgcttgaaactcctcaccactgtgtgcaactccaggtattccgggatggtggtgctgggggaaagtgctcagtcttggggaagaatcctgtggagatgcagagctgaacaatggcttttcaggcttcttcatagtagtcggagaagacatatctgcgagaaacagagaaaaacccaaagctccatgactttcttaagctctaaggttcatgtcaacaaatgacagatctcatcttgcaacattttagtattcttatactttggctcttttacaaaatatattctgagtgtcaacgatccagctgtcttggagctctgaaatatttgttcaatctccatggaagctagcagaagccttcattaaaattatcatcagaattattcccattactaaataaatcttaaacttctaaaaacccaaagtcttgtttcctttagccccttggttcacacaaaggccttctttacctcagtatttcattctgagatttatatgattcagaagattgtctttcgacagaggataactgctgcaaatgggaaaaacaaccttcaggtatgttggtcacgatatcactgatttcacagcttttatggaaaactcattcacttgattagcaaaaagtacattccttaatttactccttctgcaaacgtttactgggtttctgtactggccaggtaaaatgaagatgtcaaagaaattaaaagtaattcctgctctagggatgctcactgttggtgaggaggaaaatgattagaagaaaatggttgtgaatggttgagaggtacaatgtgtgttgagagcagggaagttttggcatttgctgctacatcgccagctgcgatgtacaggacagatatcgtctcagtctccccaggatgaggaaggcatttctcattggtgccattttcaaaatgtgaatgaggatgacattctcagagaggaaatactcagaaaaaaagatggcacagaatacacaagtaaacagtgtgtggagtggtgaaagatgaagaagaggagcaagcctcttgcaggtcccacaggatgacgggtctccagcttcctgtacaaacgtctgaatgcttaccctcataggagaaacgccatagatgggcaaaacatgatcacaatgacagtttaaaacaattcccccagaaactaaatggagggcggactggccaaaacagagacagaaatcatgaagaccacttcagaagacagattcatcaatacattcattccataaatacttgttcaagaccgaatgtatgccacatgctgcactagcctgggacacactggtgaactggactcactttcggctcctttaaagcttaaaatctagtgaggcgatgtggacaagtaagaaggaattgcaaaggtgctgtgataggaaaagaattcagagatttcgggcttcattcactcattcatttcataaatatttaatactgccaaaagatagatcatgagagcttgaaataagaatcatgatagaactaatgcaataaatattttaacagggttcacccaattaaattattaagcaatgtagactgtcatcatcttagttgactaagagactataccatgcagtttgttggaataagcagggagttgagagatatgccttggttttaacatcttgagtgctgttgactttaatggaagtttatcaactcatagtaaaatgttataaaaatgatgagctataaaatttgtattttattatgaaaaatgttaactgtattcacaagtagacagaattgtaatgaatcctcacgtaccgataacccaacttcggcaatgatcaactcataacaaatcttatttcatctttatccccatctacactttctctccctgtggtactttgaagcaaatcccagatatcatataactttgcttctaagtagttcagcatgtatctctaaaagaaaataaatctttattaaaagaaaaaaacaccaaaactttatcacacatacaaaatgtacacaatttgcatttttgagttttcttgaaattagaaaaagaccttatggtgctattaatatgagaaactaattatcattacattttaccatttgaaaaattacctaagctctggtaaaggcattcataaaattaaatatgcattttcagcatggtggcatttaaaggatgaatatgctactgtaaaggcagtagacatcacagtctacaaaaaatgccaggcggatttgtagctgtaagctacaatttgtgactaactggctgttgtgaatctatcagaactttgatgagtcagagaaccatttctgtatatctttttcaaaaaaaaaaaaaaaaaccagaaataaattgttcataaaaccacagcaattaatgccactataaaaaaagaaaaaaaatttaaaccatggtttaaaaaatagacaaagctcattttgctatcttcaagatgccaaaaataatacttaatgtcgcataagagctatgtgatttcaaaaggtaatactacaaatataggcctctaactaatggatgtaaaatcatagacatacagattattaagaggtggaaagaacctctattctgtctttcttgttatagatgatgcaatcacttgccattccaaatttttaatttaaaattaactgtttgaaaaagaaactgggaactttttattgatactcttctgctttacctatgtttaaatataaatttcaagtaaaatgtaactgggtaaatcagtttctaaaaattccatagaataaataataaagcataattatacctcattttaaaataatttaggccgggtgcagtggctcacgcctgtaatcccaacactttgggaggctaaggcgggtggatcgcctgaggtgaggagttcgagaccagcctggccaacatggtgaaaccccgtctgtactaaaaatacaaaaattagctgggcgtggtggtgggcacctataatcctagctacttgggaggctgaggcaggagaatcgcttgaaccttggaggcaggggttgtagtgagccaagatagtgtcattgcactccagccgcgacaagaacaaaactctgtctcaaaaaaaaaaaaaaaaaaattaatgtgaccacagcttgagaaacagaacagtgtcgttctgggtatgtcatttctggagaagaggatcaattaaggcaactgcaactactgtaactatatcagacttttcattaaactcaggcaaattcatgggtctccttttgtaaagggcacataaatcaagggtgtttatatagaagttgaagatgattatgtaatttttaatgtaaattatataaattttaagaagcaaagcatttgtattttcttagccaaaatgacacacttgcttttactgagtaattattatgggtccatttattttttcaattcttttttgggcatgcacctaataataacggtacgttcatagaggattatacagaccaacacagaagaaacagaatacaatttgctgttcaagttgcaaaaggaaccacaaactctttccttaaacaacaaaagtaacttataatagtaaacataagaatgggaaggttcactgaccaaactgaaaggatttgctttagagacaggtgaagaacggtagtatcagaatataggtttaattgcctttgttttctcattaaatgaaattaattcttggcccattaataaaaatacactgctacacagcatgcagaaggcactatgctaagaacttaggaagatacaaaagtgaatccccgctcaaaaaaaaaaaaaagacaaaaaaacaaaaaaaaaacaccctctctagactagaaggggaaataaaagatcaattatctggggaaaaagtaaagatagagtttctagctattacattttaatcatgaaccaaactagtgttattttaattttaatttattttgaatgtctacagtctaaaaggcttcatgccaaggtgaaaaatgatattgtttctatgtgtaatgtgctcatatgctacaaaaaaaagtttgaagaatgaatatatagaaaagatactttaaagtgacctttctgtgaagaaaaacaaataccacgctttacacaatctactgtccctcaagcaggaagaatactacataaaaagattaagttgaaaataagttgaataataataaagttgaataatgcataaatatataataacttgaataatgcatacataataatgcataagttgaataatacataaaataaagcagctgaaaagagatgcaaaatgataggcaaaggattagctgatgtttctactggtgggagggaggcaggagttgctggtagttgaagagaaacaagtagaggccagtgatggcttaaaatcagacagaacaatttaaatttgatttagaaagtaataatttataaatgaattgattttagaagaaaaaactttccaaaaatttgactttttttttctgttctcaccgcccttttcacttgtacctggctgaaccaaaaattttcttcctagtctcctccaggccttcctctccatggcactttataaaaaccagcagctggcatcgtatccttcaaacagtatctttctcattgcaagatctaccacagtatcacatttttaaatagctctttttctttgttattccattttgtttaaacttcagtgaagctaattttcttatggcttccattaggagcaggagaaatatgtttttaactctgtgccatccctgatctatgacattcccttgaactagaaaatgaggcatttccactctccttattccacgcatagaacaatgttttatccactgaacaaacttgttttctccttaagtaatctctcttggaaatccctgagatctagatttcattaatgatcttttgtttgtatcttatattgcttgatgaatttttcattgttatttacttgtatccactgcgtatgctttttttaaaaaggtgactaatggcttacctcctaaggaacatgcttttaccaaaaacacaaaaagatgtagaggctggaagaatatgctacttgggaagagaatgaaaaaaaaaagtagaaatgaaagaaagaagaggtaaagcaggcaccgtgtctaggcagcttattttagaatctctggcatgtgaaagaaactgtattatgaagtgatgactagtagtgcaggatgagaaaaataaccatagccagtatatcttaaaattcatgttccatgaataaatatcaccagatgagaagtagctgactgtaaagcaaagagaaaagaaaatcaatcactgagattctagtaagtgtgaggaactatggctatgcatcaagatgccaaacaaaaccacgtggtccctgtcttggtgatgctcatggtttagtagagagggcagaaattaaagacagaaatgcattaaatagttgcaatcataataatactggattgcagaaagaattcttcttaatgacagattagagagaataatttttttaaaaagattcacattgatggtgttattcttcaatgtgtacacccatgtttacatttataactggaaaattagctatgactttagaaactcatcgtgtagttgaatatggaataaaagatcaccatgtaagaaaaaagttcaagtaggctactgataaagttggttcatttattcttaagcatccctttaaataagtattttgcaaaatcaaattatcacacgatttttcctgaccatactatatatatttttggcactgtaacatatatacatcctaggccttgatgtgttatttatttcacgtcatcacttcaaagagataaggacttaagcaaataaagagttagatcaactcatctcccaacaaggtaatttcatctacaaaggaagagagtcgctgtgaaacacagcgtatgtactcgactcatcggcagcttgcacaaattgcgctccagatgtatatctgttcaagtcagcccaaggcaacaattttgatcaattctaatgtgataaaatgctgcagggaaagtgtgcagaaacgtgtttacgtcagcccttaattaaactgttgttcacttccaaagaaccttaggaaacactaatgagacatgagttttggcaatttcttcatcaaagcaaagaccccttcctcagtctgtagcagcctgtcatccaagtcgctcccgggataaatgtcacatggcactccaatcagttagccacctgttagtagaacttcattgaagtcaactagtgatctagggcaagctcaaacagcaccttaacacctgcctgtctgggacacctgctcctttttcacatatagtagagcaatatgttagcttttccaatatgctcgagtagattaaggttacaaatcagactactaaagcctacatagaaaacatacaattttcttttttgaaaaattccttttcttccctatagtaacacaatttttaacaatttcaaattaattatgtaagaacacgcaagaattcttgaatttctggaagctattattttcagcaaaccatatcactaaattaaaatgtattaaccatgccagtcctatgatttagtcctttttctaggatagaatagtcctatttctatctggttaacaaagaagtaaattccttcaaaatgttttaaaagtgtaattattttacatattcctaaattgtcttccttatttacatgccatacttgtaacttgtaaacaagtctaaatgaaccctatagagacaagtcaccatttgctggctacttttattctccagtatttaacgttaaggtttgttttattgctaagtgcttataaagctataatcattgttaaaatatctacatattttctttatttttcacattatcaagctgctaaacaatttacaggattcctctttttcctttctatcttttattattgtgtaaatttcatttatttatttaaatttatttaattattttagagacaaggtctcactctgttgcccaggctgcagtggcacaatcatggctcactgcagcctcaaactcctgggttcaagcgatcctcccatctcagcctcccaagtagctaggactatgggcacacgatcacacccagctaatttgtaaatttttagtagggacaaagtctggctatattgcccaggctggtctggaactcctagtctcacgagatctcctgccttggcctttgaaagtgttgagattataggcttgattcattgcatacggtcttcttttttcctttcttcctttttttcttcatcttctttttttgttattttttggcagaagaaaactcaaagtgtaatgaaaacagttgcaaaacttctgttaactttgaccctctggtatgatactgaccagaggagtttgatacagaccagagaaggaaagaacatacataagcacacttagcttagagacagtccaatggctgggatttgacaagattatattatattgacaagttttatcaagttgatacaccctcataattttcaaagttcttcattttttggacttttgaaagtattagactttcatagattttttttaaaagagttttctagataaacaaaaactctgaatattgaaaacctcttcagagaccaaattcattgctgggtgaaggcaaaggtggtcaacacatccatcactccattgaaactctgtcaagcaacacagcactgaaagagaaaaatgagctttagcttaactgggatatttctgctttccattaaaatgttgggtggaagctggaagacaacaggaaaaagaaaagaaccatctgtataagataataatgttatttaaaataaataaggtagtaaatgacaggctaccaaatcaagtgtgtgggatgagttttgtagctgaaatctgacatttttacttcaggccacaaatccagagtcagtcctgagacaaggaaacagtttgggctctgttcccagaggacaaggagaaggcagagaagatgactgccaactgaaagctaaaaagaccacaatttctctgcctctgtttttgccctgggataaacagtgttgaagagaggaaagtgtccaggttatttataagtgtatgagtgttatgtagaataagacaactattaaggccagattggggcagcatctagcctgccagatacttaagatcccagtccaaagctttgaggtatttatttctaaggatctccatgtagagaatgacagcaatccttactttaacaggttttacctaataaataaaggactgatgatgggtgagggtgtgtgtcctgaaggaggaagaaaggagagagagaccaagcaggctctgcctttacttgaaagctttgtacaatcctttgtacaataccctctcaatttctccattttcttcacaaatggagctatcctggctcatggggagaagacacatggtgtgttccttgatggtttaaataaaattcaaatgataaaaaagaggtgcatgggtaaagtcacagggccataaagaatgttctataaatttctgtcagaggacatgctttgaaattgcttatagagccatgtgctacattgaaattattacggcttataacaatggagttaagccactcaggcactgctctagggaatgtaaattgataagatctatgccaatatttaccaaaagccttagaaatggacataagatttaacttagtaattctacagtaggaatgtatttattcccgtagcaaaatttcactgaacttctacttggtgacttcatgccaggcagtatgctagggacttgggacagtgaaaagaactagacaagaatcacccaatcagattaggcacagagttacatgcagtgatgttcactgtatctctctttataatacaaaaactccaaaactatctaaatattcatcagcaaagtagatatttaaaattctatggtgtagccaaagtgtggcatattatgtactcattacaaagtggaaggctggatggggtggctcatgcctgtaatcccagcactttgggaggccgaggcgggtggatcaagtcacctgaggtcaggagttcgagaccagcctggccaacatggcgaatccccatctctactaaaactacaaaaattagctggccatggtggcgtgcatctgtaataccagctactggggaggttagggcaggaagagttgcttgaaccagggaggtggaggtggcagtgagccaagatcacgccactgctctccagcctgggtgacagggcgagactctgtctcaaaaaaaaaaaaaaaaaaaaaaaggaaattgaaggatatggtaaaatgccattagattataaagacaaaaaaacttacaaaatagcatatatcatataagctcaatttactgcaaaaatacattcatagaaatagaacgcaccgaaatgcagaaaaatacatagaaaaacaggctagcatatatacaatgaaatactaacagaagttatctttatgtgatgagattacaggtgatttttattttcttcttcatatttgaaagtttgttttttcaaattccccacaaataactattacttttactgtaaaaactgtaaaatagatatttttgggaaaattgttgcctgtagctccacagaatactataaataattcccaaagctgggctgacaatattgaatcctgttaggtgtcccacattacactgcaagaaggaaagcttcatattagtttaggtactggatattgcaaaactgtaaaatgaaatgcttcaatgtaacatttgcaatttagttggctacaggcaaaacaatgtcttttgaaaatacagtgaagaaaaaagaatatctaaatatctgtgtctaaggactcctctagatgtaaaattttatgattgtgtggcaaatgtgaacaagtccttcccacacactccaagttaacaaaaagctctgaatgttatgacaagacatatggatgtaatcccactacagtagtttgatgatgatgccagatgattcaaaaaataattagctgccatgttaagaaagtatctccttatatatatatatttacatttatcacactctaaaataacactggaaaaaatggcaagctacgttaagaggagataagatgtcatcttcaattagatttctcaaccattttttttaaatttatgaaatcagttccttttcaaatgagaaagtatggtggtctttgtgttaaataaatgaaattcttactttaattactgagttatttaatcttaattacacttgagcatattattgtattcctcagtaaagtaaaatcttttctaatagtttaagtctctcttgccatatattttagcccaagcacggttaagtagcatgttcctacaagtctcaattttatcacttcgctataaaaaaggtctcgaggctacacctacacccaataccaagttaaagcaaacctctttgaagctcacaaatgtcttccagagacacttaaaaaaatcctttgaataatgaagaacagtgctaaaacagtgaatatggaataaatgaaaactactttttaaaaacacttcaaaatgcttttgtccactaagcaatttcattttaacagacagacaatgataaagggtcttgagtaatgtgtgtaaacctaatttgaaagagagaaaaaacatcaaacaattatgcaggacttggagcatattttcgtcacttattaaacactggcataggtaaatagctgctattcaccatgcctctcgggaaaacctcttggctatggagtcttattaatgttaagcatctgagagccatgggctataaaataaaatcaataccataaccttaactgtaaaagtcagaaagatactggaagggctctaatttaacaagattacagatgagttttcagaggagaacatttggggaaaagccatacatttaaaaacatttatgctacaagacatctcaaggtttttgttgttactaatgctgttattatccacgctggtaatggttagagttgatttaactgatgtgttactttagtggatttacaggaaagtcctataaatgatctggaacttacttcaaataaaatcattacactgaggtagtaaactaattgcttgagaacaattatgatttgatgtgatttagtgtggtagaaaaagaattacaaaaattttaaggtcatcagttcagcagctcaatgcaaatatgattactctgcacaatattctgttgctcttaatggaaaagtagtcaaaattggtataaattgtagtgtttaagttcaacctaaatctatattttttttctccaacaaatgtaaatgaagaaaaaaagaacattctgtcaatgaaattactatgatggcatatttattatcctaatggttttagaaatcatgtgaaattcatcagtaacaaaacctctatttagtaatggaccaattacatttgtgagataatgtcaatgaaaccgaatattgtcacaggataatggtctcccattgctacatccctagtcatttagagaaaataaatgttgctgtctggctgagtcatttgttttcaaagtaggagacactgattccataacaaggttctgttataataactcaatctctatcaatcatttgttgcaccagaatggtgcaggacaggacatgcatttgtgagaactgcgcattcctcaggtataaagcaaaatatacggggcctccaagcacataagcagcccaattattgttattcaatgagagtgtttaaaatgaacattcaaaaaataatttaagaaacagaaaactttctgaattttccaaaagatccatgttaatgacggctttggaaagactcaagtactgaagatcttcaaattcttggactccaatagattcaaaatctaaaatattagaacacaaatcttagtatacaactttgttattttacagatgggaaaactcaagagttactgaagttaagtgatttgtctaagaccacaccagtatttagagtttcctaatcacaattacagtgcactaggcttaaggcaaaaagactagaacagaactaaaagaaaacatatgtatgataataaatatatactttatttttatattttgacaaatatagctcattttaaactggccatatatcacacacttctactaaagacattctagaacttaggattatttattactatcttattaaatggaaaagtgattttaacctgatttcagagcaaggactacatgcatgaatctctaaggagtctacgaacccctgtgaagttatgtgcattcatctgtattgaagtttcatgcattaaaaaaaattgtaacagaggttttataattagtttgcaaaatcataaacataatatctcaatgacttatttgggatacagtattatatagcaataacgagcatgggtttcttcagcaagagagccaggggttcccattctacctctgctacttatgatctgcatgatctatgatgagtttcttaagcatgatcagtttagtaagctgtaaaatggggtttctgtcaggtttaaaagaaaaatagatataaacttagccaagcacctgacagaaaggaagggctcaataaataaatgacaaccacaaatggcaatagaatcttgttttccatgtttcatttacatgtgcttgttgaagacaatttttaaatttacatgctttcttcaataaataaataacacagaaaaaggaggcgaataatcagtgtaggctaaaaagaaggtgaaaatacaaatataatctatggactaaatttgagtcctgattcaaacaagacaacctttgagatattctagggaatttgaacatggattatatgttagattatattaagaaattaatgttatatttgttaaattgataatagtactgtgattatgtaaaaaaaaaaagttcattgttcgaaatattcagatctatttacatgcaaaatgacagatatctgggatttgctttaaaatacttttaaaaactgggagatagtaaatgcaataagactggcaaagtgttaataacagttgaagctgtgtgacagtacagtgaggttcactttacaattctactttcaatattctccaggccaaaagacttcttaaaattgtgcttaaacattcatttcaaacaaactcttccccacatttattcttcaaaagcattcatatcttcagtttattttagttgaaaaaattttaatcctggcactaataataatagttgatttatgtgtgtgtgtgtgtgtgtatgtatatgtaaaattttaccatctcaaaattttgttttgagaattctttcagaaccctgaaaactcacaaatacacctctattttctcattctagttctgttaggtctaacagagtcttccttaagctttccaagaaaagtgtccctctgggaagacttgcgaagcagtgtttaaatctcctaggccatttgtaagtttacatactgattccctaggcaggctgcaggataacagaaaatgaaaaaaatcccttgaacaaagatctaggctctgccattcattagttgggacaggacagcctctctgatccttggactacttagctgtgaaacaggagcttgaattatgtcttactaagggttctaataatttgtgatctgtacctgaaaaatcaatttcttattgtatatgatattgggagtctaataactcaaatgacactggctttccaaactacttcacaataagcttaaacatgaactcaatatgtaaaaagatttgaaataaaaccttttcttatgcagagaaactttgtatggcacactatgacattatctcccatgggtttcccacttccctattttaagctgtgttccatcaagctagaaacccagtattaaatagaaagttgttattttttcaaactaattatctattgtggtttttctgcaaaatgctgtattttcaaatctttaagcctccagagcacagaaatatgagcacgacttttccatattaatcagtaccagcccttctaacatgtatacaagtttaccccatccaaaatgctattcttgattagaacacatgaagggggaacaaacattcactaattaggaggcaatgtggggaattctgatgaaagccttcaccaacaatttattgttttcctttccattttgaagaagatcgtgttgtgatttttcaattacagcagtgtagcagtgtagttgaagaggcattcctcttcagggtggaagcatccttgaagtttgctttccaatgccagggtagtacctagaaattcacttagagttctttacttttgatattttccataataagaagctaaacaaagaaacttaaaaattgggcttgaacatcaaattcaaaccatctcttcttcacattcatccaccaaaagcatttgtagctctctttttttctggttcaaaactttggtatttgaatatttgccatttcatccctgtgatactaactgcaggaatataaggaattgttggtgttctatttggtccccaaagagaactttaaaacttcttccagtatggttactaagctgtctgcactgccattttctaggacttcatttaatgttaatgactcccagatagcagttattcaaccatctatgacagctgcttattcactcagctcccacagctctagagaaatcttgagattatatcatttgtcagactgtggtttggactagagcactgtgttccaaagtttgggcctaggattaatgctccctatggattctttgatagaaataaaaggttctgaagtcacaaacttaataaacatgttcagtcaagagccactcctggatattcacagcacacagtagcatattaaatattctgcatattcatttatgaatgaaaatagttgaaatttttgttacaaaaaaactttgcaaatttagctgaccactcttttgtatgtagcatatcttttcacattcctaaactcacattaggaaatgctggggagcctggtgtggtgcctcacacctgcaatcccatcactttgggaggcccaggtaggaggatcagttgagcccaggagttccagaacagcatgggtaacatagtgagaccccagctctacacaaaatttaaaaattagctgggcatggtggcaagtgcctgtagtcccagctacctgtgaagctgaggtgggaggatcacttgaacctgggggggtcagggctacagtgagccatgatcgtgccgctgcactccatcctgggcaacagacagagaaaaaacagaaatgctggcctctgattctggttctgtcagcatgctatcacactcttatttactgttacttatttcctgattgagcacataatactaaactggcatttttactctctagcccccagtgttcccttgggccctctggcttaatgcgtttgacatttaatactatatccttatagaactctagaaagtgcaaactgaaatttagcacaacagttaagactaccttactaatgagaatattttcaaaattatcaaaaataaatctctaggacttggaaacaaattaaaatttcagaaagacttaactgagaagacatttatataacagaactggagacttgtataaaaattagtagttttattttttagtacctaagacaccagaacacaatgcctaaatatagcttgagagtccagtttaatttttcaaactactctccaaattgtaataacatgccaatataccaagtagtgctagtttttgctaacatgccaatttattgattttatgtaaagatttacggctcatcgtccttaaaactaagctagctctaaagcatggagtcggttctctcataatcttatttattttagtccccgatttttctaaatagtaaaagttacttttccattcaggaggtcaagggctggaaacttaatttattcatatttgtgtacccaatgcctataaaaattcctccaatataatatagacatttgacaaattgttcattgaaccaaattatctcaaatcccatacatgtagaaattaataacattttactgcataaagtctttttgaatttatattttatctaagattacaggttgtttaaatactcatctggctgaaaagctgttcaaatttccatttagaaatccccagctgagggcaacccgctggggtcccccttccacactgtggaagctttgttctttcactctttgcaataaatcttgctgctgctcacaaaaaaaaaaaaaaaaaaaaaaaacaacgaaatccccagctgcatactgcaaatatatttaacatatcatattttttctcattaaatgtctattaaatgttttagaaattttacattcagacttagataaattagtgactattagaatggcagtggcaaagtgaccttataaagaattgttttcaatgttcaagcatactatttatttgtctgttaaattactgagtgatatggtttagctgtgtccccacccaaatctcatcttgaattgtaactcccacaattcccacgtgacatgggaggaacctggtgggaggagactgagttatgggggcagatctttcctgtgttgttctcgtgatagtgaatgagtctcacaagatctgagggttttaaaaacaggagttccctgcacaagctctctctttgcctgccaccatccatataagacgtgacttgctcctccttccaccatgactgtgaagcctacccagccaataaacctcttccttttgtaaattgcccagtctcaagtaggtctttatcagcagcatgaaaatggactaacacactgagcaacggaatacaactggatttagtctcatgagagtaacttgaattagacgaaaaactatgacctcttatttttcctcttatatcaaaagttacaaaagattgctctaaagaaaaatttcaaaaaaagtacatcaactagaaattgagtctctgaattgactcagatggaaaaaaaaataagaaagacaagatcttaatggaattttttatggaggaagtattggaataaaagaaatgttcaacttgcctgttgacagtctaatctggttctattcattaatcattaaaatcttaaatgaagaaaagcaatatccaaaaaagaaagtttttaatagagagagaagcagtcaggagtttaagaccaggatttacagaagagactaagcaaggagaaatattctgaaacataggaaagaaatataacagttgttggatacccctttgctagtgactcagtattattttccttttcattttgttctgtatatataaaataatacaaagtaaaaatataaatactacataatatagatgctgacaaatttaattttcatcactattcatcagaagaagcaaattatatagccccctaccaaatgcttaacactattaaattatggttagttttaaaatattcatgtctatatttgcagaagtataaattacaattctcttataatcaggaagttgtaactttttgttttgaaaagaaattacataaggacataattaatttattattgtaatatgctaaaaatactttttcattaagttactaaaattgcatgaacatattattacataaacctagattttgtgttaatattttgcctgatttattttaagaacagaatacatataataatttggtcatattatatcctttatttttgcctactcagaataaatctcaatggtttaggttggtatttcagattgaaagggaaagcagaatgccacatattgtccataattttgttatctttgattctcatatttaataaatcaattttgctaagggctatgtcaagaacagattttaatgcaaatttaacactaacagaataaggcatacccaggaaataattaatagtaaattttaaggatttctgcccattttaaacacaagcatattttaattaaccaataaatagttattgagtatcaattagtgcagggctttgtaggagaaaatattataaatacaagacatgtcaaagctatttcaatgactggagtggcactcaatatgtgctttagacaactccctccatcacagggaagtgtgtctaaagaacattagaagatggacaagaacaaccattgggcattttattttgcaaatttttaaaaagcaattttctaagaacaaaaggactgcattgggcttagcaaatttataaagatagtactgtactgcccgcatttcttcattgtagttgagtcttcttcccacaatggcttattgtgcacattacgaagtcttcagggtcttcagaattaaagtgacagagtgtgtgtgtgtgtgtgtgtgtgtgtgtgtgtgtgtgtgtgtttaaaatgcacatttgagaatggaatattcttccttcctctaaacataatatgcctttacagactcctccaataagtctagtcatcttgacaaaagaaaatcaccaagacaatacaatgttttcacaaagaaaaagaatgacagtttcccttctacttttcaaaaatgtttcataatatgatttgagattggctttattcagtaggcttaaagaggaatcaattcttacaaagtgacactctctataataaagaacacctacacttctgaataacgcatccattcccacacattcacaaggttattaccattaaaatcttctccagaagaattttctgacaaggaaagtatggctttgtttagaataagctgacaatgtcagtaaaacaagcaataaaatataaagggttgagggttttgtttttcgtttcacttctgcaactctggtaaaagtctctattatatcttgccttcactaatgagactggtgttctgcctatcaatggttcatttatacaactacttattgtactcctactacgcaccaagtgtgtgttaagtgctggttacagtaatagtcaaaatagacaaggtcccttctctcacagtgtagacagatttagacaactaatcccataaatagctatatgattacatattatgagtacaatgaaagaacagtactgggtgttgacagagaaaactaggaagacagaatttagactgaaatttctcagtttaagctgggctctgaaggatggcaaagagtttgccagatgaagagttagcagagcattccagaggtcataacttataggaaggtcccggttgttgaattcgcaacttcaagtaaagcagtgggctcaagtgcaagcaagaggaagcagaatgtcacctgccaaggctatggcctgttggtgatatgaaaagattcccattttttcctgagagcagtgggaattgactaaaggatctgaagtaggggaataaaatgctgttatttacattttataaagatgatttttacctactgcctgaaaaatagatttggtggggtctctcatgaggggagtctcagagacaaaattccgtctgaggggggggtctcacagtcaaaactctccagttgagtttcatatccttgcataaaatgacccttgccatctctattatttccctccatgtgcactgtgtccagccacatggcacacacagccattctcaaatttgcctccccacctaacacagggttatgcttttgtctcagttcccaccaccaccctcttcagcccctcacttctttactagttaaaatctcaaggagatttagatgagatttaggaatcgagctttgagtcagttgtgctaaaggaggtacacttgactcaaaggccaatgtctccatgaagatttttcactattctttaaactccatggcactcggtataaaaaatttgagcagcaaagaaggagcactgaataaagaactgactttggccttaactgttaaggcccagagttatgtgtctcctaagagtactcaacatagagtaccccaaccctcaccaatacacacccaagtcctgggctgaaaaccattattcctttcttttagacttttttttttttttttttgagacagggtctcactctgttacccaggctagagtacagtggtgtgatcacagcttactccatcctctgcttcccaggctcaactgatcctcccacctcagcctcctgagtagctgagactacaggcgcacaccactatgcttggcttacgttttattttttttttgtagagatggggtcttgccacattgcccaggctagattttttttaatgcagaattctatttaaaagacaatttaaaaatacatgtttatgctgctgacattaagatcttatttgcagacatgcttacataccaacaaaaacttcagttagctaatttttctatttccatgcttaataatctccctctgattgtgggggaaagcatggatatatctaatgaaatatagtaaatccaacagactttaagaagagctaagtctcaatccttccgggtctcaatacccatttcttaaagttatatttctcctcaaagctgccctagaactgggtcacagttttatctagaaagcatagctagattgactccaacacaaagtatcttacattacacttttctttattgtatatggtctacctacttccaaaaggaattgcaggttcctttaaatgacaactttcagttcctggcacttgcaaactgcttaaagtttggctccctgcaacgctccatagagaggagcaggcggatctaattgaatcacagtttgtggttctgctgtactccaaccaacaaatgtagacagaccataatcagtcacatacataattgtgggttctaaaatatcattttgtctaaaaaaaactccaacgaaacatgtaaaaataagattttggataaattaactttgacgacatttgactaacattatctcaaaaataattctacaggaatcattttatgaaaaaaatatacaatccatattggtttaattatgaaattttgactcaacgaaacttaagaaacgagccaacattttactcatggtctctagaggcatctccttattactcaccttgatctctttcgtgccatgttcgacttccagcagctggtgaacttggagaggggtaaaagtctcctgtaggacttggttccatattttcatctatggatatagttttgggtcttttgctgttaaaatatggcaatagttatattaatgggatttctgggaagatgtgtacattttaaagtaaatgatctgagaagatccttactgtgaaaattttcataagcacaagtaataatggtgagtataatggtgagtattgaagatatcaatagtaatagcaaatatttctagttgcatataccatttattagaccatcttatacctaacctgtctaacaaatatggtgttcattatatttatctttcaaatgtatttccaaaaaaaattccactaataaaaagtgaactcttaatgttgtttgccttctaacattaaaattgtgttattgtgtacctgactcattattattatcaatactaacaatgttccttttaatagcacttgtcattgacaatgcaatccaaagataaggtaataaagtaaaacaagagctttggggtcaagacagtcctagtataaaatcttgagtaggccacttatgaattgctaatagtaagctccttaacttatctaaactcagtttaatcatctgtaaattggaaacaataaaacctagttcaaaggcagacggttggaagagtaaaatgagttgttaaatgtaaagcttttagttaagtggctggcatttagaagatacttatcaaatagtaattcttagtaataaccctatcattaataataaaaaattatagtattttactgattataaactatttcatatattattctttactttttcttaaaacttagattattgattctttattcttaaaatcgactgtgaaaaaaagaaggccactgccaaattcaaacttttaaaatgatactttttttttttttttttttttgagactgggtctcactctttcacctacgatgtagtacactgtggctcaatcttggctcacagcaaactccacctcccaggctcaaacaatcctcccacctcagcctcccaagtagcttgaactataggtgcctgtcaccacacccagctgattttagtattttttgtagagatggggttttgctattttgccctggctggtgttgaattcctggactcaagcgatcctcccacttcagcctcccaaagtgctgggattacaggcaggagccactgtgctcagccaaaatgatacattttaatatggaaatatgactcatctcaatgaataagaaaggtgactatccagaacaaagattaagaagctattttatacccatagtggttgatatacttctttcatatgcccccaccaataaagcagacaattatgaaattatgactataaaagtgaattcttttctttttttgtttgtttgtttttgagacagggtctcactctgttgtccaggctggagtgcagttgcatgaccacagctcactgcagcctcaagctcctgggctcaagtgatcctcctaccacagccgcccaaatagttaggatcacacacacatgccaccaagccttgctaattaaaaaaattttttgtagagagggagttgtccaggctggtcttgaactcctaggttcaagtgatcctcctgcctgggcctcccaaagtactgggaatccagctgtgagtcactgtgcccagtgaatattttttctttaattaaaaaaaaaatcttattcacacctatgctggtaaaacctttttaaaaatcttcaaaattcacttttcgcagcaataataaccataatgttataggatttcagcattgaaattgacctcaaaaatcatatacataaaccaatccccttgtttttacaaatggggagacacatttggagagattcagtggactgtccagggcaagttaatggaagcagtcagacataaggtaaggacgtctgacttccgcaagtgtgctctttccactgcactgtgtttccaagcccttgaatcatgtatatgcctgagtacatttgtagatactcatgattaatatttgactcacaattctcagagtattaacgatgtagaagatggcaatttctatccatgctaagcttagtttcttcccaaagaatccaaagttagaccttacattttaactctcttttaaacatattctctcatctatgagtcagcagaaaatctgcctgaaaaacttaaaattggggacaaattacatgcataaggaagtactagagaaatgttttttaaaccttgcttactctgaaagacagtatcttatataaagtagtcaggaagaaagatctgtgttgacaacagtgatttagcagacagaatttaaaaattactgctcacattttaaatttagaaaaatcaaagcatttctaagactttgatatgtcagagactattttaataataaaccaaattatcttgctacacaatttaactatatgaaaatggtttaaccggaactgatataaaattgatcttagtttataaacatacacatgcccagtccataattaattcaaattcaacgaactttcactactgagaatactttagaaaaataaatatacaggtatccttttatttttaaaaagttgacattgtaaaatgagtgttttgctctagaattcatgtatgctcttatatttgattacacatatatttaatgctctaggaatgagatgggtcttgaagatctagctcaaataaaaaaaaattaacacatctgtaatctttattcaccctgactggcaattacaatgagaagatcaggaaaaaaaaaatgagaatgttaacagagaagtaaaaagcaaagagaactctctctagctgacccccaacatagaatggttaaaccaaatctcagggaaggtagtattttcattggtaacagagcgttaattaaattagtcaaaaaacatcaactaattgaagaacttggcaaactgtggtctttaattttaaggctaggtaaatgacacattttattttttatgtttcattatcctaagcttagatgtaatatttgggtaaaagttaccaggaatcagttataaaccagagatcattgccacagcaacatcatttttaaagccatcaaaagattttgttaacttgtagcattttaatatttcctacaacaggacaaaagtcatattaatatattttcctagttacctgtccccctgaaaaagatttttaaaactgctgtgtacaacaattacatttaatttgtaacagccaaataaatttaaccaggaaagattaaaaatctgtgtactaccagcaaaaattatttcccatctctctttacctacctacctatctatctgcctatcatccacctacgaacctatgtgtgtatcacttgagaatatgagcagcccttctttcagtacctgcttggtggagaagacagagacctctgaagattgacccccgagttcatgtcatgatagtatggttggcttgggatttctccaattgggaagttgactccagttccctgggttatgggcgctgaggaataagacaaagaagcactgggaatgacattcgtatttctgacctctattcaaatgtaataatcgagaatctttcatgcctctggtcaaagatagagagaactttcttcaccttaagcctctaatacccaccatacaacctgggtaggacctgaaaacttgctcaccttagcaacgttcaagcttggaaatttgaggcaatcagattataatcactggttaccaatttcccgaatcctattcctcaaccttctttactcactcctttatattagttgacattacatctgtcactctgctagttaaaaatgccttggaggaaacagaatatacgagtcctatcactcagcaacaccaaacaagctgctttgcactacctaggctctcgaaaaccaaatcattgttaaataaataaacagagaaccgtttcacaaaaaaaagcaaaaatcattattcacagcctcccagttaggatatgataataattattaatatcatgacttctaatccactcaaatattaatgttgatattaatgttgataatatagaataataatttttggtttgtaacacaaaggataaatgcttcaggtgatggataccccatttaccctgatgtgattattatgcattgtatgtctttatcaaaatatctcatgatattttgtataattacatctgttcacattttttaaatttaattttagatatcatgaacaaagctgtgaggcagcatattgtgttagaatcagcagagtcttgagagataaatagccttttagtttaaactccctctgtattataagttatgtgccctagtttcctaactgtaaaatgggagtaataataaccggacacataggattattttgaggatgaaatgaaataggtagtgataagagcctagaatcatgcctagtgtataacacgtgctcaaccattgtgagttcccttccttctttgctttctcctccaaacttcttccctggtagactggaatggttagcaaagatgaacagttcaaaaacgtgttaaaagcagaggaagaggtataaatgaacctgttcgctgaaaatttgttcattcaacaaattactgactgtgtccactgctggcaggtgttggctgcaatgtgtacaaaatagtctcatatattgcccttaataaaaatattgggcaacaagctgggtaagtaaaacattcatgcgaaacacataaataccaaaatagatgaaaatgaaactgtccaaattaatgacatgatccaaaactgctgtagaatttcaagggaaaaagaatccaataccagcttgaattgtccaagaagtctgcgaaaagccatagctggcactggactctggagaatgagtaagagattagagggaggtcattctaaacagggactgctgcagaagcaaaatcataggtagagataatgtgcaaagtggagaccaggcaggttggtgtcaaagaactccttaagaatagtttccatttctttacctgtcttaatcagcccttcaaaagctcacacgaaattgtactctggggctttgcaacaaaattctagagcccctgagatgcactctaagcatacgtggtctacttaaactcctcctctctcccatctgcctcaagttgagtataaaattccaaagggattgcagatttttatggaagttttcttacccctcatttttaatgaatattctaaatgtgttcactaccctttgaattgtattttaatattaggcaggctaagattaacttaaaatatttttaagaaagtatgattaggaggtacaagctttatcacagagaagtaaccacggaatacacaatgaacatctccctttctggactaaaaattaaatacatcagtatatacatgactagtaacagctccaaacttctggattatctatcagccttctgatagattgttcatgttatataatacactgtaacatcctttacacagaaaatacttgtatccaatgagtaactaagtgcctgatggcttgaattatttggacagctaaaatgtagctatgtctgttgtggcttgaggcacaccaaaggttaaaaaaatgtgaggtaagaaatcccacagtaaccgcatgttttataatttattattagaaccatgttctatatgacactggaagtggggtacatgctagaaggagtatttcaggggctcaagtgaagtaaacaatctgtctggcttcctatcacagtaatggatacaattcatagacctgagttattaacaggaaacttagaggttccaccttacataaactattttcaatttattaagctcatgcaatatttaggcaaagatttatagtttctattgaatacatatggctccatagttaacataatttgcttacccataaataaactagatgtaatttgtagtaaatgataattttaaaatcttcagaaattgtttttttctaaattttgttccagaaagattattccgcagtgtcaagacagcaataaaaacgacaaatatagcatgttctcactcatacatgggagcttaaaaagttgatctcatcgaaggggttgtcagaggtgggggagggtggggaggtgaggagatgaagagagattggttaatgggtaaaaacatacagttataatagacagaaagaataatttccagtatttgatagcacagcagggtggctacagttaacaacaatatattacatattttaaaatagcaaaaaaagaagatttgaaacattcccaacatgaagaaatgataaatgtttgagatgacagatatcctaaatagcctgatttaatcattatacactgtatgcatggatccagagatcacatggattccataaatatgtacacatattatgttttaattttgtaaagatagcaataaaataatttgtctacggatttatgcatgagcactgtaaaaatttagtatgcattctgacactaaatgggagatacagaaaggaaagtagattaacaaacacggccaaagtactaaaacaacacacatggaaattatttaatgacagagtgtgtgggaacagcaagtctcagtcagatattcctgcttaagagcctctggaagaacttacatcagacgcaaagatcagtgttagcgcctctcccagggagctacaagaaggctgaaagctgcaaatcatgtttaagaggatgccgatatcctcttagaaatgaagcaccaaagaacctcagattctaagggttagaggccaacctttaatctcccttattgttctcctcactccaaaagctgatcctaaatcaacttttaagatggagataatatcattcaaaagagagatcactatcctaatgctgaatggcttcattagctaaagtcaacatacacatcagtgggtcttatgattgtaaaaccctagaggactgaaagcactagcatactgtaaaccctcaagaagtcagaatttgtgatacacacatagtgttgtgctgaagtttatgtttacttagcaaacccctatttcataaataatgaagtttaattgtgtaaacaaagattatgatgcggatatattaaaacacttaggaggagaacttatcaggcctttcagagacacctatttacatatggaggagaaaataaatgtttgctgaataaattacgtaatgaatatagataattaatgtgctaattacaaatcagtaatgtttgttataacaaataacctaaaagtttctaggatatgacattataagttaagaatgaatgaatgaagtatattaaatttaccttggttttgaactgttctagaaagataattttcatctttgttttaatgtttgaaattcagatttttcaaaatatctatctgggcttttgaaggttctaatgtggttctcctttgacagcccttagcataatattacctatcatgaggtactaaataaatattttctgacagctgactctactgccctactcctaagaaggatgaaaatataccattgaacttgaactcagagaagtacaaatttaagcaaataatttaataagcctcctaactggagcaccataagcctttccgctaaagaagagtatggggaagacacacacaccccttcagataacccctgtcttacctgatgctacaaagtgctactggtaagtcaggcatatttcttcccaaattaaaagtgaaaactttcaaatgttggatacctttggatatcacatattgatctggaaaaacacattaaggtacactgccttggacaatctccttgcccatcgaatacacaccctggggctaccagaatacaggatatttgtgtttcttctcctacactgccaccatgtaaaaagacccatgagagaagtcttttgggcatacatttatccactctagaattataccagaaaggataaactacttaagatcttaaacgttcatatgtatcactccctgctatacatgctatttgcactgttcactttagaaatgtgagctatttgaggaactacggttcaaaagacagtcagtgatagcgtgaagattcctttactgaacaacaagactctaaaacactgcttattcttatcctcagtaactcgattactctttgttctttctggatcatcataattcttattcatgacctctaaatatgacccaaatgagaaacacaacttaggcaggtatcagagtgtgactacatcatctgaataacatcactccgaagtgtgatgcattctatcaaaatgtcaggtgaaaatatacccttcaaagttacataaataagctaaatcagtgaagggagtatgaagaaaggagtcaccttctttaacataattagtacatatagatctgcatcttggatatgtttgtacatgctagtaataagtaaaagagttaatcaaggtaacgtcccctttgcttaggtagcctgccaggtgagcttagcctagaaaaatctgatccagcctgctaagaatggtgtctcaggtgaagtggccagttaaaacaattggacattgttttggataacaatgctttctatctatatccaactacaatctgcaaagttaatttctgcatccctctacactctgcacgttagtgtgtatatcctgtgcatctccaacccccaccaaaatgttagtaaaatgaaaaagcacttatctacaggaaacttatgtgggttatcataacaacatagagtacatttaattaatcacacttcctttgatataaatggccatctatggtcatgcagagaacagtgaattaaatgaataccaataacatggcaatcagaaaaaccccaaaattatttttgtacaacaaaaagttttgatgatttgaatgcaaacattttagaaaatcaagcaaaatatattgttatttcatcaaaggttttaagattttaattcaaattttcctaatatgtggtcactctttatactacatttaaggttcaaaatataaagtattttaaatcatactgcatgcttaagtagtaacaaaacaatttacttacttctggatactcttacaagttctgatacattgaagactccagattttacaaaactatcctcaaggtaacctgaaaataaatattaaaggaaaaatgatcaatataagcagaaagtaaaataaatgattatacactagaatttaagtgttttaaagccaatggtttgaacaaaaaccaaatatgcttacaataaggactttaaaaaatgactcttaggaatgcaaattaggtttgtttaaacaaaaataaaaagtttagataccaaataatctcttaggaaaattttttcttccctttctaaaagtacaggtttattgatgcggtttgatttgccatggcccatgcatacagaatggtctgtgggctctcagtgaatgcttttgactcggtagcacctggtagactaaagcgaaaaatgaaagaaagaaaaaggaaaccacaaccacaattagcaccttgctggaataatgtcaaagatctcttaaagccaccgttcttttgtaaacccttctctgatgaaagaaaagtgaactgctgttaccagcaccccgacccttgttccagggtcactaataacataaaaagcagaacttgtatatacagcaaatacagaactttgcgttgacctatttctgggcatctttaatatacgttgcacgatttcactgctttcctcacccttgctactattccactggactccttttatttcaagaattagacaacttttctggcaaatggtggtgaatccaggcctctgggaatgccacatgacccttaagtcacaccggggcagggtccacagtggccatggagcctgcttgctagctggtctatgtccaaaactagagatgagaactcccacaaacaacagtaaccctgcacccagcccaccccattctcatctatgttaagggggtgtaatgagtgtgaggaataccttagcaggggaggttatggcctacttgcttctgtcctagggtgagaataagtttgaaaatcctcagaattgaaatacatctgagaaacaaacaaacaaaactagattctaagaactggcaatttgactggattttacataaagcttcagggctgaccaaggaattagatgcagttcagagatgtgaagcatgggtagtgcagcaacatggagcactgaaatcaaagagctgggatttgaatcctagccacagatgaccagttatgaaatcttggctaggttattagtcctctttttgcctcagattcctcacttaacaaattggagacaataaaaatcacctatcttatagagttgttactactggagataaaaatataaaccccatgataagcatgttaccaacaaattaagatcttagggccagtggaacctgcgatcagctatataccgaattacgcacactggcctccagacagtccaaaatgatccgcaaatctttattcagaaaatttaccagaacaaaaggcaccacactgcttttcaaccatacatagcatgaaaagacagaaaatcattcaattagcatatgtgtttcactgctgtgaactgaggagccactgatgtttgacatccacccacccaccttctttagaaacagaatgaaagaaggagtgagaggaagttgtaagatctcagtagggaataaaacaggtgccacattaagtcattattctgaaaaatatatatacatttttaagagtattataacaaaatgtcccaatttaatgcacttctattttaagaaactcttatttcttgagcaattaatttttaccaggttaaattcatttcagtaattattgagaaacttctaagtaacaatcactgtacaaggtgctaaaagtcatgaatacaaaaaaggacactgactgtcttgcctggtcggggaaagagatgttttgactcttctggaccactgtaacttactatcatatagaaagatttttgttgcttttgttattgtttatagttcattatactttattttatatagggtaaacttaataaagtaaatatattaagtacaaaaccttctttatcttgggaggccgaggtgggtggatcacaagatcaggagtttgagaccagcctggccaatatggtgaaaccccatctccactaaaaatacaaaaattagccgggcatggtggcgggcacctgtagtctcagctactcgggaggccgaggcaggagaatcacttgaacccggaaggcagaggttgtagtgagccgagatggagccattgcattccagtctgggcgacagaacaagactccatctcaaaaaaaaaaaaaaaacaaaacaaaacaaaaaaacaaaacaacctcctttatcatgactacagctcatatacttaaccagtcacacaagattatttttcatcacccaattgtactttgtaaatgcctacccttcatatcttcctcctgcagctccctgagatgagatggccctctttctacacactctagtctcatccttcaaaatccagcccaaccaccacccactctgtaaactgctcctccaactccttctaccacccactggcccagccagaaatctccttcctctgtacttgtatagcacctagtttgtactaattttatactttgtactttcagattttctgagagatctgttttcaagtcttgcagtcattgctggattatcagatcctttatttacagaagtgactgggttttgttcatctctatatcttccttaatgactaactcgttgcctatatatagagtaagtactaaataaacacagaacaaaattttaaaattcaactttacaaacagggtcacacattaacatcttagtcattttattacaatgtagatacagatggtttaagatttatggataattatactaacctctgttattccctagaacttgtttgctgaagagtgtatttaggcttttgggtcacatgagaaagagtaatgattagggtcggattgtatctcttactttgttgtgtactaatgtgtaatgtcaagcatttaatacaaagtaacaaccaaagaactggaagtgtttaaatagtaagagcccaaaaatatttgtgaaacacatcgatgaataagtgatgaacatttcaatgtatttacataaactatatcagaggtaatacaaaataacattacaatatctatgtgtaatctgaagttcatttccttattactccaatgagaagtcagagatccatctgctcctaagtcatgaccattaagatggagtggggtgtgagcctgttggaagccaaatcatgaagaagggatgagtcagctcaaggccaattctaccagtgggaagacagtcaggcagtcaaacacagacaatacaatgactattgcagctattcacagaaaaaaagaagacaattcagaatgtagcagggtgtttctccactccccacccccaacttcccaggttctaagaaattggaatctacggaaacaatggaaagaggtagtttaccgaaaccatgaaaagcattggaaatatatcagaacttctttggaacctactggataaaatgcaaaaaaccacagaggtcccactgggctctactcctgcatggagcccagtgagactttagtggaggaaggtttcctgaggatgagtgatgatgcctattaaccatgtacctatgggaacagggacaggtgagaatcagccaagtggggtagcctgggagaagcaccggaagcagatggctgccaccttcatgcatctctgcaggcagcatagcctttgtaacggacaggcattaaccaagacgtggcagagtgaaaaagaaatcatggatgaaatagtactcagatacttaaaatagtacttggatacctactagtgcttactcattagcatacagaagacaatacttgagggctgtagcaaaataactgagaggattttgaaatgggcaggggtcctgcagtaggatagggggtgaaactcagcaaaatgtcaggttatctgctgctaacataaccccatctgtaacctccaaggtccttgggcctttcaggaacatgtttttcacatttcatagaccactgtaaatctaaatagctaatacaacagctaaagatcttaaagcaatttggagacattcatatagtaaattcccttcgtctaccaaaggaaatatgagcatctctgaggcagagcagctgcttaatggttacagagcaatattacacaacagcttaatccaggaagaaaagaacaactctgcatttgtgtgatgctgtatttacactacatgtgtgctttttaaaaaaaataaaattgagtaggaaataaagacttctacaaactgaaaagtctcaaaggcaatatcaaattatattattttacttcttttttatttttctctgacaaaagcaacagtaaatcactactcagaagttaatatactgtttaacctcctttacaaacaataacagagggacacaatggcatatctaactgttaatatctcaaattataatcagtaccatttgaatgttaaacaacatttacatagaaaatccaaaggaagactgataatgctcatttttacagtctactgtgttctattcttgaaattaaaaaaaaagaagccacagaaagcagttattaaattcatgaaagccgtcttcaagtattcgaaggactattaatgtagatggtggatttgacttattctgcatagttccaggagctgttttttggctcaataaacagatttgtcatccaatgggaacaggcctaaaaaggcatgtgaaattttgcaaaggtagcataaccaatatattcccaacaactgtgatgaccttcacaagcaggcattaacttcacgttcaccattatcttataaaatatgtcatattattggtgttgccattttacagatgaggaaactttcatcttacagagatagtttctcagtggctataaagactcccactggatataaaaattcttgctttgtgaaggaaatctcaaaaaaaaaaaaaaaaaaaacagaaaaaaagaagaaagcatctcaaaagccactgcaacccacagattctcccttcttacacagatgttttcctatgttagttttctggcattgttcatttggagaacaaacaggtggacataagacatctataggcattttccagccctatgattgcaattgttcactttcttcaacagagtttaaaagaaggcttaattctttttgtaaagggacaagaagagattactttatactagctctttgccaatcttcatataacttcagataccacaactaacccattggtaattttctggtagtgatgttacaggacatagttctatcttcagtttctcaactgacttgaactatccatggttaaagctaaacttgtgttgaagttaaagctgaaactgtgattataaaatagaaatattaatcattgcaaagacggtgattttcttcacagagattaaatctcagcctatagcccaggttaacattcaaatattaatttagaattaagtgtatctctcaatatgaaacgtaaacccacgaggatgatttaggtgatcttggagggagtcagaaatttcccaactttaacacgccctgatagcattatatttttttcaatatttccttccagtcctttaaactttttccgcatatatatatatatttatttataaaatcaatatcaaatttaaatatagttgtatccagcttttttcctattaacattgtatctgtccttttagataaagtttttcaaaagcatgatctttatgactatatattgcatggctgtatcatactttatattaaccattccattgtttggcattttaggttatttcccaatttttaaaatataataaacaaatagcactgtaattaacatcctcatacacaaatctttgtcagccattctcatgatttccttaggctggagttcccagaattagaattacagggtcaaaggacataaactcttttaaaactcttggtaaaaactgtcaagcagctttccacaaagttgttttgccaacttacactccttagggcaagctgtgagcatgtccatctcacaatcctgctgccagacttacatattagtagggatttgtttttaattgtggcaagttgatagagaaaaaaggtcattacattaatgttacaactttcatttatttcattttaataaaatggactcatttcagatatatgagcatatttctttcaccagaacattaagaaacaaaacattttaaaaatcagaacattcataaatacacaaacattaaaaatatataaaatagaaattgtgctagcaggaaatttttttcctaatatcaatgagattgcatctacagtttcacaatgaaaatgttggctatgaatttatcactgatttttttttctcattatctgaaaaagtactcacttattcctagttttctcagatttttaaaaagttttctgacgagaatggctattgaatattatcaaattcttttttggcattagtagagattctccggtttttttctaacagcatttattggtgttatatattactgaattcgtagatttaattatctttgctcatccatggaagacagttcttaaatttactgttgaactggttggctcagtttcttctaatatttctacaggtagctggaaagcttttatggaaatttttgtattttatttgtcaagtttttataccaggagtatacacatgcttcataaaatggttttgatcattgtcccaatatgttttatgctctggaacaaaacaaaatattatttcataaaaagttattgaatgtttggaaaactttactagtaatatcatcttccttgaatctgttgcagagaagactcttagataactctgaatcgtgaatactattctacttttgctttctaatgttgagataaattttattatatattttccaaaaaaattcaatttttcagatttataaatttattagcaccgttattttacagtttactaagtgggctatgtttatttttatggcataataaaattaaatgtatgccctcttatctttttaatggatgtggaaggtatgcctctctccaacggtgttaaagcatactagctaaaaaggcagccctggggcaagactatcaccatttactatgtaaacctaaggcaagctgtctaactcttctacacctcacatttctcttccctaaaatataggtaataatcatactacctatgagtagatgcaaaaattgcataatcttttcaagtaatagtaaagcagacatctcaagagcaggaaaagaaaaagtagaatttccaaattagcaaagagaaaagaaaacacaataaataagaatgcaatcaaggcagcaaaaataagaaaataggatgtaaaaatatataataatatgaagtaaaatataagggataaaataaaatacataaatcactacaataaatgtatatggactgaattttcccataaagggagtttaggtcaactgaaaaatacaaaatccaactgttttcaagaaacacacctaacacaaaatgataataaagagaacaaaaagttgtaaataaatgggtaggcaaagagaaatcaggcaaattcaaacaaaaaggaagcagtatcagcaacggttaagagaaaacttaagctgaattacaacaaagataattataaatggataaaaggcacaattaataaagaagataaatcataaaccccacatgcaccaaaaaatattatgaatacaatctattaaaatacaagaaactttataaaaaataaagtcacagtgagaatttttactattaatgtatctttttaagaattgaacatgactgttagacaaagactaacttcatatcattcaaatacaaattatattttactgatatgttcatggaacttctaaaaacatcgatcatgtttttgaccaaagaggcaactttaacaaatccctaaaagtacagacttttaaggccatactgtctcatctttggcaaataaaagtaaataataaaaaaatgactgaattatctcaactacctagaaattaagaaaataaaccatgaaccaaagagaaaaatcaaaagggaaattataaactatctaaaaagcaatgaaaagaaaaagaagaaagaaagaaacccattacttaccataaaagaaagaacagcatcacaaccaccccaaaaattaaaaagatgaaattaaacataaaagctgaaattaacagaatagaaaaaaagaaatatttaaaaaaataaataaaacaaatgactctctaaaaagaccaacaagacagaaaaaccacttccatgcctgattaagggaaaaagagaaagtaaaaatatacaagtatagtcatgaatggcttaatggcagggacacattctgagaaatgtgttaataggcaatttcatggttgtatgaacatcacagagtgtacttacacaaacctagatggtataacctactacacacctaggctatatgcatgaaattgcatatagctcctaggctacaaacctgtatagcatactactgtactgataccgtaggggattttaagacaatggtatgtgtgtatctaaacatatctgaacatagcaaaggtaccataaaaatattataatcttatgggaccactgccatatgtaatctgtcttcgactgacctatcatgatgtggtacatgacatacaaatataaaaagaagacataaccatagaaatcaaatacattaaaacaattatgagagaataatacatacaacttattgactacaactttgaaaacttaaatgggcaagtattagtaaactaaaagtaaccaaaattgagcagagaagtgtaaaacctgagtggaccgattatcctagtgtagtggttgccaaatttgctgaacactggaaccatctgggattcttgaaagcagtttatgtttggcttccaaccccagctattctgatttaattgatatggggtgagacctggacatgagaactcttttaaaagttcccccaagtgattcaaatgtacagcaaagtttgggaatcactatgacaccacattcagaatgtggttccagagccactagcactggcataactggggagcttattagaagtgaagaagaataggctctaccccagaccctcagaatcagaatccacagcttaatgagatctgcaggtgattcataagtgtacttaaaaatttgacaatcctagaacatactagaaatgtgagtaagaaccacctttgaaaacagcaccaggtccaggcgagtgcacagctggattttatgtatcctttatctagtctttaggttccaatgttatttacactctcccaggccttaggaaataagacaagcttcctcatgaagaacactttcttataagcctctatgaggccagcaaaacttgaatacctaaatttgtagcctctctcatcgaaacaaaacaatgaaccaaccaatgaaagatcaagcacacaagtaaatgtgacttcaagatgcctaaataaaatatgaaattgaatacagcaatattatcaaaagaacaatacactattataatcagggtttattccatgaatgagtgcagctcactatgagaaaagctatcattacgatagaggaaaaagtcatatgaccatatcaagatgctgaaaatgtacttgacaccaagaggcaggcttacctaataataaatctaagcacaaatagagacaaagcaaataatacagactcttcagcaaaattcaacaataaattattctaaaaggggaacactagtctgtcattcctattttcccaacctccccagcctcctcctctttgcagcccttaaaaatgtaatctggaaaaaagccagtcacaaaaagacaaatactgtataattccacttacatgaactatctagggtagtcaaactcatagaaacaaagtcacatggtggttgccaggggctggggagagtagggaatggagagctgttatttaacaggtattgagtttcagttttgcaagatgaaaagtttctggaggttggttgcacaatgacgtgaatacatttcacactactgtattgtacacttaaaaatggttaagatgacaaatttaatgttacgcgtatttcactaaaatttaaaaatgcagtctaaaattttggacccagattgttaaccacattcttgtttacatatattcaagaacaatcttttacattgacatttatgtctgtcatcttatttataacaattacttggtcataattctcaccttaattgttactattctcatgattagtctctatctatatttttattcatatatttatggttatactttcctgttcttaatttttttattgagtcatcacattgccagtcagaataggtattcaagtaacatttttgcaaataaaatgaggaactctattttttgataccatgagtaataaagaatatatttccattgcctttgactgtaggtgaaactccttgagtgaaaaacaatgttttttccatcacaatttcaagtattctcccactgtctcctgttatttaatgtcgataaaaggaaatctagaagtaacttgtttttcatccaggacatttcaaaattttcttcatccacgaaatgtaaaaatttcaacaggatatatttagatacaagcctctcattatgtggctggaatagcattagtccttttaatccacatagataatttttagctcatcaaatttttctccatttgtctttgatcctacatcctccaatttctccacaatgaacacctaaataaaccttgaattttctattctctcatcatcaacccttttctcatcatcttaacctctgtgtttcctctgcttctggaataagtatcttggggttgtcctctatatcaatgcttttttccacagtatcagtgctgtttcttactcctccgatgcaattttaacgctatgaaagcaatttagtttttcttgatattcttcctcatctcacagaataccgcatttattgaagctattcttttgtaggttcacttttcgtataagtcttctgggtaaacattttctctggaatttttttctagttctttattttcaaagatatgtcctcgtggttcttgatcatatcccatttcccttgttcctccatattttctcaccaagggcatattgttgtgtgtgtgtgtcggggggggggggttcccctttttaacatattcagtaatgtaaactaattggaagagacagaaaacagatcaataagtcatctgaagatgagggtagacgaaacctttgggattagaggaaacgtcatcatccttgagtgtggtactgatttcatgagtatatgcatacgtcagaactggctgggtgtggtggctcatgcctgtaatcccagcactctaggaggccgaggcaggtggatcacttgagtccaggagcttaagaccagcctggacaacatagcgaaaccctacatctactaaaaatacatagcatggtggtacgcgcctctagtgccagctgctcaggaggctgaggcatgagaattgcttgaacctgggaggcaggggttgcaatgagccaagatcacaccactgcactccagaccgggcaacagagtgagatgctgtctcaacaaaacaaaacaaacaaacacatatgtcaaaactcatctaactgtacactatatatatgcaacttattgtatgctattatacctcaataaagttagcaagtgacctataaagagtggtttccaaattttcaaaaagtgctatttccacagcacaaaaagaatcacaagtgaatcagaaacattcagtgtaatcaggaatatttttgaaggtatgaattacaacagtcaggtatttttttgcagcttctagaatgttatcttaccaggttcctcattcatggtcaagtgaactctaagaacactgtagtatactccctagtaaacaaaagcacaaaagcagcaaacaggacttctctataatttgtcaaactgggagaagagaaactctatccacctgagattagtattctgaatcagcaattatattggagtgctacaattctcagtcagatacctctctacaaaattcatcatcagtatgctacataagatgaggagttcagaaaaatattccaaataatcatgtctaggatgtggtatacctacagggcataagaggatcactgtaagtatctccgcagaagtacccgctttttctaggcctaggtcaggttctgagtaagggaatgatcccacacactgcaagaacaggttatttatttagtctattattggtctaagcctctgcttcataaatcttggacattgtctgtaggtaggcattgccttggatgataggtatacaaaaaagaagaatgcaatactcacccaaaggggctcagaattcattaaggggagtagatgcgaaaatagagataaaatagtgcactaaatgctagtactgtaaaacagcactgcagagaggctctgaagaagtctcactgaggaggtgacaagggagtacaagcattctaggcagagaaacaacatgagcaaagatacaaagaagcagcacacggctaacgctaaaggcatagtccatgtgtgcaacggacaaatcatgaagggtcatattgtatgtcatgctaacgagctaggcttaggctagagtggagaccttggaaccatacaaggaggtgaatgaaataatcagatttgcacatcaccacagacctgtaatggatatatcagagggattaagacatgaggcaaaatatcgctacagagattaggaaatgattaaaatgatctaggtgagctagttaaagaggcaaagtgtaaaggtttttaaagagttattaagattcagcatcaattaccttctttttaaaacattttgcccctctcatcagcagcctgagcctttgtattcattcctctgttctttctacattctttctcccaaaagctcacaagtactcccttcttcacccatcaacattatataaggtaacattattcatgtgggctatttttggatatcaatttggacatggtaagcataaaatagcagaatactttatcatgtcccaacagacatgatcatcttctagttctatcttacttatttagaaaatactgctctgcttagaaagtacttcaattcagaaaatgacagcagtccaaaataccaaattttaaaatgaaaaatccattgcattgaaaacattactgcaaaatacacaatggagccagcatcttaccattcatcatgtcactgtttgtttcatgacattaacaagtggaagtgatgattttaataagatcaaatctgaaagtcaagtggttttcctgtcttcttcctgctgaatactgcaggaacacacatacatgcaaggtatagagcactgcgcaaggggaagatatgtctagtggaatcaggaattaaaatatctcagcaaaaacaggagtttggtatgaaagatgccaaggtccctaaagagcagaatgtaagtcaaaagaccccaaaaagatttgtaacaactttgaaaaccaaaacctgaccattgtttcttaaattcttctatgatcaatgacattatcaagcaaaagctaataagagtcagctgggtgtggtggttcacgcctgtaatcccagcacttgaggaggccagggtgggcggatcacatgaggtcaggagttcaagaccagcctggccaacatggcgaaaccccacttctcctaaaaatacaaaaattagccggacacggcccatgcctgtagtcccagctactcaggaggctgaggcaggagaattgcttgaacctgggaggcaaaagttgcagtgagctgagatcatgtcactgcactccagcctgggcaacagagcaagactccttctcaaacaaacaaacaacagtcaaattaacacacaaaagtccttgcttaaattattcattacctagatacgctttcatagtcacggagaaggaaagaaaaactgagactttagtaggagatttgtccaagatctttaaatcacatcctttaatcctataaggtagaaaaagattaaaactcctcgggtaattagacacatatctacttaatattttattctgtttgcaatatattactatagaattgtactctctttttaaacattatgcttaaatatacaagtgagagttgccttagtgcctggacagtttagtccagcgagcttaacttctgcaaagttcagtgattttaacaagcctagagcaagtccactatatttgtgatacaaaacaatcccagctttccgtctgtgaggcagaaaatgctttgcattattaaattgtagctgtatgtggcaaaagcagatcttgtaaatatggagagggaaagaatttaaactgagaggaaactttggatgcaggaggccaccgtagaaggaacctgaggccaggcatggtggctcatgcttataatcccaacactttgggaggctgaggtgggaggatcacttcagcccaggagctggggaccagcctaggcaacatagcaaggctctgtctctacaaaaaaattaaaaattagctgggcatggtggcacatgcctgttgtcccagctacttgagaggcttgaggtgggaagattgtttgaacccaggaggcaggctgcagtgagccatgactatgccactgcactccagcctgggcaacaaggcaagaccccatctcggggagagggggagttacatgagatacttgggtaaaagccatcactacaacactgcccagaacagcaggtaccatcacaacctcacctagaggaatttatgactcagacgtcttttcacatgaggattctgaccctcccttaaggggaacctagacattcaactaagaaaaatataggttatagcaatagcctttaaaatttagcaaattacaagctatttctgtgcaagccctcttggaagttttctggaactaggtacagtattaattaagtgcctacatcaatatattaaaattttacttggattctatgttaccttatgacaccatttcagataacacgagaccttaaaataccgttgtaaagttaaggaaagtttgaactaactgtagcccatgaacgagtcctttctctgacagcattgtgaaaggagagtactgtgttgaaattaactcttctccccattctttctttctctgacctgtatattaacacaagtcatgaaacacaaatctgacttgctgaaaaacccctgatgactcactacttatgaacctatattctatgtcacggctttaaatgctgctcaagccttgctcagacaccaagttcccttcctttccccttcttccatgtgaaatgctctttcctcggctaggactatatccaccctacaacctcttgttcatccttttatccaaactgttccatgcatcttatattccctgggaaggggtagacatctctgactccactatgactgctcctttaaatataaacttgtgtgcacacatctcttgcccagtaggcagtcacattttttaaaggtttttcctcaatttcaggcaagaaacagtgttcagaggtcaaataagggtaatggtaactgagaggtaaaagtaaattcaagagacctttcaaagtagaatatgaatgaatatgtggaggataaggaagaaaaagggttcctgggaaagaaatcatgagcaactctaaccaagggtatctagataggattctggtgactccaggatatcttaaaaagggaaaaagcaaaaacaaagaaaacaaaaaacccaagtctggtaaaataaaataaatttaactttggaaatgttaaattggagttaaccatgagacatctagggaaacatgtccgaaaagtagttggacacataggtctaaatcattaggagagagaggtatttcaaaggtaaacatctaggagaaaaggttaatatactttaaaaatcgcaaggtactgaaaacacagagaattaaagacaaaaatctgattaagaagacagaagaaatcaccatatgcaatttttaaacataggaaggttcctggattaccaggagaggtcctgttttcagaggcacgggcaaagttttaaacagagcatggccaactaaatcaaataaatattcaggaatatggaagcaagaacaggacagaaagaaaccactggtcatggatttaatgagaatcatttcagtggggacagaagctgagaagaaatcaagatggaatttcaggggaaatcaagatgagactttgacatccttcatgccatgttacgaagaagaagagagagagatgagacacttggttaaaggggtttgtccaaatgaggaacaaaagatgtatgttttaaaataagaaataagttggtaggtaggaatcagtgaaataagaggcagagtaagagggctaggaaaagtaaaggacagacagaagtttcaatagacacagaaagttgatggcttcataaagtagaaacaccatggaaaggaaaggaggggaaaaaaattatacaatgttaatacaagcttctacaagataaattcttggtaggaaaaaagtaatctctaaagatacatttgtaccttttctcatgtcaatactgagatttatgtaacaaaagtcactccacctttccttttatgccaataggcttataacaacatttgctttctaaaaattacaattctatttcatcatgagacttgaaagcatctgtttcttttgcctcctttataaaatctctaacattctattcttatgcatcttctgtaacttcggtatgtcatcttaagcctttagagaagagcagtataaaaattcaacactttttttttttttgagacggagtctcactctgccacccaggctgctgtgcaatgacatggtctcggcccactgcaacctctgcctcccaggttcaagcgattctcctgcctcagcctcccaagtagctgggactacaggcaagtgccaccacacccggctaatttttgtatttttagtagagacggggtttcactatgttggccaggctggtctcaaactcctgaccttgtgatctgcccgcctcagcctatcaaagtgctgggattacaattcaacacatttctatttgattccacatcaaatgatactttctgcaggaagccttcttgatcaaactagctgaagagaaagtagaatgaaaaaacccctcacttttatcaagcacctgctatctgtcaggtgtgctcccctatgtgatcctcacaactggcatgaacataattgactgcacaaagcggttggctgacttgctcattctcctgatgacccttataatcattcaagggaaaattttaattccaaagttcatgctcttttcactccaccatgccacctacaatggtgggaaacagtatttcacaactttgaactcctacaagacctgcatcgtaacactaatatttagtctttatcttaaatataaatacatatgtaatatacatttcatatattataattatgtatatattattttgtagattttatgaacaaaaacatttgggaaaagcaaggttcatgtgtaactcacatttttatcttctccagtatctagccgagtgtgatgcatacaatagatgctcaataaatatctgctggctgaaaaatctacctatagacagctctttctgaattgtttatggttcttggtataaaatggtgtgtattttacacaagggcaaatggctgtctctgcttctaatgttgagctgactcaaatgtagtatttaattgttaactcagcaatcgttaggcaattaatataatttgttatctgatagagtaggtgactggggagacatggaaaaatctccttctctcaggaccttacaagacattcctaaattgtcccctttttttgactctttcacattaagtattacaaataatcaggctagaagcactgtggaggctgggcatggtgccaactgctatgtagatcaacctttcatgagtgggctgtatacaagttcccataatgtaccctgtaaaattatgtagctgagggctatgcgttcttctggctttttaagagtaatttgtgaaagaaacacttccctcatcctctcttcctttactctgaatcctattctaaatttgaacatttaagaactttattgaatgtgacgtctccaaacaagttagaggataaagaagaaaaatgttttaaaacaaaatacattaaaaaaaaagtcctttgattttagcactgacccatacagacctcattctcaaattacttaaaggttttacctacgatgtcaggtcttacctgccattaaccagtcctttcagcatctttctccaaatatttttatgaatagagagcctatttatagtcgaatgcacattgtctagtgccaaagtttaaaatcaccttttaagtatcatgaaatagtgcatttttcctcattaaaaacatcttgatcctaatggacacaataaatgaggacatgagaaggaatagacatgaatttattaagaagtgaatgaggccgggtgcggtggctcatgcctgtaatcccagcactttgggaggctgaggcgggtggatcacgaggttaggagttcaagaccagcctggccaacatggtgaaaccccatctctactaaaaatagaaaaaattagccaggcacggtagcaggcgcctgtaatcccagctactcaggaggctgaggcaggagaattgcttgaacccgggaggcagaggttgcagtgagccgagatcacgccactgcactccatcctgggcgacagagtgagactccatctcaaaaaaaaaaaaaaaaaaagtgaatgaaatatgatttgaaaaagccagagtaaatttctcttttctttgactttgactttgaacaccatattccaagataaaacgtggtatgaggtcctcaaggacctatgcgaatttatctgcctttatgtacagattaaaaagtactaagtttgtcctaaattctaagatctgaaaaatcaagcaaatatcggctctagtgatctcaacagatgaacaaatgacaatgaatactgaagattttgaactagttttcctaataattatttggtttgtttctattagttttatgacaaccttctgttggctttgatttcagtatctataaaataacattggagagagagctatctcaaaatttttatgacttaaagaatttcttttttttttttttttttttgagatggagtctcgctctgttgtccaggatggctggagtgcagtggtgcgatctcggctaactgcaagctccgcctcccaggttcacgccactctcctgcctcagcctccccagcagctgagactacaggcgcccgccaccatgcccggctaatttttttgtatttttagtagagacggggtttcaccatgttagccagaatggtctcgatctcctgacctcgtgatccactcgcctcggcctcccaaagtgctaggattacaggcgtaagacaccacgcccagccagcgacttaaagaatttcttaagtgcaagataagcacatagctatcattaatagataatccttctttgatttactcagttatttatttagtgtcatccttgctccagagaggatataaggtggcttacttgaggtacacccaatatataatcctactggttcccagaggtgttgccacactacatgcataagtcaacacacaaaatagcacaagcacctataaaacctacaaaaaggaaagtagcatgttaagtccatgttattcccggtaagaaagttctgcttaatgatactagaaaggccccaaaagtttatatcataaaatttgcaaaaactgccctagcatttaacatgtcttcgtcatattaccagcagagaattccccacaaaactaccagccttcctgaactccaaaataagacattagtttggaactgacttagaagcaaaaatctgaattctagattgctatgttttccttggattttacccattctaggattagtcaagggattgagattgggaaatcttaaagatcatagtccaaagaatgtagacacacaaaataataaagcaagtcaaagctaatttccaaagattaccatccaatcaatcacacatttcctaaaagtagcagtggagtttttaattattaaaggtaaaaagagattcatgtctaagtcccaaaattaatggtttaccctcatttggtccacaagagttgtttgctataaccaagagaggacatttttagttctattgcttaggagggattaacttgttaaaaaaaaaaaaaaaaaaacaaagaagaagaagtgaatataaatatataacttctgactctatcataaacaaggcaaatgtgtatccctagaaaaatgaagtgcttagcgcttctcagccaaaattgcaatgccatgtccttgggtgctatctgagttgtagagcaccttcactccaaaaagattacggtgcccacccctgccacgtaacaaagaatgcaaacaaaacatttaagtcacaaatcgtttaaagaaataccataaaggctacttaaaagctctataaaataacaaatgacaaaaaattacttaaatattttataaaataatatcaaatattcctttccaaaaatgcgttgcctttgctgcttgtgcttaaatactaattccaacacagaaactcaaagtaagaactaaaggcctatctgtagatgtccatactatagtttgaagagctttagggtcacccttcagaagttctaagtcagtaagaaagtagtctcaaagtcagacattcaagcctgatgctggagaaaagccaagccagaggaggtgttaagtttgtgggtaggcatatgcatctgcacttataggatgatcggatgggattccaccttcaagtcaacagtggggaacagatttcaaagagcctatatctccaaaagggcttgaatttttgccatctcttcccaagctgttggggaataaacacaggaatagacggtagcaatttccatgggttgcacatctcccagtggaaaactaccagtgataagaaagtgttggtattcaaggtgatctttttcaaaagcttagcttgtatttggtataacaattcaagcagcaaagtgatttgattgtttcattgcttgtggtggtagactgaattttctcatacatggatcgtgccttctcaagacacaaaatctcaattttggagatttcatattttggccaaggcaagaatacagagataaaaagagcttcctaaagataaattatgtcctaaaataccaaatatgcttatacttaaaaaagaagcttttaatagaaagtataatttactccagttgactacaaaacaaaaaccttaataagttctagttgttcacatttaaaattagaaaacattttatattctaggtttaatttatttcgaagtattacaaaacaaactcttaagctcataaaaaattctttaataatctctatcattaagtccaaaatagaattccttaataagccttatggttgagttcatagtattataatacacaaggcatattaaagtcaatattttacattctggataattaaataaaattctaattatattccatttaagttgggtataatgtgtattttatattacattctggctctaaaaaaatagaatcaacgtacgatttacatatatacaattttcaactaatcataaaatgtatttatctgtagcatcccagtttcaggacacagtctcaaaaaggtttgagttccaaggaaaatttaaaagggaaaaaaattagaggtgttctaccttggttgtttttgtttgccatgttatatgcaaacagagaaataaagagatgctacatcgaatgcagcaaaaatgaaattttaaccaagcttcttgacaaatattgaaaaattgaatgatgttacataactattcaaggattatttattcagctcaagtagagaacagttttaggtgagtataattccttctgtacatgttcagaaatgaacttcaaacaataactgctttattagtttcaaatcaagctttcattcaaatgcagaaaacatatccgttgtttagtccgacttataatagctatcaactctttttctaccaaaggttcccctcttctcccacctcattctttgtaagatgagtaaggagacttttaaaaaatgtttggataaaattcattttgtctatcatgcaacacagggaaaatatcagttaattaaaaagaaaaaaatctttgtaaagttaaaagaccctataagttaatgaaatattctgaacttctgaaaatttttgacaaaatttattatattctaagtagcctttttggaaagataactaaaataatatcaatcctccattcacacacaacaaaataaaataaatttaactgggaattacattttaaattattctgtttttaatgttttgctctcaatgtacagtaatatttaaatgatttatgaagaaaatgaaaaatcaacttagcatacatttttaaacctgtgtttaattagaactttttatctttgaagtgtatactacttttgtcaacaatatgattttgtacaatacagaattaataaatatttggaaaaagataatttttctgaaataaaaaaacataggactcagaaaaatatagtctgttttgattttgcatttttacttgtatatctacttgctgtatctttctaaaatcattttaagacaaaattggtctgataaactttcttgcaattttggtgttcttctggtatttcagcctcatattagctaagcacgacttcaaggaagatcaaacgatggaggacctaaaaactaagtctacctgaggaaacttttcctattacttcatataaactttctggtttattttcaacgaaaggacagatgagattgtttggggaggtggggggcatgtgtagctggttcggggtttttgtgtttggttttgtttttgttagtttattcttagagcactcttttactaaagtcaccaatataattcacattcttttaataatgaaaaactgcttgtgctagttttatctcatgagaaaaaacactgttcctaaatcaaaagcaaaatgttgtatgttcagagctatatgaagacagccaagttataaaagcccattttcagatctggaacaacttctgaaaacaaagagggtatttgggataccttatgctaaagaaaaaaaaaatcctgctttcattatttcctgattctggagatccaataaaaactttatggaataaaaagtcttgcaaaaatccttcagtgaaaacacaaccaaccactcccacccccaacccccttctaaagtaatgagagttgataaactataattgcagtatggaaatttttacattttcttatgagttttaaaagaaagattaaaaggttcattggcttttcaaacagcaattattttagcacctaaaagatacacaactaaaatatatgcgtatttattttcaaagaaacaccaacaaaaattaaaacattggtgattaggtaaatactgatgacgccaatataaaagtatttgccactgcaaagggcctaagcacaatcacatcttgtcccgatcatacctgcctgccagaacaaaataggcagctgaccaattatggggtgtttatctatacagtggtacctttgttctccaacaatgtcagattgcaaatgtcctggaacacatatttacctggaggattcttggcaggatcattgtggcttggacttcctgattgtccagaatctgtaaagaaatcacagaaaatgttttctttttaatttgttttgaaagaatttcacaatcctcaaaggactcgaaaaaaaaatttgaaggtataaaaatgaagttgagtgcttaaataaaatacactttcccaagacttttgatagaaacattttactcatcaaactacatgaatgcatatacatatttctatgtcaaaagaaaaacacaagtattgatctataattttcttgggctagagcaaggtttttttgaaacaaaagatctggctacaaagccattgaagatggtttgaaggttaggcaaatattgaggcctgtcagtagcaatatgaaataaagcagatatattctcttaaaaatgcaatctaagtgtaattaaacgtgcatttaaaagcctgaaagtatgtttttattcaatgagtaaaatacacagaaatgagagtccgcttttccatgatttcacacacaagtacacatacccactccaataatctcccaacctactggatccaggcccagatttatctacatcccataatagcaatcgatttgcaaacagcaaggaaagcataaattactaggtagaaaccaacatggctttgtggagagcaaatggttgaatcaatttaatttccatccatgacagatggacagactttgcaggtaaggaggaagagatcaatgtcgtatatctgaatttcctaccccatactattcctcattgatgctacagaaagaaacgtggaagacatacaactgttaggcaacatgccctttcggactgatctgacactgttgtgttttgctcactcctcttccctccttgtaccctctccatttatctgtgtcatttgccccatattattatacacttacttgcgagttgctttgtaatcttcttttattggttctagcatttaagttttgtcgccccaactaaattgcatactcctaagcagaggcagagattctgtctacttcttttgtgtcctcctcagtgtgctgttcatggctgtgaatgcactaggcttgcagtaaacgccggaggaatggatggctcagctccagcagcctctttgcttgcctagaaaaggcaattttgaacttgataatgaatttcaacaaaatttgataggtggggcacaaatgacggctctgtcatgtactgccatatactgacaagtctcttcccccaaaccttgccattatacttgagccaagaaagtgatttggttaagcaggaaaatcatatgctggtttttttcatcggggttattctgtccttccaggtaagtgattaacatactgaaattgctgcttctactattaaatgcaagaacatcctgttagtttcttctcatataaaacctggttatttatttctgccctttgcctcatgcctgttagcttagatttaatgctgaaatcagaattttaccccttcatcccatttccttaattgtctttttggttttattctagaacagatttcatgagatcttggcaggcatatttagtgattcccacattttcctccaattgtttcctgatttttcaaaatgaaagtaaagaaactagaaatgaccattcttcatctggctcgagtctcctgaagacagtcagagagctgagaactctctgaaaatctctctcatctcccatgaagtcctcttattactttttctgaaatcaaggcaagattcagtgacttataaattaggagatcaatcttcttcgttctacattcctttaaaaaactggtacaatatgggccactttccaggcctggagtatgatagctacataaaaatgataaatcataactttttgctatagcatcagctatttttaccttgagttcctctgacaaatgtctctcagcattgatattacattccagtttaatttctcaagcgattctaacattttttaggaattcctacttatgtataatacacccactgaccagagcctccctatgttttactttccctccaaagctatctcactcttatgaaggtctagacatgcacccctcaaggtggctaatgccaagcttgtgatgacacctgagatagttaaagttgtcaattgttgcagcagtcgccttatttcaggagttgtagactctgcatgagccttagcatgtttagttacagcaacttcaaaatggtgccgcaaaactcttttccatcatctgttgctaaaatttgggtccagcagagaaaagaatgaaaagtctcttccattcgtaagaaactatccagctagaacaatggcatcccctgttaccacaacatcccacttgggaaactctattcttttctgctataaattactttttcttctcatttccaacaactgcagaccaacttcttcgattgaaaaaatatacttactaaaaaaaccacaagcatttgagggaaagctgaagtagaccctaaatttgaggcacacattggctttttgtaacaattccactttctaaaatgatctggtgtttactggcacacaatgacagactccttcatatgccaaagcccataccttctcatgaaataaagcagtgtatactgtgtctcagaaacataggagagggccctctcagtgagcaaatgatagagcatttacttttcagactgtaaattctaacactataatctactcttaactcttatgtcaccttatatcggtcacttaattccaactgctggaaaaggaagtaaccagggagtcgtggttggcagagaaaccaaaaatgaactgttattgtggttgacttcagagaaggaattattcagaccacatctaaaccccttccaattcaccacctaggtcaaattactctatacccaaaggttttatttaaccacttccatcactttgctcaacaccccccacctctctctctctctctctctctctctgtgtgtgtgtgtgtgtgtgtgtgtgtgtgtgtgtgtgtgtgtgtgtgtgtatttaatatgttacagtgaagcctggctctgtccctcactagtgacatgatcttgtacaaaattacttactcttaagagtcttggtgtctggatcttgaaaactgcaataatattatctaccttgtaaaatcattgcaagattctatcacattaagcaccaaaagcattgggtcagacacagtctacattatcagtaaataaaagatattaatattaagcatagagccacatttaaaatgattaatatatttaatggtttaaacatattaaaatgaaaaaattaatcatttttaatgtggctctatgcttaataacaactaacttttaggaagaaagggagaaaagggacataactaagttctgtccatcccaacacacgcatctgaaaatgactggtgggatgactaagcatggagaagtgtgtgcctacctgagaaatcctgtgtaaatgctttcacccctcattccccaaaagggaggagtccactgctcttcaaggctcttagcagctgtcatgctcaaaaggcagtagataccagccagttgatgaaaattaccttccagaaggctgaagtctttgaggaacaaggctgctaagagttgtgagctgcccagcatactgggtctggtgtctgggaaaaaaaattttttttttttttttgagacagagtcttgctctgtcacccaggctagagtgcagtagcactatcacagctcactgaagcctccacctcctgggttcaagccattcttgtgcttcagcctcccgagtagctaggactacaggcgcacaccaccacacccagctagtttttgtattttttggtagagacggggtttcaccatgttggtcaggctggtcttgaactcctggcctgaagcgatccgcctacctcggcctcccaaagtgctgggattacaggtgtgagccaccacacccagtttagtgtctggaaagattttgatgcagtagagaaaaagagaggagtttttggaggcagccaaccaaaaccagtcctccctcattctcttccacctctcattttatcttcctcgatctcaatctctattttccccattctttaagtgtgggtttcatgttccccattctttaagtgtgggttaaacatatgtttattcttctaaaaaaaaagtaatgaagttatttctaaattactatattttaaactcaatcagttccttcttctccaggttaaagattctccaggaacaagaaaaggttcacattcatgcacgacccttaccaacttttcaatcctttcgtccactccttttttaaaagcggtcaatctctcgtggctcttctaatatctaagcttacctaaggagtgagcagtttttcctatgacccaattttatggaagatcctaggacacataagtgatcaaacggcttgtccaaagttgcatagcaactattaaaacttatgttctctatatggacagcctattcagacacaatacttcttgaatcgttatgatgcaatcctaaaataatgcgaagctaaatgatttttcagtagtttaaatgtttctgggaaacttaccttcccctaacctccctcacccttcccaccattcaccaatacattcaaaatctttttcagaatctttttttaaacctttagctattttctatatctaagttggaagcaattattagtatcactgaactctatatactaattgacgttttaaagagaggccaattctataaatcaaatttgtctccattaagcaaaggaaattctaatgttttatggacaatctggtggaagctctgtaagatgtgtgttaaatatatatgacaataaataagtaatagcctgtaaagtatttcttactgagcactaactttctggagtagatacactgcaactatctgaggtagataaatcatcaaaactgtcaaattttttttgtaggtcattaatgtaaacatcatttaaatgtaaatcaattaagatttatgctcacgcctgtaaatcccagcacttttggaggctgaggcaggcagattacttgaggccaggagtttgagaccagcctggccaacgtggtgaaaccccgtctctaccaaaaaatacaaaaaagtagccaggtgcggtggcacacacctgtaatcccagctacttgagaggctgagacatgagaatcacttggacctgggaggtggaggttgcagtgagccaagatcggctcatgtattccaaacacctggtaatgtttggaacacagtaggtgctctgtaatgcttattaaatttatatttaatttacaataatgacctttaaatattgttttaaaaaaagtatactctatgccatgtagaagctcagaggctgcctgaagagacagaaatatacaaataaaaaaatacataaatcaagaggggacagatgattcttcctaggaaaggtgggcaagggcatatcataaaagatatcaaaagaaggtgaccttaggaacaatgccgtgaaaaaacgacctgatttcccacctttctaagacatatttcactcttttaccaagaagatctttataagacccaaaactgattaagctaaacatctgctaaaacctttacatatattctgaaaatagtatgccattcatggcaccttgatctggtccccatcagcacctgggtcatactttagcctttggactccttgtgtgtctcctgcatttgatgtctccaagtctgtgcataatgttcccccttttttctccctgaagtcccccagggtgaggtcatcccctttacatcctcaacaatatgacacgaagtctattattgccctatttagccttatagccctaatctttgggatagggcctggcacatttggttaagtcaaatgaacagaaaaccatcagtctataaactataaaagtgcacaagaaagaaagacaaagcataccgctctgtgtaaaatcatacagtagaagtcaaacagataaatttcttgtggcaagccagggaaacagacacacaattcccagggctaagtctctcagtctaatgtaaggctcaatcctacttcccaacttcctgaagaaatatttggaaacaagatagggtggataagacatactattttgagttagaaattattttttgtccatctcctataaagagaagaaatgtttgttgaaggtccatgtccctactttgcaagcactgaggcaagaaagttttaatgacctttatagataaactttctactcctagatgaaacttcttttaggaactctttttattctctgacaccatggcttgaggatcaacagaaaaagacaactggaaaagcataattttaatttataatgagtttggtgcaaagaaggagctgtacaaggtgagttttcaggtcccctgtggctctaaaattctatgattccataacaatatagcttttatatcaagggatatcagaggagtaaatgaaacccacaatgtaacctgttaacctacagatagcctcttgctagaactaaacttagtcatcctgtgataaagggcccttttgtcatagttctttgccttaagcaggtgaagaaatagcccattgtcaatgaaagaataccatgagattttttttaaggctcagaacagtctctttctttctctctaaaacattattaattgataatataataaaacagtatatttttacaattaaatatatagcatgccagaaacaagacgtaacaggtaagaaacaaaagcttgacggaaggaatacaaatgcatgtattttatagtagggaaataaaaaggtaaaacaaaaacatctatattattaagggtaatggagagcaaactattctccttgggccaaaccttcttctctcttcccctctctctgcccaaagttttctacctcactctttgcagtttactgtctcccatgactgattccttgggatttacagaacactagctttccataatcaagtttcctattacataatttggcttttttttttccagcacagttaaaacaccaggcagcttcagttttaatggaaggttgcttcattgctttgggtgacacaaaattatagttctacattattttattttctctctattagatgtgtattaaaataagacaacgaaagaacatgggaaaactgagtgttttccttgcctctcataagcatgtaaatgtttgggaaatggtttctctctctctctccctccttcattcttcgctcctgtgtgtgtgtgtgtgtgtgtatgtgtgtgtgtgtgtgtgtgtgtgtgtgtgtgtgtgtgtgtgtgtgcctgtgtctccctttatctcctgtctctctctgcttctgtctctctgtctcttttcaatagggcattaaattatttggagtccacttcactgcaaaacttaacttaacaagctgttcatgaaaagttttaactttatcactttgttaatggaatccctgatcttgtttgttgtttgtttgtttgtttttttagtgaatccgtactcctcctaaacccagttctgagcaataagagaaattagacctctctgaatattttggcagaaccaatataatatttgggagatgcagtttcctgcatattttaaactatttactatttcaagtatgaagacctatatcttcagatccctctttctgttgtttaacattgattttaaaatatacgtttgatttagcaaaacgcatagtttaaaaagatgttgctacacttaagatcttcatgataaagtaatttcattaaccaaagaaaactacagaacaagagagtagatatacgatatatcctgtttcattcctgaacatcccagttgttttatcattaagctttcttttaaagagccacttttttgcttaacaaggagattaggtacaaagagtcatatcccaaggattaaaataaggatttgttagcgctcaagactgaaatttgtccacagggaattaactgaaaaaataggccactgaaatttaaggtggaaaaaaaatcatattatcaaaaatcatatatcaaaaaaaatcaaagcaaatcattctaccacaggggactactaatgaatcccctgcaaatatgaaaccctgcacaaaaagtgttaaacctgccaacatctctgaccagagggctgtggtacttcattaagtagtaccaacccaccccccacaacaatgggaagctaggataatcatatctgacctttctgccctaacctaagattaagttcaatgacttcctactgatctagggattgagtgaaccaaaggtcataatcaggatcacctacagttcttgcttttgaaggctttaacctacagaatgcaaaaacaccgtactggtcattgtcaagattgctgactttctacagtgtgttttcaattaagtaaataaaatgtggtaattaaatcaagattgcataatatgtttttgatttgtaatcttatttaaattaattaactgactcaatccttgcttagtttttaaactggtcgagttagggaaagagtccctgggagcaaatccagttttctatctttaaaaacaaggcaaagcaatctggcatacttaaaaatatacattaaatgcaccagcataatataaatacagaggcaagggtgctaatgtagaggagggaagagttttatggcacgattttgactaaaagaaatagctctcgcactagagagaaataaactaaaacattatttattcaaaacatttcttttcgaattttatgaagattgcatatttgttggaagcaaaacatttccagctgtattttaagtttctgaagagggttgtaagatttataatctttcataaatgctgcccatatcttataatattagatgaacacgccactgcgtactttgaggaacaatttgccaacgcagtttgccacatgaaaataataaagtcctttccaaaacccagccagatccagtaggaaaagatgagatgaatgttctttcttttccatctgggagacattttggatttcagctatactatgtaatatacattttttccccttggaaaccaagaaacctgcattttacaacaaggtatgtagtgcaaagaaaatgctggtgaaataagaatctgaaaatgaaaaccagaatgtcatcagactcaagaacataatcatgaaggcaaatcgaaaaatcaatgcagaatttcaacataaaacaaatgcaatgtttatgatcctattagtcttaaatttttctcttaaaaggaaagcatagaaaaataagtgctgttttacctccaaagtcctgaacagcatttatgttactacctagcaccatgacttacatatctggtttatcctggagtcttcacgcattattctaaatcccacacatacaacactcctgtgtacacatggcccctctgtgctatgtcacttcatgtattttcccaacacttaatatatctaggttaaaatcagacataagactttctaatatttcattggcaatctttcttctcagggagcaggacatgttctctccaaactgcctggagagtcaggactctgggctctatccggcaactgccaagcactagcacgctgactctaagcaaaccatttcacgcacgaatcagttttcatcttgcccagtggcaactagttaatgaaaggtaagagtttagtcttagttgttttcaaaggaattagaaatactaggaaaaaaataatttcacacaacagtgaaatatgcacaagtatttttgtggaaaaaggctatgagatatatatatttaatgttctttaaggtttaattagtactcctcctccccctcctaaaaaaaaaaaaatccccacctacttggttgcactgccccttgcaaacgctgacaacacaggtaattgaagggctgggttagagtgcaactcttctgctacattttaaaacccatggggtcaagaaacatgttagtcttattcactgccctagcatattcctggcacatactagatgctcaatcagtatgtgttgaatgactaaccactgttttacagagaacaagatgatgactggtagcagttaaaacagttcatcttccttaaattacaaacaaactgccagtaataccaatcataactttcagtttttgattattatctacacatattctaatttttaagtttctacaacctctctacaaatacaaatgtagtgattgactcaatgaccaaaaagtcatattcttattttttcattgctcattttttcataggcatatgttcctaaaaaattttttaaattggatacagatttctctatcatgttagctaaaaagatactttgccaaatcattaaaatgtttatgtttatatccttatgtgagcttagagagaagaaactggatgggttttttatatcttatgttacttacatgtgattaataaccagtccttgttttattattaaattatggctcttaagtctgtgatactatattcatataaaaataaatgtatacatttaaactcaagatgcatagcaattaactggataacagagtaagatgatgcatagcctactttctacaaaggtaaagtagatttgtacgtggggtattcattactgcttctgttcataaaataactttatcaaaatattagaggaaaaaaatcagataagtcatctgatgaacaggaagcttgctgatgtggcagataatagtattaaatgtcctaacagttccttgataagtggttcaaagaacttctgtccccatgttttcaaggcaaaagttaatataccaggaataaaactacttgaataatgcatcattgaaccaacatttttgaaaagggataaaatgaggaaacaaatgaggagacagtaatttcctcttgcaaattaaaactgtgcaggcaaagaaaggaactcaattatactgataaaataaaaacaaaaaaatagctgacatgattttcctttttgtaaaaagagaaggtcaagaatattctaataagtgaaataatgggtttgaaagaactttgaaaagtttacaagctcacagagacatgaagatggggcattttatggggcaatattctttcaaacagtcacttaaagagaacagtttaaaatacagataatcctggccaggcacggtggcatatgcctttaatcccaacactatgggaggctgaggtgggtggataacctgaggtcaggagttcaagaccagcctggccaacataatgaaattccatctctactaaaaatacaataattagctgggcgtagtggtgggtgcctgtagtcccagctacttgggaggctgaagtgggaggatcacctgaggtcaggagttcgagaccagcctggccaacatggtgaaactccacctctactaaaaatacaataattagctgggcatagcggtgggtgcctatagtcccaactactcgagaggctaaggtgggaggatcatctgagccctggaggttgaggctgcagtgagctgagattacatcactgcactccagcctcggtgacagagtgagcccctatcttgaaaaaaataaacaaaaataaaaaaaatacagataattctaaccaagaataataaagaataacagaagcccaccatgaaatctactactcatcactatggttatttgggaaatgggaaaataaatgatgacgggcatgttcacttgctatatccattttaaaaaagggaactgagagtatactggtgcagagctatgtaccaggtgctcaaaattcctcccattttgtcttgttactcattttatctttaatagagattcaaatcaattccttatgattcaaaaatgcctaagccaaatccaaagagtatgaaaaaatcaaggttctgcataatgtcccatccatatgccttaaccctgaatgatatcaaacctatgtaatcttagacatcaatgccttccagatgtgacaaaattttaacacagaccaacttcaagctttttactgcagactcatctcccatgctcataaagattattttcattgcacgtaccattacatatggctaatgtttaattttccaaattgattattatgctgccatttcaaaactgacattgccttccaatccaatcaaaaaacaaactatgctgcatactcaacctccaacaaacacatacacaaaaacaagaaatcacatcattatttccaagttctagatagtgcttggttacaagaccagttgaacttttccttgtccactcttggtacctccaaaagatggaaaaggggaaggagggatcatccaattctttgtcagagttaattgccataggaataatttgagcctgtcacctgttgtttttggtcttaaagattgcttctaatcagacaagatcaaattcttcttgacatttaaagcatgttaaaattctaaaattaactaacaagattgttcatggatattttgcaaaaccatctaacagcaaggccatgacagaaatgtataaactaaattttcagataggatttaaaaaattagtaactcaacaccagtaagaaaaactggtgtgataaagctttggatgatattatgcaaacttaattcccctgccccaaacaattgctttgaatcttacctaaatctcatccctccacccacccccaaaattagaattgccctgtaacggtaacttgtcctcagatccatcctgaactctgtttctgcaaaccacctttcccagctccattaactattgacttcaggctaggtccaaccaacaggaggcaatggtaggagtttgggaatttggagggtgggaagaaaggagaaggagaggtattccttccctcctctgctttgacatttgtctccaaacagtggtgagttttcctcttgtgattcttgcttccactgaacaagttcctccctctgtgatgccctcccttcaggcagctccagctcaatttgtgtagtagattcctactgatgctaatgactgggtgacctcactgcccattcagcttttcatctattctaacattactgtaactggccttgcccatgaaattcctcctattggactatctggtagtttattttactcaaatctgacagatacatttgtttttttgaatttggcatatctgtcactctaaaatacgtgtcaggtaatagaattaagcagtattagacaaatataataacttttttaaaaaccaatagatttcacgtgtttgttatgattctcatcttttaaaaaaaagatgagaaagcactgccaccattcagtactaagtacaaaattctgtatcccaaagttttttgtaatgcatactgatacataaaaataatcaagtttttaaaaaaggcaactagatgctcaatgccatgttctaaatatatctcttccaggaggtcttctgataatcctacccatccatccaagtttacttcttctttttatcatctcctagtctctctaaccaatttttaacaagttttttcttgtgcatgtgtttttccttcacacatgactgtatgctccttgactggaacaattataagtttgattatttttgtaaaatatgatacatttacttatatttcatgccacaaacaacttcgaaatgcttatcaattgtcggaataactaacagtctcatggggataatcaaaaggttttcttaaatatgcaccactatacatcaacgtaagaataatccctaacaggaaagagaaatgacttcaacattactctgtttcctttaggaaatggttcataagtccccactggacatgaggcattttacataagaaaaattacaaaataagacaaaagtatttttcccatcagaatagtaacactctatagtgttttgctaaaacactctacgaacaggagaaaacaaaaatatttatgttcatacgcacagggatatatatgaactcacagtaccaaaactttagaatcacatatgcaaacagtaccaatatacttaatgttttaaactgtgctagataacagcccggctagaggcaagtgacataacggaaaaacatacagcatcaattcacatgttgccaactttttttggatagaactaacaggatgacactggtgatggatgtgcacacttagctgccagcattgcaccctatgcaatgtccctctacatcctctctctcaatcattttgaacccccacccccaagatttattttatgtctctttttaaaacattattttcctagttggtgacagtcaccaccaaacatcatacagagatcatttcaactgaaaatacatgtttattattttttaagcctgtgcctgaaatgtattttagtcaatctatgccacataaggcaaacttctaatgcacatttatgaatttaattcaataaatatttactgaaaaaagaaaatgggttggagtctaaatagacataaagtggccatgaagtaagtctagcaataactttcactttttatgttttcccaccaccctttactttccccaatgagaaacttatagtgtgacaggtaagctaagagacaatctccataaatatgacagcagacatattgcacagacactaaaaaccataggaataatgctgagaccacaagacagaaatagcccttgactttttctcgtaatggcaggtagaatgggtgggacagggagcctaaagccagataggaaaacgaatccaacttttaaccaaattttttattacacacatactatttgaaacttaaactttcattctaagttacagtcaaaaaagaaaaaagacaataagaagaaataaaaattatcccagttcttccaatgtactgtatatgtatatgctatgatttaagaattatgccataggaatagataattcaattaaagccaagataaaacaaatgagatacattatactaagcagatagcaaattatgatataatttggctgagaaataggttgaaacaggcactatcttagaaatgggatgacagcaaagaactaagctccaccttcaatgtatttgaaggtctgtttggagccaatttacacaaaatatccacttaccaatttcacagaagatagaacaaaataacactgagataacgtattaggaaattattttttaatattggaggtgcactctaccacctcaatccagcacacattctctctctctctctctttcacaaaagagaaagagatcccgtaagcttctccacaatgttctatacctgaccctggaaggaaatcctattcttctaggcttgcttaagccaataaggtccccagagaatgctaactggggtggttatgtgcccaagaattgaactgaaaccattaatttacttcataggaccaatcaactggcaaaagaagttaaaaaaaaacaaaaaacaaaaaacttttggtagaactgacctacagagaatttaaaccgccagagatggcaaggtttgatgttacagcttccttcatccatctgcaaagctctgtcactacctaataaatgcacaatgcttctctctcctgtggtgcttttaggaaataatgcttgtcattttccatcttattgacaaaatattgtattttttagaaaactccatatctaaggaatactttaatgaaataaagatgggttaaaacatcaagctaattttgtgagcacacgaaacagagaaataatctcaaagaaaatgataaattctaatttttatttgaaagtataaagcacatatgagacgacttttattgtgttgccacttcattcttgtttatttaggtttctttattcactgtcgatataaatgactgcagtgaagccaggattgcagaccaaatctgaatttggaagtttggctacagcaatctggatcccaaagccaaagcttcctcctcacattagactcccattcaaagctatcactgtgttttcaaagtgacaacactgttcaactttcttttcacagagcaggaatcttttatggcattaagggtatgtatgtcacaccatgaaaaacacaatgacattgcaaacatagacaaaggaatctagtaagggcattgggaggaaaaagggggtggggtatttaagaaaatgttttttaaacttttttttttgcaaaagaaaatgcataataataaaataataactgaaagttccctattaatatcatccagcaattattaaaaatagaataaattagctgatatgatccaatcacctggtagggaacagcatgtgtctccttagtccattggcagtgctaatggtgctcctaaatgaaggattttttttttctatgttcacgctggttgaacttaattttccgttcacctgtttacctggattagttttcagcttaacattcattaagcatcaagacataacaagaggtgcagtgatgatgagataaaagtctcaaggccattactcctcccatgaggcactcagggaggatctataagtgaaagatagcttcactcgcttgggttaaagtgaaaaaatatgaacccactctagaactttgaaaatcaaagagagctttaaaaagccgtgtgtttatgttttgcctaatttttcactttttctcattagaaggcaaggtctgactaaatgtgggttatttctgatatctcagcttctagtttgcggaagggggttcctgtttaagggagggaatgctgccaccccctactctccccagcagcagcacactggacacctgagaagccaaaagcgctacaccaaaatataccacctttaatcacaaatcaaacaacagtaattaggagcatcaagttaattgtgtctactccccacagaatgtgtcctccaaggctccttgaaatcaggttgaaagattagtagtaattttactcccaattctcttattctaacttaaaaaaaaaaaaaaaaacagagcctaagttcatcactcctaccctcagaactatggagtctacaagtaaaaccttaaaaagaaaaatcagactacttaattaagtgttttcttaggccgtttatgtaatcagagtaactttgatctttggcttcttaatctgttcaaaatttgttgtcaaatcgtatggaattcctttaaatccagaattataaatgttattttccatttgtcttttattaatgattaagacaacttggcagtttgaatccaatcaatcaagaatgtgcaaaatccatttcatatacattggtacaattagatactgacaataaggctctttcttaccttccatttgtactaaatatgataaagatagcaagaataccttagctattttcgaggcattttcatctacattactttgcaatcccgaaataggttgtgctttattctgaccctttacaattaccagaaaggaatgcagagcttgacaacttgcagagtaatagaaaaaccttgatttttcattgcatttccccttctgactttcttaggatctgagggacgacccttaacctttctcagtctcactctcctgtctcaaacaagctataataaaactttattccagtccactggggtattagaacaatgaatctgataggatgtccctaacacactgtactgtgatctctatagggaaagttgctataaaaataaagacactgttgttattcttccaattgagttatttgcaaatggatcttcttgatggagcccagccctccgatatagaaaagaaaattctatcagtcctctagggtacaattgccttgtggcaattatacccataaccacatttccttattactatttataaaagactgtggagttcaaggggaggcaaaaagggagcttaagaaaaaatatgctgtttattttcaacagaagatgctgaagttgcaaatttggaactcaaggctataggtaaactttgacagaacatgtgttccaaattagtgtggtgtttcttagctgtgtcagaaagtcagaggtgtccctgaggctgcagcgctttagcaaattttggaaataacttggggaaaaaaaaggtaaattacacagttaatctggtcctcactctacgaatgctacaaaacaatgacgaaaaggttcacggctagaccattctcaccaagaaagacagcatatctcgaggtacaaaaggcacaaaagaaaattaaactgagcttaggaagaaagtgctatggacaattttacatgaaaagccaaaagggaatgttggggctacgttgaactttcctggagtctacagacagaatacacgttgccccctatattcattaccaacagccataagaattagtaggtggctcaggtttaggcactttaagaattccatattcctcaaatggaattttttcaaagtaaataataaaagctttgctttatgaagtattagagaaatggggtttcccttccataacagaaatcactaggcccatcacactgcacgtctccaaggagcatgattcacagtgtgggctacggggagggagccttctaaagtcgtttcggatgttcactatggcattctacgtgtcattaaaaaagccttataaatcatcctaaaatttagagtttaaacctggaacaattacttggataaagtttcttatgttaacaggtttttaaaagttcaattttcagaaaagtgtttgttgtcagtggagatctgcatataatctagattccaattaaacacagagctccaaaaagaccaattaaaggagaagtagaacagcttgccgtatcatgacaataaatgctacttgccttattgtcatttcacaatcagtgacattcagtccacaaattctagtgagcatcagattcacctgagatgcttgttagaaattcagattcctcgacctcacccgcaatgactgggactcgtacagcaatgctggggccaagaaagcgctctcaacaagcaccccaggtaactcccgcacattgttctcagccagtgtacaagggacttggctgctgatgcttgctcacagacaccaaactggaaagcaaaaggcagtatgtgactatagagtcctgaaaacacaaacaaacaaaaatgcagtccttaagccaaaaccaatctccacttttctccctctccctgccatgtgatgcaccagctttggccaaaaatcacatgtgtacagtgaatcctaaaaagcaactaaatccaaatccacactgaaccattctgaactctatcacacttcacagagctttaaatagaattctactcaaaacatcacaccctgactggccaagggattctttgggttctgttgctttatccaagtgatccaaagtgacccaggttccattctgcaagttcgcttctacagctttttccaagtcgaacacagaaggattaaaaagaaaacacaaatattggcataggtgacttgaggttacttgacctttctgaaggaagattttttggcaattgtgttctggcagctccctggaaggcaaggccaggacacaaagaggaagacaggaagccgggagctggccatgtgtccttggcaggcagtagtgcggcagggtgaaccacctcatccctgccaaaccagaaacagtggggaaagcccagctaattggcaactcacagccggctacagtgtacatcctcggctttagatgcctgataaagttaaatggcctgccagaccctaatctacttaaacaggatcctcctttactttcaaaaacttaactcacccatttgtgtttccttaaggaagtggtaaggcagcatcttagaatgttaagagctggaaaaattaaaaacaaaacagcaaaaaaagtaaagatgtgttggagtctcattatgcttatagccgttttactttgtgaaagggccatgtatgtttgtgcttttggttttagctaataagacttccacttggtcatttatttttatttaaaagaaattctcaagtcaacattgcagactgattatgacttcagttcattggaggatccaggatccattttttttttaatttcacaaaactcctgaagatatccaaggagactgcagagttgcacccagtttccactcagctattgtttttacttacacattagttggctcaatcatatttgctaaggtatttctgtatgtactagcataaaatcaccactttctgagtcttttacagctaaaatagggaatcacgcagggagaacaggagcagaagggattgtccaaataaactgttccttactgctgctgctaacagagtgaatccagggacctggagcctggagcataattttgcccctaggtctgaaggcctggtaagagcaatttaaaggggtgtgctcagtagttgggcatatttccttctattttctgtgaaactgttcatgccttcttcaaaactcaaagcaaaatttcaaattagcttctcctccttaaaatatagtagtcaatggtgaaatttgatgaagaaaatgcaaatttcctctcagaactggtagaagagaaagattacaataaacataatccactgttttcatcagaagtttcttaaagtctacagaatattcatcctttaagcaacccaggaccccagaatctgtttcagtgaagttagaccaaggaataaaacacaataccaaaactcacatactctctgatcacgatgtgagataagaaaataataatcctcatgcccaacactagctctcaggatcggtaagtctaagtatgtgtttcagctccaaaattactattttttttaaaacacgacttgactttcccagactctacttagttgacttttcacactaagtatccctagcttttggaaattctccttcccttttcctttagggcaccactcctttcttaggtccaatcctctatttctgagggctgctttcctgtcttgatggctatctccttctcttctgttggtcccttatatgttggtgatcccaaagacgatccatccaacttggccatcttcttgtctttgtacattccccctcagcaaactcagctaggtccatgtttacaaatactacccgttttttgagaactctgtatctccatatctagccctaacctcttctttaactgcaaaactcctcctgatgttgctagtgcacaacctttgtacactcttgcctccccgcaaccaatccatatctcaattaatggcattcacagccattcagtttcccaagctgaaaatgctcattccagaaaccccaactccccaaagcttcacattcagttgtcagcccagactctatcttcctttcaagcctatttccccatctccatcccaactggtgctaagtcccttattgagcttcacatttttacctcacaatagcctcagcctcctcaggccattatgattcactcttcacactataaccagactccatcctctgcatagccaccaggaatcacaacacttcactccttaaaacaccttggtggcttccaattgctagctaggataatctacaacctccttagtacagcattcaaggtgctccataacctggccccagcctagcctcactctcacagaaaccatcaccctttaccctccccctcacacccacacccaacttcctaatattcttcttaacagtcctagaatatgccgtgcaactgcaggtctgtgcccttgctcataaggtttctatgcctggaatatcccttatttgatgcaagacaaacgcctaattcatctttaaaagctcttgaatttcgtctgttacaaccttcctgaaccttattgccccatctaatgagaccaccctctggggcccacatggtcttgctcacactttagtgcagggcccgaccagtgcattatagttggttgtttatacattacttctctccaagattgtgacctcctgtatcccaacttaccctgaataattttgggaatctatttaaatggcatacaaatttatcttggatgtactatccatgaagaaactgagacaaagagcattaattcccaaaagaaagacaaagtaaccttaaaaaaaaaaagtcataatgagctatcaatttatacaggtaattaacattcaatattctgattgtgacatatacagatgatatttatccattcgtttatttttttgaaaaggactgaacacctacagtggtccatgtatcatccttggaactcagtctacaacagtcaataaaagatgatttgttcttgtcttcatggagcttatggtttcatttgcacaatgttgactttcattcacttgctagcaggtaaaatgtgctctctatacaatttacaaataagcagaatctgtaatcattatattttgaagataaaattgatacttttcacacacacacacacacacacacacacacacacacaaagatttagcagtgggacaaactttttcatttaatttttgtttatagcaactaaaacatgagagactaaaagccacagactgcaaaagcattgtttagctgtgataagcagaatgtgtaaaggtggtatgatggcacaacagctattgcagcatgaaataatgagactataaaataatgagaccacagttttaaaattctccgacttccattatctttcagaatagatgaaaggggtctactgactagttcgggagctgaagagtcaaatactattttaggatgaaaattactttgtggtcacatcccattatagaatattgatggagccacactacatgaaagtctcaaaaggagtactgagagaaaacatcgttaagaattggttttctgctactcaaacccatcctcaagaaaaaacaaaagctaatttaaaaaaatcatcaccaaagcaaagtttctaaatggaatgacataaaaatatcggttctacgtttcttgtcttttagaaaaacgacccatatgtgtagtattttatatggttttctctaacgtatctgagaaatgggtaagcaaatctatgcaaagagatatcatggattgtgatgtcatatttcttatgaaaaaaatcaccttcacaatgtcaattaataccaaatttagctttacaactccatgaactctaccattttttaggttagctgaaaacgatctattgactagctttgtgagctgaacagttgaatgctacttacatagaaaattatttctttcactccataagaataattatcatggcgatcacacaattattacaattacatctgtaagaactgttactgggaatttatctctgaaacagtctcatgccttgcaggggacatttatctttttgaatgatcatcaacacgagtgtctttttgtagctatataagtgatttttacctccttctattaatatcctcttgcatgctttagaagccaaaggagacagcccccacattttttttttcctaaagcaattgtttcagttaagccaggcccatggcatcttttgagacagaaagctaccctttccattcacggcaacataacattcacaatgtgctttcctaaatggatggaaaacccctcaaaaaagcccctcaaatctgtgtttcataaactgtactcttagcaataaagtttattacagacctaaagtatctgcataaacccggttaattgaaaagtgggtggagaaggctgccaaattaaatgtttacattagcacagctgtattgtaaaaacattctgccccctgtgctttgtaattataagatatttctggactgtgtatctctacaaagtttatctccactgccaagagtgtcttggcacggagcgactgcagtttttggcagccaggagctctccgcgcgggcaggatctaaaatggctgccaagcggcctcctgaaatgtcgccggcctgggcccgcctcaccaagggcaaaggccaaccctgctaccaaggcagggtctaaagtctgtctcacaggaagtcaaaatgtgtatttccctcataaataagacttggtaccacaacttttgtgttgcagtagttaaagctgcttgaaaaactaactacaaaggaatattggaatactaccagatagaaaatggtgacaaggggtcttttacgaaattctgctgacctcaacatttcaatcacacataatgcccgcaatattttctgctgattaaagaaactcatttaatttgtggggaaaaaaaaatgttaaaaaaaacctcaacaaattctgaccatattaaaacatactacagagaagcataagcaaagccaacactttcccatttgcaatggcatgattttgacataaacttataatctctatcaaagcatacgtgtatgaaaaatgaaaaccaaaaaattaatttgttttcttctcatcctttaacaggctatgtttgtcttacaacattaaaataacattaacaaaagaaaaccttttcatacctttctatggcacaggcctcaaaatttgaggaatgatctctcttttcccgccgtccactgcccaagatgtggaaaggaaagaaggccaaggggaagaaggtggctccggcccctgctgtcttgaagaagcaggaggccaagaaagtggtcaaccccctgtttgagaaaaggcctaagaattttggcattagacaggacatccagcccaaaagagacctcgcccgctttgtgaaatggccccgctatagcaggttgcagcggcagagagtcatcctctataagcgactgaaaatgcctcctgcgattaaccagttcacccaggacctggaccaccaaacagctactcagctgcttaagctgccccacaagtacagaccagagacaaagcaagagaagaagcagaggctgttggcccgggcggagaagaaagcgccggcaaaggggacctccccactaagaacacctgtccttcaagcaggagttaacaccatcaccaccttggtgtagaataagaaagctcagttggtggtgattgcatacaacatggatcccatcgagctggttgtgttcctgcctgccctgtgtcgtaaaatgggggtcccttactgcaatatcaaggggaagacaagactgggacatctaatccacaggaagacctgcaccactgctgccttcatacaggttaactcagaagacaaaggggctttggttaagctggtggtagctatcagaaccaattacaacgacagagccaatgagatccgtcatcactggggaggcaatgtcctgggtcccaagcctgtggcttacattgccaagctcaaaaggcaaaagctaaagaacttgccaccaaactgggttaaatgtacactgttgagttttctgtacataaaaataatacaaatttcccttcaaaaaacatctgaggaattaactatgtctgtggcataaaactgaaaaaaaccgagatcagatacatagtctctgtgagtgagttccaagggctgaccaaaggaacaaaaattggaaggaagggaggggaggggagggggaaaaaagaagggaggaaggaagggggagggaaagcagggtgggagggagggaaagaagaaaggaaggggaatgaaaacgtgggagggaggaaatgatggagacactgcatggaactaaaaatacatactgatttgttcatagtaggaatataaaaaacacttgaagaattaaaaatacttcataagtacaccttcataagtacgatatatacacaaggtatatattgtctctgtcctttttttctctgttaaacttaaatcccagctaacaggctatgttcacagcagccaaatactgcataatgaggtcagtggatttttctttgagactgttccgcaagtttaagctcaggttgagagacacattaggcctggtgtactcctgtaatcatcattggcagtgattactgtttggtaatctaagcttcaactgaatccaacattcttgcctctgctgaaagataattcagaggtgaaagatgaattccataatgctgacacaaactggtggtattcatcatagtgcttattcactgaatgcccattctagcttgaattatatgtccacacactcagcagagccacaccaatattgtttacttaatttttttaagtctccattttaggagaagaaaatctaatgtctctttaatcgtatattttgaataatgtctattctccagtagtcacctgaaaaacacacacacacacacacacacacacttttcctggacctttttacagcagaataatttctcagcattattaattatgtttctgcgtaaaagacatttagggacttttatcctttgtttaattagttatcaaaataatcagtcacacagctatttaataatgggccactcttaacagacaggtgaaacagagtggttgtgttcaaaaaatatttctagttcactagtaacttactaactctctctctcttttttttttttttcttctttgagatggaatctcactctgccactcaggtgcagtggtatgatctcggctcactcgcaacctccgcctcccaaggttcaaacaatcctcccacctcggcctcttgagtatctaggaccacagatgcacctggctaatttttttgtatttttggtagagacagggtttcaccatgctgcccaggctggtctcaaactcctgagctcaagcaatcttcctgcctcggcctcgcaaactgctgggattacaggtgtgagccaagcacctggcccttactaacactcttaaaacttgagctaatttctttcctttcatgagattttatggtctgacactgctgacttattaccttttcttccttgagagtttccaaatactaaaacaacaatctgctcaacaaacagaagaattcgataaatgttgattgaccatctagtacctgcaaagagaccctatgctatcatatacagagttatgagattcagacaacatgctttacaaaaaaaaaaaaaaaaaaaaaaaaaacctaagggatggtttcagattttgcctgtgtcttagtttcagtcatgtttggtatatattgccaagtagctatattttatatccccaactagaatacaagtttttggagatcatgctctatgtcttactgactgcacaagacagtgcaacgcatataaaattgtcacctacaaatgaaaggattccagtgaggctaaatggtgattagctgtgtaaaaccccactattccatacattgtatgtgcttacaatgttagcttatcctcctcttagcagcaaatatcttctaggtgaacagtaataaaataatagtaaggctaacagtcattgagtatttgtttacatgtccaatactgttctcaatattacggtatccatagatttcgtccttgcgataacactaagggatgctattattattcccattttcagatgagaaaacttgcctaaggctatccaactaataactgaaaaagccaggaattaaacccaagccaaactgaccccagaatccaaactaaattactgtcttcccaaattagaggtgtcaccactggacagaaaaagagatacagtccaggtagaggttgcacctctgcaattacagggctccttagtcaattttttctaatttttgacacataccttcccaattttcctggcaaaagcctcccttgagtggaggccactgactgtggggagtttatgttgtggtttggtaatgtgtacaaactgggaggaggatgagaccagaaaaccccttttgcccatagcatgccacaaattgaggactaagtcagtgcatgctgctgacaggcaaagggccagctcggcatgagcagctccgtgcagggactgcatgtgacaccagacaccattttcaaagccactaccttcctccttccccacaaacctcttcatctcccaccaaagtcctgaagcttcaccacaggatcaagtaatccccctctaagccacatctcgtaaatgagagtctaatttctcccacgtgtcatttttcacatgaatgttactacggtcttggctgtacttaaccagagttcaaggtctgatggtttatctacagagacaacatgaccacagagaagagcccgtttccattgccacctgaaagacagatccaccaacacaatgttcaccactttctcacacagggctaaatgagactcaaggaaagagcccaaggtcaaacatttccttggttgaatttaggtggtgggttcccatacagagcacagcaccatcagattcacaaggccaaatgcctcagcatgatgacttgaaaagatgacaagctgcacacaatgttcaaaatctaaattcaaaggtcacttcccactccctaaatagttttataccccaaaagtcattttagaatcatctttccacttttattccatatttgtaatctgattttaatgacctcagggtaggccatttttttaaactccagacaggttctaattcatctatacaacaaagcaatacgtggtgttaaaaaaaagactaagagagtaaatcgatacgtgttcagtgtagtggcagtttagattttttttctttcaattggcaatccttccgacatcaaggttaaattgtactaaaaaagaaaaaaattacacctcattccaaatttgctaattcaagaagaactgaattattctcacgtctacttgtggcaaaacaagaaattactttatgtctcaaatgtgagtatgaattacgactaaattcataaaaacagacgtgacttaagtttttattttactactttgaagttgtaatgtgttcattttcctggtatttttacttaaaagagcttttttttttttttccttaaggactcttcacaagtacttttgatagagtggtataaaattatcctattccaatgaccataatatgaaaatcattttgccaaaaaacatcctggaagtttccctcattttaggtacttgggattattctcataaactgaggaccattcaacaatgttttgaagatatacagtattctattcagaggacaaagcatatattcaaaaaaatgcaaaaatattcatcttttctcaaacaactccagtattaaattcatctagacccactgattcactcagtcttttttttaagtttagtttccaatatgatattatttctgccctcatctcttccttgcaacaccccacccataagggaaaagaagaaacagtcagagatgaaagaacaacaaaaatgtacacaaaaatgaaatgttttctgataagtagcatgtcagagtaaacaagttatttttttccactatcactttcttacatgatctacagcaaaattatgttgcctctgtcttatgaatcatcaatacatcacagcccagcctttttcatatatagtgggaaaaatgctgcagattataactactgtttctgacatggagatatttttaattcatttttatgacatgcttatgttcttttcatcactgaataattgctcgtttccaatactaagctggtatttctttaaagttcacgtaattgcactactggtaactttaggatttggaaggaaaaggatcacaatcgataagcaaatgcaatgacgggcactgacaaagactcaacatttattagaaggcaattgctagagaatgtggctttaattgtgcatacatatttttattcattaagatgaataaccaataaaatcccacactatggtgtcccagcctcataacacattaataaagtttcttaaaggttttggcagggggccagcacagtccattaactctttgcaagttgtaaaaagaagtaaagtcatttcagtttgttttgtggttatgaatgaaacagcaggcagcctgtatggaaacgtcactttggatatggtattggtaatggacgctttgctgcgcaatcagaacagtgtggggagaagttaatgcatcctaccacaacccaagcccagacgcactgaaaagctaatttacttaaaagtggagggaaaagagcagaggactacaagtttggaagatctatttattttgctaataggctgtcacactgcctctgggtaaacttgcccactgtgaaacccaaaagtacaggatacattttaaatgactagaactgcttttcctgattatttttttttttcctaaaaaaaacctggttgcttaggcattcacttggtgagggctggatcataaattacaaaaatgctttttatttaatacaagaagcaaaattctatcctttctacgtttttgttttacatacttgaattaagtcatataaataactacaacaattggtagctatgtatttgtctccgactttgcctaacaatttgaattgaagcgctacacatctccccaaagctttacaatgccatctgttctcatttttcatgacactacaaacattttcctttggaaaaaggattctgtattttgcttcctttttagaatgaaaactggaaaacttgaatgaaactaaatatatagagaggcatccaagttgtacgtgtaaagtagtaaatgtagagggtatttaaaacattttttgtggttaagatctctacccttttcatctgttccactctagagataaaagttcttttttactttaagatttttgcaaaaaataattcaaaactttaaaaataacgaaaaatgaacttaaaaagtgattaaaacccttgagtttgagaacaccaaaaaaaacagaattgctttacaaattgtttttggcacttcacttacgaagaaaatacgctaaaatgtaagtatacatacacacatgtgcacactcacacaaacacacacccacacccctccattaatccctaaccaaatataaatagcatcgttagtcaattacttctgatggttaaaaccacaaattggttacaatgatctgtcactttatatggccaaataataaaacttcaagcagaagagatgattactataagtacaatagaaaacatcattcactgttttaatttgttttgaatttttactggaaaaaaacagaaagaaaatttttaactttcaaatgtaaacattcatcactgagtcctaaaaaaacttcccatttcaaatttcatttgtgtcagtgctaatatgtatcaaaatagccgcatctcttgtacactgtggattttctgggaagttactcacctttgattataggaaagtaaaggaaagtctaattaataggttgaaaccgtactgaatttctgcttctctgtatacatgatcatttttgtctctgtttggactgaaagccagatactcaacaatcattccctaaaaatttaaagtattaattacatacatgtatttgtacaatgttaagtatcactgcaacctggaaaaacttgcggtaaaattaaaatttttcatttcaaaacaacagtgctcttagcttaatcctctacaatattgtattcaaaaatagtttttctgtgtgattaacagtaatattacctgggctatttttaaaatctggaattagaattcaattttaaaaactgcactcaaaaaacatcctggattcagatatgaatggacctgggaagtttcttaaaagaaatacattttatcctagatcgatagtaagaaacagcaaggaaatgcacagaaacaggatatagggaatacataaattgggtctacactggttaagaaacaaagttaaaaaaataattctactcactttaaaatgacactgtgctgaaaaataatgagaatagataaaagctttgaccactcccattgtctaccttaaaaaaatactagtatagttactcaaggcacggaactggacaaactgcaatttgaatccagaagacagaatccagagccagggacaaaacaagtcaaaggagttggtgaccagggcaatggccagaagtttacccgtttatatcagattctgtgccatccaccctgcggggccgtctgagctgtgcttccccagctggtgggcccctccacgtcagccctctcgtagactccaaaaggaaatcagagttgaacagtatagcatattgttattaaaagtgatttgagttgtgacatgaatattgtactttcaataaaggaggtatacactttagaaagctcttcagcctctagaaagaatagacatttaaaagattaaagcgtttaaagaatgatctctccactgaccagaatacccacatcaaaataatgtaccactgggttttattggtagctgcaatttagcccatatgaaatggaatatggccttagtgttaatgcaaatacgttgccatttatcataaaataagtgtcatctctaaaggtaactggactttccttaaaaatgaaccattctaacatgaaagaggcataaattaataaatccctgagaaagcctagcctacggctgtaaggaacatctaactgcttaactgggcaaccaaaagactcatacaaataattagaatacttatttccaattgatgaaagcaaaactactccaattcacattaaggttgatgagtcacataaaccactcactgacttaattttacttagaaattgctcatgcacttttgttgctttcctggaaggttatacaaatgattatatactcatttaattattaaactgaatgatctccttaagggcaacattaaacatactaaagtacagtacaccatgtcacaatgtgcttaagtatccctactaaaaataaaaattaaaacaaggttagaaaacaactaacaactaggttaaattcaatccaaaatatagatttgggaatttctaataaaattgtccatattgtttgaatgggttcaccactgagtaatagtgtgaataatttaggtaatcatctcaaaaggttataattcctctgggaaaaaaaaaaaacatgtttaaaactctacacttacaatatttcacataatataattaataaatgtttgctagatgattggatttaagttatatgataaaaaaatactgctcacacttataatgctttaaatgctttacaacttacaaaacactttcacataagccaccttacgctaacaactgtgttaggtagatattactatccccatttcatagataaggaaattgaggctcacagagattaaatgttttacccaaggtcatagccctagtaaattcactgcttagagaataattagcttaagttaagataacagctacttcctgcttccccattccagtctcagagacacacaaacacaatatgcatcacatataaaatgtgataaaatcaaaaattatacatcaatcatgtttatgcactacattatttgcctatttccattcgtatttttgtaagcgctgtttctgaaaggtaatatagcatataattacacctttctttttaaaatgctatgataatcttctcactgcctgggaagtttccatggcagaaagactgggcacagtcaggtaactggtatttcttgattaccatccaccagtaggttgatctttggaaagttacttatctttggaaagttacctatccaccagcaggttgatctttggaaagttaacgcgggcccccaggttccttgttagtcacataagggatctgtaataaacacttcctaagtcaggtccaccatccattctccacagcagtggttcttaagctttaacatgcacaagaatcacccagagagcttgtcctaacagagtttctggcccatcctcagagatctgatttaataggtccagatagggcccatgaatctgcatttcccagaagctcacaggtcagaccagtgctgctggtcgtgggaccaaactttgggaaccactgctacacagtaacatgggaaaccgaaatacttcagaaaatgaaagtctgatgtagcttctctccagaagccttcagtggtttccccatagcccttagcataaagtccaaagtgctaaatgaataacagtatgtggacacccaggtctccacccagatgcattgctcaggatctctttctgggcctttcctgataccccaagctgctgggctgagttttatgtccctcatctgtgctcttaggaaaatgtgttccctgtgtcctaaaactgtaaggaactgttatcacatgcttccttgcctctgttctcaacattccagaagtggtttgtaaacatacccccaactcccactgctccaaatttaaggggggaagagtcccctcatttcacctcacatcattttacttaagaatcgatgccaccttcgggctatgcatcaggtctcgtttccaatatttctagcagagccctcctcaacccttctttattactccccactctgctccccaaataggccacatcctagccccccattaattccccttcctgaagaagcgacagagataaggaaagcccaaagagagaacctgcacttctctgagcacatccctgaatgaggcaccaacttccccttccccaccagcctgctcttctcctcacaggtcctgagcatgctcaaggatctcaaagcacacagggccagtgtcaggagcatggacccatgcagtcacatagagccccacttacgtggtccccatgcttggcttcatgctcttctgtcaccatcttgaaactcttaatttttgaacaagaggcccacacattagggagctggtcctgaaggcaaattatggaactggatacatctcagctcctcagcaagcacacattaccacatcccattttcacccacactatctcagcagcacagctcccagcagcctaacagaaaagtcacgctttcctctaagaaactgccatacttccttccttcagagtaaaacaaaatcatattatggattgtatcatgctttttacataactaccaggaaactttttaaacacatgatgctaatttagcagccaacatttttgaacttcatggtctataaatttgtactgtttcccatattttcagtctctgtttctattttcttggtcctgactctcttttccattggaaattcatcatttattttactgaatatgaatatcctgctgagagctgtttatcccacagtccagtacacacaggaaggaggcacacacagtgcagagagccatcctatacaattggaatttaaagagatctgacttcataaagtacgtgtatacacatgcatacctatgcttccatgcccattaagaaaatgtggaaacaagaaatttaggcttgggagcaacggccaaaggagaaacaaggagaaggaagagatttacttttcacttttacctgtatatagtatttaattattttctgtaagtatattacttataatttttcaaagtaaatagctcagtaaaatgatcttctgtcaagctcaacaattgggtgcttagcagagcaagaaatggaaaaataatggctaaagcagcttttacgtaatctccaaagacatcaactttcacatcagtttctcatagactgtccagcatattggaaccgaagaaaaagagcaggcataaatactcagaacaataaacttgaaaaatgtaacctctggtatacatttaatggtattaaatgaaaagcagtgaaaatgaaaaccttaaacatctgcatatactaagactatgttaagaagaaacgattattaaaagttaactaataaataagtaaaagtttgagtatttgggggtgaaaaattgtcagaaagcaaatgtgtaaaaagatatatggtcctgaaaatcctcgcttattctaaatttaaaatgcaccttgattctattgcaaagaaagttgaaagtatgtcatcaaaaagtcatttaaaaaaactactacttaaaaagtgatcagataatttacaaagattattctcaagaagtcagataaagataaagatgccccatttgttaacagtactttttgttcttctggataatgtactgaaaaccagtctagcttcctatggtatgcataacttcctctgtaatactccaattgtattaccaaaagcaaacattacttttgttatcaaagcaaatttaataaagaattttcaactatcttgcccactcacttgctttgtaattcagataaatgactcaacatctccaagcttctttcatcatcttgtaaaaggcaaatagcaatctctcccaagcagcactgtactgagaattaactgaattgctttatgtaaattctcagcacgataccttgttcatggggggtgggcaataaataggaggtatcatcatcatcactcttggtaatgacgataaagctggtatattttcaattctattgcatacagtagaatttaaatttagtcaaaaataatgttcaatattaagaaataacagacttcatcttcataacaaaagataggttggcaatggctaccttagaagctacctaattgcctggtcacaattttttctttgtgtactttcctaaaataaatttaatgaataacaaactatataaataattttaactgataatcatgtgcaaagaaatacaatttggcactcaggctgagcttatcccactggaaaggtgtgcattaacatggtggcatgtattcgtttttcaagtcactttactggccactattaagtctctgtgtggatgaagtagaaactaaaaaaggtctggtttgagaaaggccggaagcaggaggcaagtgggctctgccaaggtgcatctgtatccacaggtaagaaggaaggttctccattctttctctctctctctctctctctctctctctctctctctctctctctctctccctctgtgtgtgtgtgtgtgtgtgtgtgtgtgtgtgtgtgtgtgtgtgtagcattgacaagggggtaagcccctacaaaagagagtgaacctcagaagagagatgctggagagacgctgtgtcctccaaaggactcatgtcaccacagtcaccatacccaggtcaggtctacctaacagccacttcaattccatctttctcatgtgacacttaaggctatgctgactttgccaaaattgctttcagccaaattttctaaaagaaaggaaaataagcatacttttctgatgaaaactgttgtcagacaggcctgtaactaaagccatttcatacagaatatcctggccaatgtttagcacatggtgctttacactgaaaactttaaaagctagaacagctatccatatccatcttctaaaataatgttgtaacagcattagtaaatggtgaataatgtttgaacagtgtctactaggaaggacttaatgaaataaagtggaagatatgtgaaatgactaacatttgaattcataaggatgttatgccccaaaaccttatttttggtatcaaggtggccattttgattaatttcctgatgatacttaagaaagaataacattaatttctaaagcttccagataataactttttcccaggttacagcttttatatatgttatatgcaactcacactaattcacacttaacagcagatagaatctaaattagatcttcttataaattatttccagaatgggcaagagcaaccaaaagataagatatacattatctaattattcaataatgctaggaaattcttttaaaatatacaaactaggctgggcgcggtggctcacgtctgtaatcccagcattttgggaggccaaggtgggtggatcacctgaggtcaagagttcaagaccagcctgaccaacatggagaaaccttgtgtctactaaaaatacaaaattggctgggcgtggtggcgcatgcctgtaatcccagctacttgggaggctgaggcaggagaatcacttgaacccaggaagtggaggttgcggtgagccgagattgcaacattgcatgccagcctgggcaacaagagtgaaactccatctcaaaaaaaaaaaaaaaaaaaaagacacaaactaagcaaactctaaatttatattattttggaagactcatcaaaaatcctgctccaaacactcatattgctaattatctcattcaagatattacttcaccatgtcaatattgatttattattttatactttgtttctttcccccaaaagacatgagaacacttacaaaaaatactcctgccactgagataaaatagataggtaagtaaatctgggttaagtcagaatgaaggtaagaaagtaaatatatatgggcagtggtagagcacaaaaatgtaagcttttaggtccctgatcctttgccagtaaagctgtactttccatcccaggctcagtttcttccgtgtttgctgggagttcctgtattactctgtagatttcatcgaacttttaagaaggcagtggttgctttgcctagcaagggaataagaataatgagctgagagctccaaggtggtatttggaaggcatactttttcccagaggaaaaatactgaagaaaaaggccagttgtacaggaaatagggacagacattatcaccatattgaagccaaatagaaaataaaatgattttttttaagtttaaaattcttttgtttccatgatatactcaagagtctgactccaaataacaacctcaaaaccttgtttctgttttcagtgccttcctgaactaagtgttttccctcaagtagcaccaataaaacccagattccacccactggcattctgtctaagccaacacagcttttatcaggtgcttgaaaaagactttgcatacagtaatgtgagacgctgaaggtgcatggcaaacagcaatgcactgctgtagaactccaagttgggcttctaacctcctgagagactgatgactatagatgtcacccaatcaatgaacaaatgaattttcttcagtatttaatagtgtattttggtatctggattactgggaattttaccaagggccaaaagagcctattgctaccaaccagatttggttgggggtttggcatctgaaatgtactcttttccccaggagctgaaattggaagtggacttatttaaatgcattggccttgatcacagtggatgcctagatttctattaacttttagccttgttaagtccaggtaatttcagttattgatgtaccctccttttaacttctccatcatcaaaagacatttattaagtacctatttgtttaccttactcttcgaagtaccacatggagaaacacttcttgccctctagggaacttaaaatcattcctctcatggtctccttctggctttaactagataccattaaatagttgcctcattctcctgctgcaaaaacatttcttcagtgctggctcttcattaaggggtggctaatgaagctcatgtagatcacccaatttggtagaaactctgatggctttagcccttcatctctcctaaatgctgcaccttatgaagtttggcacagcctctcacaactccctatctgccatgtttaaaggagttttgcatttgtttgtttttgattctacgtatttaaaactaccagtattttcaacaagaagagcaaatctaagatgcagataaattacgttactttgaatattaactattatatagattgacaaatattgctattttatctccagagaaactttaatatagagtcatcttgtagcactagggtaaaaaaaaaaaaaaaaaaaaaaagtctaagttgaagagatttttccaaatacgatgtaatttagggttacaatgtcaaaactgtaaacctaaaattaaactactaactatttttgtttgcaggcttcttttctcaaaattacaaccgcattacatttgttgcaaaagaacagattcaagccaggattttgttcattcacatgttattcctgctttacacgtattttatggaggagttacttttgctggcattttgttttgttttgtttcttttactaaatggtgagcaatgttagagataaatgtaactgtctacaaacactccagagcaaaatttggaaagaaagcttgagcaaataatactacatttgatgggatataagaaattaagagttcttcagatgacaagaaagtggcatattctttttaacacaatggaattaaagctatggtgaataaagcaatatattaagaatcctctggaaagccaatatcttgaatcattacatcagaatctacactgggactcttataacaaagcttccatccctgggaaaatgaagaacttcactatgagaggatggaactacaccaaaaaaacttttccaactccagtcttgggagcgcatcaaagcaacaggccctcgtccctggtaaactgtaatctaggcgtactacactttctgcatgttgagccaaggaatttcctcctagcaacaggctgtggtctgatgggctcgtccacctcctttccaagtggagagaaagcaaaatcaggaacaatatcccctgaattctcttcatcaaggattatcagacacctgttttaaattttaatctcattagttattattgataacaaggacaatgtagatccattgcaaaggcttataccacaaagaaaacacaactctaattagtacacgcttcataaacaaggcaaaggtgcctatctgaagctattttaaagcccttgttgtggttcataggcttagagagagatgctttgaattctgcttccatgtattgtactaggggaaagacatggcattctccaaatattattgagaggcatctttaccacaaggcaggatagttctgggcatggggctccctttcgaccatacctagagcaccaagaaaccaggagccccgcctgggagccccagtttcttctctgctatctctctggatgctggacttgcagtctcctcaacagtggatcacagcccatagctctcacatctttttatacccaccaatcccacactctcaacctcgtaaacttcacctccccttcactttctcctcttcctcctgccctctcccttatttcccattcagaaaacccccttcatcaaggtgtaacttcctcaggaagaactgcaaagaatcagcccagtgcagatgaggttccaccacccgaagtttctgctctatatccagtgaaatcaatctccctacacacacacacacacacacacacacacacacacacacacacaccacatcccatcttcttcctattcctctcaccccctcccaaggagagttttctgctctgaactacgttatatcctacctactagcccatctactccctcacccgaaaagtctgaactcctctaaggcctccatcagcagcaagatactaaactctgcatcctgaggtcaagccaagccaaatgttgacataccaggagtctctgcccctccgaccccagcttctagttgatattcccacatttcacttgaaattcaacatcctctcccttacaacctggctacttccccatatcgcaaagtaaaagccttctccagctttaaaagttaaccgctctacctaaattccagattccaaagtttcctattccttgaataatattgcaaatagttactaagatgccatactgattaagtggcaggaactatgctagacatgcattatctgacacagaaatcataagaactctataaggtataaatagatttggttgaatcacacaatatttgtaatacgcagctagatttaagccatgaaataattattttgtatttatatgtgcattattattagctccattttacagttagaaaaactgaggctcatgagacaaagtatgtttcccgaagtcacacagctcaagtatataagaccccaaggctcacagccacataccacactgcccctcaagcttatctgactccccaattttgcacagagctggtcctgtcttctgacctttacttaagtaatgctcatgtcctctccataacttattttaacagccagggtaagacccacattctcccatgaagctgtcctgacaaattccaagccaagctggccccagcctcccttggaatccatagtataattgagcaagctgcccttcttatgccctgtatgccagctaatcattctttaccagtgagtcatctcttctcaaactaaactgcatagttggcaaagcttagaaactctggtaactatgtcattttccctttctgaaccaccatatctcaattattaaatgagggtgttagaaaaaggctgccctgtttaagagaaagcatgaagagcctgtctgcttagcactacccttcattacctttccctccgcaaagcacaaaggaagcaaatcttggcttaaattagaaggtagcaagttgtcctctttttgatccttggatccccatttccaatgcactggtgctctcagatcttttgatattgcaaagacttcctcccttgtcaactgtttccagttcatctttccaaaacactttctacatcccactaatactaactttcaagaacacagcttggaacatgtaacttcctttttcaaacactggcagaaactccccattatctaccatggaaggcagaattctaagatggcccctaagacttcctgcaccctcatctacaagccctgcacctactgaggaaatccattgcatcagatggcattcagggtccttaagggtcatttcctggattccaggctcaggttacctgacactaattcatgcacctcaagctccaggtaaactggtaatctgagcctttgcccaagctaatttccaggtaaatctgtccctttattcattaagtttagaaatctgcattccaggaccaggcacagtggttcacacctataatcccagcactttgggaggccaaaatgggaggctcagttgagcctaggagttcgagaccagcctgggcaacaaagtgagaccccattgctacaaaaaattagccaggcatggtggcacacacctatggtcccagccacttgggaggctgagctgggaggatggcttaagccctgggaactcaaggctacagtgagccatgatcacaccactgcactccagcctgggcaacagagtaagatcctgtctcaaaaaaaaaaaaaagaaagaaagaaaagaaaaagaaatccgtattccttgcagaccagctcaaacaccccttctttcctactctttggactcaacattaatccatttcttctttccactgctccctcaagacattacctggaattctatctagtggcttatgcagctaaatcaggggtgtccaatcttttggcttccctgggccacactagaagaagaattgtcttgagccacacatacactaacactaacaatagctgatgaacttaaagaaaagcagaaagaaaaatctcataacgttttaagagagtttatgaatttctgttgagctgcattcaaagcgatcctgggtcacatgcagcctgcaggccatgggttgaacaagcttgagctaaataaaagctcagggagggtagttgctatgcttagatgatagagcagggacttcctgacagaaatctatagcaggggcacacttatgattcccgcaggtcactgagctgatctactctgaccttgtcctcgccttactgataagtgactactacgtaatactccagttcagactcatgatactaataacttctccactgcattgcttttctgaattgcaatctatttgtaataattttagcaagtccaattctcacccattagaaacaaatttaaatagaacaaagcttaaaaattagcattccaattttttttagggcatttgtctataaaaatgtagaaaccactaattatttaataattacactgactctttttatacctcaagttctcctcttgtgcaattcaataggagatcaatcaaaagttaaattttttgagaaatcatgttttccctcaatgtgtaaaagaggaagaagaagaggggaagatgtgttacatgactggttagaggccaatctaatttcaaggaaatgcaaacgcagaaaaatcttatcagctctagctcaattcctctaaatatactaaatcaaaatctaagaaggaaatggaaatacctgtgattgatagagaagtacaatactaggaatccacctggtctcctcaagggcaacggtttgtttccttctcagccacactatatcctatcagccaccctaaccgcccactacactctagttggccaagaagtcactgagggctgtcctgtgtatcttctcaaattttgtcccttgagcaaacaggattccccctgccttccaaaataatctaaaacaatattaaaagaaataaggtcacatcaaaataaaacaaacagtaaaatgtccctcgtccaattacgccttccagtccccacacttattatgtttgcctgaacaattaacagcttttaagatatttctggctgacccagaaggccatattcaatacacaaaaaggtggaaaacaagtgataggctacacagaaaattgtgccatcatttgctgaggcttctgttcactaagatcacagctatttttcagtttccacatgatgttctgtgtagaaaccatatatccctaatattggaagaccatgatgatcttatcactaaaacataacagctaagaactaaagagaatatttagattgaaagtgtcctgagaaaaatcaaggtgtagaggatcacagttggatgttctgccctatcttagtctcttccagaatgatgtacatacacatgggctccgcatacatgaattcaaccaaccatggaacaaaaatattcagaaaacaaaaattccacaaacttacaaaaagtaaaactccaatttgctgcacactgagtactatgctgaatccactcaaatgaagtgatatgtaggcactgtattaggtattgtaagtagagatgaattaaagtatatgggaggatgtgcacaggttacatacaaatactatgccattttatacaaggaacttgagcattatggtgtttggtatccccagtggggcctggggttggggcggtcctagaaccaattcccccaaaataccatggaacgactgtattttccattgtcgtattttctttacctttaaaataggaatacagtatcttccctgagaggataagtggtttctcaattttataaatttttctttgaaagaacctgttggcttttttaccttttcttataggagagcacatgacatttactttcttagcgaatttccagtatacattacaatattgttaactatagtcctcaacttttgcattaaatctcaaggcttattcatcctacaaaactgcaactctgtaccctctgaccaagatctctgcatttccccacctccccacctcagcaccattctactctgcttctaagtatccaacattttaaaattccagatataagtgagaacagaaggtattatttagaacaaaaactgtaacctcgttttttaaatacatttgctttggatatccaagaatcttcttatctcaagaatgctataaaaaaatatataaatcccattcttaagaagccagttattgtttggtactaggttcatccttacactacattcctcctcaagaagaaaataggtgctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaagaagaagaagaaaataggtaatatgatagatttgaaagcaatgattgagcttgtgctgaaatgaagtgatggattgtgcctggaattttttggtttaatgactttagatttaggataaaatttcattttatagaaacaacatgaaaaaatcatcattgcttataatattaaagtctgatatagaaagtaatagtaagttttccagcataggcatggggcttaaagggagatttgactctatcagagtatcaggattcactctcaactttactgtaattctccagaagagccaaaagaaaaaaaatccagaaatacagaacaaaatatttaaagatccaagccaaatgttttttaatgatttttttcttttatgctgactgtatatataacattttgtcattctgatgaaatacatgttatttccttttgaaatctgaatgaatcacatttcagaaaaattcattgaaatatgatttagaacagtgatcaggtaaaatttttaacactaattcagatttaattattatagtctttaattccctgtcattgttaaatacagcactaacagaataattaattgggaaggtatgtactatacattttaaagagcatttttttttttctaaaatctaaatgatgacaatttggctttgtaacacaggctgaaaatatttattcattgagatacggatcatctcccttttaacaagctaataaacaatatttggataacttttttttggctaaagtctattaggtaaaacgaccatcaacaaaaacaatgaggctaggcacagtggctgacccctataatctcagcactttgggaggctgaagcaggagtatcacttgagtccaggactttgagaccagcctggaaaacatagtgagatccccatctctacaaaaactaaaaaattggccgggcagggtggcatgcacctgtagtcccagttactcaggaggctcagatgacaggatctcttgaacgcatgcggtggtgcctgcagtgtgccatgatcatgccactgtactccaacctgggcaacagagcaagaccctatctcagaaaaaaaaaaaaaaagcaatgaatatataagcatattagtcttaaaaaatacttcttatgagctttattaatataagcatatatttaaaaattagtccagataattgctaatcacattttaaaaataaatattagactaatacagccaaagaaaccttagaaataaagaactgtagttattctggtaattctgtcttttcgatggactaataattaaaatcaccttttttgtttggattccaaatggtttcccaatttatcataaactcacatgggtggggaagttgtggaagagagtaagaaatcttggccaggcacggtggtgcacacctgtaatcccggcactttgggacaccaaggtgggtggatcacctgaggtcaggagttcgtgaccagcctgactaagatggtgaaactccgtctctaataaatacaaaaaaaattagccggccgtggtggtgcatgtctgtaatccgagctacttggtaggctgaaacaggagaattgcttgtacccaggaggcaaagtttgcagtgagccgagatcacgccattgcactccagcctgggcaacgagagcaaaactccgtgtcaaaaaaaaaaaaaaaaagaaagaaaagtaaagtaaaagaaaagaaatatattctaaacatgtgcagaaaactactaccaattttaaaagctaatttatcagttgaaagatttctgccacctatcattgtctaaatggattcccagtttgctggtgagatcttatttttagactgtgatatccttgaggatagagcctgtgcttttcatttctaggtcagtatagggcatgaaatattaggaagtactcaaaactatctgttgaataaacaaagcatggatgaattttttaaaaaccaatgaattggaaaacattgttcttgaatatctctccatagacttgaaatatatcatactatggagaaaggcacacctactttggattttcatgaattagttattttccctgaacctaagtaatatgaatactggcatgaaaatttacaacggtactgtaatcatggtttttttaaaaaaaatttattttctccaatgttgttgatgataataaccaccccttacatatgtcaattgtaagcaagctttttgtaacaagattcacaatgtttcactctaattctcaatacaaatcatcaaggtggatactatcatcaactccatcttacaaatgaagaaagggaggcctcaatgggtttaataacgtgcccaagttaatattgctgtttagctgcagagaggaaccttctgaacctctggagtctaagctccagccactcaacctctcagtattttgaagtaattcatgtcttattatggtgttaatttaaatcaattttacataatttatttttatatacttcaacatcattttcaagtatccaagtttttatttttaactcattaataattcatttactcttcctttaatcagatgactcatacaactttgcattttctatcttttgaagacatatagtaaccagtagaaggaatctaaagctattgtgttaaactactgactttaaaaataattatataggaacagaatcatatgcatcaaagatattagattattgaaataataaactttatgattctttttttttttttttttgagacagggtctcactgtcatccaggcaggagtgcagtggcgcaatctcggctcactgcagcctccgcctcccaggtttaagcaattttcccacctcagcctctcgagtagctgggattacaggagcacaccaccacgcctggctaattttttgcatgtttagtagagataaggtttcaccacgttggccaggctggtctcgaactcctgacctcaggtcatctacccgcctcagcctcccaaagcctcccagaaccgcatccggccacgattcttaatagtaattcccacatctaaactatacaatgttccactcgaacccatttacaaaagccacactccattttagtggtcaaaacagtaaacatttaattgttcatttaatttatttgggctatattaattccacataaattcaaattgcttgcaaattgaggtatgcttgattttgaaaatattctaatgaaaaagcttcctttctagccaggctttaccactacgtaagaaaggatctgactgtttggctttttcagtccatctgagatgtctctttgtaactgtattttaattttattagagtgtgttactcatgtggtttctctttcacatgaacccaaaccaaaactaatttaatgccatgttccaggtgactcaatatgaaatggggacacataaaaagatcttatctttttggaatcttagaaattcctttatctcttttacttctttttaaattttcaggtagttgtttttattataatcattattatatgtaccacctacttgtaaaaacgctttgggcaggtttacagggaaaaaaaaaaaaacagtagtagagaaattcacttaaactaagtatgagaaaagaagtgccctaaatatcacaggaaaatcaactacatacgatttcattttataatatttctacattcacgtacaggtaatctccaacttactattgattcgtgctctaaaagctcatcggtaagttaatggtcggaactcaatgaattctattgaaccaataacatattaggtgatcaggttgttacaccagcacgcaaagcccaattcaatcctgaatgcaactcaaccatcataccaatagtaccaacaggaattctgagtctaaagacgatggccttatgaagaattatgccaaatgggagatcaagtacttctacaataaattcattcattcagtagacattaattgagcaccaaaaggctgcagagtgtcagctttacatgtactaattctggaattaaaaaggcctggctcctaaatataaactggagataaaataatgccttaaataaaataatgtatgtaaagtttgtggcacataaaaaaatctttactaattttaactctcttcctttctgctgaggaagaagaagaaagaaacagagttctcagctttacataaattcttgaaggaagccaggcttaatttcctcatcatttgcactcctctccaccttcccttccgggcttcagggcccagtgcaagaccctcactgagccaaccatcttagacctctctctgttccaggctctaaaaatatcccctcccaacctgacttttattcccatcctgcagccactaacatctgctaggtgataaagaaaagcagatgcaatggcgcgatctcggctcaccacaacctccgcctcccgggttcaagcgcttctcctgcctcagcctcccgagtagtggaattacaggcatatgccaccatgtccggctaattattttgtatttttagtagagacagggtttctccaatgtcgttcatggctggttttgaactcccgacctcaggtgatcagcccgccttagcctcccaatgtgctgagattacaggcgtgagccactgtgcctggcctgacctgatgaatttctaattagtggtatttttaagacagtataaaagaatggtataaaataattcaggcagagtacaattataatatttggggacagggagaaagccattcatttattaattcattcaggttctatgaattgccttctatcttcctggatagacatatgtcagagatcatgtcctcatagagctttgagttcatcagggaaggcagaacttgtccaagctatatgactatttccaatgggtattaacaaatatttgtttaacagagtgaataaaatgctatgaagaaacttagagagcaacagaaatgcaaaataaagggcgctaacagaatggaatgtcaaggaagacttctttgttgaaggcttctcctagaatgtaagtcccatgagagcagagatatagtctatatccaaatgaaccctgaatttcaagaacccagaataatttcaggcacatagtacgcacttaactaaaaatacatgaaagagaaaaggaagattagcttaagcttagacttaaagggtgaataaaaattagctggaggaaatgggattaatagaagtgaaggcatttaggtagaaaaaagtagcactttttgacaaatttaaagaggaagcaggttgtacagacgatgaggcagaagttccagagagaaaagtgagaaacaagtttggaaaggtgggtaaaatccagatcaaactgggcctttcacaatgtgcaaagaattggagacatttttcctgagactgactagcctactgccctggaaagcccagcttggattgaactttccacaatcatccctcagaacagttctgaggcagtggcatgtggattctggtggcgaaaggcaaagggggagcggagaaatggagttcgcaagatgagtaactgaggatcccaagctgtagtggcagagctgccactctgtcactagaacaaaccactaagaaataaatacaacagggatatctgagtccttggcctacagtttttccatggggaaaaaaaaaaaaaaaatatatatatatatatatatatatatatatattcgttgagacatttgtttgtaagttcagattgctatctaagcatgctgggagaattcactgggagaaagccctgaaaagaaaaactatttgctcctgaatttatctgtatgagcaagtatgtgtgagagagacagagagagggagagagacaaggaaaggcagagagagggagagagaggcagtcctgtcagagggctgactgtaaaagaatggaggattacacacttcactgttcaagggtgacagagggaaaacgaggctggcaccaagcaggaagcccaatcctgcctgaataaaacactgcacatttatgcaatcccgggtaccagatcttttatcacaaactattttgattgcatagaaagaaaagtgctaagtaaaaattatttactccaggtctattatgaaaagaacagattaactccctaacagttcgttctttttgaaggtatattttctaccttgctggtatgatttatattaatgagaggtttaaaacaggttttaacttaagaatgattgctgatggtgaagtgcagtaattatacaccttatgacaggacacgtgaatggctcctacaagagaactgcataacatgtcaagctaatcctccttgcataaaaagagagaatactttgcaagctggccgattttaagctccagttaacaaaaaccctttttgttggagtctaaaacaagaatgggttaacaaaagcaaggaggaaaaaaatctcatttttccccttcttcacaaaatatactattacaggacttaaaggttttgaaaggccacagtgtggctgaaagacttgggaaagaaacaaggtcttcgccaacaacaccacactcaaaagatcctaaggtaaatcgcagtctcttatcagtatggaacagtatgattttactctagttttttgttgttgttctgtttttgatttttaatgagttaaaggtgtagcgagggaaggagcgacaccatggctaggtaagaatgaaatgggttcatggatgttaggaagaaaaaaacgtatgccatggtgggcaagtcaatagtgtttgtgccttttctgcatggctgctttttctcatacaagagccacttctggacaataatgagaccccgtaaagcatctgcttagggattacgaccccgtcacactgggaatgttcagttaacacagagcagccatgggcttaactccgtgtgtgcctgtcttcctgctgcaaaacgcaccaaatgcacagtggtcctggattcttctaaatcatttgccaccaggaaagaagatactcagctactgacacaccacctacctgctcaaggaaagcaaaaattaaataaacaaaagccatcagatttacttcacatcatggaacttgttaagacaagggagacaggaagactaaaggttgccaggtgtgagaaacgaagtctggaagtccattttaaagtattagagggctaaggatcagcgtcagtgttaaattcttttctaagaattcttttcaccttggaaactttcaaatgagaaatttaaggagcagaatccttatatttttctatgactcttaagtgatttacagaatcctaaagtgtagcaagttcttataatgagttgaactatttaacttattttatttaaatgtttatttcaattgttttgcctatgtactatagtctgtaactatcctagtctataatcaaagaaatcaggagtgcccaccacctatttgcagaggtctctaaagcagagtccacagtggccagggcccatctagcaaactggcatgctcagtgggacaggtcaagagggcgggtctgcctctggcttcctccttcttctaacacatgctgcacttgctcttgataggatagagcaaaaagtcaccactttttaagaaaaccaaggcaaagaacagaaagtttaactcgtggtacctcctaaacaattgatgtcattactgctcttcaaaagatctcttacagacatgtagtttagccataaagatagtacgttgtgttgaaaatgcaaaatcacacaaatattgccttaaatattttatttccaaatgtaagtaatagttaaactatttatatcccttcatgagaaactggaagctgaaattttcagatgtgaaggaatttctcagaaagtgatcctaaaaattttcaggaaaaacatctaacaatttaaccataaagagctttggtgaagtctgacacccagtatttagctcttttgctattattcttttttttttttttttttttttttaagatggagtctcactctgtcgcccaggctggagtatagtggtgcgatctcggctcactgcaacctccacctcccaggttcaagcaaattctcttgcctcagcctctcaagtagctgggattacaggcccaggccaccacgcccagctaatttttgtattttgtagtagagaccgggttttgccatgttggccaggctggtctcaaactcctgacctcaggtgatccactcgcctcagcctcccaaagtgctgggattacaggcgtgaaccactgggcccagacttgttttgctattattctttaataactgtttgcaaactacaaatattgaaaggtgagcatatgtacaaagacaaaattaactagtagtctgagctgaaatattgtagcttaattctagtctatcaattttgatctgaaataataactctgagggcagttttgtcaccatcagcactcattccaatattcaaaaggaaaatttttgtttaatttatataacatcttacttatagatgctttacttatagaaagcacctatcaattataattagcaaaacaggagtcaagggcattgttttattgtgttacatgtcaaggaaaggagacttagagctaacttctgtgactcttggaaaatccaggattgaagcctgcagtcctgtgacttattgaacagtcaaacctaggagaaattatcctaaggtaaaatgtcagaggattactctctagattggatggcagagagagattagcattctcagcatcaaaaaccagatcacaaacccatctgcaacagaagtacatgcaataaaagtactagaacaaaaatcaccacatttaagagagaagctacctcatggtgtagtaggataagaaggaatgagattgataagaggaggcatgtaggtatattatcattactctttttttttttttcttaatggagtcttgctctgttgcccaggcttgagtgcagtggcgggatctcggctcactgcaacctccaccttccgcgttcaagcaactctccttccttagcctcctgagtagctgggattacaggcacgcaccaccacgcccagctaatttttgtatttttagtagagacagggtttcaccatattgaccaggctggtctcaaactcttgacctctgcccacctcggcctcccaaagtgctgtgattacaggtgtgagccactgcacttggtctactcttttttttaacattttgttagttatgctttgtaaaactagcatatttttaatttaatttacatcaatttaactaaaattttattaaacattcttaaacttggtggtgctggcatttgttcgttgaaattttttttttggttttttttttgggtatgttttaactatttcaacatacgtttttaaaaaccagatccaagaggatcagaataacaatagtgaggtgaaatcactggatcaaccaggggacaaaaaaaaatagcttcacatatgctcatttggtctttttgaacaaatgttgaataaccaaatcttttagacttttaaatcattcattattcttgcagttcaaatgtggcaatcttaactatttagggtttcacaactggtaggtacttaataagtatatgcctatagaggataatgataactttactcaaatgggacattacagaaaatgttatacgattgaaaacaaaataaagaataaacaccaagctcagaaaaaaagacttcacactaattcactccatctcattcctttaaaattcaggcttaaaaattttttgataaaggcgatctgatgttcaaaggacatcatttaaaacttgggaggcaaactgatagaggagaatgccttttgtgtttaggaactcccagtattgccagccccgaccttgttcctcaccagctgtaaaagcctgtgtgagaccttagtgctgaaggcctcagcttccttatctgtaaatgattagaatagataataaaggcaacaaccaagtttatacagtttgcctgacaactttgacatatactatctcaccctaaaagatccctttgggttttcatgggctatcatcttggttttatacacaactcttatttggttatatgtcacttacctaagtccaagaattacgaagcacagttgttcagttaatttatttcttatttttaaaaaaagcactgttgtactgctgtagatagaacaactctaatcttcacgtactgctgaattacaattaggtgctaaatcaccttcaaagaatgaacaaccttttgttttgaggctcgtccagaagcatcactaggacctgatatgtacaagaaagaaaaaaatagtaacctgggcagtaagagttttgtcagaaggaatgcttgtccttatcagaaacaccacttatccccaaggcttgaactttaactatgaaactttacccactgggtttttaacacaattactactgcaagctcaccattatgtatttaaactcacaataaagaatcaatgcctgatattgcattatttcctaaaagcagattttgatggaagacaagaggctgggctccagtatcaagagtgtacaggatattttttaaagacatatttaaataatagcattgatcataacacaataatcactataccctcatcttccattcctacaacaaagccccttaacaaagacatgtgtacgcattatagctaccagttttatatggaactgcccactaatagctaaattggcatctttatgaatttaaggttctctataatgttgattatggctactgcttttgactgtatttttcaaaactgaccacaaaatagaagcttctaacttctctctgcccttgtgtttgcaatctccagagaaagcactccttaatttcatcatagtggtcagtaatctttagtgattgagacagaaattaaaattgattatttgaattctgacaagctgcttatgtttgtaattaccataaaactctaccacaaatgccctagagtccacgggtgtgagtgaggggttgataggaaatgatccattttcatgtatctagatttaggacgatgcatgtggaattgtagagccacttaagatcacactcatccgtgctggactaactgaagagggaagtcactatcctctcttaatagaccagacagtcctcacgtcattgctacaattaaattccagagaattttttggattctatttaatgaataaggatatatttttcatgtggtgtcattgtttcactacttcccatgtttatttggacagattcatagcactgggtaggaaatgtattggttggcaacttcagttttggaagagaaagtaaacacatgctgattagcaaacagtaaactctactgtgtttaattttggcttctctttaaaaaaaaaaaaataaaaacacaaaaaagccactatttggtgttgtgttccaagtaggagcatttgtccctaagttctttcctaaccccttactggagggcttccagaattgctctcatttttttttcttcttcccctaacaccagtggcaaacgccaacattatttaagaaaatacttgtgcatatggtatcctcctagcacagatttgccatccagttgaacagtagggccactaacccacacaaactaaactgcaaaattatgaactgcataaacataaacaattgaatttagccctaataaattcaaggtaaaatcacacttctgaaattcctaaaaggctacgtcactgaaaactatcaggtctgagaactgaaggtggtaaatatgacaatctaaaacttccaatgctctctttagagccaatttctttcatctatctcatcctattgatttactgtgactccccaaattattctccaagctttagccattcttagccctcttctcatccatcttcagaagatcatcaaaatccctaacacccaaaaagtgccgaaggccagcacacacagggaaaagcttggccacctaagatataccattgcccactgagcacaaaagctcttcattatgtctatgtaccttctcattaaacagagctggtgtctgatcttttcactgctcatgattactactcattattaatcagacttcccaacatgcttccaaggtatgcaaaatctcgtccccacataccagatgggaaagctgaggcatccaaaagttaaataactcccaaatagcccaatataagaggtcagcaacatctcttgccgatctacattgtttcttattcaataaacatttattattgatctaccaagctcctcaccctgctaggtataacagtgtgtgtgtgtgtgtgtgtgtgtgtgtgtgtgtgtgtgtgtgtgtgtgtgtaagctcctcaccctgctaggtataacagtgtgtgtgtgtgtgtgtgtgtgtgtgtgtgtgtgtgtgtgtgtgtgtattctaccatattctgggttctgggcaaaacagcagattatcaaagtcctaacccacatgaggcttacggtctaggaggggtaagaaacagtaaaccaagaaacaaatgaatatgaaatatgtgaggtagctatggggcaaagagtacagcagggtaaggagaaaaagacctgggaagaagagagtggtagctggagtggtaggagattttgggggcacatgtaatttaagtcttcctctgaatgaggtaagggagcaagccctacctacgatcatctgagaaaaaaacggttcccagcagaaaggacagacagagcaaagtgcctgaggctcagctgtactggagggatggtagtattgctgctactgaaagggcaggcagagtgactcactggggagagggaggcaagggtcagatcacacagcacctggaagtcaccactaaaagtaggggctacaaatataaatgagactactcaagagagacagtcttgtgaagagtttaatacgtaaggttacattaaaaattcactgcattaaaagcagttgatgctttccctaccatcacataaaaagtatatgtgcacaaacagacagaagggtgcatgcgctgaattttatatagtctaggaaacattttcacattggttgtttcagtcaaatacaaagaagttacagaacagcatcgagtacctaagagagaccaaaagcatttccttctgtaaagccctgcagctgagggcttacatccgcctggtccaatcagttcatttccaaacaaaggtaggaaatggctgcatcctagtatttcattgtggactcatgactcagtgctttggaacttggtatctttgggagtgagtgtctattctccacgtctcttgccacagggggaaaaaggtacagataaacagtaacacaatttcacccaaccgagatataaatctgtgggcttctccacccttctcaaaaataaatgaatgaatgaaggaaattcagttcctgcttttttttcttcccttctctgttttgtttcctaattcccaggactccctggtgtctcctaaacagcataaggtcaactgatggtgaaagtacatcacatgataattattcaaaagctgttatgttatacaatatagtttataataggaaaaggagttacatttgattctgcaagagcagtcggtaatatgcccattacatagggattctaagaaactaaaattaagaaatttgtcctaaagaacaaattgattctcctccatcatttaaccaaaaaggtttgtagtattttgtattcacaatgttacacaggagaacagtaacttaactttgaaaactgttttcacacaatggtcacaaagaaaataacacataaatcccattaggtctttttgtaaaaagcttccataatttccaaatccacggtgtagagaggaaaagaggaaaatggcatgtgtatatgttctaagactattacttcaaatgaataaggtttagaggtatacttaacatacaaactgtttccttcaggaaaaagtgcaggaactcctggatagacacaatactcatttctgatgaaagttacagaagaaactaccagttgtgtatgatctaatactacaagtcacttattatctatgaaggaaaacagaaagagaaaagataagaaaacaacatttaaataagaatgagaaaggaatctctgttctaacttaaagatacataaacatataaatccaaatatgagccaaattattttataatgatatccatgtgatcaatgaggcataaccacaagaaccttacacgattataatgagagaagcttcgaaacaggaaatttctatctacaaaaagtacaaattattttcagaatattggaggaatctggggttttctacccagcagaataaattatgaaaacagtgaaagataccctccagagggagagagtgcaagagtttatatgttaaagagaacattacatttcacttttccaatgtagaaacaaactgaagaaaatttagaggggatggtgaggatgaagagaaataaaatcataaaaaggaatgagtaaaaaatgtaataaaagaagaggaatatggtttccacttatattagttttgtccttccattaaaaattataccttaaagtccattactcttgactatattgccaatttctcaaataatacactggtcaagttccaaaatttcattaaatatataaattgcatacataaaagttcctgtgtagcctatggaaacattttaaattttcttcagcaaaattgggcctaaagtttggaaaaattcctagagagtgaaattaatctctctgtccccatctctccctctctccctctctctttctctccctctctctcaatagataatattaccctactatatatcctgccatatatctttatactccaatttcctacctagtcccctattcagacatgcataatgcttccattttgaagcatatggctggggagccaaaagaatttaaattgccttcaaaatgtgcatcgcattataaatggtgtgaaaaaagatcttactattcagctctcaacttggagcataaagcaaagaagaagcaacacaagactgcttcaaactttatccaaaaactcaacagcttcacttgtttatagaggtacaaaaagtatgcgacacagtttataaaacaagaacgatgtactgtatgcaaaagtaaagttaaaagcaaagtatagtaacagccctatctcgttacaaacacttggcagcatgtctaaagtaccatggtcaaaaacatgataccgtctgcgttgtacttctgccagaaagcactccctaagtccaagtctctttagccatcatcaccacctcatttggcaaactctcccaagcctcagttcatctactcaaaattactccacagaaagcagacaaactctctagctttgtaggctgcaagtatcacaatgaagtagcattggcaagtgacagcgtaagatggagctctgaggttagaaagccaggaccaactaaactgtatcctcaaagcttatttgcatatcaagttgagcagggctgtcttcattttggtaattcagggtttcttctctactctcacagtaattccaatgggtctttctgaatcagccgcagctgagaaagaaagcacatggcaagaatacactcaggcaccgaataccttttaggcaaatgaggggcaaatgtattcggcaattacctgccatttaaccatttctggccaggtcttttgaataattccagaacctcaaaaactgcctcaatagttatgtatgcataacggaccaggccattaccaaggctaagtaaatacaagaatatgcatcaaggtttaggtaataagtagataaatagactatatcagtatcaacatccatatctacctgtggcatttataactaaaaaaacagcagttcataatacataagtataaatgtggcagtgaaaagatgactgataggacagaagtagctgcatgaattattaattttcctagggcacgtaagaattggcttccaaatttttctttaatcgactttctccaaagtagcatattacataattcaaaaaaaaacagatattgtcatcttaagtttacagcttgccatatttcctagaaaataaacaataattaacaacatatctcatagttgttccctccccacctttcttcaagaaactttacactctgaaatgtagatacataagctacttttggatcagggcccacaaccatatgcttccaaaggaataatatgtacaggttagtctggtgtgtaccagatgttaaaaaaaagcaaattcaaaaacagaaatatcagtattcaatgcagaaatatattttaaattaaatcccattcttcctctccttatagacacagaatcaaagaaagccaattgtatgtctaattttttaacctttttcctgaacaaaaatcccaatttgactcatgactctagattctttatatacataagatcacaagacaagaaatggtcatttataaattatcctgtctcagagtgagcctcctaccatatgctgatattcaaccagaagaatttgtttgaaaaggcaaaaaaaattccagaagttaagcctataaggcaaaccagccagcaaaaggcgacagagtccacatgtctatcagatatttaatatgttaaacctcaattaccaaaagttttaagattctctgtaaacataactagtgagtctttatttttcagatgattctgaatgcaaaatgagcacattatctgcacattgaaagaatttatgtgttttttcccacatatggaaatatgcatgagtattaaaaaacaaattacaaatatccactctctagaagtttgaaaagtctaaagtttgggctgtatttgctttttccattgcaaacctacaaggattccttcagacttacaaaagttattgcaagaagtcctgcaggaagaaacagattggggatttagatcacccatgcctaactttttcagggcatcatgatctctccccttgttctatacatcagagatgtcactgaagtgaaagccaagttttactttagaatttaataaaaattgattaagcatcacagagcacaaacaaagctgctccataaatctttcaggcctttttgtgctaggaagaaagcaagcactgtctgctgaagcagatgacagatgctggcttaaagataagtattatttatacttctgtaccagatttcttcttatgcatatcttatcatgcatgggtatatgatcaacaaagcaattattttatatcagtcaaagacattcaaatgtaccctggctccataggaatgctttaaagagttcaggtctagggttcaattaaaccaagatggagagaaaagaaagtttggaaagaaaaacaaatattgaaatggttgtgatttgaaatgtactttcacacacaggctaatgaatatatatgtactgaaaataactttgttctgaacatatgcctatgcattttaaataaatgatgcatgtttgaaagataagagggtttaccaaatctaaacacatcaagatatatctatattaaactgcatttatttgtacagtatgtcggtaaggaaacagccccctgaaagaaatccaatagttatgtaaagagatagctgatttaaccaagtttgagaacattttagtcatcaagactagagtttaaaaatttaaatgacattccttccctccctccttagaaagacagaatatatgaaaaccaatcacttaatgaaaattcccagaggtttctttattgttttacttctagcatatgaagtggaaaaaagataactaattatttgaaagagaagaaaaagcaacttatattaccttctcaaaaaatatataatattctgcatcataaggcatttgaaggtggagaagctggcatgtgattccaaaacaaatctggataagtaagagaaataaatcaggtgggctgtcttgaccattttcttctaccccgattcctaagtcccttgagaatctagaagaggagcaggtttgggggtggaattgttttgttttattgtgtttcatgagggaagacaaactggaaataaatgagttttcaagtccagccagaaagtcaacctatggttagatttacctaattgggtattttttaaaaaaaaagtacaaaaacaaaaacctgtgctcatccatttttttatggtatcttattgtatttcatttttttctcagcatttttcttcgtaaaagttcgtcctaagaaatcccaacctcgtctcagatagcctaaaaggcagaaatgttcatccactcaaagaccaggaaaccctaagctgcatgacatcatgtgggagtaaaatgactgagtgagctcaagccaggatccttgctgctggagggtttcctgcacaagggctagctgaagccacagatatggctgcaactgcattaaaatgacattggtagcagaattaaactgtctggtttcatggaaattaccgtatactgtagttatcacgtgagaattagcaatgcactaaaataggacacacaaatcagtactattatgtggtaatactaatctatcatacgcaataatttttctttcctgaattatatatgaaaacacatccataagggtgtagcaattatgagcaaatattttcaagaatggctattgtgtatgtctcttttaagcatgcaactccacatagaagcactaaacaaagtaagtgcttaaagatattcaggattctctttcctatttaaataatcctctctattatataaaaattcagtttgtacaacataagcataagaaatttgtagaggaaatgataggtcagaatggtttttaaatgaccttatagtagaaaacaaagttaaaatatataccatataccagtgcagtcagatatattggagtcactaatacattctgaatctgctgattaaatgagagacattcaaaatgaatgaaacttacccacatactttctcatccatgtaagcaggaaagaattacatttcttctgagctaatgggaatgagtatagtaagctttaccgataactttaatctccacaatctccatagacagatccccaccaaaaaataaaataactgcttagtaactttgcagcatatcaaagttcacaaaccatgcccagttccaatacttattagccgttggccttagacaaattactgacctctctgaatttgaatttgtatatctatttaaacaaagataataggctcaaagtttgaaacaaatgggatatgtagaaaaaacattgagcaaaatgcctggaacacaataagtactaaaaaaatagtaaatactattattgttgttcttgctactgttattattattacacagtactttcatgataaaagtctctggccatacatcagcctagattagtgcagcatgtgcctaatttctcatctctgattccatgacattggggtgtccggattctcctcctacttatctgacttctcactatcattctcctgtattaactccaattcttctaaaagtcagcattcccctggttctctttatcaccctctgcaacctcaatcaaactttggcttcaaaggtttgggataacaacagctaaattcagacctgtattttcatttgcctgtcagacatcaacacttgggtcatgcctacccaacctagaagaaaaaaactgaacaactcacctccaaactcagtggttcttccactgcctctgttaaggaaactaacatttacccaggtgacgaaattagaaacatcacagtcacacccaactccttctccctacatccataataatatgcctccttctttctattcctaccagtacaagctttcctatgtccttcttgctgctctcctgactttcacagaagtcttagcttggttatgttcaacaaacaagaacacctaagatatgccaagcaccatatactctgaatgcaaaccaggacagaacaaaacaaaacagaaaaaaaaaaccaacggcaacaaaaaaaatgcaacccttttgctctcaaggttcttcaagtagtgggagagatacgtaaacacatgattatactataatgtcatacaagcaataataagtacacatggccgggctcagtggctcacgactgtaatcccagcactttgggaggcaaaggcaggtggattacttgagatcaggagttcaagaccaacctggccaacatggcaaaaccccatttctaccaaaaatagaaaaatcagcagggcgttgtaatgcacatctgtaatcccagctacttgggaggctgaggcacgagaatcgcttgaacccgggaggcagacattgcagtgagccgagatcgcaccactgcaccccagcctgggtgacagagcgagactctgtctcgaaaaatgataataataataagtacacataaattataaaagtgggacagaggagggagtgattattccatctagacaggtcagaaatgagtttactgtaaatatccatcactctagaggagtgttttgaagaatgaacaggaatgtgtggttgcacaaatgtgtgcaatgaacaggaatgtgtggttttcctctctaattcctgagaattagagaggaaaaggcattctagatatcagggacagcgtgggttagactctaagctctctaatcaacatgtttacacttaaaactcgccagtctaaaacccagacctaattttaacactttcccttttccataagaccttcaagggctttccactgcctctaggataaaatccaataccttgcattggcaaggcactggtattctaaactccgacccattagatgggaggaagctcccactgctctccacatccctttgtcttaggtacaggaagtcactacaccttcatacaggactgtgctccagccagccaccaaaatgcctctctgcccttcaccctgcaaaatcccatttaccctgggatatcaagtttaatttcactctgctgaagtccttcctaatcaaccctgcattgtgtcctcctctgagccttcagtccctttgttgatagctctatttccacacatctcatacatggatttgtagagtgaatgcccatatgtttgccatatcatttttgaagagcttttgctgtaaatgagaacttcagtgagtaatttccaattactttcccccaaattaacaggcaaatattaggaaacatcctatgccaaaccctcttatttggtgccactgacagtgctaacaggctagagtgaaatatcaaggtatatgtgtggttcacagaaaaccactaatatcaccctgctattgactgaactgtgtccctgaaaatgcatatgctgaagacccaatccccagtgtaactgcatttggagacagggtctttatggaagtaattaaggttaaatgaggtcataaagttgaaggcctgttaaaacgggtttagtatccctacaaagaagagatgccaatgtgcctgatctctctctctctctcttgctttctttcactatatctctctctctctctgctttctgagacacaataagcaggtggctgtctgcaaaccacgaagagagccctcaccagaatccaatgatgctaattccctgatctcagactcccagcctccaggactgtgagaaaagaaatttctaccatttaagccacccagtctatggtattttgttatgacaacccaagctgactaggacttataccatagtcaagagaacttgaacagtccacaattaagtggtgagactgtctctggtatgatgcacaatgtatttaactttacaaacagactcattaatctctcaaaagcttaacactgtcaccattttacagacagatccagctaatggttggaggccttccatgcgccatccaataatgcagggagaggcagtgaccatgcccagaacaggattctaaagtcctgcctttcaaatccctgacctagaaaaaaggactactccatttctcacaggaaaatgtgccagtcatggaggcctacatggcacgtctctgcactgctccaggtcaggagggccatctgacactgcacaggcaccactgcagggcaaaaggatgatcaagcatccaaaggccaccgccaccactgactagctgaaaaaccatgaaaaagttatataatttcactggatataaaattaaagcaagattttaatacttaccttgtagggtcactgtgaagatcagaaataaaatacagaagtacatggcccactgcttggcatacagtcaagactcagtaattagtgggtactctgcatgctttgatgtcacctcattaacagtttcacttctacctaaactaaaagcaggaacagggtgttcttattattttttaaaatctacagtagatatctgccctgtttgtttaggtgttgtctacacagtatctactaattttttctttttttctttttttttttttttgagacagggtctctccctgtcacccaggctggagtacaacggcataatcaaagctcactgtaactctgaactcctggactcaagcaatcctcctgcctcagtctcctgagtagctgggactaaaggcatgcaccaccatgcccagctaacttttgaatttttttgtagagatggggtctccctatgttgcccaggctggtcttgaactcctggcctcagcaatcctcccacctcagctctacttctttctttctttccttctttcctcccttccttccatcctagcaatcctcccacctaaactgcccttccttccttcccacctaaactgccctgccctcccctctcctccactcccctcccctcccttccttcctttcttccttccttccttcctgtagccttggtctcccaggctcaagtgatcctcccacctcagcctccagagtagctgggattacaggcatacaccaccatgtcggactaatcttttatttttttgtggggatgggatctcactatgttgtccaggctggtctcaaactcttgaactcaagcagtcctcctgccttagcctccccaaatcctgggattacaggcatgagccaccacgcccggcctctattactttttgttagtaataacaataattttcctctgggaagccactcttccccactttctgagatcatgtagtttgggtgtctcgtgatcctcctctagctcctctccaagaacaggcaggagacttaagcatagccaaagagaagaaagcaccagttcagcaacaggttcaggggtagtccaaggagatccagcccaggaacgtctgcagggactagtgaggaagggaacattttcctccccactgggtttgcttggctaatagaatataagccttcactgtggaaagagaccctctttgcccgagaagtaagggaacaaagagaatggcataggaagagaatcagagaaacattcccagttacatcatttgaacacctgaatcaaactgtacctgcagataaactggacttttaaattacatcagagaataatctccctttctcacttcagtctgtataacttcagtttcttacacttgcaattaatatacaaaccaaatagcagcaagaatttgacacctttcagtgaccaaaaggaccactgaaataagaacttagtgataagaaatacctttcattaaattctcactgtacgtcaactaaatatttcaaatttagtatttccaattacataaactgaggatgggggtagatattattatctctgctttactgataagcaaattatgagtcaaagagcttaaacaaattgcccaagtttaaatagtaagtggtggagatgagatactacctaagatttagcttttttcttttcttaagtattaccaagaaatagtattactcggaaatctcacatatttataagatccctttgttttatgctcttatagcatcatgtgccttttcaccaaatgattcaccacaattgttcattctacttttttttaagattgcgtctcactgttgcctaggctaaagtgcatttttgtgatcctttgatttgggaaattgttttctcccattatcttataaacttcctcagtttacgtctatcatgattattgcatatcattgtgcattcactgacaatagtagatacttagcaagtactgtaaaaaaatagaaaggaaggaagagagagagggagggaggggagaagaagagaggaaggaaggagagtaaagggaaaagaaatgaggaaggagggagagggcagaagagagaatggaaaagtgagaggggaaggtaattccacaaccccttcaccacccttaagccctttcttgagataatttagggcctagcaatagacagtggtgacactgtcctcatgcaaagggataaatagaggaattccggaacaaggcaggaatatcatcataaatgccaaagtcttgtggataccatttctgactcccccaaaaccccacacagtaggaacaaacatgataaaaagtttcacctattcctaactccttgttcaaaacccctcgagtctctttcttcttttcttgataagtcttagggtaacacaccaagttttaaaactcagttacaaatttgcccttaactgagcatctgaaaggttatcacgcaggatttttagctctaacagggaggagggtcttttgagtttatggcctgttgagcacttttgtgctgagtcaaggaagataagaggagtgggaaacaggaagaatccattagacagtgtctgtgcatataatatctttttttgttttctttatgtaagttctctgatggacaataatgtccccaggtagctaatgtcacaaacctcttaaacatgagagagaaattgtaccatttctcaaaggcagctttttggaagggaagatcaaagaggaggcagaattaaagccttagctcaaaaggaagacagatttccaaaacttcagcttttgccattaaaactttcaggtgtgtcccaagataaatgatacatcattggctactacatccccacagtggcctcactactacctcaatttgattttgtgaaggagtgctgaagcactatcaaagaactttggtgttcccttgcttatgtcatagttacctagagaaaagagagtatgccttaggaaatattccagtttaaagcaacattaaacataccaaattcatcaccgggattacagtatatagaatattttaagtcaacctgtatatctctgtcaattatattttattttaactatgtgagagaaggaataaaagttactaaggtatcaccttttctagtaaaagataaccaaataaatccattgagaagtcacgtttattcaaaagaattggtttctctggacttatgacatttgagtatagtacctcctttcttctagaatactctgagttaataaaagtttttttgaaaatgaaatccatgggtatgtgtcataataagtaaatactaaatgcttgtagtttttcagagacttttcttaggtgatgtctattcctgaagtatgatcagaatgcaacatctaacattttacataattaaagattatagtattttgttttaaaaagcaaactagaaacctcaagaaaaacctatccactggcattcctttgaaacatacatacaaagaactttacggtgtttttccttgcctttgggtgtttgttttacaagagaggaactccaggtgcaatcactgaatgaggaattagaacctccctccaagctttcatctgattgcataccaacacataacgaaggacatgatatatttacagtagctaaagagttaatctttagcaactctgcttaaaaatcctaatggcagactgcccatcattcttttagacagagcttgtcagaaaaactagggcagcttgtccagctcagcagtcaactgattactagtgaactcaatggggctcccagccaacccctgagattgctgccagccccttgggtattcaaaggccaagttccaatgtggtttactttgccagaatcacatgatgtcagtgctattttctcctgaccagaataaccagtcattcaggttactgcaagtggtatcggtgaactaggcatcacttcactgttagaggtcacatacacaccaaggctctgctccttctcaccacggccgaggggccactggagcctcctgcaggaggtcagctaatcccagtttgtcagttccagccacccaaatcctgcacgggcatcctgcacaccgcagtctgctccaaggaccaggaattacacaggcgtgctgcacatggcacacttagagaacaaaacaaacaggtccaacttttataaagaacaagctggagaggaaaacaacagaaaactggttttggctttcacttatattatattactcgaggtttagtaggcaagccacacaaattctgtgggatttagtcaccgttatccacctatgcccacattctttgcatggtagtaagacattaattaatttttacatctatcaggagatttttcagttgctacaggatttgcaagggtacatgcatgtaaggagtagccagtttttaaaactgtgattacccttatctttcggtgagagaaagtatttcactccctaatgcagagaattaaaaaacaagatccactttttaatctttcttcctccagaagaaaatacaaacatcaggaatagcaaacgggctgatatggctggtggactctgttttcaaagtcttgaacatatttcccaatgccttaaaaaccttgaaatatttttaatattcctcattacttctatggcactttgcatttatttatatgaattcattttaaaaactcactttaaagagactaaatctttaaaatatgacatttaaaaatactgtagattttctatatcattatatttatagtttttcatcctttcttttttctgtcagtaaagtaataaagttttaactgctgagaaataatgggcagcaaggtaaagaagtgtcatgatttttaaacatttgtatttgttaaaaaaaacagaaactgcttcagttataatatgtaaaagaaaaagaactgtaatgactgcagtaactactattacgtaaaagacaatacatgtttcagaaataatagagtcaatgaactatctgttactactggatacatccttattaatattaccttggggaaacctctaagcaaagtgagaacaagatcacgagaacaggcgtcttaagatctactgatgcagctttacatgttcctgccatacaactttgtggaggaaaaaaaaataatgtctttccatctcctgcagcaaaatattgcacccatgacggtcacccgtattaaactcaggtaaacttctacaagaagtccatctgtcaaggaaattgtacagtaagaaaagactggtgatggatgcatggaaggaaggaaaggagggaggaaggaaggaagggagggagggagggagggaaggcaggttggtttctacaaagaaaaaaaagaccaaaaacaattatttttacatcaatgcttcataattttcattcattccatccatgaagaaagtttaagcagatctgcaacaacttcaaagccaatgttatcatgtttttcaatcaaaatcaggtgctacagttagtgttccctgatggttacagctcatctttgactattcaacatgtcttttgtcctggtcttttatttccttctcagatgcatcatatcctactgctaacataacatctttaacgaactaacaaatgtttgaaagaaagagacttgctagatacaagttctctggtgcaaagggactgagtggtcaccaccaattagattatagcgggataatttcacagttctcgagatgattgtttcaaggaaggctggaaatgtacagaggcagaatagcctggaagtgtgtggttttctctaagcagaccaaaacagcccacaaaactcccagaaggaaaaaagcaagtgagatttcgatcctttggcaatgaagaaataatgcacaaataaaatgttttagcctagcacaggggctcacacctgttagtcccaactacttgggtggctgaggcgggaggattgcttaagctcaggagttagggaccactctgggcaatacagtgagaccccatttccaaaaataattttttaataaaaaaaagaaaaaaatgtttaaaatgaagttgtcagaaatactcttttgagactacgtaataacctgggtgctgcctctaggtatctttgcggaattgttacagtaagtaaaactctctcaagccaacattcatggctctccatgaagtaatctctatttatttttttcacgtggcctccagcacatcatgggtcttgtattccagctacactggataacttcttgtacattttcctgccctttgacttttgctcatgctgttcccctggtctaaatgcctccccagcacttgacaaaacccgtcttttaaagtcagttaaaaacataatttctcaggccagtcatggtagctcatgcccgtaatcccagcactttgggaggctgaggcaagcagataacttgaggccagtagtttgagactagcctggccaacatagcaaaaccccattctagtaaaagtacaaaaattagccaggcatgatggcacacacctgtagtcccagctactcaagtggctgaggcataagaatcgcttgaacctgggaggtagaggttgcagcgagccatgatcacaccactgcactccagcctgggcaacagagtgacactgtctcaaaaaaaacaaaacaaaacaaaacaaaacaaaacagcatttctccataagatgctccctccacccctagaaccagatatgagctcctccactgcatctcagtagcttcacatttatacagtacttctcttaaacactgacttgatatgggcttgcgttacttactgatcttatccctccaccagacataagcacataagcatggagacacgcatcttcagggatgtgcactcaataatcgtttgctgatttgaagtgaaatgatgaggctaatttattttacagtactcccgtgcactggttctctaatagctgctcaaaggccctccactgatccaaaagcccatctgctataatattagtgttaataatgatacataggttcctgagataaataatttaattatcacatgcttattagggtctcaccaagagcagagccatttacctctttatttgaataagacttctgaaaaatgctttgtagttgggattctgtgtgtgtgtgaatctatgcatgtgcatatatgtgcatttacaagcaaggtctagaggcctaaataataataatgatcttttgctcctcttcagtgaacttcagacaagtaccttaaagctacaagctttaaagtattagcttatgaaagcgccaaccatgcttccaaatttcaaaacaaaataaccttcgctaagtcaggaagatcacttgaggatgggaattcaccaccagcctgggcaacatagcaagaccccatctcttcaaaataaaaataaaaatagccaggtgtggtggcgcatacctgtagtcccagtttcttgggaggctaaagttggagaatcacttgagcccaggagttcgaggctgcagtgagctatgatcacaccactgaactccaacaaggatgacaaagtgaaaccctgactcaaaaaaagaaagaaagaaagaaaaaagaaacttggctgaaccatgaggagttaacacttggacattttttgattctgcaactgtaaaagaatcttgctgaatttgttgaacttgtgtctctaacagattactgacatttccttaatgtaagatcacctggggattaaatctcaactgtagcacatatcaatgactgtgagcatctgactttaccttgttttacaattctcatgaaatggatgtatggtcaatgactgaggggatgataaactttatattaaccaaacatgatataaaaatccagggcatactgatgaccagatatgggctggtaagaattagttctaatataacatggacatggacatgcttcagtttatataaattgctctataggtagtgacagattaaccctcctaacatccttaaaaaaagataataaaagttattattcacttttattgatgaaatacttggagtgtttagactctcacaaggtcactataaataaccttttaacaatccagctcactgatgagtcttggtgtgttttgtgaagcactcaactgactgtgagaatcacatataagagaaatgatcaaatagcctgaatgcctttggaaaacattgaattcaactctgtcctgctccagaatccacacactatgctagcatagtattactgaagcgcaaaacaccatgctagcatagtattagtgaaatacaaaacactgtactcaaggcacctagtttaaatccaccacctattagctgtgtgatcttgagaagtcccttaattctccctcatgtgcaaagggaagctaccaatggtgcctgccccacagggctattatgagtataaaaatgagacattttatgcagcttctgttttaccaaaaatattcattttgacccactttttctagaagcctctccctctaacaatattcatatgtaaaaccaacaaaaacactaatcaaattccagagagattgaatttcagggtgagggaggtcttactgcatttttgccttaataatctcagtttcatctttcattccataccaaaacatggttacagggaaactatgttctaagaaaaaaaattattaattatatacccattctgcacatttagaaataaataattttccaaaaacttttacctagacaagaacccctccttacaaacagaagttttctctttagaccaatttcactgctaaccataaagaagaaaacatataagtaggatgagatagaagaaaaatcagaaagcagagaaagactaattagaagatagagaaaaaaaggaagaggagtgaaatataatattcatattctagctgccaatccactaacttccaaaaaggaaagtgaatatgccagaccattaaaatatttcagcaacactagcttgtttggcagtcagagtctcagaaccatgagaatcacagttacttaatcactgtgagctcataaaactggacccaaagtgacaagaccattgggtgagaagggtgagagggagctgagcagggtgatctgctccaacaatgcaccagttccagaggtcctctgcagaacttgaagagacagcacagcatcctgaggccgttaacttcctgactcctgcctttgaaatagaaccaggaactgagcttccatggcctagtttgacctggctttgtcactaccccagttctgatgagattatgatctgctaccctagaactaagcagaggtgagagccaagatgcctttctatggcctagagcacaagaagggcccacatagtaacaaaaacactgtcacttttatggattaggcagtattgcctaaaggtttagcacccaaggctttaaagccagactgtcctggttctaaatctgactttgacacctactaactgtttaaccttggttaagttggttaacacagaggctcaggttcctcacctataaaatgaggggaagtacgaggttactctgaatattaaatgagatacacatatataaaactgagtatagtcctagaacatggtgcacacaaggtgacagctgtgccttattacagctactgcacagctgaaaaaaactgtgaaacactgaaagtcactcttctacaagctggatattagactgtgaattccccaggaccagcaaaacccagcattcccaatgcctagctcagtgctgaatgaacaagagagaaaacctcaaaaatctttcagtaatagaaagataattctggacaggtgcagtggctcacacctgtaatgccagcactttgggaggccaaggtgggtggatcacctgagtcgggagtttgagaccagcctggccaacgtggcgaaaccctgtctcttctaaaaatacaaaaaattagccgggcatggttgcgggcacctgtaatcccagctacttgggaggctgaggcaggagaatcgcttgaacccgggggacagaggttgtggtgtgccaagatcgcttcacagcactttagcctgagcgacagagcgagactccatctcaaaaaagaaaaaaaacgaaagaaagaaacataattctaagactaagaccaataatgtgccagctatggtttccttgtcattgaatttattaatataagtaggcagaattatttgttatcatgctaaagaaaaaatgagatttttttttaacggacaaggttttcttaaagcatcatatcagtatctcagtatctcctataaatagattttgtttaaataatacaatttactaaactgtctgagcagtgtggacttcccccatatttatgtttttagtggctgtagctgttgtggtggtcaaacattgagtgttcttttatgaacatagttagcataaaagaaccttttgatgactcgtattagaacatgaatttaatagaagcaaaggtactgcttatcatcactgagaacattcattcagatctaccacagttttataactgctctgatctaacagagcaatttattccaacatgcaatttaaccaataggctgtttaaccttggatacttattagtaagggaacaatgctttcaggattatgctgaataattcagcccttccagtcaaagaacttttgctggtgggtgagaacagcatgttgtctaagtatctgagaacatttctacacatctggagtatgtggccctgtgctgcctttccaggcctgctctcccagccagaacttcttctgccatggggcaagacagtggaatagaactatcttataaacttttttgaacaaagacagatgatgttgcactactacattccctgtgaattctttctgctgctgccaacttatagtatttttaagtttgctcctaggtgttttacagtagaagccattccaaataagattttgctgaaggttcagcatgaactatgcaactactctgagaaataatcccattatttcaactgtttacttttccattataccccatttccaaaatacgtgcttttaaaagttttacatcctctcttcataaatcaagttagtaaggatgtcattcctttttaaagcatgttgcatagaaacattataaaaacaaaatacataaacacacatgtatacgtgcacacaacacacttgctcaacttgaaactgagccccaggactaacaaacacacagtccagggctctggttactatgccttctttctaggatctggcttcatttggaggctcatatcccataccagtgctcctcaaaccacgttctaaggtccatgaaatattaataatagttctatggggagtgggggagtggtataatcaaatttgtggttttgccttaggacaaatctgaatcataagcacataaggctcgtgagaatctctttggtattgagtgaaccctgccaactattcaacattcacatctcattcattgttacatacaaagctcatgaagtgataacatttctttgttttaaaaataaaagagcactgaaaaaagaagtcaattgcttgtggtggtgatgaaagtgaagagaaagtgaaaaggcctaaggaagtgatggttcttggaagaatacagatgtctaggaaagaaattatactccaaagagctacctgtaaatttagaaactcatcattatctctggacaaatctttcataaatgtcaaagacctgctacatatcaaaatggtctaagttcctaagcatcatagaaataaactggacttgactgtggattctacttgagcaaaagatcctatggctgagtcttgggtatgaagagggagaagtttctcacataagcatgggcccatggggcttagactctggaaagacagctccaggggtactgccatacattgatgttggcaggatcttctgtttaaaaggtattggtggccgggcgcagtggctcacgcctgtaatcccagtactttgggaggcaaaggcaggcggatcacttgaggtcaggagtttaagaccagcgtgggaaacatggtgaaatcctgtctctactaaaaatacaaaaaaaaattagccgggcgtggtggcgggcacttgtaatcccagccactcaggaggctgaggcacgagaatcgcttgaacctgggaggcagaggttgcagtcagctgagatagcaccactgcactccagcctgggcaacagagtgagactccatttcaaaaacaaaacgaaacgaaacaaaacaaaactattggtgaaaaacagatattttagttgactggggcttaatgctgagaagtaggcctccaatacaacctgaagatggattcgtggtggtacaagtttgccttctgtgagggtctggaggaagcacttttattaacaggtgccaagtagaactgctgggtcctgaaagaacctacaagacactggggtgagaacacgtagagaagagtccaagtgcactgagaaaagtgaggcgcactgacttcagagaatggatctagtttctttcctgtcagtgaaaactgaagctcactggagttctgagacagcctctggtctcctggtccaccccaggatggctcaatatctgtaatgcagaggctgaatatgtataaatgcagaggcccaatccaagcactcactatgactcaccaaggacactatgaaatgtgaccaaagtcttccagacaaaattgcttttcagtcatgtaaatatccttttaattcatgttcttacttagtttatgtagcttatgtgaaactcgtttgtcactttctaaagatttacttttgtcggactccaggaaggattgtctaacttttccctaaatctcatggtgcttcaaataataggaacttttccctcctctacggttttgatttcccatggaagacagccatttaggaaagttacctgcatgcagatatatgcacagctaaggtaacatggaggtgtgccagtcgagcatatctgaactggccactgtctacctagagtgacaaacaaaatgtagaatcttgcaggatagctcagatcctaccatcttgacaaccaatcacagatctgtcttctatactgggttcaggcaaggcagcatgcttattggcctatatggggcatggattggcccaaaggacctgctttttctgaatttgaaggcactcagttcagggagctacacagatggtggcaaaaggtagccacatcattggttcttgcctctccatcacaatatgtcttagctttttaatagcaagaaacctgtaggtatactaaattggtggaatccaggaaaggaggagggaaaaaagtcaagacaacagcatttaagactgaaaaggggccgggcacagtggctcacgcctataatcccagctctttgggaggccgaggcaggcagatcacctgatgtcaggaatttgagaccagcctggccaccacagtgaaaccccgtctctactaaaaatccaaaaattagctgggtgtggtggcaggcacctgtaatcccagctactcaggtggctgaggcaggagaatcacttgaatctgggagagggagggtgcagtgagccgagatcataccattgcactccagcctgggcaatagagcaggactccgtctcaaaaaaaaagactgaaaaggcaaacttgatgaaaaggaagaaagaagaaactcaaaagcagtcacatctcaaaccttttgtttgaagataatatataccattcatatcacatttcagcccgtaataaggcagtgtagttgagtccattgtaggggccaagggaaaacatcccctttgctctctaaaagtttgttgaaaattaactcacaaaaggcagattaagaggagaaatggcatataaatttattagtgtgcaagggggagaatgcagggatgactgccccatatcccaatggggtacagatgcttatatacactccttcttagaggaatgggagatggggaagtctggatggttttaaggggacagtaaatgatttttaggggaacttaatgaacttaaagtggcctgggacaaagtctgttgggcccacacagcagacaatggtttgtgacaaatgtctgtccagatgtgttgacaggcttcagtgtttctttacatgctatgagctcagttaatggaaattcggggaaggaaccagagataattgttttattctttggtgcatccgaacttgaggcagataagggaacttcagggaacaatttcctcctttgctttgggagagacagaggattgcaaggcaggaggtggagggggtacagtgtcagagagacctaaggctgcttcttcagctcagcatgtcaaagtgccacattttggtgtatcggtttctgagccctgacactatcatgtcacttttcacttatctacacagggcactaagatgcactgcaccggccctcaccatgactcctccctcttgctgcccttctcactccaggctcctaaacacaggccacctatttgatgggatatttcaaacctggctttgattgtgagggtcagtttggcatacaggtgatttccttgtagattaagaacatttactttcttcctgctggatccctcccagagataccatcaaacctctacctacgcaattagttttcacaggtggctgttttgcctccagtaaaactactttctttctccttctgcaagtcaaagcacagcgaatacacacgaaaacatttcagatatgaaataaacatgttcataaaggcagctatgatgtaatgtatcatttttgactgatccaaattatggaatgaactccccacaccaggattaaagtgagaagaatcatttctggaagaaggagcgcaatgggattgtggtgggctgaaggctagaaaaaagggttagaattgagacaaggaaaaggagccacaatttatgctggcttataacggctagggttttctgagatgccttctcctttcgtaaattctgttactgttgacaatcctaacttactagagacagaaccgacagcggagaaagaaaagatgttcatacgcgtcaagagtcactggtaaggcagctgtttgttttttgtttatttgtttgtttgttttttgttgttgttcctgctgcaccagaccagtttcaacatgaaactggcaagttttgagatgtagctgtttctctggtcctttttctagtaaaaggctcccattttagaggcagccatttccaaaggaaaaaaaaattcaatgtcgacataaatcccttgaactaaacatctgtttaaactgtttctaggtcaggagtctaaaactgtgaaacactaggggtgcagacatgatttctttcccaaggtctccaagtactgcggcatgcacatatcctgccatattgtttaaacatctggctcacttccccctaaaagaaaagggctgatagggtgggttgttatggctttttgtcttaacctataacatgattttgttatttgtacagtctctaaaacaaactactgttaaacaaggttttttttttcccttactgcattatttaaaggtggatgtttcaatggcatttgaatagcatgaggggattttttttttttcataaaagctacgaactcaaggatgttcatgaagaaatagtttccttcagttcttccctatgaagaaaaactcttccagaagttccactttcaacattccccttcattaacaaaaccaagtacgtactcttgtttttaaaagtctgtttccatacccgtatttacctgtggaaaaagactgtgttcaaaatattaaaacataaacttattttaaaaagatgcgaagtggagagagttcaagtgcagctttcccaaaagcctggctcaaaccctgtatacatatggaattctgcactgcgacctcagaaggatctgagtggctatacacaggtttgccatctagattcttcacctttactactcaaaatcacccaaataatttgtgtgtgcatctgtgacgaagaacagttatgagcctacattatcaaattcagaattggagtttagggatagcaaaacgaaaactgagctgcagacaaataaagtggcccattcaataaaagtgaaagtatatggcgtaatccgtgaaacccaaatatcagggtttgtcctctgcatctggcagttacttatcctcctcgtacaaactattactgctcctgtgttatgtccatgtctctcctaaaacttgctggaggcaaaaaagcaaccctgaaaaagttcccagtttaagtgagaaagagtgatttcactgacagggcagaacaattgcccatggttgtcaaatataataaaaggattagagttttgttttgatttattttaatgtacaaaggaagaaaggagacaaacttcaaaggttttgcctctagcccagacttctggcctcagggaaacaaatttcctagtgaatattacagaaatatagaaacgactatttaaaattgaccaaaaaaaaaaagcaaatagatatccctactaagactagatacgtatttcaaaagtccaattttatttttccttcctctctgttactaagagaggtggttcaatatccactcctggccttacttcacctgcccagtcaacaaccattcttttccccatggaaggttatttctatatttaggtcatttgttttttaattcaaaagtacgtgcccaataaataatgttctaggaataaagaaactgactaaaggaagatactattataaaaatagaaaccaaaggaacccctactctctgtgcatttaagagcatttaggtgagaaaaagacatattactgtggtttctttaggaaagtaaaaacactcaatgatgaatttttatctatctgaggattacccagattacagtaagacaaaactttgcattaaccattcaaagggtccgatctgctatatgtcccctacaatattaagtacatacttctttcctggatctgttcttattttcaacagactctatttctagaatgtagaggagaaaaggatttcaaacagtctggaaaatatcatttttaagttccaatcagagaacgttaaagccaataaggaacttgaaaggaaatctgggctatcccccaacctaaggcaaagccacactgatagcaacccaagcagataataatctaatctaactttaggataagttaggttccgtgacttccctcttaacatgttcctgtgcctgacacccgtctactcatgaaatttcttttcaagctgcagcctaagcacattcagttattatcaacagtgttaagtgagtagaaagagattcaggggacaacatgagacgctctgcaagatcagtcatgagaacaaacccaaagacctactggacccgaatttattgatctgggaaaggtatatctaggtctcagcaatgttctttggatcaggatttggagaaaaggttgtatctaccactatagattggatattatatcctatttgcaactaggactatctatctctctataaatgatgaacagtattcagctacaacggaggtgttacagactgaatgtttatgtccccccaaaattcacatgttgaagcccaaccccaatgtaggcagaacagggccttcatatttggagataaagcctttacggaggtaattaagattacgtgacatcataagggtggggccctaatatgacagaactagtgtccttatcagaagagacaccggagagcttgcttgctccgtctctgccatgtgagaacacaatgagaaggctgccatctataagccaagagaagaagcttcagaataaaatctaccttgccagtgccttgatcttggccttcccagcctccagtgaggaaataaatttctgttgtttaagcaacacagtctatagtattttgttatggcagcccaagttgactaccatgaacaccaatatgttgaccaccatatccctctctctgagacagcattcctctcccttctaggatgaattcagttattcacttaacaaacatgtattgagcatcacctatgcatcaagcattgagctacatgctagagacacatttttcaatgagtttgcagtgtagtggagagaaagagttcatttagcaataagcaattctagcattctgtaatcagtcttatgttagggaagtagaaagtactacaagagtccatagggggaacagccagcttcaacaaggggagatcaacttactgcaataccaaatgtctcagatgggccctgaagaatgaatcagaactaattagctgaaggatgggatggtcaggcaaagggagaggatgtttggtgtgatgacagtaaaaaggtcctgagggctgaaagatgtgggttcctctcccgtactcactcactgtagacctctctcaagggtccatctgtagccctcagattccctcaagaagcaatcccttccttgacagctccactggcttctaagtcttcaataacacccaaatctgcattcctaattataaccattcccttatgctcaaacactctttttaattgactactagctattgcagcagggcatgtgatctatggcttatttaaaatccaagtcttagccaattgtggtgactcgcacctgtaatcccagcactttcagaggctaaggcaagagggtcgcttgagtccaggagctcaagaccagcctgtgcaacatagtgagacccccatttctagaaaaaaaaaatttttaaatagcagggtattgtgtcccatgcctgtgattccagctactcaggaggctgaggcaggaggatttcacgagccagggaggtggaggctgcaaggagccacggtcttgtctctgtactccagcctagacaatagagcaagaccttgtctcaaaaaaaaaacaataaaataaagtaaaacccaagtcttcatgcttccctcggatctcctcttcctcttatatgccccatttttgtggcccatctcagcattgattcagtgatgcagtcatcttcccctcctccctctcccttaccctctacatctatcatcaccaagttctttttcctcaatatctccagaatctatccattcctgttgtttctgttctcggtcagatcctaagcaccaaatctgaagaatgatttttattgatttattattacaaataatgacttaatactttaattaatcaaaagtttcaataatccactaatataaaacaaaatgcaaaatccaagagatgaaagcagacaggcagtagaaaattcacagaatcagaactggggaaaacagacaaatgaaaacaaattttgggctgtgagctttctagcatacagggaaaagaagaaaactagattgcatacacagttctcatcataagatgaaaagaggcatgccaacttatcagaaaaagaaaatttgtttcctggaagggatttttcagagaaatatattgcaggggagttgaataagggacactgaacacataataggaaaaaggtagttttatacaaaagcaaagatctgcatatggatcttttacatataaaatatttttaaatatttaattcacggtgaagccaacctaaggttaaatcatgattccacaaaagtagtctatagaggaatacagcaaaatgcttcttatagatagctttctgataattatgaaaggttaacctgtccctgaggttatctcaataaatgcaaatggctcaaagggccttttaaccaaagctatattcataactgacgtcacaaatgagtactgaaagtactaggaaactgggttaattctcatcttttcctatttcatttcctcagaaagactttcccaaaagaccttagccaacaaagacccccataccccattttcactttaatctatgtattatctatgaccctattagttttctcatagcatttaacacaatcggaaatgacttgcttataaatttgttgaattgatttgttgttccctgtgaatagacagtgagccccctgagggcagagaccatgtctgtcttgtacgctactgtatccaaagccattaggaacatcggtggtatgacaggtgctcatttaaaactttacaacctttcaaatgaataaatacgtagcctgttttaggttctaaatattcagggctgggcgcagtggctcacgcctgtaatcccagcactttgggaggccaaggtgggaagatcacctgaggtcaggagttcaagaccagcctggccaacatggtgaaaccccatctctacaaaaatacaaaaatgtgcccggcatgatggcgggtgcctgtaatcccagctgatactcaggaggctgagacatgagactcacttgaacctgggaggtggaggttgcagtgagccaagatcacgcctggccgacatagcaagattccatctcaaaaaaaaaaaaaaaattatatactgtacccaaaaaatatggagaagacaaagataatattttacatgaaaatttaaaagcctggcttaaaacgacctcctcccttcactccattttcttccttcattccatcctccactttgctgtcagaattgtcttctaaaggaccacctaaatataacagcttgaaagcttgatgatctaccctctggaaactctctaatgtggcatttgaagccctcagcaaccctactctttcagcctagtctcttacaactctcctccacttcgcctacacaggctaaagtctagtcaccctcccctgatggttcatgacccccaactaccaacatgctttccccatccccaatgacttaccttttcttgtgctgtttcctgcctccaggacccccatgcctcacatcctcgtctaacaaaacggtgctcatctttcaagctcatttcttgagtcatgagaaccttctttggattcttgtgaattctgaattgcctcctctgtactccaatagctctttttatgtatctgtgtggcattgtctactatctgtttcatatgaattaggtgcttagttttatgtttctgtttccactgctagattagattagaaactccttgagaacagggattacttcattggtcttcatatttctctaacctttagcatgctcctagacatgtagtaagcacaaaacaaatgttcactgaattagacatacccaaaattagaagtactaaagagatattgatggtgacggctttgggtttcaattgtaaacagttgaagacctaggtacagtacaaccatttattaaattacagatagtatcaatctccacttaccactaactgtgccttattagcaattgtttcatgtagtccttgtttcaggaaacttatttatgttctagtacatatgagtaaatatacattttaaactttttttttttactaacagtggctcatgttacgaggtcctctactatattaaaaacattttaatagactttgtccacagactgaacttttactttttaatgtgatatcacatataataccacatctcattctctacagattctgaaatgattcagggacttttaaatcagcatttgccaataaaaagacaaatttttcaaattctgcatcatatgtaaaactagctctttttcctttcctttttttaacattacagaagacctaaaaccttatatttgatgaaggttctaagtacaaggatcaaactataatcgtgtcatttcttcaatactttcagtactgctccccgaccaggatttagtttgccaaattacgacatcattttcaaagtgctactaatcaacagagagggcaatgaatgaattcacccatatacatctgtcaggctattgagcgataaagcatggtattgagacatatgtgttcttaccatctgcacacattacagcaatgcactgcacacatatatgtctgaacctaatgttacacgtgaaaaagaaaagcattcatgccaaccctcagtacaattcacatcacatcagttctacaattggtggctttatgttactctacatatacctatatgtcccgatttttttttcttgtgaaaaatgattaagacacagaatcagatatactctttaggagattagcttcaatcttatgctaacaaaatcgcagtcaccctcaaatggagttatggcaagcaaatttgctttctcagaactcataatttttactttactcctctgaaaactacagagcggcaaggaagttgaactgaataaaaacaaaatggcaagctatatatattgattaattttacattatatattttggaagggcaaattcattatttatacaggtgctacctgacctccatccagcaagttattcattttaacctattaacaagcacactataaacaacaatgaaagttacatgaccttacacagctgtctcaagccactgtacttccatcattaaggaaactgttagatgaccctgttgtcagaacacactaaatctgtctgaataagggaaaacaaaactttgtctccaaagggtaaaaaataataataataatcctaggcagagttcctgttcacactgtacagttactattattatttatcatttcttatttacctgtgtttttagtataaacattcctggaagcttttatactgcttgtggcacatagtcagttgcttattgccaagggaaagactttttccccagaaaggcaatctgtgcacatgctaatttgaaagacagggtaggagctgcaagtgttttaatagcccattatcaaaaattatcccttggctataaaatccccagaccattggcttgagatcagctcaaagaaaaatgagattacagaatttaatctagtgaaggggagtgagagatgagttctaaaaagccttagatcacaaaaaaaaaaaaaaaaaaaaaaaaaaaaggcagaggacagaaacaacatcagcttagattaaaccttccacacatttacctcctacaaatctgacatgttccaagactgattttaattttaaaaagtaaggtgtctctttgcaacattttaataagtagggaatgctcagtgaaaaattacatattgaggtgacaggaaacaaaacagcattttgtcttaaatttgcacaacctaatttatagcaataaagcagaacctatgagttctggtaaatgtcagggcagtcatgtccattacatatgtggataggtatgaagctgagtctccgtaggcccttcaaaaattgcacacagccgccctaatgcaaaccagaagtctcaggctgctggatgaacactcagattcgctcccatgtggatatttagagagggtctcctccacccccatccccattctcacgtatgcatgttttaagagaccaaccagaggccataaccatggaggtggctcattagaagagacctcccaccccaacaaaatctggcccaaccccctgcaaagaaagcaccagcgtcccatagaacctccccctctccccctaacctctactctcttacttctcctcccccttctcctcctccctccccacacccctccccatgagcatctgcctggcccaatctcgcctgggccagctccaataacaacatctgcttggcagcttttcaagcccacggatagttatctaactgaggcttttgtgctgtactgtttattctatgtgaagaaatgcctccttagttgaaagagtactttagaaaaactgtgcagctattagcaagtgaagcacaaggctaataacccccacctgctcatcaaattaattatgacatctgagtcattataactcagaaagaaaacacgactgcagatttgtcacatgtaggaataaacatgtattaggaccgggaaaaaaatcagaccaagagactcagctggacgaaacacatgcttccacctttcagagactggaaatatggatcctatctttccaagtgaaactgacgaagagggatgaggtggttggccagataaccacactgctgttacatggagcaaaatgagataaagtcagggattagggaacctcatggaaaacactgtaaggttgaataataatttatttagaaaaactaaaactctatacaaagccatttcacagagcaaaacaaaacatactgcccacaatgaacgtgaccctgtgtcatctggtccatcttaaaaacactcataagaactctgggtagagaatttttgtccctaggtacaaaagaatattttaagggtgctaataactttagcaaagaaataccttagaagtaaaaataaaaacttgtcatgaagttattgcatttcctaaccatgagtgcataagactagtatttttaaaaggcaaattccatccagtggccattaaaaaattacatttaatagtcagacatgtaacagtatatctcgtgatcagtaacattttgctaatatttcatactattaaaaggcgcaagtttccattatacgttttgaacaaacttaaaatagctactaacctcttttttcccccacatatttctggaacttgcaactatagcatacatgttaaaatatcttactcccaatttttcaatctggctttttgtcgtaattttaaaatgcaagtaaattttaataaaggtaaaattattttaaatagaacatgacttaataggatgatgacccatgcaatagagccatgacatttttccttgccattattttaaaggaaataaattataacatgatatttgcatgaatcataaaatgctatcatttaaaaacactcctactgaaaatgtttgcagctataaatttaaagcctcttcatcttcctgcaatatctttagtattaaaagaactttttaaattcttttctagcatttgtgctgccagtttcataaaacataaatccttctatgaaagcatatgactcttgctaaataacatcggcctgctccactttatcttctacctccaggaaagtcatccacagtagcaacagctataatcaattctcgcaaaaaaaaaaaaaaaaaaaaaaaaaaattctatctttttataaaagcaaaacccccagaagagttaattttaaaacagaacatgctacatttttaaatcctttgaggtttaatatattatgaaagcaaatctcaggaagcaatacaattagtcttttctctcggtaaacaattttgtgttagagtctaatgctgagttgatttatgtaaatgtgttacttagcctcaacttaagatataaatccagagtaaacataacaatggcaatcccgacagtctgctttgccaaatcagaagatttagtcagcctagactaaaaatgaattaagattatattgagagtgtcagtcctaagtcaagaaaacatgcccagccagggcacgccagggagaaagaagatcactcattaacgagccagcaatgctacaaagcttttgctcgtctgggaaaacatgttcccagttttaaactccacagcaaatcaaggcactctttttaataagtacattttccgtctctttccccctcatcaatcccaaaaagaaactcagcttctctgtgtattatctgtgtaactctacatgtcaaactacaataggccttgtatcctttaaggtaacatgggccagtgtctgaggtggagtggaagactcggggctgtggggagttaatgcctcccttctcaaaataactttcaagttgtctattaacaactagttcccataattacatattaaatttctttaccatgataggttacagttatacatcccaaataaatctgactgtggagtacctgccggcagatttctgtctctgtttccccagacacattgacacacagctcagagacaagctggtcaggcacgctacacagaggtccgtctgtcctcgcctaaaaagtaaataaattattttgtgaaaaatatccttagcaaggatcagtattattgtcagtgtgactttaaaattctaaaggcatgccagaaagagggctacataaaattcagcagtttccagatcatacacagtacagagattctcatacccacttaatctcagcacgcatctccacccctacttccttcccaatggtatgtggtcttgaaaacacaaatgttcacgtttcctgaagctgagctgcaaaggaaaagtctcctcccaagaggcagagctgtaggcttttggtgcccccgaaattgttcactacagtacaacataatgtgacactcaccacaattagccacagggaaacagtctttttttcacctctgatgtcatataatagatttgagatcacatcagtgagcaatgttatctacaagtatttttggaagtcttgttaaaagagccacgatactgcaagcctaacttgaagtgtaaatggtgaatgcttctctatatctcatcttgaccactactttactgaagagtgaaaaatgacagatgcaaattatttttcagaaagtagacatttccactggtagttcttcctcctaagtgatcttttcttctctctcatgctctaccccctttctctctctagcattcttcctccctacacacacacacacacacacacacacacacacacacacacgaagacatccattaatattaagaacagtcttccgtaatgtttttcagaatttctcaggggcttaggagggcggcagccgtgccaaaattacaagctttcctctagtcagaagggatgtcttttcaaagcccagccctcatttttcagtctgatgtaagtaaatttacctctgtgtgctgggctgagcagcttttctttgtcgtttttgtttttctaatagctgctgctctggcagagctattcatttcaaagggaagttagaagcattcttcactcttccccttttagattatttgcagttactgactcttctgaaatcttagatttgaacagaaacctaaagcacagcaccattttaaaacagcaaatcaccagcattcctgggatcacatttctctagagcaactatccaacatgaggcacaagaactaagtcgaactgggctaaaattgacaaaattaaagacaaaagaattatctcttttaaaaattggggcctactgtgctctgacagcatgctaaaggacaaccatcgtttggaaacattgtttcagaaccagagaagaggtggtggagttctgtttgccagttagctaaattaactgatttcttaagaaatccaagtgaactgtatagtaaggtggtcaatttttggaaacattgtttaggcaacagataagagatagtgaggttttgttttgaagttaatttacttcatgagaaagtcaaatcaacagtcatagaccatgaagctgataagatctatgataaaatccagtgggcgaactatcagtaagttcttaatttgcccacgtcccagtgtattcaacgggcttcagttggcaatggctggaccttgctcttgttacttctgaagggagttgttttacgtggacaaggccaggatcatggtctctgagtgctccaaggggttaacctctgtgaattctacttctgtgtcacatatttaaatgagtaacttagagttcaatatctttgtgttcaactaaagtcaacttcttctttatcagccaacattctcttactctaatcgttgaacacacttgaattcatatcagttctgggattttcgtaaccatcaatcataaagtcatagtaagaagaagaataaagcgatatcagtgcagttgaggcaaacagggaagaaaaagtgcacggcgccatggttaggatatcatgccaggctaggaagactctcattaacatctcctgagtcatcccattcacaagcagtatccttgaagaatgatatctgtgtatataagtgaaaaccctatcacacccaggggcttatatccttggcatcttaatttcctagttgtgagtacttatctaaaaggacatgagtataatgctatcctatatggcatactaagaaactgatgtaaaactaagtctgcaggagaaaagagatgctacattcctgtggcaattttcaaatggcactaaaaatagataaatacggcagtaagaactaagtccctcctccctcacttccctatctctatttttcttttacatttgtgtgaattcagtaaccataatctatctaatcctattatgccaaaagactaaaagttgttgatgttcaaaactctaccagtataccaaaaactctgaaactaggaaggaaaaaaaaaaaactttcttacccttaaccaaaaatgaagagtctctcaagcatatatggatagcttgacaaattaccaatttatactgaaatatgagaagatgttcactaagaattacatgactagatactgcaggggttttttgttttgtcttgtcaagcaaaaaaggtctaggtttgccatactccattttttggtatgaggtggtgaatcaagcacaaattttctttggacttaaaacatttaaaatgcagtggaaaaacagttggggaaaagatactgttcttaatccccagatctagactatctgttggggtagttgcttcccaatcctattttctcaattgtaaaatggaaacaatatcttatccaattgaaataaatattaaataagatactttaaacaaaagataaaggtgctttacaatttacaagtatgaggtataacttaaacagctaactggaagacattaacataatctacatagaatgaccttcagagcaatatggtttgcaatttaaggaatgaaaggaagataaattgtaatacaaatgtacctttctcagagaaggctgaaaggtacaacgccaaaggcattatctgcggactcaggcttcagattacctttgccacttcctacatgtgaaatactgggtaacttattgtaaaattctgtgagctctaattttctcatctttagatgagtaataataatatctatcttgtgaaggttcctgcaatatttaaataaaatactacacatagaagtatctgactttaaaaataatattcatgcgagggaaagctgatcacacgaaaggtttcttagggactgtttgccttccatatctgtcttattaatatagcttcatgcagtcacctaaatatcttcaagtattgtaaactgaattcagattatgtgcttttttaaaaagtacatcttttctatatcaagcagaaatcaggccacaaaaaaatacttctgtaaaaagcttaggaaagaataatttttcaattcaggaaatttcttcatggtgctacgaagaacttttcttgtactgaactgctatttgtgatccacctgttaaaaaaagctcaaaacacatttcaaaaacaaatagaatgcttaaactttcttaaaagacagaatgttttacatgttgtattttgaggagattttttttaaataacaagtttttacttactcatctttaaaataaaagagaaagtaactgcccaagaaacagccttatcttttgctttctacaattcagaattttgaaagaaatcctcaaatcctccaaacaagtgtaatacacatggtttgctggcagaatttattccaagcatctccaggcaatatgcatgtgcacccgcgcacacacgtgcacgcacacacagacacacacacacacacacacacacatttttgaatcattaagtcatttggaagaatctccagaagtgtgccgaggcatgtttttggtgttttgccaaattatgtgcttctgtttgtggctttcaaatatggattagacagacgcacaagcatgtactgtttggcaagtagcgacaatggtctagtctgaatttagtaatttaagcttttcattagtcctcgtaggtgaaagaaagaattaacaacaacttgtttgagctctatctttatatccctttgtcatccattcctgttcacttgccatagattagaagccaaaggaatttcagatgtcctctgcagatagacctaaagtaagggcttcaaacagggggttcaaatgtcaagtacatttaagctggaacttgaacttttactcatccttactctaaggctataactctgcttttctgagttccccattgtacttgaacatccagtgtaccctccttttttctcacaaaaagtacagatagaaattacctaaagagataaaaggtcacttgagatttctgtttctcgtgacttgaaattaccatgcacaacagtagacttctacatggcaaagcgctcacaaagatgtttctgtctcctgtgatgatctctgggggaagctatgtccctgccaccctgcctcatgctgtagtcactctaaacttcagagaccagcatcttacgaccatgagttttggtgctaagttcagaaaaattaatcctaaactgtcacaaccatcctgatgaccagtatgtctttctaattagaatcaatgcagtaatcattataattggcagtccctccccagatcacgtggagaacaccatgggaagtgcagttgacttgcagtatttgatattttcttctgttggtaggtaaaagtaatctgatgtccaacagaaaagttcacaggaaccatgaggtaaaaaggaccaaatgttgacagtggtccattgttaattgagtcgtgcgaagctacagaaagattagtttatacagctgctgttatttgtcataacattcctaacaagatacacatgttcaatcagtcttattttgcacctccaaaactgggccatccaatggtctgaaacatgtggaaatcaaaagcaacagtgtacagaaggaagaccatgtatcccctcaggctgcctcaatggctgaggaaagaaaagaggcgagcccctgagtgagcggagcctagaatgtttgggtttggaggttagtgagtaaaacatgaacaatgaatgtgggcgggaagctgggacagaaccctgttagggtcattactaaggtataatgttattgactgttttgtggggaatttagacttttaaccccaccatgattcagaagcagtgactttcttgggacaaactgaaaaacgaactgggggaaaataattccagtcagagcacaaagctaaccatgtcacttgtccactgtattttccagcagtagaacttcacgctacttataaactacaggcatactgaggggaaaaaaatgtgttaactaactttaggaaactttcactcaaacacctaagctgaaagtccacaataggttcaatacaaaaacattatcagtactatctataaaacaggtgttaaaaataaggtgtttcttatcctcaggaatttttcattttagtgaggtagggagaaaaatatatgcatacacacacagagagagagacggacacagagagagtgtgcctacaattcacaaagccctttcacacacgttatcaaaatttatcctcaggagtgattgttaacaatgccatcattatacagacggcaaaaccgaagcacaagtcccagtcactggtaatggaaccaaaaatggaagccccgtcttcccatcatatcccctaccttttctacgataataagaggatattacatctactaatcactatgatgaaaaaagtacatcatgcctggaaactgaatcctgttttcaacactgataactagattctccaagttgtatccccttcccactactttcacacaaacattttacctaagacttgaccacctgagattgagaccttattaaatcctcatcaaaaagggaaattaaggctaacagtgatcagactgctccatagagaaggcaggtcaaaaggtacgacttcaaagaaagaccctcaaggcaacagagatcgatataatttacttcagacaataaaacataaatctaatttgaaggatgttgctcatctacaactcaaagcacctaagatattttccaggatggatatttatgggccacaacatgtactgctgctagtctgtatttgctccttctgcacactcctttcacactcttcatctctggttccttatcttattatgaactggttgaagaggccatctcagacctcaatagaaggtacacttaccataaagctcccaaatgtaaacaatggtcctgtaataatgatgtgaactcagaaggtaagaatgatgtttagattccttttgcatatttctcatctaaaacaattttccttccctcacatctttcgtgctttgattaaagcaccaaaacacaatgacaacacaaccagcgggattgctctgatagcagctgaagtgcccattccaatcgtattaacttgatccaagatggtacttcaaaatgacacactttggaaatgacaggtagaatccaggattttatttcccaggaagaggaattaatctgagtcctgtatatctagtttagtacaaagtctgctaaggaggttagtcctatcctggatcagcctcactaagccagcttaggggctgatctaaaataatagtttaacaaaatgcctgtgtccaaaggctgattccaccacttgctagttgtgtgaccctgggcataatttttctgttctttcgttccctcacatgtacaaaggagatactaatagatcttgcctcatggggctgatgtaaggaatagatgaaaatacgcacacacacacacattcaagtgtttaaaagagtatctacattcaccacccccttcaagcctttacttaaatgttgccttaccaaggaggacctatcctaatcattttttaaatacctcaatcttctctaaccctacactcacactttacttattttaaaactagattagaggcagtattttctatcagattagtgctcctgtggtcagtattcaatttataacacaccttaaaagaataaggcaattcattgactagtcttctcctgtaacaagtagctcccagggaattccacttccacaggagacaacgttaggcaaggggggactcaggatgacagctcagtgtgggtgcataggaggtgtctgtggttccttggaggatgcacctattttgtaaataatgaaatttactattttacgagtagtaaaatagggaaaagaatcctcaggtatagaaggtggccagggagactacagaccgaactgataactggtttccttggaggaagactaggattcttttatatgttatatagttgtgatcatttaaaaaataagactttcttataattttctggagattcattaaactacaatacttcatatgcaaaggcaattatggcaatacataagttacatagctctttgtgccacaatatgtacggtgagccaaaatgggatattatatttttctagaaaaatcatttttaccctctcaaatggttgtgagagcagcaaaaataaaaacctaaaatctgtattgtggttgctaacttgaaccatgccaatgaacattcaaaagattaatcaaaggcttgacagttgttaacagttcaacatggttcccataattatccaattaaacatataatgcaaataatagaagtcttatgggttccatagagcatgaatatcaggctgcttcagaaaactattaactgtaatgtactgtctgctgagtctgaagaaagtgaaaggagaactagtacatttataaaggaaggcaaggagtagaaaaatagagtggagagacacgtaactcaagcactctttatgtggtcatataaacacaacagacagtggtaaaatccagaaaacaaaatttaagtaacaattattgtaaaaccaaaagaatgtagagaaatgactttaccctataattcctactggctgcactatatccacagcatacttcaaccacacttttctagcttgctgctaagttagaaacatggatgtaattacagttgttggcttttgactctgtctataaaccatgcagagataaactgctattagtgaacataccaactccatatagttgtgttttgacattataggtaaaaacaatgagaaggaaaactaaccacagcaattataaacagcatgctccagggcatgtcaggtcacttatgaccttgactaaatgattataatccttaggttgtgttctcacacgttcacatgcacacacacacacgtgcacaccccacacgtgttttttttagggaaattaattcagtgaacataagaatgactaaatcccatatttataaatgcccagaggaacaaaaaatggatgctgcataggtcaaatatctgtactttaaaaaatcttattatatttcaaaaaaccaatgtaaactttaaaggaaaaactttgtggtaagtgttcattctaaaaatattctattccacagctctgtctactcagggggcaagaagaattgcagaaatttgattcagtacaaaaacttctgctactatataaattggatttaagttacattatttggagggcaatttttaaatatttaaaccattcccttacactgataacattttttcagtaaccattcaactatttacctcattttatttgctacagacagaaatgctgcattcatttctttttgtaaaagtcagtcttctcctcccctactaaagtggtaacaagcaatatcaagagggcaataaatatcccataaatattattaaagcatgatgttctcagataaaaaatcgtattgtgtttaatgacttttcttctaatatacaaaattatttgtacaatcagtaacagtagagatgtgaaaattaaaataatgttatattacacatggtggaccactttgcaaaagtccaaattacaagtgatgtgactttctaatgtgattactcacagaaatggcagttgataaacatagtctttagagtgtgctaaggtcattaaaacagtctcatctatttgcgtatttcttcaaagtgtacttttttaatgtgcctttcttatttggtcttcttaacaatctgatcaggaaggcaagagtagttgtcctttttacagatcaggaaacaggttcctgaaggagggcgactttcccaaagctaccagactaatgagtttctgaattaggccgcacagccaggtgagctcctcatgcagggcttcagacctgaacacctgggttcaaatacttgttcctccttttaaccactgttgtatgaacttcggtcatgactggctctctctttgtctgagaactttactttccatgattataatagcttccacataagttagttgtgagaattaaataaaacatgctatgtgatgcccttaacacagtcccaggcacatagtaagtgcttaataaatattagatgttgcggctgttgttactgttactatcatcttagaactactctggctaagtttggcaaggttaaaggattaaataaataaccacataaatatcaaatccagagattaacatttagcaaacattttagtgcacatttttaaagagattaacatttagcacacattttaaaagaaaacgaactgacataactgggtatcactgtgactccggactaggggctcttggggaatgactcgcatcagccattcttaaaggttttctagcaaaacgcttgtgtatttgtatcattgcaccactcactggacacaggttgaaggaatttagattgagaaaaactatgcaaatcaaaactgtggtaaaatgcaagcatactagtgtctgtatccactttatcttggggatcaaagttcctctgttttaactgccacattccatcctggacctaatagtttctgtgtaactaactggcaagtctagcatcttgactgaaagttcacagttaagggctctgacataatgtccttgaggacaatggactcctctttcagggcaagagcagtcctgatcatgctcagggctgcatgaactcaagttgatttggcctgagccatcactgctctttttaaaggaaatgaaatcagaagagaaaaatatccatattcacgttagggagcaaatatataaagtcagtatgtttaaatgttgtgcgttggcatccaggaacactcaagaaagctctgttgcttgtagctcactgagggacagaggaacagtgtctgtaggacaaacagatgcacatctaagcaagtagaaagaagaaacatttacagtagacaggaaaagacaaaccatacaattatttctttgtctaggtaggtaggtaggactacactgagatctcatgagagttctctaactctgcttcatacacacattattataaaatgtagcttataacccttggagatgcagagaagacccttttttaaaaaatagttttactggagaagtagtgggagtgaagctgggaatatgagctgggaaggggcagtcatgggttgaattctgactctgcctcttactagctttcggattggagagttattcaagatatttaacctcaatttctttatctattatttgatgagaatacctagttccctgggtaactgtaatcattataataaataattaatggggggaatgggacattttgttgtttttactattactaatattgctaccaattaatactaacataattataaaacagtaataataaggaggattgctgtctttcagaagagaaagggaagtcatttctggatctttccatacatcttctttctcactaagattcatagccttatctaagaagaaaatcaatctttgaaaccaaaaaaatgaatgtaatgtataggaataaggggtggcggaatttttgtcctgcaaacttatgatgatttacaaacctcataaactcttatctaaataatccacaaagtgagcactcaaaattcaaaagtttttgaattaaaaatggactctgtttagaaagatgcaaccaaaaaacttatggaaactaaaatatacgttctttgttcatctatttccttcagaaaactttcataacagaaagagcccagagtccatttactcaagtgtacatagatattttatttgaaaaatatcccaacttttcaaatcaataagaaaaacagaagaaaaatttattctaagacttctaaggaaaaccattaatctagcatagggtgagtgggatagggaagatctttatcataagtcaacaatgaagaccatgatacctattcttgaacagttggattcctaagtatggctcttgacttgcttaatcctctctttaaggacattttatttgccctatgtagcctttgtggactgcacaataaacacatccaatttcaaggtctcctacataagcagcatagagcaagagaaaacaaaaaatgagaaagactgcttagtttaaaagatttgcttggaaatcactaagattttgtatatcaaaattaataaaactgaaagcagtaactcataaattaaagataaaacaaatgattctttccaattttcttttcttgagacagagtcttgcactgacacccaggctggagcacaagggtgcaatctcagctcactgcaacctccacctcccaggttcaagcgattctcctgcctcagcctcctgagtagctgggattataggtgcacaccaccacacctggctaatttttgtatttttagtagagacagggtttcaccatgtcggccaggctggtcccgaactcctgacctcaggtaatcccccacctcggcctcccaaagtgctgggattacaggcgtgagccatcgcgcccagtcctatttcaattctttttagtgtgtcaataagtgaaatgagttttttttaatatgtagaggttatttcagactatataatattttcttttgtctcttttaccctactggggccagaggaagttcattatctagaattacagttaagaaagaagtccagcgataactgcatggatcaaaattctgactctgtcacttaactagcttgccctcagagttctcatttgtgaaagggcagtaaagtatctacctcatatggttaccagggaataaaggagtcaaacaggtgactttgcaaacaatacctggcgcatagtaaatgctcactaaatgttagctaaatggcaatggtcacatgtggaaaagcaccacagctagaaaatcctacccaccttaagtgggtatcacttaagcatcaggtcactatgtaaagccttaacttgtaagattggtattatctccattttacacaagaagaaatggagcctctgggacttcaaaacacttgctgaaagttatacagttaaaaaatggcaaaaacaagattttagatagtactcctgatttccaactttttgactatttccagggctccttctagcaagttccaacgccatgcacacctagtcaccgccccttgatgatgggacaccaccagactgacatgttcactgcaaaacctgcaacaagtctgctgacatctgaggaattggagaaattattgggtgtaccccaatgccacattctattattctttaatttgttccattaagtgcaatcatcttcaggaagcctaacacatactcactattcctccaagtttcattacagttcttgcttactcacttttgaatgggagggtgctagggccactcagaacccaatgcaattgctccagttaggagcagcgcagagtccagaaatacatcctgacacatttccaacctcctgcaaaaaaagctacatgctacaagatgtcataacaagcatgcttgtatgcttgttatgtataactaccatgtacacactacaaaaatattttttgtcatacagagaaaattatacttgttcatcacaataatccattctcatgatctcactattttctcagaagttgtcacaagttttcatgtcatttctttcagatgatgtttgtataatcactaccattactctttttataacttattaagcacttaatgggaacacttaagaaaaaagaacaacaaaaattgggtaattcttcttaaactgtctctcactactataaaatctgtaaaatgtctgtcttctctatattgcaattttaggacctggcagagtgcctgatacatagtaggtgctcagtgaatagttgttgaatgaataagccgcttcactgcagacagaatggcttttaaatgccatcataaaggggcaaactgagaaagatttctttttaaatgtcagtgttcataatctccctacatgtgcacaacataatcaacactgaactaaagaatcaacaaaacccactgtatatcaccttataagagaacaaggggaagagaagtatgaaaataagaaaacctgatcactgtcatctaagaactttcattcactttttatttgcctgaggagatggggaagtacagaggaactgagaatttcacaaactaggttcaaatctatctttgggtatatgatttgtaaccttaaaagattgaaagctactttaaaagagctattataggccgggcgcggtggctcacacctgtaatcccagcactctgggaggccgaggcgggcggatcacgaggtcaggagatcgagaccatcctggctaacacggtgaaaccccgtctctactaaaaatacaaaaaattagctgggcgtggtggcgggcacctgtagtcccagctactagggaggctgaggcaggagaatggtgtgaacccgggaggcggcttgcagtgagctgagatcacgccactgcactccagcctgggtgacagaccgagactccgtcaaaaaaaaaaaattgagacggagttctgctctcgttgctcaggccgcagcgcaatggcgcgatctcggctcactgcaacctctgcctcccgggttcaaacgatcttctgcctcagcttcccgagtagctgggattacaggtgcgcaccaccaggcccggctaattttttgtattttttagtagagacggggtttcaccatggccaggctggtcttgaactactgacctcgtgatccgcctgcctcagcctcccacagtgctgggattacaggcatgagccactgcgcccggcccacagttttcattttacacttttttctgcaattacctatgaggaaacacctatattctggaagaggcatcatttacagagaacaaaatatttaaagctgggtgttattttattgttgggtgtgtcactagatcagcccattgcttttagcagcaaaaaagtataaatttgcatcaggtcagatattttagtctgacaataaaacatacctcatcaaacaaaaaccattttttcttctgctgagttcaacagccacgcttgatttttaaaataataatgatagtcatgtaaactggatgcaaaactcaactcagctaacttaagaatatttttaaatacagtatatttgcagaatattttgctttctagattttttaattgcctatagaattatcttctcaattccaaaatatcttaaaacaaattattgacacatgacaaatatatattgacaattttgattcaagattatataacataaacaattgaaataccagaattagttttaaaagatactttacgaaacattttaagacaatgtgtataggacatacactgaaatctaagagctaaactatatttaagaataatttagatatcagagttcaatgttacgattcaataataaaaaagagattaatcaatcaaagccatttagtattaaatattttggcatctgtgttaaaattcctattagattcttttattaacttttttttaacagaacaccaaatttgtcaccaaaacaaacattcccaaaacagtatatatcaatgccaaatgcagttaatttatgtgaaaagtagactcttggttatctgtttcattttgttttggttttgttacataacccctgagaaaactctgcttaacactcacctcctctccgtgacctttccattgcagtcacacagggttccctcccagaaagctccgcaaatctaactatatatagtagttggtgagagggttagttagttgtatacttgtcccactatctttggtatttttgtttttcataaacactgcaagtgaccatgaccctctcatttctacttgtaaattactcggacaaggccatcagtatttcaccgttttttcctagctccttaaaatattgaaaacagtgctcagtacagtgcttccactccataaatgcatttctcattttttcacctttagttcaaatgttctatattttccttgaaggatatattttcataaatccacaaatgcctacttctttgactatatgatgatacatacggaatcatattaaacacataccaaaataaaaggatttaatataccacatatatattatatcttgtccttttttattagtcattagattttccaaagcgtgtgtgtgtgtgtgtgtgtgtgtatgtgtgtgtgtatatgtatatatatatatatatacatatatatatatttggtatgccaaatatataatatttaccaaaatatataatatataccaaatatataatttggtataccaaatacacatatatatatgcatacacatacacacacacacatatacatgtacatacattaatatatataatcaacactgaactaaagaatcaacaagcccactgtatattgccttatagagaacaaggggaaaagaagtatgaaaataacacctgatcactgtcatctaagaacttatgttcactttttatttggctgaggggatggggcagtatagacgaactaagaatttcacaaactaggttcaatatatatttggtataccaatatttggtagttggtgagaaggttatattttcctatatatttggtataccatatagatatagatagatagatatacacacacacacatataaatacacatatatatgcacatacatatacatacatacatacacacacatataaatacatatgcacactttgaaaaaatctaaagactaataaaaaatgacaagataaggattattatccagggacttaattatattaccagtgaaatgattttttaaatgatgtgtcatttttaatgaataagagaaaacagtcaaaattattcttcagagaataatcttactcataatattgagatatttcttccaaccttatttgtgggactaaaagtcagtgctattggaaacataaaggaaaaaaataaacacatcaccattccagaccatgaaaatgtttgggattttaaagtcttagttccttgcataaataaataccatcaccttgaacactccccgctaggcaacagttacgagtatgttcacttttatctcccattatgtttgtgcctgggattgtcttatacccaaatgaaagacctcatgaaaaatggatagtagtaaagtatactggattgtaccaggaaatttatacaagaatctatcatgtctttgtactctagggaaggttatttccttaagtaactcacaaatattgaaacaggcattgtgattagctgtggctctataccattcacattaggagtggattttgagacattacatagcaattacagtatttaaatttttgccatatacctaggaaactggaaaatttgccaaatttaatatttttctccgcactttaggcatagcattgcccttaacttaaagctctgcccacaaaagggagaccaagtcttctggaaagctcagagaaagtattgcacgtctacaatacggcaggtgcggcggtaagcacttcacaagtattttctcagtttaccctcacaattgccaaataaagtgcatgcctactccagagctcaggaaactgaatcttagaaaataaaactaatttacccaactacatagtgaatagtataaaacaaacattaaaactcacagcaagattccagaatacgtgctattgctaatacagaccctgtaattcacatggttttattttactcattcttaacattaaaaatatacacataaagtggaaatgtatttctaaaacagtgaccaatcactagtgcatatacaaaagaaagaaaacaagcctcagtaaaaaggagattttcctagtttgaggaactttcttgtgttacctcagtaacagtaatctgatttgcccctaatgttctatattcagtataaataacttgcatgcattcatccattcattcaacaaatacatattatctattttatagtatgctctcataacatttctattgattgtggtttcctgtacttgcattgtacccatcttttgttcacctatttttccatcaacaattgtgcctgaaaaacatgctttcaaactttcaccatatactgtcaaactagaaattagctactagaagtagctgatattaaactttttctaatactctaatatctctgtttcaatgtgttaatctttgccttattccagagtctcttgatatacataagcacacacagggcatttctaaaacataaattatagacaactctttcattttataaaagaattcttggccaggcaaggtggctcacgcctgtaatcccagcacttttgggaggctgaggtgggtggatcactcgaggtcaggtgttcacaaccagcctggccaacacgatgaaatccagtctctactaaaaatacaaaaattagccaggtgtggtggtatgcacctgtaatcccagctacttgggaggctgattcaggagaattgtttgaacctgggaggtggaggttgcagtgagccaagatcacgccactgcactccagtctgggcgacagagactctgtaaaagaatttctaccttaacaaaaagattcattgaaagttgctttttgaaattaaattccccttgtaaatttcatatgttttatttactaaatattaaactaataaaaaaattctcagaaacatctcttaaataaaagagatatggatgtttgttttaaacttaaaaaaaaattctttaactgagatgatacatgccacacaaaggaaaagggagatgtagtaattatcaagctaatcggaaaattacaaacacccaaaagcagaacttctaacagctcctcataactagctctgaccttttctttaaaaatctgactttcagttaaaaaaaaaaaaagttttcttataacaaatctcaatcatcttttcttatgttattggaaaattggccatatatttttaatgggtcctttctgtttttcaaccagcatcaaattttggtattagttgagtgcaatttagtgtatcttccatccacacacaaaaaaagagaaagaccatggctgcagattgatttcgttagaatacttcctatgaaaatgtataaaagaaaaaacctagtctcttgaattaatttatcttaattacaaatgataatacaagatgtttaatcattatttttcttctattttcctttaaaaattgctgccatgttttcacgaaataataacctttcattattttttgataatttacgtttatttttcctcctacagcagtaaaagtaacgcatccaaagaagcactgggcctctcttagactcagtatcccaaactgtaaagtgagaagatctgtagggattttcccggctctaaaattctacaagttaaagacctctttcttaaaaagtaagcttttatctacattgaaccaaatgagttaactattggactttgaaatgagcaacatgaaagtgttactcaagagtcaggttacacattttctatttctctttaataaataaaatgtattaaaaccctaaatttaacaagcatgtgctaaactttattaagtattgcttactatgaagaggactgctctctgccaagataaccagaaaccaaattcctaggatgctagagctaacagggatagtggatgtcctctaggccaattctcttccctgacagatacagaaactgagttactgagagggacaaagtttcccaagcacctgcaaacagtaggaccagcaatgtttttctcttccacttcagcaagctgcttcaatcactatatggcgtagagtgaatctctacatcagtaaacaaaggaatggaagaaggtaattccattatcaggtcactaaataatttagagtctaatttttctttttttaatgtaaagaccttatgttcagaaacttacatttcaaagtacattaagtaaaattatgtccatacgcagatatgtcttctcctatatgcatcttaataaacaaaaaaaattatcgtcatcccctacaaaacaaaaactgaaattaaaagaaagaatagagtaaatctaaattgtatattttcattccttctaaaaggattaaataacagaattctaaatggtttgtttgtactttccatgcaatatgtagattaaccatgaaattctgtttgggacactttgacatctgttttcagtgcgttacaatgaaatctggggacttgatacatacatttgctgtaataaaactgtcactaatcagtgttttccaaaatattgcccataactattactattcagtagtctcatttgcatgatctaatattgttgctacatcatgtttttccctgacaatgtgttagctagtcccaggcacatggtcgaaaatggctgcaaaccactcaataatcccagcatttccatagtactctgtatatatgcacgcaatctgtcctagaattgaaccaacacttcatccttcatgaaatattttctctgtaactggaacacccaaggttgaattcacatccctgagtatgaaaaactcaacaataataaagaagcccatggtgaggaggaaattacgcctcatgggccttccacaacaggagacgcaaacataatccttactcagaagtcccttcaacaaagctgtaatgatgatgctttctgaacataagtgcggagtctatcattaacttagaccatttctatgaactaaagaataagactggactagactttaaaacggagtctacttccctttctctaggattagtagacagccttatcaatgccagataccaagagccacaagttcacaagatattaacacaaactcctggatattagattgaaaaactgtttccgtttcatattgcatatatctggtatgtcatgtacaaaatatggatctcaggggaaaagtaagtctgacagcccaaacatggtattcaccaaaaaacaaaaccttactaaaaacagtctgtctacctatgttgattctaaatgaattccgtattttatcagtacttggcattatattcatattgctcaacagtccaaaataatttcatcttgtcctcccatgaactcatcttaaacccaaaatatgtttctccatgcacatgttttatattatacgaatgttggacacgaaaagcagattaattgtaggccctaatgctgtgtttgttagtactaagaagtcattccaaatgttccaaaagggattaatgtagtataacaagtctatttaattactgtaagaccagtgatcctcatattactataagcagcttttcccttatttggagactgtaaatagaacagaaattgttacatgataactataagtcatatcctaaaatgttgatgctttaccatcaggaataaagaaatatgcaagcatctctgagaggctatgaaaggcaactagaatttaacaaccatgtatacgctcccactttaagtgaacatcaactttaaatcataagtgtaagcaaagcttttcaaatacattagaaagacatcatatcaaatctttctgccatcaacagcaatcccagtttacatatgtttaaaaactgtggctgcactttgtttcatgtatatgattttcgagttttgtgtatcccatgaacagaactgctactaaacaccagtgtgttatcaaaaagaaaaggaatgccacagattattaaaaattatgtgccagaatccaaacaagctaatcaatgtactgatcctgctttccgtacaccctagttaccctttaactaatggacaaacagtgaaataacttttcctattaactcctggctagaacccctaggtacgtgatacacttattataaagtgctccatataagaatatgatgcctttttaccctacgtcaatgtgacacgtgatttaaattttcctagtagggattgtggatatgagctaatctctccactttccaaacctcctgtgcaaagtgaggggtgcagttcagtggccgtagggaaacaagcaccgaaactagttcctccaaggacctccatggacacaaccaaccagagctactgaagtcaaacacggtgatcccaaatcacagtttcgtaagaagtaaatgttgtaaccattctccacttggcttccagttgttcttagcaaaagtgaagtcaatttcagtaataaatgttaacttatttcctacggagctcatttaattatttaattttcttaacacgatagaaaaggaggaatgggaaagagtgacttaaaggagaaaaattaaatggcaataaaatcaaaacaattcatgcaactgattaaacggtttgaggttttgactcaactaagggtcatttttaaatatgatactttcggactttaaaaagagtctgaaaaccagcagcatgcttttttaaggacaatccagttggccgggcgcggtggctcatgcctgtaatcccagcactttgggaggcccaaggcgggcagatcacgaggtcaggagatggagatcatcctggctaacactgtgaaaccccgtctctactaaacatacaaaaaaaaaactcagccgggcgtggggaagggcgcctgtagtcccagctactcggcaagctgaggcaggagaatggcgtgaacccgggaggcggagcttacagtgagccgagattgcgccactgcactccagcctgggctacccagccagactccttctcaaaaaacaaacaaacaaacaaacaaacaaacaaagcactatcccatctagccacatcatcatcacttctgccgaaacaaatctaaaacgtaagtgtagttctcccaaatggtggcaatttaatttttttgtacatgacagttttacacttttattggagtgcagtgaattacgagtacttgataggacaccctttacccacaccaaaattgagttatttattcagagagccactaataaaattatttgattccttcccttcaaatatacctagattgatcaataaatttagtctctggtaaatctgagacaaaaaggcttctaaaaccatacaatcattctaatttaaatgggttttaaaactacacacaactagctaacttcatgtgcctacacaaagagttttcactaacaaatattcacgcgcactacagtgagcaggacttcgatttcctctttggtatgtcttgttacctgagataaatatgaactaaatgatgaccctctgcttcatatccagtcattcctttttttcactactggatagtctccctggcagtctacattatgctattttccttcatatatagtagtaattgctattattaacattattgcttttacttacatgaattatttcatttaatcctaaagcaacacagtgaagtaggcattttaatcctcgatttacagaacagaaaagcaaagcacatggagctgaagtgacttgaccaaggtcacaaagcagataaatggcagagccaagactagaaccccaaatgtcaaattctatgcacatgatttttgttacaaaatgaatgtttgggtcttccccaaattcctacgttgaaatcctaacccccaatctgatggtattaggaggtggggcctttgggagataattaggtcatgagattggagctttcataaacaggattagtgcccttataaaagagatcccagagagctctcactcttttgctgcatgtacggaaacaaggagaagttggcactctgccacccggaagagagccctcgctggaacttgactatgctggcactctgctcctgggcttccagcctccagaactgggagaaataagctttagtgtctgtaagtcacacagtttatgttattttgttatagtagcctgaactaagacattttctgtgctctacaaaaatggaaaaggcagaagggggatatgctgaacgtcttaagcaattcaaaattcaaaggatgacagaatactttaatttgcacattatttactcttcagtctaagaataagccatctttcttaagtaattcctgcaagatctaagccccgcctttctctttttcttctaacttcacttcttcaactccctacaacacgtgtgtgcatgcgcacaccccctgctccctgcccacacacacacccaagttggataacacacaagttggactagaaactttaactcaacaggtgagatcaccttaaaattctttcgatgtaggaactgaggtagacgtctggagaaaactaaagagatttttaaatcctctgggctggctgctgttctcatatcacagtctcactgtcatctgaccccttagcccaccaaccacatctaaagccaactccacattggcgctgcccctgaggatgctaatgaaccggcagaaaggcaaaagagatattttctattctagactagtttttacaggagaagagagaaaaactgaggccatggactaaaatgagattcagagcacttcattcaaccttcctcctttgacccctatgattctggattatcaacatgattcattctgaaaagcatttaaattccttgatcttgtgaacattcctgggggaaaaacagtttaaaacacaacagtaacaaacaaacaaacaaaccagaaagaaaagaaagcctctcacctgctattttcagatattttctagatgggaatgcagaaatctactgcttttttcccaggttctagcgcctgtagcacattgtctctcatctgtcagtgtatctacacacatgtataaacagtacgcaacacgcaagtaaggaaatgtacattttaacttaaacttccttttttcctctaataatttaaaaataaaatgtaacagcttggattttaaatatttaatctggcaaatataggaaaatcatgaactataatgtcatatttggcaaagaagagtttggtaggataaaaatatctgtgttttaacattttagaaggcttttccagtattttaaaaataaaattatttcactgcttcagaagagaagaacggaggtaaaattcgctatttttgcacatgaggttttcatgaagagtagaaaaaaaacaatttttatattcattaaaataaatagttatttttacatgctggcaaaagtccccacagaaataaaatcttcatatttactaatggttctctactatgtcatgaaatttagctatttaagtcacaaaagataggattcccttaaaactataacataagatggtatatataaagttacaacattaactcatttgtaaagaaaaaaatgttggttttaccctacatgtttagtatacagattttttcagtactagtcaaagatttatagtgttaagttcaaaagtcagttgttttcacatcggtaaccaacagcataactaaatttcccacttttacctcatattatgacaataaaatatttttatcgtagcagctgaaaatgctgaaaagtaattattaaagaaaccataaatataaaaagctgaaaagtcaacctcagacgagtgtggaaaaggaaattgtgatatgtaccatcataaaacagagaaactgaaaatctaagcagaaaagatctaaatccctccaaatgccagaatactatgccccacctcttgtagcaaggagggctgcaaatttgtccccatcactgtcagcaaacaaaagaaagtcacttctacagccagaccatgtcaaacagaagacgtagctactgcagacggacgccttgaatccactggtgtgtaaagggcgggcttgggcctttttgtcagctattaccattaaagaataagaggaaacagtgacattattacacaatagaaaggtcaaacagcttgcagccattccatgacccaaacaagtcaaggtcaagggattcaggtagcaacttagccagggcgtaagttacagcgcaaatgaattgttttaacacatcagctttggtcaattaaacctaacaaggcaagttgcatcaggtagcagggttcctgacaccaaggccagaagctgagaccgacctcataaaacaaggcttttaacatagcatagcaaatttaaggtaatccaaccagaaactgcagatgtcagaataataaaatacaagttgtcctacgaaggaacattttttacacttcagaattcactaatagaggggtatagacttcatattgacgtgtcattagcataggcataaatgtaatccaccactcacatgaattacagaatataccctacttcaaataactttttcctaatatctgtgctcatgattagattttttgtcccaagctctaccattccgttagcaccaatacatttatccatgtatttttttcaaaatgagtatgaaaaatcaggtttttaaaaaaacagttcatcttcattcagcatgagactatatatgtgtcgcttaatattaatggatgcttgttaaatgcttttatgtagttttatgagagatgtgtacttcaaaattcaatgaatactattaagttgactattttgagaaatagactattttgaatggagttgaagctaactaaaattttaaaactgcatgtatttaacatgaaataattcttttcttaaaggtaattcttattttatttcgcacttgtttaaacaaattccattttcaactggtttatgcttcatcaataacttactacatgttctgaactgccttaaaataggattctgaaaatacacaacctccaggcaacttttgatagtaaaattacttcatccatcaccccatatttttaattatatagtccttgttcagagatctttaatttgtcagtgattcatcagtgctgtcctgtttaagctatcatcataaacagaatatgtgtatctaagtgttttactataaacaatatagttatgcatgtaatcatctgctttcccattttagaacaattaaattttgaaggttttttaaaaatgtgtggctttcaattcagcctcaaggactttccacctcacttgttagccatttcttccaattttctgaataatataacaaccaaaaagcccaaccattcaagtcctattagtctcactctaacgttcaatctaatacaagctaatcccacagactcactccttactacaacgcacttagttttcacaagttctctgcagtttgatgatttattctctatgccaaattctaacaactaaattcagttaaattaaccgcatcacaaaactggagttcaaggtcccaagaatttactttaaaatgagacaacataccacgttgccacagaaaagtgagcatgatcagaaggaagcgtctcttcttgctatgcttggcactggggcatgcagccgtaataactcaagtttccgatcgcataaccactagtccttgagatttctaaaattattcctccttcacaaggatggagggaaaaaggctggaaaatttgctttgaacattatgttggctaatcatttgctccgccatagcacatacataggaaaaccccttaagtgccgcaagttctactttcatcaacttcaaactggaaaatgctattctttcataaaccaaagagaaacatttacccagaagctagtttcagagccagggatcgcctttgcccataattttcaggtatttaataattgaccattttaatgagtgtttcatgtgctctttgcactctttgcaaacttggagcttcaaacaaagcaataactacttctttgattataagtccattatcatgtaagccaccatgataacagaaatgaaaactaacttatctcaatttttaagaaatcctgtgaattctgacataaccttccgttgggtccctctctcttcaggtgctgaaattctaactggccagcagtgatggcaagagcgctagtgtcagaaagcaaacggttttatatagcctaccagtctagtttttcagtttaatctggctgagtgagagcttatgaggagaaagaccttgctatattgggtatcttggattgctgtttcaaattttaagtgccaaattcaaaagcaaaaagttaatggaggattacaactttaacttccttatgacagcttcttcctaaattccaaatttagggaaaaacaagtaagtaaatgaaaaatcctaccaaatctattacgaatcttcatgtttggaagtgcttcttaggtaccaccttagaaaacagtaactttaaagaactaaagctgtagcaatagatggcctctctcaatggctcctacccagctttaagtctccaggcacaggcactataactgtgcctatcaggaaggcattcttcaggagacctgaccgtcactcctgtcactgcaatgcacagtcctctccaattaccacgattctcgaacaatgcatattattttggttcttacaaatatggagatatttggaattattttaccacacaagagacattgtgcactaaatctgtaaatccaaatacataatctaactatttttcattacaaaatttgtagtgctgtatatacagggtggggggaaggatgcctaatgctgtcagtagaatattttaccaacctttgctgcctccagaaagtggggcactatatatttttaaatatttgaaaatcataattgatgtaacaaataagcgtcccatccctccctccctctctccttctctccccccacccttccctttgaaaaatgagatcatattaactgcaatgcaagagcttagtttgccatatcggaacacagatgccaagcttccccagctggcaactggggcctcagagtttaactcttaaattgtctgttaaagctatcttgtggcagagacctcatggcatagagggtgaacttctggtgggagactgtgttttcttatcagtgagaaaattgctaagtatcttatctcacaatatatgttcccacaaaggtctcattaagcctaggagcaagacatgccaataagagcccttctttatcttgtgaattgtgtatgagccagaatgcaaacaaatgtgcactagagttcacaagttcagtcaaggacaagttgctagatgggaaaacttaacagtgctcccctaaatcaaacatgcataccaagtatttctcctacacacaaactcttatgttcccagagcatttcacagtgcagacacaccaaatcatcctagagagcagcctcattttaatcaattatgaaagcttattttttcccataatgggaaatacctgcagatgaagtgaaatctattaaaatgttaaaatacactgccaacttgcaaacaattatctacttaagcttttcataaagaaataattgttacccaaaaggattctgaaattcagtaactgtaggaagaaaataattcttagcatttgcttcctcactaatgatatgtgacaaccaggaaggcttctatttcaaaaacagtaataatgattatgacttcccctgtaaataagtcacatttttcacaacttcaaaatgtacttcaattattataacatttaacaataaagcaacaaaagtggccacccaacaagagatcataattttaagggttcaacaaggctaaaggaaactactttttcaggatagcaatgaggtttctgggctctctttaacactccaaaacatgtttaataagagtgcaaagtacagtccaaaaatcagttagggtgactcattttaaactctaatctgttacatacacgacaacagttgctatctcttgagatctttaaatgtcttggtgtgttgtgacctctctcttcaaaacgctttcctgcctcagagaaaggccaatcccactcccgccccccgactcccaccaccaccaccacccccttccttttttccccttcagacaggacacagtctggcaactcaaggcctcccataggccagacttccttctgtgcagccctttgggtagaactgctaatccttcttattaattaacgagataacggtggttaactgaaaagcaatattaacgctaactatctaggaaactttaaccaaaattattttaggcttttggttgattttcccagtgtacaaaattgtgcactgagaatttcgtaacagtgtggtgcagaatcgagaaattccagaatgactgattttacctcagaccttaacgcataggtctcctctttaaagttttctctctctctttttaaacatgtattctgttacacatttctaactagagaggaaaactgaagtcctctcaaaatgttactataaaatttgcaagagtggcaagtgagggaactagaaattgcatagcaaataagcagtgatgtgactgagagcaacagtcagtcataatgaatgcatcacatatcattacgttaggtttgtcctccacacacttgtcatagcacaccctgcatcctataggacacttacatcccaggaagctgtgctgtgcaaggcttgcctggtttttgtttggttttgtttttgctttgctttcatgaatgcagtaacaaaggcaatatggggaataggtaacacctgcccaagaatcattggacgtctttaatatctttgggaaaatagataccatttagagctattttttctttaatctgtcccagtttttttagacaaaacctaaaaaaaggaagagttttatattagctaagatttgctgcagcaaacaagcaagcagctttcattcagggattgtcaaaaactttccagtgtgcccactgcaatgcggatgccaaccaacgaatcaaaggcattcagcaactagacaaagagggtctgatgccaacctcggtgccactggcaaccattattggcatcaaacacagtgtctgccttttttttccccctcgcctggcacttcacaaacaaaatggcggttcttgtagcaacgaaacagccgaagcgcagccctctgaatcaataacatcaaatgactttatggatttaaacgcagttactcccaaatgatgtgtacattttaggtgaagtgcagggagacatttaattttataaacaactatattgaacatcagcctttgctaatataaggaaatagcaaaatggactgaattgcggtcaaccagactacatgcatagtagccgaataacaaagagatttagctttaaataaaatactgcctcatggccacgtgatgcaaaagtctaatgaactatatatcaaaaatgatttcaaaaagcataaattttttcccaaaccatatcagatgcagatgtagcactatagcttgtgtcaaagctctggtaactcttcccacatttcagaaagatgaggctgctgggcatgaagaaggaaaaaaagtgtgggttgaaccaaaagagaaagagggaaaaaagaaaagcataggaagttggtcaacaatgaaactttagtacatgttggtctttatttcgtcttccagaagagatgcagtgtgtgatcttgtataaataaccaagaggactattgacatttctagatctggaaattgtcaatatattgtaacatcactccacactgcaatgcggatgccaactaacaaatcacaggcatcctgagctaaacaaagagggtctgatgccaatcctggtgccagtggcaaccatctttggcattctctctgttctttctcatgtttttctcccagtcatttagaagtggggagagagaaaaagggggaaacgtaattttgttgctctttctgctgcaaacattacatttctcttttctgatttttctttcgtgttttcctttatacttcttttcctgatttataaaacagacttaggtgagttatcatgtacttagaagacaaataaaaagtcatcactcgcgatatgcagccctctaactgaccggagaattatcttttaaaatctgccttctttaatcaattgcactataaaatgacataattaacctacacttgacaaagaagaatatataaattttgaaaaggggaaaacacaaaagcatcctgacgtgagtttttcaaaggaagaaccaacagatgttaagagaagatgatgcactggcaggtagcagaggatacaagttatatacacaagataaaataatgaaaagttcttacaatagagattgttgaaccaacaacaaaatcaatgttttatctaaaaccatggtctcttaagagttgcttaaaactttatagttatcatgaccagtggtgcaacatggaaggcatttatgcgttttttttcttttttcaatctatctctacaaatctttattgtcagttcatcaaaactaagagagctggctgccttccccaggagtaaatgtgcatgcaggcaggcacacctcaaaacctagccttcaagcaacttaaaatgtgagcagtagtgaagtggttgcaaatcttccctccctgcactaaaaagttacatgacccactttttgaaactttacttccatccttgactttcacaacacagttacaacacatttatagtcaatccaacacatatatacagcccaccttaaagtgtcacctcctagacatctgtcaatcaaataagtgtcatgtgttactgagttttattttaggacacatgggacaaaaatattattttccccaaaccatcattatttggactgtaattcttaaatgcatggaaatattaaatgcaatgtttcattttttcaggaaaaggtaatatttctaaaagtgcaatgtccaacaccattatttaaaatcagactaaaaattctaaaatgacacttaagcctatctccaaagctacaagaaaatcaagacaaaaagcacatagtgagggcctagaattcagagtcaaaaaagtaattttgatttttttgaataataaagctcatagcagtttattaagtcccacatttatataacaaacctcaggtaacagtctgtcacctggctatctgcaggccatttttcctcccaccaggccaagtttggaaatgacctaccatctgtgacagctcaaacttcagtctacttttggtatgcggctttgtaaaatgattgttttactatggattgttggtaatgcaaggacatctatatcttgatgcatttatttgaagaaaagaaattcttacctacttaaggaaaatatattaagaaaaataaaaataataaacatttcattaactcaaatattcagtaataacatcatcttttttaattatttaggtaaaatgtataccattctccttctcaggtattttaaataataggtatggtatgcagtttctgtattctttttaagatttatcttaaaccagtgtaaccagtccactttctgttttttgttctgtaagcagcgctgcgactttcctcctcggtaagttttatgaatttacatacaagtaaactaacattattaagtgttcccaagtaactctgggaacatactataaataatttaaataataactcaattccatttaatcgacagtgaatattgcacaatcaaaagtgatgatagaaatattaaaattaagtaaatctaggtctacgtaagatatacttttgatattatctatcttaagcattttgtaatagtaaacattagttctattttcagtgcgataccactaagttcataaacaaagtccctctacctcattaattaataaggttaatacaaaaattatctaggatggtttggctattcataaataaagttatattttcaaatcaggaaaagattactagattagatgcaaaaatgtagcctacgacagaaagtatagtgtaatgaactatatttgttagactaccctatgtctttgaaaaacagtattattttaaagatacttgaaaacgcacctctttgtggtctttcttaaatatccaagcctatccaggtacgaaagctctgtgtctatttacatggctcgcacatggcagcggacatgtgagtgaaagcggacaccctactatacccagagagggtggaggatatctaggggccttgaggaccatctaactcaagccagatactctgtctacggagatttgtaggcggtgtttgccgtgctagaaaaaagaacaatctgctcctaccttgctcctgcacgtagtatgccaaaaacaaatcaagctccttaactgatactgtgatatgatgtggctggacacaaagtgctgggtttgtgcaatgtggggatttcatgagccgctctccatcggtactttccaaggggatgcctttgaacaggatcaccatgactagatccagacgccagactttgtctgcctgtcgcaggcagtcgattctcctaatcttacccttctggtcgggattggataagacacagcacgggtgcttcttgccagtcacggtgagcacaaagtcctctcgatactcctggcgaatatctttgcgcagtttggcaaggagcctggatgcccacttctgtttgatttcaggcttttcactgagaagctcatctttgactgctctttcttcatcctttgacattcgcttctcatgctttttaaagtacttgcgttttcgagcctgcaggttgaaccaagtataggcaattgcacggacatgtggaagaagtgcctcgatgaatgggtgaaattcatcctgtggaagacagaggggtgaggaaaagatgtgcatagtcagtttaattttaaaagctcaaaaaataagaaaagaagaccacaacccgtttccaattcagtacaaaaagttatacatgaaaataacattcctttcttatttaaaattatcaaaataacaggacaagaagaaagtaaagtatgcccagctgtcccctttccaccaaaattcacaggtcaattctccctcctataaaggaaataaggtttatattttgtattacactctggccccatcccccttgtttccaccccaatgccatgcattctacattctttaaaatataggcaactaactaaggtgcttggcacctaatatagtatttcaatatttgattgaccaactaacactatgcagtaccattttacaaagaacacagtgagattttttttttttaatcggagtagagctgttcagaaggcaggagcgatgccacagttcatttctcttctctgtggcacagaaacacaaagcatatagatgctcagtgtaatgccacacagttcccgcttttggagcatgctctcagcaagaggctgctggtggcacaaagagcatgcgccattaaacttgatccattttcttatcaaacgtccaacattccaacactgaaacagcaccattccaaaagtggtaactagagaaaccggtatacagtgagggaaagtgggcaaaggacacagctcgtcgtatcagtgtcctgaacagaaggtttccatactttgagcagtgcattctctccccacactaccaacgccagctcccaacacacacacacacacacttgcactctcctgctttctcacacacactcttgcatttttaaatagaagttttcaaactggaaaacaaaaattacatgaatgttcttccatcagcttccctatagaatatgcagccccacagagtccgttaatttgttcaccgatcacatgagtatagcaattattctaaacctcttaaaaatcaatctgaggtgaacaatgaaaaatggcaacttggcaccaactttacattctttgtgtctctgcatgctgtggtggggtgacactgctggtcagttactgcttttgtggaatctatacaattcatttgccatgtagatgaattatcagttagaactgtgggtgcatatatgcatgtgcatgtgaatttgcagatacatagattatagagtaccaatcttttgaattaagtagtttacctttaggctcctgcatttttcctgcctgtttcatccaagccctttttttaagggaggggatcagtgaggaatggtggataatctttacctacagatatttcaagttacttcccagtgcagtcagtttcgttacttcctgatttaggtaaaacctgtcttataagcttaggcctattactgttcaaagagaaagagcttaacgtcctgtacatgcacaccgcatgtacgcaataagccaagatttgaagcaaatgagaacttccaccaccaccacttttctgatcatattgactatactgtcagcccaacgacaaaataactctctgattgtatcccaagttagaatttacatactcatgttaatcaccctgaactacgtggaataaattctatttaacagcagactgactaattaattccattaggtaaatatgatgaaagtacaactaatgactctttaacaaagaaggtgtcaaaaatccaatatagatatgaatacattttgaagaagaaattcgaagttttaatgctacagactgcaacatgttagctgtttgcacttcagatatggaaggagtacatgtcccatccaatcaataatgtagttatcaagtgttctaacattgctgtaagtgttccttcaccagaataagtatgaatcaaaattttataacaatacagaatgctgatgattacatcacagcatgaggcatacccaaatgccatagaggaaatcattaaaccgatcagtagtttccagcagagatttgaacaattcagttactatgcgagcacattaaactaggccatggaaagagttaaaccacaatctgttctttgtgtgggaaggcagccctgctcacagcaaccacatcccatgataagacctccctatctccatacactttctgatgccatgcttttagctttcactgtaactacaaaaactttgtttatcccctttaggaatatatgcaaaaggaaagcctgctcaaggaaatgtggacttaaatgtgctttggaaactcacttcctataatcttttactacgatttattgatatgactaaaaaacacacatatatgcactcacaaaactaaaaccttgagaatgtaaagagcacatgaggtggagtgggtgggctctgtctcactcattttacccttgccatgctttttaaaatgcaatattattttataaatattaagccatgtggtaacacgtaagtacttacaccttaagtactatgttcagtgacatttcattttcttataaagacatcaaacacagttttgattaaatttgagtttcaatatttgattataaatataatctatcacacaagaaagctcaaaattttaatgagttattttaaacaaccaaaattcaaatttgaaggttgaatttgaaaattcttagcaaatgcacacagtttttaaacgttcctttgactttgctgtcaatgctgccaatattgttttaaaacatgctcttttttttgagaaataaaagtagcaaactttctcaggctgccagtttgccttattgatatcgttcagggtttcactattatgtgaattcaagtgaagcacttatttgacaaggggacatatcctccaaaaatgactgtaaattgaggtttgctgtaagtcgcatatatttctgtattaacatgcctaaatgtcatctcccaagtgtgactgtttcctaatgctgagtaacactagagtcttaaagattatgagtgacatgaatatggaacataataactgtcctgatacaaaaatatttttttaaaaggtgattaaggttttcaaatatcctaactagtagtggattattacaatagcattaagcaatcataaattctttaaaaaaagcaaaacatataagtgatttaaaaccaaacaactgtatacaaaggtaataggcaactttgctctttcagaatttttagtaaaatgcattgatgttcagtaattctcttttaaaacttcctttagttgaactaaattgacaaagtaaataacaaagttaccaatttcagatataaaaataaagagtcttaattccactaggcatatttatttttcttccgtttccatgaaagggatggataatttagaccaacatagaggtagaagagtaaatactaggtgctcttggcgcattgctatataacaacaaatcatgcaaaaaatgtacctaaagaacttaaaagcaacgaaagaaaaatatatttaatgccatcatgccaattgaaagttatattattaatggtttacattatttttaaacatatattaaatcatatgatagttcttaatttttcctttatatctgatttatactggtgtataaatattggttattgatatgctgattttgtagcatactattttgctaaacataacatttaatggtaggtccttttaaattaagattttttttctaaaacctagataccttattgcaacaattgagatacttttaaaagtttataaccaattaagaatgatactctattttgcaatttacatgtcctgagacatgtttttctacagctactaggctcttgtgatacaaaactactgatctgatacaaaagtgacactattaatgtggcctcacttttataacacctatattacctgcaaagtcacatggagcttagtgaagtgaaaattcttaagctgaaattccttccctggtgtaggccttgttttaatacataagcctagatttatattattaaaatagtagagaatattagtcatcacaagttattgttgttaagtgtgtatctctgaatactaatgtgatagctgaatgattatgctgtatatgatcccaacattccctgtctcaatgctgcaatattatctttaacttacacaaattaagataaaactagtgacttttcaatacatatttggaggatactaaaaatgcaatgtaattgctagcaatgtttctgaaaagctgatgttagaaatatagagaaatgcacaattattcaatcttttacaggtgagaataagtgatgctatactctgtaagtgaaaatcttgctttgatttgttttatttgatcacggtgtaaaaataatatcaagttaacacagcttatcagaaagagaaaaatatatccagccgatgggtaatattaatggtaacttttacaagtaaaggcaattcgttatacctgaaacagtttcatcatatttattggctattatcattcatggcttttaaaatacaaatagctcagcaactcatttttccagttttgttaaattaaagtgcgtgtttacttgctgaaaatagccatatctaagttaatcatactcagatgccaaacaaaatataaacaataaaaaatgtgtcagccaaaaagctacaggactgtatccaatcactgaataagccttatcattgttttcatcttcattcacaatttatgaatgcctcagtccttttgaatcacaatggcttctaattgtcatacaattgaaatcttaattatttgtccattataaaaatgcatcatcgtgatattagatgtttttaaaattttaacacgcccaagactggctgacacttctttatatgactagttttcatggcaatgtcaaagaaaatagttatcaattaccaatggtgacacatcttccgaaaagctgaaataagctgccccatacctttagaggtttaaaatactgcctcaaataacagttctgggctaagatattttagttactttgtcagttgttagttccctgggcagcgatgaaaactgcccccaggtaagtctgttgggtctcgccgcttttctatttgaccgtctggcttaaagtgatacaaatcgtgtttctaaaaagtataaaaccagtgttttatttcataacattattcctaaggtcttaggacaattctcaaagtcgaaaaaaatgaccttacttctaccagcattacttaaaatgccttacgagctacgcccaaatatcgtcaaatgaacaggtttccacaaaaggaacacgttctaaaaactccttaacaatcaccaagaccaactaactcgtgtcaacgtaaatactgcctttgtggtgcggtcactagaaaccccaaagtgcagcaggtcactatggaccagggtttcagatccccaaataaagcaaaggaatgggtccccggaccacaacctccgactcgattcgtcgcccgcccaccgcctgcagcgcagtccagcggcgcccacacagactcgtgctacagtcccctcgcccaagttcactggctgtttttaaaagcttagtcccccgtaaagtcctccaaagcccgagtccacctcaacgcgcgagctgctgagaggggctacgggcaccccgggcggggatgccgcaccacaacgggcacttgaggggccgcacggggcctcgcacttacaggtcccggccctgcccaccccccggcggccttgcccggcccagcgcccgcgctccgtgcccagggcgcggggctgggcgctcgcagtggccgtggcgaggggccgctcccggctcccacgccgccccgcgacgcccgctgcaactccgggccacttctccaagggacggggatgtgcggaggttaactcaagccgctaattgtccgcaacaaaacaaaacaaaggcatttcgggccagagagaaagctcgagaaagcgaccgagacatgtacctgagtgagacagatgggagaatacatcatgacttcgccttaaaacgcactttccgggagatgcccaagaaaatcttcgagaagcaagaatttcatctattcattttacagtcatctgagccccgcgatgcgatcaatcaggacggggctctgcgctggatcaccgcaacttcacaacaaacccagtcctccttaaatagccaaagattcaagttcactcggcgtgctagatttccaggggtgaaatccaatctacacttttaaccctcttgcagtccgagcgcgctggccgtgcttgccgaggccgccgccgccgccggtgttggctgcttttcgcctgggtttggggatttgttttctattttgcagttgttgttgttgttggggtgtagggggtgcgcgaaggttcggtgtgggttggattggggtggtggttggtggtaaaatgctttttcaaaaaaggcggggaggggggcgcgggagggcgcaggagggcgagcgggcgggcgggagggagagcggggagaatgtgtcaccgcgctgggaaagttcaaggttacagccccaagcactgcggcaggatcccggagtggtgatcgcaggcgaaactttgccgcgagccgaccatgtgtgtgcgcgaggggcagcgtgagcgagtgcgcgcgggtggcggggcgcgcgcgggagagggccggggtgggggcggggtgggatgggggagaagggagaggccggggtgagggagggggcgcgagcgctgatctctggggcggaagaggctcgcggcgcgtggtccccggcagcagcagccgccgccgcccgcgccgggtcttcggcgcccggccgcccgcccgcccgcctcgccccgcgtctgacccggccgagcgtggaggctgctgttgccgccgctgcccagagcccaggggtatcaaaacgatctcctgaaaaattccaaacgataaatcccgctctcccgctcggctccaaactcctctcttttctgctctaggctcttttttttccctccctctcttgctttctttcgttgcaaaacttggaagttgaaaaattcaccggttccaccctctggaccccgctcgagctctctccaaatcagacttaaggattgttttattatttaattacacaatcatcgctttactcctcctcctgcaaacgcgcattccttttgcaccagcctctccacaccccccgcccccccaccttcctcctcctcctccttctccttctctccccccacctctccctcatttgttaaaggtatcctaccggtgctacagaaccatgactttttttttttttccaaaatagctcttctttccgctgccctccccacaccagcacacacatacacacccccgaaaacccgccctggaagaggtatttcggtgctcgctgcggactcttttaagccgcgggaacatccgagtgggagaagcaccgaaaccgtctgagcccgagaaaggaacgagtggaaaattccctcacacccaggccgcccccaggccggggctggggcgcggacactcgcacccggggcgggctcagtccgcggagcctgcggctgccgggaaaagggggaggccgagcaggcggggacctgagcgaacttgggctcaagtagttggggcgcgccggcgtggaccaggggggtgcggcgcccagcccccgacggccccgcccggagcccgggttcgcggatagggagggggtgcgggttcgtcccgggtctgcccaccaggggcccgcacccgaggcagtcgcggcgcgcggcgcttcgccgcggtttgccgccctccccgggggtgccccgtgcacgtggcctcgctctgagcgggaggaccgggccgagccgccgccgccgcctcttgctccctccacctcctccccgcgcccggcttcgctctcctcctcctcctcctgcagccccgctggctggctcccaatccccaccccccggggcccggggcgccggcggaaagcgtctccctacccgcccgggtgcaggcggggcggggccgcggcgcgcccggggctgcggggcgggccggcgggcgcgcgcgcgccgctgcagccctccagaggctgcgggccctgagccgctcggcgcccgcgccggctccccaccgcggcgctgccccgcccccaccccgtcgcccgtgcaggctccgagtgaatgaacttgattccagggattttgaagaaggcggttcgccttgcaccctttctgcaccccccgcccacatacacacaccgccccccaaatccagttttctgcttggggtggatggggacgagggggaagcaaaggcctcccagacaatggagggaggaaaagtgagcgcctggggctccgagtctacctagctgggggatccggggggcgctggggctaccgggtcctcgcgggcccatccccagggcggggccgccccgcttccacgggtactgctggggcgtttcgaggctcgcccccgattccccggtcctctttccaccgcttcccagctcgtgatctgtcccctcaactttagcccctctcactccctctggtttctgtccaccgtcccctcttccctcccccagcggacctggaggaaccagtgactttttccttcaccaagtgggagttatccacatcaagcatttcacaacgacacatcaagaaaagtaggcaggttcaagtcaaccatgaaatggtcactttttaaccccgtcctgtcctcattagggaaatgctcaaacacagtccgttttcaaagagcgctcttaatgaggcgagcttgccaagtttaccagctgcagcccccgtaaacccagagcccaaagaagaaaggcgctggggggtggggagttcgggaggccggggacgggggctgctgggactaggaagacaggtaaagtcggggagatcgcgcggacccctgcgagttaaccctttcggccacacgccctgggagcggcctccctgcggtccccgcccctgccccggcaaatcctggagtcagcgttctgacaacgttaatttcctttgtgcgggtcatttcttctttttgaaaagctgggataaagttggcagtctttatggatgaaagaaatgaggtgacagggttaatccaagtaaatactcatttctctcagaaattttaggcaacctcatcttagattaaacacacacagacacacacacacagagaaaccaccagcacgaaagcatcactttgtattgcacattacactgcatcccctttctcaccctcaccagattctgaggggagggggtggggaagctctactgataataccagctttaactactgcagtttccctttgaacaaatattcaatttaactggagttaatttaccataaaagacattccccttggcaggaatgcactaatatccttgaacacacctctttgaatgcctggactctcatagaagccattatttcggggtctctttaaaaatcgagcgcccatctctccttctctccctccctcccttcttccctccctcctcaccacaccacccccagtgaaatcctggcacccagagagcactcctttcagcctgagagcccagaaccagccgttgtcccctggcaaaaagaggcccagggctgagccctgggcaagtgtctcccgacatcgctacccctcctccctttattagtttccctttcccaacagaaaccatttccttctgccaccaaaactaggttgcatccaaaagtttttcacaagcttaaaaaagaaaaacgaaaaattgacaagtattacacagaagagcccacaaaagcttcagcaacaccaagggcgaagaagcagcgtcagatccaggtaagaccccagagaagtgaagacgtctggggcctcccaggcccatcacttaggggttcaaatctctttcaattgccccacgtttgagggtgcttatggctggttgcactttgatgaccatagaggatgcttgatagtttttggttttgatttgtttcccagaaaaaggaaaatgagataggagtatggtgaggcgaggaaaaccaaaaaggaatgaagagtgagcaacagagacttcctgaaaaagaaggtttatgggggtgctcagtttctatggctttgactgtcttctcaggccttgcagccatgtggagaatggctgacaccccccaaaacacttcttcttgtccagccaatgccaaggtcattgcaggccttccctggaagaactctagggagttgtttggaaagagggactggtggatttcggtgcatgggatgcctggcttctcttaacacaacacttgtccaccacctttggtttgaaaatctcaatcttttaaatcccaggtagaaggaggaactgagaaagtgcctgcattgtattcactttccattttttctagcacgtctgtgtcgtggtattaagagtggaaatatctctgaaaagcttctgatagtatcaaaatgggccaaacacttcttaaactttggtacttaccaatcctaaactcttcatctctccctcccacactgagagggttaaaagcactggtgtgacaggccactttcattcaccccaaaacctggctgaggaggcagaaagaagtgaatgattctctcagcaacaggaaactctgttatttcagtattcttaaagatctcctccctagatctccttgctgccttataagggaaaaaaaaaagtttcctttctaactaacagaaagtttattgatttctaaatagaatgccagtgcttcagctcactggatttttcaaaacccagttgtatatttgaaataagcaacgctaccacatttgagcctttcactacggatctccagagaggagcttgacatctcaagtatctaatattgtttttcttttaaccttttccttcctaaagaaattgcagcgacaggttgcaaatcctgggcagtttcatgaaagatttcttggaacttaacaaagctgtcatttccaatacactcgatgcctttttttttttttttttttttttttggctcttgcatgtggtttgcaagaaggttcaactattctacacaccctggctgcatcaccaatatcaatatttaaaaactaaatgcaaaagagacagatgacctcctgaccccagaaagcaggcctgcaaaactgcaagtatctactgcaccatgccctgggatctttcctttttccaaatgaaccacaaaaatcatacatgtgtagtctggaaaacacaaatttatatccacaaggaggaacaccaaaaatccactcataaatgcatatataaacaatcaagaagtattgaaagtgcctgtacttgatgagaattgcaaaatcaattttaccagctcaggtaatcaaattacccagctcttaaactactactgagtactactactactgtctactactcttaaacaaaaaacaaaatcatacccagcccttaacgtactactgtcaaattagggtagtaattttttccccaccagagaattcacaactggttagtttccccacccccattgctagccctttgcactgaaatgaataaataaccttggacctttttctcctcctctgggagctatttggtgtcccctgaggacaaaagtaaatgagaaaaatgacgctgttaataatgtcactgccgaaatgcctctactccactgtttaaaaaaaaaaaaaaagcatcccactaagtgtgtctacatttctagcatatttacaagttataatacagttctgatctcaacaccaactgagccagattcctccactaaggttatccggttttcacttctcaacagagatgaggccagtgcatcaacagagattcccaacactgtaagacacttgcttcacagattacaaagtcagcagttgccctgtaacttttgcatgatgtattttaaactttgaaaatagaggtaatagttgcctcacttatccacaatgttacaaaggttccatatactctctcacacagtgtctcttgtctgctgatattgagagagttgcagttattgctctttttcaaaatagctgacctataaagtaaaactatatgaccattttatttctacaggtaaactggcttctattacccatatacacatgccttgtaacataggaaaacagatgggtttttaagacaggtatagaaagctctgtccaaaatggctaagtagtctttacattctgtattaagtataaaaagtgcatggcagagcaactcaaactttctgcacccctttctctcatttcttctttgaaaactgcataacaatgcataacaacaaaatttcaaagtcaaagcaatgcataacaacagaattgtgcattttaattttcaaattaaaatttaagaaacaattttgtaattacaaagaaaaaacacaaacaattgggcctaaacaaaatatatgttcagtaaactttatctctgagtgtatctgaaattttaactacacaagccaataaatttcaaagcagtaatattatcaaattgtgtaatgtcaaaaactccaaaaacaaagttacagatgttcatgacatcacattcactcaaaattatgctgctgttcagtctgaccatattaaaattaaagggatgcctatgtctgctaaagaataaaaatttattttggacctcaaacaatgaaaccgtcaccatttcttgtatggaacactcagctaatcaatttcctattaaaatagctttcaacaatacttggctttaaaattcatcagggccagtaaaaacgttttcccagtgcacaagaatgcagtcccaaccaccgatgataattactgttctaataattttattgccaaagtactttttcctgtgttcctcatcacttaggcaggaatctgtagtatattgcgtcagtgagttggagtgcttgacctttgcccacatatgatttaatagggacttttcagcgctagagctttctccatctctcataccattaaatgaaaacatcaaacctcaaatgtaaaactggaaaccacaacgttttgtgtttcacaaactctttgcagtttttacttaggatgcttaaaggtcagtttctttgcctcacaatgcttttcttcatattgtaaatacactggaaagtcacactaattctgattttgattaaatcttgaactcctcagtcatatacacacatacaccctgcttatttacacgtgcattcttttctaaccacataagcatgcgtgtgttactttctggacttattccattttagggctgatttaaatgtctgttcaagtgtgggatcaaaagttaactttttcccgcctattggaagttaaagttacaaggatggtgctataagatccgttcaaagaaagtcagagttaatcttgtgtattttggcgccttttccctgccagctactgtacttggggggtgggggaaaaatacttagagatcttgtctgtcctgtctcaagttcagtggcagttcttccaacccgagcagaagatggccatgttcacagccctaataataattctgatcacgccacttcagcatcttgtgtcaaagtcgaaactggcttccccgcccccttcaatctgaaagctgccaagtcctcacacacttcacattcaaccacaacttaatggatgggatattgtgcattaaaatgtgtctcagacgtattggggaaaagaagacaaggagaacgagagatagagacacacataggaagaggaaaaaaatcggcagcaaaaatagcggggttggggggaaactattaacaggagtggaaagaaatccatcaaaatcggttttaaaaagttggtggggggtgcggaagaaaggctaacaataggatgccacaaattcagggatgaggggatgggggttaggactaaactttagaatgaatactgactttaaacattccaacacaccaatcagagttaaatagtacttctttcacttaaaaatgtatttttaaatgagaatatctgtgaattaaaatggagaaaagaatgcttcaagaggagagaatggcctacaaggtagaactaaagtatcatttgaacagtaatttttttccaccactgaggggagaggggcataaagcagagagttaaagcagaacaaaatgctagattctgcaccgtttggaccacaatgttactcactgattcccgtcataagagtgtgtcacatgtactaaagttgccaacgctaaataataatgcatatttgcaaattagttctgcaaatgcagcactatagcccacaacctgtaaaacaaaaatgacatttaggaaaggggtaaaacagccactttgcaatccacaaacaggaaaagaaaaactgtgccagggataggagggggtgcaaagaacgaataaaagaagcaaacaaaacccatcagttcaaagccacataccatcgcactgtattgcattaaataaaagagatcttgagtctgtaacagaaccctgggccgctgacttgacgtgtctcaggtacagatttgtggattttctcaggggttgttttggtgtcgctttttgtgtttagttaaaaaaaaaaaaaaaaaaaaaaaaaagcaatccgggagtagtcttatgtattttttaattgtaatttctgcactgccacagttcttggcccgagaagaaaaggcggtcaaagtcaagtctaaaagcaggcagcccttcagtctgtctggatttccagctttctttcctctcccttgcagaaggctgtttctcgtgcttgacttgaacgccgtccaggatggtgtgtgtgtgtgcgcccgcgtgtgcgtgtgtgcatgtatgtgtgtgtgtggtgggttttattgttgttttagcggggctgctccaggagtggggctgcgccggtcagatgcagccggcacggccccggggtcgcgcgatcgccccttccccgccctcggattggcctggcccgcggcggggctgccccggaaccgccacccagcagcgcacccttccgcgcccggcccgcgctcctcctgcagtcgcctccctggctttctctttctccggctcgcggcccgccccgccccaccctaccacggccggcctgggcgcgcgggaagcgcggctcttcgcttccgcctggcggcgggaaggaaaccgaaaggaggagccgggggcgggcgcgccgcgatgcatattcatcagggcgcccgggacccgggaggcgggagcgggcccgagtgggtgtggcggcctgcgccgcgcggcgcccctctcgagcgtgggtgggtgcgtgggtagcggtggggctctggtctttgtgcggccgcatggggccggagagcggcgagggcgtgaccgtctcgggggctgctgcccaggctccgcgcgcctttgtgcttcccgaccgtgtgtctgcggcgcgccgcgggcaaggggcccctcgccggccttctggagcaggaacccggccgaaaacgccgcggaaagactctaaaacaacaataatgataaagaataaggaattgctgttacttcctcacttcccgccacgttgctggcttcaacttcgccaggccacgtttgtttccgtgtaggaggactcccgaaatgttcctggctgcgcagcgttatcattaaagcaaaaggaccagaaagagcgcactttgacttatattgataggtagtcacgcgaatatcaaaaaaatagatcagtaatttagaagtgggtgaaacaaccaacaccaaagagataatacaaccccggagttcccagaagtaaacactctagaggagattggatagtgagttaatgttcataaagcaagcagttttgatcagcattttggaaacaaatatatgtagggggattttttttttcttagtttttgagtaatgcaattcttttcatgttaagtatctgtagttatgtcgggaaataatgtttaacagtttaaattgttatacaagtattaaaagtaaaaatataacactagccctaacatttacttagtagtaacccacatacatttagaaaagattttattacagagatcctgactaattatgtaattgcacaacagacgacgatagcttcaggtattctctaaaaaccctgttgaattatgtgattaccagtgagactagaatagctcccgatgaattattcttatctctctactaaatgtgagcacgtcagtattttaatctcaattatgtttaccctcaaagtcctagagaacttaaacgacattgttcgggttcatacctcctacaacacgcagtatttttttttaaaaaaaggcatggccttattaccaaaaaaaagttttttccccttgtatacacatcatacatacgtttggctgtgtgtgaataatatacatagctattttcagtgataataagtgcaaaactaaaagtgggattggcccaattagactttagaaaatgcccaactttaaaataatttgtctaactgcaagtttaacagttcccaatttctcctccaaaaaaattagcatatacagcttggagaaggggaatgaatgactgggagggaggggatacacacatgtagctatctccacactcagctataacttcccaaggaaaattaatttttaatgtttatcttgctccaagttattgtaaccacttagcgagtatagctataactcagtctccccactcagttcaagtgggtaacaaacagatctgttttcattctaggatttccaaatagtagtttcatggtcaagtaaatcacatttagtactaaggaaacaaatataaaatataaagattctatgcagctaaataaaaaatttatttagagtgagaggataacacttgaccaacagaagaatgatggatatagaaataagtaacatgtaagtaacacttgcatgggcagtgttatcaaatactaaaacttttatgtaagtgtgcaacagaaagtcttctctgttattatttgaagtccgcagcagaattaccaatccctcccaatgtcattacatgcaaaggagaaaggacattatagagagaatctagatttgtttaggaaatattttgagacacaaaataggaaaaggaatagggaaagaaagagaaaagtatttcctccattctcatgatgacttggaggaatccagagtttgtatcacctgtcaaagaatttctatctaagcattttatttagtcataaaatgtaccattgtgtgtcatgttcaggctttcatatattatctttttttatttggatgtctgtttcttttgacatgtgaagcttataatgatacttattcctatatccagcattcttctgttggtcaaatatgtacacatattatcattagatgatacctaaggtttataaaatagggagactgattttcaagcatgtcttagagaaattggtcttgctaatttttagttacctcaacgtgttgttgcttctaaattttttaattggtaaatagttatggtcttttaatctacaacgtcgcctgcttttctggtttttatattttgcaatgtaaataaatatgcaaaaaactgagaagtgttttgaaatagatgctcctttttaaatgaaaattatcttggttgaaagcctttctaagaatataattaaggtccagtatctttttatattaatcttttgttataaattataaataattattcattttttaaaaatagcactgtccaacactagttaagcattttgggcctctggcacatctaactgagtgattccagtgtttttaaatgacatttttttctgccttaagttgcaggcacaattcattccatagaacttaccagaagcttcacaaatacacttgcagttaagatttttctgcttcttcctaaagccaattaactggtaatgcagtttctgtatgttgtcttcaaattaagaattttaaaaatgtactagcaacatctgtgtatatttatctttgagaataatcactatataattatttctaaaaggcttgcattattacaatgctttatatcataattgaagtaattcctctaccccatctaaaccagtaattttgagtcattaccccaaaggtgtttattttgtcttacttttctatttctcaaaaatagagaaagtgtgttttaatttctatgatttttatattattaaagggtacacactggtttattagatttttatatttagtccattattataccagaatttgtgcaaatttaaagtatgtaataaagatagtggcatatttaggatgcaatactaaataaaacatataccatcttttaaaacaattggatattgaaaaataatatttttagaatttaaaaaatacataatgtatttttgaatatgaacatataaacacattcttttaaaacaattggataactatttttagaatttaaaatgcatattgtatttttaatataaatttggaaagattcatattttttattgcctcaggcaatagttttaaatatttcctaattatataaaaatagggaggcttaaattaggacatttataaagtgccaaatgttggcattttgtcagatttcattagatgagagctgtccctgcactacttttattcaggagaggagagtgcatgtctagtgtattgtcctgtaagaggaaaacccaggcataaataacaagtcatggtaataatttgtattattcattggttatagcactcttcagctgtaattcattatgcctcttctttagatattgatggtaaaaacaaatgcgataccattcctacaagacatagtcgcccatcataaagaattatatttgtggaaaagacttcaagaaattacaagataggcatctgcagtggagttgaaacaccacactgcccaggacaggcacactgggtcattttctaaccattgagagtatgggtacaaaaataaatatacacatgcagtgttccttctttcactaactacatgctgcacctgtgcacacatagatctgatgacatcttctaacataataaatctcaagtggtttgtggtgtcatcaaaaacctgagatggtggtatggctcatagccttaccaacccccggctatggccttgttaaatttcacaagctaaatagagacagactcagacttattccatgcaccaaccagaggttttcaagagcaggttaaagtggtttacagaaaaaaaaaaaaaaaaaagcctgcagttatgactcaatgtgtgaaaaatctgctctctgattcaacagtggtaaatccaggatgccttctagctttaaaaaataatgtttattgcaattgttatgaattctcagtttgaagtatcaacgatttcttagcctatttatgtttttaagacttataaaaatactatgagcaattaatcttcctatcttgcttactcacacttttgtgcaactttagaatttcaaccatcaaaatgcccttaaaaagaaaacaataaattggaatcaatttcagctataatgattaaattgagcataaaaaagcaagtgttttctgcaaaaaatttcaggatattttatgccatattaaggtttctgaaacaacagaattactaaggtattttttttttaaccattttcaaaaaacagaggcatctggcaatccagaaattagtgaggcaacaggatgcacgaaagcgctagacagtctactgatccttcagtatagtcctggcaaaagaccatcctgccttttgctcagtgaggccacattcaaaagaaagtcaatgttaattcccctatattcaaatcctgtggccaaatgtccccagtgtcacagattcctgttggcatatctagaacatgttgatatcatttcaagttgccttttacttaaagaagatcaataactatattttgtgtctatattccgtaagtaagaaatcgtaggtgcagcccagggagtagaggaggaattcattcctactacaaacacacattgcatgcttagcatgggtctggaccttgggctgggtgctgccatacaagtatagataggtttttgaggatctctgcattcgtgatatgaaggccttctattctgttgtgctaatattttcctccaaatttgtttagaaaagagtagccttcccatggggtgttttgaaaaccttcaaataaactctaaataacaacctgtggttttctgctcactttgcaagcagctgatgtgggcttgtagaatgaaaatagtgttcatatagaaaccaaagaaaaatgtaattagggatgataagtcagctgcccttctcatcccacttcatccactaaaacaaaacaaaccaaaacaaaaccctcctataatatattcaaaagtcaaacaaacaaagttgggaaaattttgataccactatggttcatgatgtgagaaatatttttgtaaacagaagaagagagaagggagcagtggtagatggaaaaattcaggcacatagaatttacctagcacccaaccagtactgctttcttttaccaactttttgttcgaggatgattgacaagcaaatatggaggtcagaatagaaatacaagttttaggaacatacctaaagtcactgcctctgcttttttctcttcatatctggcaccttctgaattgctccccgcctttttttcttttgtgataaggtcttactctgtcaccaaacctggagtgcagtggtgctatcagggctcactacatccttgacctccagacccaagggatcctcccacctcagcctcctgagtagctgccaccacaggtgtgcaccaccatgcctggctaattttttacatttttttgtagagatgggatgtaaccatgttgcctagtctggtctcaaactcctgggctcaagtggtcttcctgcctcagcctcccaaagtgctaggattattataggcgtgagccatggcatggggccctgagctgcccttaatatatatatatattttaaccattatctttaattttttttggttatatgaacaatagtagagatactttaaatgaacaattaacaagataaaaaagatatccacccacagtcccatcacctaaaaaatttgtttcatgtgcatatatctggtatctgcttatatgtaatatatatatatatgattgcatagttataatcttaaaatgaatataatttcatttcataatttttccacttaattttctatttgtattgttgatattagtgaatggtcacaaaattgtgaaattagtgacaaatggtcacagaattgtaaagttgttaaaattaaaagagacttttgagacctgtagataagagattaagaaacaaaactggaaccaacttttgttttttccctcctaaatttgtaatgttgatatttactgttaacatttaaaacttgatatattttgttgaaaaatctagatattttgctttttttgaaaaagtggaaggtgagactttttgggcaagtgttgcacataacacgaagagtttggagtggagtagcaactgccccctttagatggggcttggtctccacagtcccctttgccccttcttgtatcatattggcctgctttcctcacttagatttctgacttgctttctatacccctaagtgtacagttcttgatctagatcaaatgctcttcttatagatgaaaaacaaagttcagagaggtaaagtgacttacttatggctgctaagctagttagttgcagtgccagcatcctaaaggacacctcctgactctaaacaagcactctttgtattaatgtttttttcagagcatgtggggaaggggcttctgtgtgccagtatgagcagcctcaccataactactgtgaccacaagctcctttatagactgaaatgtcccaggatagccactcatcaccttttatgctccaggtcataattaacatttgatgtccacatgccaaacacctgacccccctgcaaatcctgggcccactcacagtgagtgactccttgtctttctctttttctttttttcttttttaagacggagtctcactctgtcacccaggctggagtgcagtggcgcaacctcggctcactgcaacctccacctcccaggttcaagcaattcttctgcctcagcctcccgagcagctgagactacaggtgcgtaccaccatgcctggccaatttttgtatttttagtagagatggagtttcaccatattgcccaggctggtctccaactcctgacctcatgatccacccgcctcagcctcccaaagtgctgggattataggcgtgagccaccacgcccagccatctttctcttattaaaaacccagtaacaggccgggcacagtggctcacgcctgtaatcccagcactttgggaggctgaggcaggcggatcacgaggtcaggagatcaagaccatcctggctaatacggtgaaaccccgtctctactaaaaatacaaaaaattagctgggcgtgggtggtggcacaggcctgtagtctcagctactcgggaagctgaggcaggagaatcacttgaaccctggaggcagaggttgaagtgagccaagatcgcgccactgcactccagcctgggccacagagagagactccgtctcaaaaaacaaaacagaaaacaaagaaacaaacaaacgaaaaccagtaacagaatgcaagtgagggaggatgatcactttatggggataacatcaaatatgctctaattgataaaggaagtacctaactaaaaagttaaatactttataatattcttatctgacatacctcacagaaatgtgatcatgtgctaagaccctagtagagaatcatcatcctaaaaaatataaagattccctctgtacagagaccatattttccgatcactaaatcagaacacatggtgcaaccaagcatttttttttaaatgattttaagattttgaaaagttttgaaaaacgttttttaaatagtttttaaccgtgttttaataaatccattctatgaaaataacaaatgtataccatctaagaatgatgatccatgtctgttgtaaaattcttagaaatttgcctagaaaatgggatttgatgacaatcactgccatttcatcatcataagcatcctgtgtagtttgtacttgcagtgctttgtttttttagacagaacaccactctctaggttttgctcccaaatggaggtagacctgaggacacacatagagtgccacagagtcaacacggtgaataattgagaagctcgtacattatgtacatgttgagtctacagttactctcttggtgggtgaagaagaggtccatattcaatcaggctccaggctcattcatagatgtgatcttaatggcccatattctaatgaaagcaccctgttaattgggcagcttgggctctctacttcatatataggagtccagcccctctgtactgagtttccccgaggtctagatatgcaagctttttcgggggcattttaagtgactacctaccagccggatcttctcttctgtgaccaatttaggccaatggcagcactttaattaagcaaggcctccctggggcaatggtttctcccaactttagattaaaagtaccatcaagacaagtgataataattactatttactgaggtctcactatgcttccgccctgtgctcagtactgtatttcatctaagctcttttaaagacgaggcactggaggtttggaaagactgagtaaccaattgaaggtcagagcattcatgatccaggtcattctaattcccaagcccgttgccatagcttaatagtttatgcagcaaggacatgaaactactagatgaatggggcccagtcacaggacttgccttggaggctttccactatgcctcaaagcatttttatcactcttcttttgaaattgccttttaaaccccaggcacattcttctaaatattatcaatagggtagatcttcctcctttgagtgtggatttaagttttggatatagccaggattcattcaataccctgtggggattaaagaacttatcaagctgggtaaaccagtttgggttgaaaacgaggcatgtcaatgtaagaaggttatattcattctccagtatgttctgaaagtaatggaatataggctttcaacttggacctggaggcattgactttttgggttcaaatcctgacttagccacgcaaaggctatgtgactctggacaaggcaggtaatgattcttaaccacgattcccttaccttcgaaaatcatgcctgcttcagtgtggttgtttggggatcaaaatttttcatttgtcaaaatatgtaggactgtttctgaaacatagtcctttctcaataaatattttctgaatctatatatcgattattacttttctttgtcctcgttcttcaaatagggtgagagatgataaacaagaatagatatggtctgcgacaatgaccagactccaagcctctctgagtgcccctaggcctgtgatagcatttatttgcaattatagtttaaaaaccaagaggaagccaggtggggtggctcacacctgtaatgccagcactttaggaagccgaagctggtggatcacttgaagtcaggagttagagaccagcctggccaacatggtgaaaccccgtctctactaaaaatacaaaaactaactgggcgtcgtggtgggcgcctgtaatcccagctattcgggaggctgaggcaggagaatcgcttgaacctgggaggcagaggttgcagtcagcagagatcgtgccactgcactccagcctgggcaacagagcgagactccgtcaaaaaaaaaaaaaaaaaaaacacacaagaagaatctccctagctccctgatgccaagagagatggatataaagtagactgtgttgtagtttgaagtttctggggggcagttttatctcaaggttgcttttaggtttttcctagaaaggtaagaaatttaacagcatcttgagcaactgcatgttcataaatatttatggagcacctcccctgtgccacgccctgtgctcaagttgagacgggagcagtgaggaccggagcagtgtccaaaaggtgctttggtgacaggcattgaatgatgctgcccaaatgctaagaattgagaacatatcagaacctaccaacacaaagagtgttagtcatctattgaagaagacgtcgtcacttatcaggcaacaagtgaatgcctgctgtgcccaggaaatacagtacgaacaaaaccagtgatattctagtgtggaggagagagacggatggggagtgggaggggaaaatgaggctatagctaacagaaacatagagcttgtgtgctgttgttctgaggccatgagcttgccagtctgttcaatgaggtcggaagggtggtctgataattctagaagtcttgcaggaaggcttttatcaaaagaaggaaatgagaagtgtgcaaagcctttctacagcctacagtcaatcaggggtattcaggggtatctagagaggagacaggatagagcagcctccaaggaacgctattgtagagctttggcagctgatctggaaccaccttggtctctccttggcagcaccctgcaagcctgaatgctttgagagatgtatgccctttcactctggcttatgctcactttcacaacacttatgaaatacattatctcatttgatcctcctaataatcctatattacaggtgtaatcttgtctcttgttttacagatgagaagatttgtgtgcatagagaataaataaatcacccaaggtcaatagcttgcaggtatcagaggcaggatttgaacctaggaaatgtggttctagagccttagctcttagccatgaattataagcagactttttcttcacccctctttcctcatcctcccactcaacagagtggcttgtacccacccttaaaatctcttctccttcccttagggctcattctaggccccacaactccctaatggggagacatatcatgggcacctttatagttcaactactccacactatagcctggtcaaaacttagtcactgaaaagagtcacttcagcagccttggcctaagtctttggatccctaaaaagtaagacctaagtgactgccttgtctctcttcctgtgctttcgaaaaagaaattgtcgtgtggtcataccattgaatattatataacaccgagaagaacaaccttctatataatgtgtatctaggaaagtatacatcacgagtgtatagctaaatgtattttccatgtcaccaccatacatcttaagagatgaaaaattattggcaatgcagaaaccgtctcccaatctcagcaaattactagccctaatattcttcccaaagacaaccgctgtactgatttctaacaatacaaacttgtactgcctggttttgaactttacataagaaaaagcatacaatatttactgttatgtctgaattatttcgttcagcctttcatgtgacattcctctctgcgattgcaggtaaccgtgttttgttttgttgtttccacattgcagtatggaattctattgtatgcatacagcacagtttatctattctgtacccaacaaaccttgggttgtttccagtttgaggccaatataaataatggagatatgaacattgtctacatgttttctattacacatatgtatgcattcttttggggtataagcctatgagtagaatttctcagttataaagtatgcctgtggtaaattttcgtagacaatgccaaatggatttccaaagtggatgtagtaatttatactcccaccagcagtatatcagttttaattgcttcacatcttcatcaagactatattccaacgtatagcaatatttccatgtggttttaatttgcatttttcaaatgactgatgaggctgagcaccttttcatctgcttattaaccttttggatatcctctttgaaatgtctgttcaaatatttttcccgtttttatttgcactcttctacctttttcttgttgatttgtaggagttctttgtatactctacacgtgagtcctttgccagtttatatctgttgcagatttctcttcctactttgaggcttacaattccactcttttaatgttgcaatattttttttaaaaaaacatgtttattcaggtgtaactgccatacaataaactgcacatgtttaaagcgtactaattgataagttttgacatccatatacacccatgaaaccattaccaccatcaagataggcaacatttctattacctctaaaaatgtttatatgcctcttggtgatccctctgtccttttctacctcccttacaaccactgatctactttctatcattatagcttaatttgcattttataacattttatgtaaatggaatcaaacagtatgtactctttttcatctggcttctttctttcagcataattattttgatattcatccatgttgttgtaacaatagttcatttctttttattactcattagtactccattgtattgtataacataatttatctgtcacctgttgatggacaattaggttttttccaatttttggctattacaaataaagctgctatgaacattcatgtacaagtctttgtatggacatgtactttcaattctgttgggtagatatctagcaatggaatgtctgggcatatggcagatatggcaggtgtctgtttaactttttaagaaaatgtcaacaccgttttccaaaagtggctgtatcacttcacaattccaccagcaatgtatgagagctcccattcctccacatcctcaccagcacttagtatgatcaagcccttttatttttagccattctagtaagtatgtagtgtatcccattatcaccgtagtatttgtctccttaataaataatagcgttgaacatctctttatgtgcttacttgccatttctatatcttctctggtaaaatatgtattcaaaactttttgcccatttaaaaaattgggttgtttgttttcttactgaatttttaagttttttgtatactgtgaatacaaagcctttattagatgtttgatttgcaatattttctgccacactgtggttttgcttttcagtcttctaacaggttctttagaagagcagaatttttaaagttcgatgaagtcaaaattgtggattgagcttttggcttcatatctaagacattttgcttaatccaacatcatgaaagattttttccctctgttttctttcagaaattttatagttttatgttttatattgagatctataatccattttcagttaaactttgtatttagtgcaaggtatgagtcaaaattcattacttttatatggatatttaattgttccaacaccatctattgaaaagacttttttcccccactgaatcgagttcaaacctttgtccaaagtcagttttccacatacatgtgggtctatttctgtttttctattctgtttcattgatttatttgtctttatccatgtcaattccacactgtcttagttaccattgtgtcgttataagaagtcttgaaatcaggtagtgttagttctccagatttgtgccttcaatattatctttggatgaactcttctggtattttgtcttgtttttaacaagttttctccaagaaaccttgaatctgctcagaccatgttacaacatgaagctgcaattagcacctgtggattttaattcctttattcccttgggcctaaaagtcatttttattcaaagatatgtttttataaatgtatgagccctgaagggagtgggattgtggtggtatttaaccaaattatcatcagctattatggtaactgaccaccagctgagcacctgacatttttggaaaatgactctacagactgacctcatgggcctggggaaacccaggtggaaggtgggaaggaggagagccacctatttatggtaatgcttacaagtaaccaggcattgctgggtgttttgtatatagcaactcactttttctaagatgcttataatctcacttctagagatatgctctgaagctgcggtccataagccttttctgtaaaggactagatattttaagcaggaccagcttcatgggcatggacctgcgcagtggcccagagcctgtgcttagaaagctcctgtgcttggtttaatgctctgcagtcaccacatcgaaacactttatttatttatttatttatttattttgtgcttttttccctttttatctaagtaagaagcgctgctgaatttttcagttgaaactgggcattttgtagccataatgcccagattttaggttttgcaggtcatacactctccgtcacaactactcaactctgccaatgttatacacaaaggggccacggacaatatataaacaatgagcctggctgtgtttccataaaactttatatatggatactgaaatttgaatttcataaaacttttccatgtcatgggatattattcttctttgtttttgttcttccaaccatttcagaatgtaaaaaccattcgtagctctcaacccatataagagcagttaacaggttctatttggcttgtgggtgatagttttctggctgctaccctagggagactcctgcacatgtgcagaaggtaacatatacaagaagttctcagtagaatagtccataaatgctccagaggagaaacaagcaaaagttccctcaaccacagaatggataaatgcattgtattatttatatacaacacacggttgaaagaaagaagcaagtcataaaaggatacatgcagtatgattttatttatgtaaagttcaaaaacaggcatacaaaagtgctgaaatcaaaataaaaaagtaaaagcaaggaaatgatggtgagaaaaatcataataatggttacctctcaggagagggaggtgatggggtgcggacctggcaatgttatatttcttgacttggggtcattattgcattggtgtttactctatattctttgaattagacattttatgtgtatactcggaagtgcacatctcctcactttaaaatttcagttctcattttctaaccctgagttggcatttggagccccactggggtggcgggggacacatgcccaggccacacgtttccaacttcctaaagctcctttgatgtcattttgaagacctttggcatccatctggcctcgggctccacacttcccaagaagagtcttggcttttatacattcagctgtttttcttttcagtttacttttgtttcagacactgatgctgtctgccaaattccctcaaggtcaaatccatattattatgggttccattgtcttgaaacctttctgcttatgaattctatgttttgtaatttcaagatgtaattgtaaataattcaattacattagactgggcagtaaatgcatgtactggccactttccctttgtccctctgttcctcggtgttgattcttttcttaatatttttaccttctggctctctatgtgtagctgtatgttgccattaactcaggcagggctaaattgaaagaaaagaaaatacgtagccgggcgcagtggctcacgcctgtaatcccagcactttgggaggccgaggcaggcggatcacaaggtcagaagatcgagaccatcctgtctaacacggtgaaaccccatctctactaaaaatacaaaaaattagccgggcatggtggcgggcgcttgtagtctcaactactcgggaggctgaggcaggagaatggcgtgaacccgggaggcggaggttgcagtgagcagagatcgcgccactgcactccagcctgggtgacagagcgagactctgtctcaaaaaaaaaaaagaaaagaaaagaaaagaaaatatgtatttgcggttggaaaggaaatgagcttaggagtagaacaactggagtttgaacctctttgcaatctatcagctgtgtgttcatagctagtgacctaacatctgagcttccctttattttatctacagaagtgaaggctaataatgaatactggagagagtcattgtgggaagtagatcagcaaagattaaaccagaaaacatgtgaaatatacctagctcatcacctcagctaccgtgtgacttgtggtagacacacagtaatacattagggttttctcttcttttcttcttttcttccttcctttcttccctccttccctcattcttgtttctttctctttcctttatgttattacttttttccttcatccatccatctatctatccatctccctctcctcctttctcctgcccctccttccccccttggatccccctcccttctttcctttctttctgaacctttgcgatagttttccgtctactgtcaccaatcacgttaacccagcaattgcctaaatagagaaaagatggtaggcaggttggggacaggaaaaatcaaagatggaaacattctgctcatgagcctgggaaaagaggacacaccatattctccactttacttggccatcccattttaaacttcttgtttcccctgaaactcacaggtttgttcaaatctagaaattgcagatctgtagcaagtatcctgtcagaaaatgtaaaaagcctagaagaactgaatcatgattttagggacaaaaattgctttcacgtaaatcacttggaaccctgtctgacctattgtaagcactcaaaaatgttggctattattactattattgttgttgctgtgattattattgttgttcaggacaacatcccagtatgtgcaacggaagttgtaagactattagctgcctcgtttgctaaacgcacacccaggttacaaagaatggcgattctttgataaaagaatggctgattctttgatcatttcccaatttcccccgttgtttcccccttaaacatttcattctgccttttccagaacaaacatcattataatcacttcttgttcacatctctgatatccccatggctcttgctgctctcactggtagtagcaacacctctaaatttactaccatctgcaaatatcattagctattgtttattccctctcccacactattaatgaagatgttaattaagaccagaactaacactgaccccagcagcaatccactagacatttatccaactggataaacttctgttagtcattacccactgctcatagacattaccactactccattctcttcatctgctaatttgtaagagactaggggagagaattaagggagcccaggattatttaaaaattaacaccctgatacttggggttttggaaagggatttggtaaaacatcagaaagacagtcgtcagtggcatgcaggagtaagtgagccagcctcccaaagtatttggtaattgcctggctaagcttatgggtttctaagaatttaggaatgcaccgtaaggctggagtatatagagttttcagtccagccacttcttcttacagatgaccagactgaggcccaaagaggtcaagtgagttgtccaaagttcacctttctagttagtgacagaacctgaattgtaaagtggggctctaactttcagtcctgtgctgtttgtaagaacttagaagcactcaatcttgcttctagaggttctgatctgcgcattagcattttcctaccacattttaacttaaggagcccagtgcctaccgacttcatctttgtgtcttcagcaaactgtctccaataataggagttcattgcatacttagtaaaagaatgggcgttcttcaccaagaggcactattctcttaaactataaattagagttctcaaccctagctaaacattagaatcgcccaggggaacttgtaaaaaagaataccgatgcccacaccacactcgtagcaattctaatttaattggattgaggagaagcccaggcactggtaactttttaaagctccccagatgattctaatgtgcagtggggttgggagccaactcagaggataaaatgtttttccaaagactcctaaactgagaagtttcttgttctatagaaggggttcatacagaatggctgtaacttagcaagtagaagcaaacttttctctcgaacaggaaactggctgctcttcaaaccttttcgttgtgcagaatgtgaattacattgccagctcagaatgatgtggtttggaatctattaatctggtggtggtatttatgcctggcattttttccaaacttaacttttgctctgtaggcagttgtgccaacttaagagtagggctacctctcaggtggtccggaaatgagttactgacttagtataaaaactggcctactagaagtaaagtcatggaaagaacagaggactgaccagtgtcggggttgggtgggagcgggtgggcggtggcggtagtggttcttatttatacgttaatactcgttgtacccattgcagtaacaaatacctgtctgccattggtatgccaatgaagccttagtagatgaggaatgtaggtcaaagacaagataaagaaacacagtctccagcttcttcctggacaagagcccaagaagaatgcaagacagggctttggaaggcttcagaatctgctagtcttctggcatcacacgttgtggtcttttccatttgagggaaacatccctaaatgactaagtgctcaccagcactcacagctgtcagaactggggaatttagagtacccgtgcttggttgtgcaggttgtggactgcccatgggtacctggtgcgtgggagttgaaatctgcaatgagaaggggtgcttccaggaaggatggacagctctctttgtagtttacagaaaggagccacatggaaactggaatgcccaaggagggagaaagatgaaacaggtttccacatctatgtcataagtagcagaggccctcaatgaaaacaggtaggtagtaagacaagcaaagagaaggatcagaagtgctgggaagggactgtgagggactggccacctccccagcacagactccagtgtcagtgccgctcactggttgccaaggctccgataaaacaggaaaataggacaggaagccagtgaaatgtggaaatggggtatctgtagaatagacaataagacccatggaaaaaggaagtctgaggtgggaacattttttatgtgttcactctcccaccaattgaagctgggggctcatccatggctcacgggcttgccagttgctgttacaacctggttctgcttctggggaagacaaagaaagagagggaatctcagcaacagtcgggctaggacaggcatctccatcagtgagtgcttccagatgcactgatgtctcagcccaaaatcccactcaagaaacattgcttagctagagagtgactcctcgggaggaaaaaaaaaaaaaaaaatcagtcattttgacaaggtcaaaataccaagaaaacagcattcccaattgggaagttgtgggtcaggacaatagttcattggaacatactcttttctgtttctcccttcttaagctttttggccatggggcaatttttaatatgtccccgagagcaaaagctctctgggcctgtgaaaacgtatacatggctggattatgggtaagggtctctctcattaaccatttgaaaataaagaacctagataagggggtagaataatggagccaaataatcccacccaagaacaaattatttcaggcagcatttggcttagaaagagtagactactatagggtctgcagtgtttcattactgggactcaaggagcaacaaagtttcccttaggaactgaaaactggggcaagtggcatgaattccctttgcttacacctttggaaagatcaggggaaaagccagtgaaatgagaaggaaggaaggaaggaaggaagacgggaggcagggaggagggaagggaaggaaagaaggaagaaaggaaagaagagaaaaaagaaatagggaggaagaaagaaaaagagggaaggaaggctcgtttattgaacccaggctgcatgccagacattacttttggctttttcatatatgcaatgccacttagttctaaagagaaccccaactgtgaggaaggtgtagcgggctacacatagtcacctagctaataagtggccaattatattcaaaccatgtgtgtctgattttaaaactcctcccttcctctcttgacaagttgtcactaccaactaaatatgcatccatatacacatgtgtatatgcatgtgcatatgtgtgttttataacatcgatgcttcttcatactgcccttatcaccaagcaaccaaacaatgagggtacatttcctatttctgtttttcatactcttctcagactaaatgagttttctcccttcagagttgccccttatgttgttttcatatgtttttgtctgtatattattaaagaaaggagggaaagaaaagggggtgaggccaacggaaataatttgtcctgtttctgttgcctagtgagcatggccgggggggtaggggagtgggtggcgaggggatgccaccattttgccaaccctgtaccacctgactgtgggaattctcagatctgctttagataaacagtttagtcctgtttttcccacaatcttctgacagttgaaatttcccctgttactgtaagtcaaccatccttggagaagtttcgtttcaagtaaccatgctatacttctcttgaaggggaattgaagacctctaccccggtgccagagaaccccctactttctcatttttctctaagaggaggtggaaatgggctggggcgggggagagtgcttatgactgaggctgcagctgccctccctattggatactcagcctcacccttgcagcccagtagagagacgtggccaggttttccctgtagcagacacagatgcttcagaaggagttgctattacaaagggtttattaaaaaaaagtgtgaaagggatgtggctgttggcagggatgctggttccatgctacagcctctgctggctgcagtctggattcttgcctttcctcccttcccactttacaaaggtttaggttcactttataaagaaaagcaatccccaggcaaaagtgtgtacagtattttattaaagtttggtggagaagggaaaaggaagaaaaaggctggattgggagacagggaggagggggctggccacaagagagagggagtgagagaaagagggcaggcatgcatgagagtcccaagcagtgccaagaagcagagaaagggctgcttggggacaagggggggtcggggggggaagtgtgccagaaaccttatagaaagagagcaaagaactgaacatgaagaatggttaaaaactgaagtgcaaatggacttcagcatcttcctggcagagagtgctgcaaacaaaatacaaaataggccaccgtgacaactggaagaaacagaagttttgaggaggcagttaggagatgctacagaaatggcctagcaaataagtaaataaatgccagagtatgctaatatgctgaggacctttaaagagagggagagagagagagaaagagagagagagagagagagagagagaaacactaaggtgcctgagacagagcgacatcaagtgaaagcaaaaacaacagagacagacacacacatacatagccagaccccaagagaggcacacacagagagagtcacacagagagaaagacagaaagggccgagagaggggggtgatgggggtgcgagagtggggtgagagagaaagtctccagccaaatgcgggagacttggcaggtcgacaggagcagccgggccaggcagtaactgcacttgctgtgtctagtctattgttgtctcagaaggggggggtagagggagttgtttgtttgttttgttgtttggcctctttgtctcttttgttccaagcagttagtttgcttctttcccagacactgggctgatggaagagctttatggattttttcttaaagggacagaataagctagttcaccagtattatcgatttctcagtcctaaccagttctacctaaatgactgggtttttttaatagaaggatcctattaataattgagagtcagtgtttatactgttttgtgtgtgattaacaagaataaacgggtcgatttcatcctccccactgaacctcctcctacagggttgccaagactgcagggtaaagaaaggaaagacaaaaaggagaaaaaaaatccgtaactacaaacaaaagcaaatgaagggcatacatactaaaagaactaccaacatacattgctactttcaaaaaagaacaacatagccatcaagattagaaatacaatcttgagggtttaaataaccagcagaagaggggctttgaaggaagaggggtggttggggcattcttcccacacccctacagcctaggcactgcagcttccaccttcggcccttcccagcatccatcctagagaataaaaagcccagctccaggggttctgggagtccgtcttgggccactctcctgagctcggcctccctgggggaactggccattaacacactttcgcggcggaagtgagcgtgttgaagggtacagtcactaaattgaaaggagagctgctttttattcatttgagtagaggtaagagaaaggggcatctccaaagcctttaactttttgttcccacggagactcctagcttcctcctgtcccaataatttaaataggttctagtgcaaaggaggtagcttctgtgggaaatgaaattttaaaacatccccaaattcatctaccctcgattttcaattcctctctaaccttgccctagaacacagccagctctttttcttaatcccatctttctccattcttgccttaaaatctcccagtgaaatctagggtaccggagcttaaaaataaataaatgcaatcaaagggtctgaggctatgcgaaaggtgcagaggagtggagtagggaaagggaagcaggggttcctttgtgaacgggatcctttatcttcgaagcaaacgcaaatcagagccgtgcttctgcgctccgaagtgcggctgccacatttggagagagcgggcagcggctagctctgcgggtttgggggtgcttctcctctgccccatctccgtggagtttggtacttaaaagcccagtgtgtcaaccgctcagacttgaaggtggttaggtaaagagttaagaagcgaggcggcttacacccataactttatcctccccctcacctgtatttttctcccctcacacccctccctcttcaaacggcctttcaaagatgacttaggggttccacgaatgtcgctgcacggttttgcttctcctcgggtgccatttcgaggagcctagaaacttcctgcctttctggttgaccctccgcagggctttctctgacaccgccatggtggcaacatgggccaagtggtacagggaccagcctagcgggtgggaggcctcgcctgtgggctgaggaggcacgaccctgatccccggcgcgcacagtagaagcgggacctgtgctaagccacgggaaggggggcgcgccgcgggcgcggggggcgcgtggggcacgtgttcaccccagcactggaaagagacttgcggtgggcgccggagtcaagtctcctgatgttcatgcggaggggagaggatttgtagccatctttgctctgggtggagatttcatatccgcagtcacacgaggtaaccgacaccccccccccgtaacctgagctaaaggtaaaggtgatcctgaaaccgcttgcccctgggaacgtcgctccggacgggcgtcatctgccacgtgtgataggagccgtctggccaagtggaaaaatctaggctaagcgcagagcacaaccctggcagggtcaagtccgatttcaagcccaacccgatgggattcagaaaagcccgcccagcgtccccaggcccagcagtccacgccacaccgtcggcgacggatttcgtttctattccccgcacgcgccccagcaacgcagaaggagatccagtttcgccacaacgttcccgttggcttgctggtttgaaagttgaagccccggggtagtaaatttggctacaaaatctcaaatctcgttaatcctagacaaaataaaaacataataggccacaaattaactagcttggggcggtttctgtgatggtcacctggcggtgcgcaaggagttatagaaccttgagggggggatcttttctatctctaattacctgtatgtgtaaagaactcaagaagacgtcagaacagggtctcctatcaactgctacctattgctgtctcgcaaacatccccctaaacccgctgcatcgacagcttcgggtgagggtggggtaagaggcacttactgtgaggccgagctcccgcacgaattagcctcacaacaggacctaggtctcctagggagacgaaactaggccagcgaaatcgcggccagggagcccctggcccccactcgggagacaacccgcccggcgcgaagggtgcgtctcctgagctccacgccgggagctggaaggcaggcagacgcgcgaggcttgggaagggtgggatcttaaaaaaaaaaaaaaaatcttaaaaaagagaaataaatttgaacaaaactaaactacaagcccgcagttccccgccgaaagcgaggtgggggaggagggggcgggaacggtcgaggcactgagagtgggggatgagaaacgaactccgtcccctgcacagtcagtgccttcgggggctccaccaccgcgcgctcccaccctcaaggtttggactcctaggggagggagaggacgggagggagaggaggataggtggagggggaagagggactccttttctcctcctgccagcgccagctggggcaaacttgagctggcaaagcgcgagaaaacttttctttggaaagtttaggtagcgcagttagtggcggaggctcagggcaagctaacagtgctggggcgggtgtggagggagtgagctgggtgcgattgggagaggggagaagggagaagggaaggagtggccagctccctaggcggttgaagatccaagtctcttcggtcaggtccgcccaaggtcccagaggcactggggggtcgggtgactgtgcggagtgtaaaagacatttccttaggaaacagacaaggcagggccaggagttccgcggttttttttccgtgcagaaatcactacccggcgacggctcagggcggtagagggcaagtcttatctgccaaggcgggattagattctctcgccgagggtcccagtatcccgccgcccagcaagggccgagcgcgcgcgcgcgccagggagctttggagcgacgcgcgtagtttcgcgtcgcacgcggtgtctggtctccgcgcaccacgtgcgctcgcggtccttggcggggacgttggtgctagcgatccgacagagcacccaggactaggtttttgtgatgccctaacctgggcatttatgctgggggcggaacgaagtcgcccaacccaagttctccctgcaccctgggaaggaaatgtggtgcgccctctggggcgtgaggccgccgcggcccattctacacacctactggcattccgcttttccttactgtgcgccaggggaaggcataattcaattatatcatacaactgcagcgcacccttttccttttttgctttgaggggaattttccaattcccaaataaatacctatggctctaaagccgagttgggttctgtagtaactaccgggggtgaaaaaaaaaaaagaccccaaattggctgtgagtttacagcctgaagcagcttatttaggctcgctgagcgccgttccaaacggcagggctcacgctatttcgggagaagttggagggtggagagaaaacaaggttatttaaagtgactcccagaacgcagctttcgttcctagactctttaggtgtcagtgcttcggctccagtttagcacggcacaggcggcccagcctttgatatttaagccaggccagcgcccgggtgaaactacctgttgggggattctgccgcctggaacccttcttcttctgcgcaatactggcagcagtgggatggctctgggggtgccacgcgaagagagagggcggaagagccgggagcagcggacagtcagctgcatgtggcagtgcctagcgagctgctcccgcgcctctgctcgctctttgaaaactggaaacagccccctgtgctctgtgctgggcccctggctgcggagatgggcccaaactcggcacgattctctaagttcggaaaccacgaagcttgcgccttcatgcgtgtctaacattaaaaacaaaaaaacctcctggcggcttcctgggctcccgcccccaccttgcgctccaacacccggcacttttccctgtaccgaaattcactttactacttcttgaaattcggaaaactccaccgacgcttggactcgctgcaacccaggggctgcctaaagctctcgcacgagttgcttgagggaaatcactctctgctcttgcgagcaaacagatctctgtatttttaaacaatctaactgaatgggggagcgaagctagcgaggacaatttgagcagtctttgtagcctgttgggagaatttttggaagctagcggggtgggggtttggtctcgcatgcgaacctgtgggaaggacagttcaggctgggccctggggctggaagtctcatttgaggagcacacggtcccgagaatggcacgtatttaacaaccttctttagggcaaactctgcaacggagcccgcccgacattaaatttagggggtgtggaagcgtagactgggttcaaccgggaaattttccccgagacgccaaaggcattccgcgttatgtttcccatgcgggtttctgctttttgatagcgaaccccactccgttttgggagcagcgaaattttggagagccccaaagcagggctcgtttggggtccaaagggaagaaaagacttgatctgtggctggggaacagcggcactttatttcctggggcatgcacttacattccctacggccacaaagcacccagctgaaaacgaaatgtgggcaaatattaggtaactacggagaaggagggaagttagcctcatcttgtttaggatactcgctttaacagcgaggactgatgggctatgcggaaaaaagaatttattagtgacaatttcttgcatagggatgagagttgagacttcgagctaaaagacggctcagaacgcttcccgcgcggcagtcccccgcctcccttaaaaaaagtcatcctgtcaatattggctcttaagtcacacccccattaccggtccacagtggcatttcccttccccgtgtgcccctttctatacccactcatctgggctttggattgcccatgatctctccctgcctggaaaaactcgtgcaaacttgcccttcaccaggcacgcacgcacgggtgggctttccccaggagggtcgtttggcggccccggggaccctcctgggcctgggaaacccggagtattttccagcgctcagcctcggtgcctctgtattatttcggttcagtcccaggggccccgacccaaggataataaacaatgccgcttattagagatacaaacgggcacagaaaagaaccacacggaaaagcaaagcacagaggcattttaacaagtggttaggcattcagggcagcctgcgaaagtgacgcaaaattaaaaacgaagggcgtttctctaagaaaaaaacagactttcacagaatgcagattttgttaaaacatgatggttggaactacgtttagtttggttttgcctctggagatcagtcggagttgttgctacctgcccttgcctcgctgcaaatcgccacccccgctgcccccaattcctatagggcgaaagacctgggtggggtggggggggaagttgggggtcttctagctgttggcatgctctgataccgttattccagatctctcaagaattgaaaacacgacctcctctttagggagggacaacaggggctttagggggagatgtataatatcaggcgctgccagatgattcagagatacaaaaaaaattcctctttctttttaaaatgtaaatgcagataccttatgggcgctgatcgtgagagtgggggctagggattcctccctgggtgcgggtgtaaccaatttctggtctgccgatggccttgggaaagggcctcccatctgcttccaacaacccccttacaatgtcagaaaatcttcctgcctgcaaatattggcacaaagctgtttcgacaggcggtgctgctttaaataggaaggagaccgcggggcaaaagaaagtcgcgacctttctacccactagactacctgcctcctatcccccaaaggccaagctttggcaaaggagactcggagggaaatctcccgttctgagtggcgtaggaaatgaatcagctgtgtgttccaggaacaaatctttagttggttttcaggagttggagtgcataaaaaataggtatccccagactagctgctaagcagggagaggatcatgtttgggcatctgcacctcctatggtccagtctccccactttttttggttgttgttaagataaagtttatgctggaagaaacttcagaggtgctttagcccaattctcttgggcagtgggttccttctgactttgccgaaagtaatttgtccaaagggcagctctgctcctggatctgcctagggaggcctggtctcaacagcgccagccctgtgccccatacagaactctcatcctagggagctgggctagggctggctgtgtccgggccagggatgcctggaccttgaatcacaccccttctgcctaccaagggcatctcccctgtcaggaaatgatcgtggtgccaactgcactcaaggaacacctcaaaccttcttttctcacctcccatcctacgctgatggccctatactgttcacacattgtttcctgatttaatttctgtacttgctttagaacttattcagctatctccagccctttctgtctatcctagatgacaacttctcctagaaagagtttctgtctgatgaactcaaacttaagaagcctcccttgcaaagactgtgactgaattttagaaggtatctcaggcattttgggtggtgagcatgttgtcctgtccttctcaccatttttcaaatcaagtggcttgtgtctcattgctttacagataaagaaactgaggcacagattccttcctatgcaggcctttgaaaagcagctactatgtttacatagattccaagggacttgacttactaaaaggcatacatggatctgagagcagagtgtgccacagaccccgggtctcttgatttgaggtcccatttgcccacagttctgacggaagtatatagctaacaataaactactgttgagtgagcatcaactgtgcaccagaccacgtaccatgccagatatgttacataagtcatctttgcagcaacgctaaagagcatcattaaccccaataaaattttaaaaataaaatcataaaaggaacacatgcgtaaatccagatacttcaaataatagaaaacagcataaaatgaaagtaaaagtctcctaccctgctccgtctcctggaattacactgattttttcatttttttttggtgatgtatttgtatatataatagatgttatcattattttatgagtgtggagttgggaggctcaccaccaagataacaaaccatggctacctgtctccgggctcagcacttcccggtactctacattagctaagatgaacgtggaaataaagaagtgagcgaggccacaggtaaaaagaagagtcgggtcagaattgacatcaccgcttcttttgcactgttcctcctgcccctgcctggctcctgagaccacaggctccctcagtgtatgtaatctgatgatcttctatggtggctgcatttcttccaggccttggtgcaattggacaagcaagtgtttccatgctctgtcacccgggccctcagtgctgtttctacgctgtactaggtctggtcctgaggcaagcctctaagctttagatttcactgcttatctctcagcgttgttgagaggctccaataacagacagggaaaggactgtgtaaacttggaatctctctatgtaaacatacagctgcttttcaaaggcctgcataggaaggaccctgtagcctttccctctggaacagaggagtttcaggagtctttgtgaaagagtacgtttttgacatctgagggtttgcattgtgtccgtttgtgtctataggggcagggttaggagtatgtcttaaagtagaagaggatgctcatttattactgaatctttggaatcaggagactttggcaagggtcaagtggatttctttctgctggagggcacacagaggcaagctggtggggttacaaggaggcagttatcctgcttggggtgcaccatgggttggtgagaatggcagaggtatggtgaaggtgctgcagcctgtccctttgggtaggtagctactaccaaaggctgtccttagactgtaggggcagacagagggtggtgagggataggtccaggccgcgtgagcttcccagacatgttatttaatttgtgattgtttttgtgcgtggaaaggggagggatattagaggatagatgtgacagttcttctgggaagctggtcctgttctatagggttcttcattcaggaagaatagccaaaaacatcctgagttcagaggcctgcaagtgagaacaaatggtggaccactgctagggtgtccttggcagagcgggggagctcctggagaggggtctctgaactgctgcatccctgcaccctgagaatctgagcatgaggaggaagcagaaaatggctttaaggcgaatgaagggggctggggagtgggctggttccaatgagagaaactgaaaggagggaagtcagatttttcttgacggcccagtctggcttcattcttcaatacctgtcaggacaaaggctgctgcgccccctggtgtccgactggccgccgatgcctgcgagctgacgtggagacccgcaggcggtgagacccggggaccagctggaggagtccacgggtcagatgccttttcttccatttgctaagggagttgaagttgaaatagccgttgctttgtccgttctagagtccaaatagagactctagtggagagcgagaggggttttgtctttttttttttttttttttgcatgcaattgaggctgacaggacaatgcctgtttagaagtagcctggtgcagtggaaagtacgctcatctgaaagaaaagacctgcattttaggtggagagctgatctggggcaaatcacttaaaatgttccaacctccccttccttctctaaaaaccaaaggggttacagtaagatgtctgtaaggtgttgtctgaactctaatgttgattgggattgattaaatcactaatacaccgcaccctattttctcagagccttgcaaatttgacattattttttcaatctacaggcaggtgcaaatgttatgtttcagcatcatgagttccctaattgtgagcaaagattttagtgtctcctttccttttaaaaataaaaaaatagctcttttgagcacagaacctccctcaccaccaccttttgtggagcctcctgcaagaaagctgcagagtgaacagggcttcagtctctgctctgtttcttttaaaaataaagtactaaagtattgtgctggaaattctgctactaagtgttacatgtggtaggtgtgaatatatgcttcaatagttccaggcacaagaccaaaatcttccccagaattagcagagttttcagctataatctggctaacatttttctacaaataggtacaaagaccaatttgagagtacggtctctctaaggggctacatggttgggtttccattgaaatttagggccatcccttgtacagtcaggtgaatttttaagtgggatcagccctggggaataattatgtagtcgctgagggtttttctctcctaaaatctccaaatctagtttctgaggtgagcagtcagttatacctcatggcaattttttccttcagcattgcatttaaatggttatctctatgtaatgggtactctgtgtgtgtgtgtgtgtgtgtgtgtgtgtgtgtgtgtagaaatggattgtcccgtgaaggatcacttgaacagcaaccttagctttacagatgtgaagggagtgtgtagcccttgtcctgttgtgaacactgtcactattccttgtgcggcaggggaggagcaggtctctctaaatgagagaagcgaaccagaggaagaacagcagcacaaatgagatgacctatagcaaccgacccctgcttcagggatggggagatgctgtgtgtgtgtgagcatgtttgggttggagtaagcacagtgacttggaacactgcacccctccccaaagggaaaagctgtgttacaggctgaactgtgccactccaaaatcacccttgatacctcagaatgtgactgtatttggagatagggcctttaagggggtacttaagttattatgaagtgggccctaatccagtatgactggtggagtccctgtaagaagtgattaggacacagacatgtatagagggaagaccatatgaagacggagtaggtagccatctacaaagaaagaggcctcggaagaaaccaaccctgctgacaacttgatctcagacttgagcccctagaattgtgagaaaataaatttctgctgtttaagccacccaatctgcagtattttgtaatggcaagcgcagcaaaccaatacaacaagatgatactctgcaccagcccattatgtacagccatttggagatgcagacccagggttaccagattctctatttgaagaatcttttgctttttaaatattggcagcagggctggcttcctgggtgtgtgtcctttgcagtcacacgggatcccatacttagaagtgccccacgttggcttaaataccctgcttgcctggccggctgcagtggctcacgcctgtaatcccaacactctgggaggccgaggcaggtggatcacaaggtcaggagttcgagaccatcctgcctaacacggtgaaaccctgtctctactaaaaatacaaagaaattagccagtcgtggtggcgggtgcctgtagtcccagctactccggaggctgaggcaggagaatggcatgaacccgggaggcggagcttgcagtgagctgagatcacgccactgcactgcagcctgggtgacagagcgagactccgcctcaaacaaacaaacaaataaaaaaaaaaaaaaaaggccaatttgcaattcttaaactttcaacaacgggcttgcatttttgcattgcactggtccctcacaaactgtgtggccagtgctagctgacaactagtacacgttttaaataatgtgcatattaagattatggggtcccaaacaaaatatgcctgaggctggggcagcgtgagacactagtacgcactttttgtcactaactggattaaaacttcccattctctggtagtcactaggagggaacttatggatcccagaggttttcttgaagtgggaaaaagaaaggcacagatactccccaggatgttatttcccaagattccacatgagctagtgtggctcggaccaagattttcttttcccagggatggatactgaggatttcacaataagaatatcttgagaaaaggccccacacgaggaactagtgtttggggttgagggctaagtttagccctgcatgtggctgatgctggtgggctttgggaagctggagctgaatatgctacccagaatggtcagcaaggccctgaggggcagtgcagccccgtgtaaaaacagcaccgagacagagcaagaaacaacagtgagagcaggactgatttcgtctcctgttttttgcctggggtttacgagcaggactcctctcttgcactccaccagtttcaggattattaaggggtcctcagctggggtgagttaggagggctgagctggagagtaaaactggatggtctgagggtctgggtgatcctgagcacttaattatgaataatgatacacttcagttttatagtgcatgccataccagtggattctaatttggaagggaaacttttgctcttgctgaaaggaatgtcagtcaccggtgagtggtcatggggctgttatggggagatcctgtttttaaggatatacactgatttatagaagctcactgaaaatattatagcggaatgtttggtcaggaggtctgcttttctagttctatttctgctcagtactggctaactgaagagtgtaaattttaaaagaagtaatttcttatgcacactgtgcaaaatccctcaggggaatgagtgaaagactgtttgaaatgctctgaatttcttggaaaagagttgctgtataaattaatatagggccttctttttcattgcaggtctgcaggacacaccaaagaactcctccaagtcacacaagggagaaaattaacttcattggcttctatcaggaaagctattttttttttcctcttctttcctgcaagtttcccaaaccccatgactctgatttccaggtcagagactaaggttttatttttcttactctgtatactttatatgtggagagtccctgaaggaacactgtgatgggctgattactgtgagccagttgtgggccagacctggcctcaggtgctgcaaagggaattcagtcacccctgtgcagtgatctgtgagccccaagtcagatccaactttttcctgatagacagcaccctcctcctccctaccaagaaatagcagggttggaggtagtgacccaatattcaagaggtttgaaattctacatgagatatttctgagttaactcctaaatagcagtttccttaatcatgtggaaaataagaacacttactaaagagaccattggtttaagagaaatggaaacttatgtccacgtaaaaacctgtaaatgaatgttcacagcagccttttcataatagccaaaaagggaaagcaatccacacgtccatcaaccaatgaatggataaacttaacgtgggatatacgtgtaatggaatgctatttggtgaagaaagaaatgaaatattaatacatgcgttaacaaggatggaccttaaaatatcatgctaagtaagagaagcctgtcacaaaagaatatgtattgtaccattctacttatatgaaattcctagaataggcaattctatagggacagaaactagactagtgattggctagagcttggggagagtttggggagcctggaggatgacagcaaagtggtgcagagtttctttttaggttgattaaatgttgtaaaattaattgtagtgatggttgtgcaactttgtgattttgttaaaaaccattgcattttgccctttaaatggatgaattgcacaatgtgtgaattagacataagtttatttacataattaatatctatttattgatatataactcatatatcaataaatatatactatataaaataattttatatttatataaaatgtgaattatatataaatacataaataaaactgctaaaaactaaaaaatatatactttaaaaaaaggctgttcgtttctttcacattttctgagcacaatcactttgggataaatgtgtccaggcttaaaaagccagattttatgggctaactaaaatggaaatgtgaaaaactgtgtttttttccataggaggagagagtctgatttgcaggtacgtgcatacccacagcagtcatacttgtaattcttggaaactttgctgaaagttttttcctagcctgaaatcattaaaatatgttgaaacaatgacactgaggactgaggtggattcgttgtttttgtcttcccaatgttactttctccttctttaggtagtagcaccccagttttctctaaaagaaaccacacaccctatttccagttcatgtggtttggctattgctgaccttacaccctaggctctatgactcaggccccatcagtcagcgtattttatccagtggtctgttgcagccaactcatatcaactcatccaaatcaactggtaaatgttcagaaatttcatgtgccagttgttaaacactcaccattaaaatttaaagttcacaaccttataattaaattatgttaaaaatgaaggtaatgatacatcaaccttatcatcacttcctaatcatttgactgcattttactattatttatgctcttgagtttacttacatctgttggatctggtagtagaaacaccggataatggcgtgctgctatacatctcttcccaattccatgttcattgacttccctttgatagcttgaagttggccatggtagcagcgtttacactacagaactgggcaaatgctacaagatcagggtataccctttcttgccaaggagattgttaaactggcagctgtagtgggttgaatggtggcccctaaaaagatatgtccaaatcctagcctgtggaacttgtgaatgtgaccttatttgaaaaaaggcctttgcacgtgtgactaggttaaggatcttgagatgaaatcctcctggattatccatgtgggctctatatacaatcatgtgtacccttatgggataaaggcagaagcaatttgacacagacacaccaaagagacataaagataagatgaggaagcaatggccacacaggccgagattgcagtgatgtggccggaaaccaaggaatacctggaggcaccagaagctggatgagaaagaaacaaaatctcccccagagcttccagaggtagcatgaccctgctgacaccttgactttggactagtggcctccataaatgtgagataatcaatttcttttgttttaagccaccagtttttggaaatttgttatgggagccataagaaactattaataatacaccagctcaccactgcagcactagtgtatggttgagggatgggcatgtgatacaagctagggcaatgggaactcagcttctatggtaaaacaaacactctccttctccctggggttgctgggtggttccatctttgctactagatatacctatgaatgaaagcagcgcagaaagtagtaaagttagatttaaagaaagacatttaaagcagcacagaaagtagtaaagttagatttaaagaaaggcattgtttaagaaactggatctattctaccactagatttttaaatattacatattatatgagaaaattattttttttctttttaagccaaattcctaaccaatgtagacatgctaatttttggagaacttttgaaagtgctcatctgcacagagagcattttaaatacatatagttgttatcacttggtcagttactatttaaatgaggcataactaaaaaagacaatcaggaaaatatatagcaaacagtgaacaacttaagacctacctgaattcaatcatgttcatttgtgctacaaacacttatattaagcccaacccttatctaaagcattcgattcaggacagatatccatctatttaagagcttacaatttatttgccagtaagaaatttggtatagcccccatattgaggtcactagcagtatgaacttttcattatatagtttataattttccgaacagttctaaattcaagtaattttattatttttcctaaacagaatttggttaatgcacaattaaaatacttttaattctttatgagattacatttaactacatccacaaattataacaaaaagtattttggcaaattgaatgatttgggtggaaaaatattattatggtgattttctgtttttttcttttttttttttttgagatggagtctcactctgtcgcccaggctggagtgcagtggcgcgatctcggctcactgcaagctccgcctcccgggctcacaccattctcctgcctcagccttctgagcagctgggactacaggcgcccgccaatacgcccggctaattttttgtatttttagtagagacggggtttcaccttgttagccagaatggtctcgatctcctgacctcgtcatccgcccgcctgggcctcccaaagcctgggcctcaagcctgggattacaggcttgagccaccgcgcctggccttatggtgattttcagtgatgttgtacctttggttaattttgtaccttttgataatttttatttgttagtgtggaagagcacttttctgaaaggaacatgtcacagaaaaccccagggatagacatatttcattaattatttttaaaataaaaataaaatgatttacattcagcatttctatctttaatgatttttccaggtttaagagatttcaaattaattttgtcacccataatcctgtttgttttcctccactttcaaatacctttgttttttgatgagcacattttggatgaattcccagtcaactttttaatctaattaaattcagataagtttaactcagataacatttacagtcagctccttgagagttgattaactgggagctcatctttcagaattcttaaaaaaaaaaaaaaaaagacttttgaggattgctttttgctaaaagagcccattactaatgctgatgtcactggcatcagtaaactaacacccacttgtcttggtttaaaatgataataggctttcaaatgcaaatattcaaatatcatattattcttcagcacttctgtatttgctagtagcattactgatcaaaaagagaattgttctgaatattttcatgaacaagcaagcaaaccacatcacatcacatacatgcacacacatgcatgcatgcaaggcacataaatgatttcactaatgacatatagcatacattagtcaagcaattgtattaattcaagtctactctctttgtagtctagaacagtctccctctttgctacacaacagtagccactaaaatcttttggaagattaggatcattcaatatgaagttaaaagaaaacatgaaaaaatgaaagcttagttttaggatttcccatttttttcttagccctgtaatagcctaaaataaaacttgggaacaaatgaggtttaccaatgacaggagtaaacagactcaatgtaaatgtttataggaaaggcaaggaagctaattcctttccattaacaaaaaggagcttttaaatcttactcattcttgataatgctggctaatgagaagcccagcaagtttgctttttccttaaagctgaaacaaaactcaacacaaaaggtgaaatacaaggaaccaaagaaaatcattgatttgttctttgatgacaactttatgccagaggtactagggcctctctacattaattgttttcttcataaggaaaccactatagaaatttaggtgaatggagataattaagtagttctgtggctccaattctaacatgtctttttaaaaaagaaaaaatcaaataccccaacatttgcccaggaaccagaggagaaaaatagccttctaagagttaggccctcaagatatttcaaagctgcctggacaatgacttggaatgactacaatggtgaaccattctgccttggacccaaatctagatttatgacctaatatatctttcccaactctgcctgccatagttttatgaacatcaagaactgggtgtctgccactgtcaacaaatagagcttctccagagcatttccatccacagaaactcaagtatccccaaaggaacatagatcgcagtcttccaaggctgccttgggatgcctcaggatgcctctagctttcaccacaaactgtggggaaactgttttggcaggataattcttcaagaaaaggaagaatacctgttactgccctgtgttttcttggtttaagaacttttggtgaggccaggtcccgtggctcatatctataatcccacacttcaggaggccgaggcagggaggatctcgtaaggccaggaattcgagcccagcctgggcaacatagaaagacacatctctatgacaaatctgaaaattagccaggcatggttctgtgcacctgcagtccccgctacttgggaaggctgaggtgggaggattgcttgggcccaggtcgttgaggctgcagtgagctgggatcctgtcactgcactccagtctgcttgacagagtgaggctctgtttccaaaacacaaaaacaaacaaaaaaaaggactttgggtcagagtagcaagaattcactgagaagaagctaatgaagcttagcttaagggcttctcctttttaggggcctcttccaaactcttgtgcctaattttatatttgtaattttacattcattttattgagtccctttaatataagtatacactctacaaaatggggatctgctagagaaattgcatcaaactgagctagagaagttgcaccaaattttagctcaataaaattgtaaaaattaaaattaaacacaaactctttgtcttttacggacactccctcacccccactcctggcaagtcaccactgggactgagactactccgtttgaggccctggttgtcagttgtcctttcttaactgtggcagtggttcaaaaactggctacagttttcagctttgcccctccttggaagaacactctactgtgggctaattattacaatggcttatagaatctagagaccagacaagtttccaagtgtgctcctccttttggttaagcggtatcattgttccgatgtcaaccaagtttttgttttacagtaaagttgatggatttggactaggcttccatactttcctaagaggtgtttctgaagacccagccatagaaacatttatttttttctgattacgaaagcaatggcatgtatatgtgtgtacatatacatatatatgtgcatgtatatgtgtgtacatatacatatatatgtatatgtacacacataaacatctttaaactttataatatgtagcatagaaagtggaaatcccccgtaatcccacacagctgagaaaagcagttaaaattttttcaaggcatatattaacttttcacttattttacaaaaaaatgggattatactctcaactcaaaagcatgccgttttctatctagcaatatgtcttagacatctttccatgtcagttggtaaaaacttatcatctttttaatcttctattaaatagctccatgaaattgtattgtatggctgaaccatactctccttaaccaattgcctattaattcacctttgagttctttccagtttttcctgtaacaaatattcttgcaaacatcattttactcttaaacatctttgagcagttgtagagtctttctctacagtgaattcccaggagatgaattattattgggtcaaagggtatgagtatttcatttttaatagctattgccaaattgccctccaataattttatacccatttacactcacagccacagtgtaagaaattgtctgtttccccaccctcttagcaaccctaaaatcgtgcaatttgggaatgtctgaagtgagttaggagttaacaggttcagcctgtggagtttttttggctttgtgaagtttgttggctttgtgaaaagccaacgaagagatcaaaagtctctccctttccttgatgaactccctgctctgggtgagccaactgcccagacagacatctagttaatgcgagaggtgaaaattctaatgcttaatactagcgtctggctggatttattagaaacaatttgtctctgaatgtataagaaaatgtgttagtgagaaaatacctaataattattaaagaaatagaaatgggtccttactttttaatataacaacacatttcatcttacagcatcagaatgtttatatctgcacaattctttgatttcattcctacatttattggatcaaaatagttttaaaaatctagtcttcaaaggtgtgtgaaaagtgaccctgagccagccctttaaggaagagcaaggtttgccaatatccagtcttaaagagcacgttttgacagttactatggtttacctctccagaattaggataattgggcattagaataaaaagaaattttaggagttttctagtaaaaacattatcaaactctgctccacataaagcctcagggttgcttcagagagatgagagggtaatggaggaacaagacagcagggtgatttaagagttcttggtaatctaacagcaattccaccacatcaaccccattttgatctgtgccatatagtgggctgtgtattatgttttctgaggcacgttaatttctcattttcattgtctgtaaaataggcctaacaatagttccaatttcagagtagtgaagattaaattaaataacactacccatgtaaagtgcttagcccagtgtcctgcacatgccaaggacttagtaaatgttggctattttatctaagattttgctctgaaacagaattctgctgctaaaaaataaatttcgagaccaccgtttatgtttgtcatctctaaaataagatgattatttcagatgtaatggtttcacattttatttgtttcctgcttcccagtccaatggtcgttttcagaccctctcattcttggaccccagtccaattttgctgagaatgctaaaggctctgaggataatgtgtcttcccacaccccaggagactccactcaccaccaagtgtggccagaccatggctattctgtctgtgttcctgttgatttgtagaagaaagatggtagtacaaaagttttccctgccctgtgggataagatccctgcaggtagaccaggaggaataagcatgacagttgtaaaatcttagaaatattacttagcttccatcttttccataatgatgagttcatctgaaggagttcagaaatagattcttataccttctaagactggctggattttctattcttggccagacgtttgttctaggaagaattcatccaacaaacatatgctcttatcaattattttcttaggaaagcttgtcctagtataggggaagtttttaagtttttctaatgaatcacagacatgaggcaggagggagagagtatcaagcgtgttcctttctgactgatctaacgtgagaccaaaaactatggagtaagagcaaaacctcccaaactgtacatcttttctacccaggaactccttccatgccagtcactgctgatgcctgagagccagatgtgggcttagggatcagtttctctatgtcagggccattcagagtctgtagctgacttaggaacaagtagatgtaaaacctagaattaaaggctgaaaacagcatttaatgaaacccctccctccagacgctcctgatcaaagtctacccttgcactaagacaattgatctacagttgcattatataaaattttggcaacactctgtcctcattgctttcaacagaggctttaggcccctgaatctgggcatcgtcccagaattgagatccagttgcattacgcataccagaagacacaccaccacagccgaggcccgtgcaaccactttcttttaacctcgcgtctgtgaaaaattactttccaaaaaataagtgaaacccgatgtcttctccgggtggttatttttgcgcctatgaagtcaataaaactctccagatttattagacagtcctgctgctgaagacaagaccacttcctattccctagcggatatgtgtgtctttcctttctgtaaccttctgaccacagattttaattttattctttttttttttcttcttgagacagagtcttgctctgtcaaccaggctggagtgcagtgacatgatctcagctcactgcaacctccgccttccaggttcaaatgattctcctgctgcagcctcccgagtagttgggataacaggcacgtgccaccatacctggctagttttttgtatttttagtagagatgggtttcaccatgttggccaggctggtctcgaactcctgacctcttgatgtgcctgcctcggcctcccaaagtgttgggattacaggcatgagccaccgtgcctggatgaattttattctttttaaatttttttcccaaaaaatctgtcagaaccctctaggacaagtggcttggcctgcactgaaattccaatctcttgcactgaagagtgatgaaatgaacacatttcaggcacctccagcttttcttctttacctcctacttcagagggccctgttttctttgcatcagaatcaacaagagttttggctgtctctccttccaccactctaaacgctaaatgtaacacttatcaacaaattatactcctgtaagagtccactaaccctgagttgatgaccatgataatgacattggattcaattctactcagtgcaacagtatttactgggcccctaccctatgcaggtgctctacttgggtatgggaatgcaaaactatagaagataatgtgcattctttcaaggagtgtcaggtctactaggggagacaaacatgttaacaaggaaacattattaattgtgacagtttccatagtgaactcagagtcttgtgtgggtacaaagactaaatatggaaaggctaggaaaggcttttcagatgagatgtctcttgagctgtgtgtttcaagatgagtaggggttcatcaggtgatcctggggaagacatgccaagcagagggactagtaagtgcagagggatcagaggtgtgaaacagaagggcacatctgagatctaagaagttgtgaattgggaatgagggtcaaaaggttgtaagcaacctgtgttcctccatgaatatgggtgtgtattttcgttgatagggaaatgctgagggggtttaagccttagagcaattgatacatgagagggcaaagacttggaagcaacccaaatgcccatcaatgatagactggataaagaaaatgtggcacatatacaccatggaatactatgcagccataaaaaagaatgagttcatgtcctttgcagggacatggatgaagctggaaaccatcattctcagcagactaacacaggaacagaaaaccaaacaccgcacgttctcactcataagagggagttgaacaatgggaacacatggacacacggaggggaacatcacacaccggggcctgtcagggggtgaggggctaagggagggatagcattaggagaaatacctaatgtagatgacaggttgatgggtgcagcaaacctccatggcacgtgtatacctatgtaacaaacctgcacgttctgcacatgtatcccaggtaccaaacatggcacatgtacacttatgtacacctatgtacaccatggcacatgtaccaaacttgggacatgtatacctatgtacaaaacctgcacgttctgcacatgtatcttacgtgtaaagtaagtaaagtaagattaaaaaaaaaaaaaagagagacagagggaaacaagtggctggatgctgtcctgagagaaatgaagagagcttgaactaggccaatgttgagggaatgaagaggaagatttaagatgacagccaagaagcagacataaagaggtagtaatatggtaaagatttccaccccagaatgactttaagtagtttgtatttcattatttatgagtaaaaattactcctgaaatgcttttaaaagttgtttacttactaataaatatttttctgcacttacttccaaaaatgatgtgaggtaggaaaagaactctgtagctacggacagggccaccgtgtttcaccaggcagactggttacggtgcaactgcacacacaactccttggagtggtacagagtggcagccttggccatcttgaactgataagcatttctcgaccattatctttggttcagtcatctgaataacatttaaagagatttataccagtgctatcttgactaacttcagttttgattatcttcatgttaatatgccatattatctcaatttaactggcatcttctttggatgatgtcttctactccattccctcatattttggtgctttcagagagagaaggtgcttatgtctgcatagctcatttagtttgacaaaggaaaggagatgtagtatagcattttgggagtcagatgacccttattgttcccgtgaacttgtgcaaggtacctgagctcagttttcccaactatatagggacaatatcaatgcctacctcacaggtttggtgtaaaaattaaatgaaccaagaatagaaagtgattggcacatatagtaagtgacaggtttttggtactgtgtatcatgcactgtgcctgatacataatatctcattgcaatctagtagttttacagaaaaggaaatttaagctctttgagggtagggtttatttatcattatattcccagaccccagaataatgtctgcctcaaagcagctaagcgaggttaaacagtaactcgtccaaggtcaaacagctagctagtagtatgacgatcagcgttcagacttgtgtctgcatcatttcaagcacagtgatttcccaatcttattgtattaaagaagatgatgtggaagctggtcgaagggctgttctgtgccttcttttactaccagttttcaaattatctaattatcatcgggttaggcttctcaggataattagtttccatctgtatcattaaaagtcatttgcagagtatttccacaggggtccatctcatagccaacagttcttccttctggagccatggttccatgttgttgatgccttctgggtagatctacctaccagagtcttcagaaggtgcttcagctttaacatctccaagccagaactcctcaatcagccccacctctcccttccccacacacaccctcccaaagctctgctttccctcatgtcttgatagatggcatttccatatatctggcactcaagttagagattttggacccaacttctactccttcttttctcctaattagtcaccacgttttattgtttctacctcaaaaaaggttttcaaatctagcttttccttttcatcacagcttctactccttaattcagtacttcaccatctttggcctgatatatttggacagcttcctaattgaccttcttactttcagtcccttccatcaccagcccactgtaggtaaaattagactctcataacctagagcagatcagacattctccatctctgaaaactttgggggctatctctttacccccagggtaagacaaggttatgtcctactgtgtatgactatacttaaaaccaatcccaggcagcttttcctgtcactcaccttgtatgttcttggctttagctattttgaaccattcgccatctccaaacacccagtacattttacgactttgtgcctcccttcaagcagctttctctgcctagaataaccttcacctccttactggctcattcctgaaagcctagctcaatatcacatcctgggtgaagcttttccactcttacccccatcggactcaaggacaattaatggctccctcttcgcatttatcatagcacttccaatatttttatcaaagttagttatttgtatattaatggtctatggagccataaggtcaaggactacttaattcattgatgtaaccccaaccccaacacaagggtagttaactgttttttttagtcaagaaaaaattgtacattggctttttaaaaattaaaggaataagagtgtaaatgataagaggaagccaaatcacgtagaaggtgggataataacagatgtttgagaatgctggtctagcccacagtgtaaatatgtgttaaatttgtgaacatatctactttataaacacttgacttcactgtaggcacaacctggttccataacaaaggtaagaaataaccatgtaaagaacagattcatctcaggatcacacgacactggaactccataaaaatcagatccctcctaatagtgaggttccttcagacttggagactttcttaccctgttatgggtcacctttgccatagggcttttttgacccctgctcttctggaaatgctatcaatttctttgtttaaatgctaatgtccaggctgggcacagtggctcatgcctgtaattccagcagtttgggaggccgaggcgggtggatcacttgaggtcgggagttcaagaccagcctggccaacgtggcgaaaccccatctctacaaaaaatacaaaaattagccgggcatgatggtgggcacctgtaatcccagctattcaggaggctgaggcaggagaatcacttgaacccaggaagcagaggttgcagtgagctgagattgtgccactgcactccagcctgggtgatagagcgagaccctgtctcaaaaaaaccaaaccaaaacaaaacaaacaaacaaacaaacaaacaaaaacacacacacaccaactatatgtccaacctgccagaggaccaaccttttcttatagctatgcaaggcctcagtcatctctggaacttttcatatcttttccatcattatatgttagctttggacatgaggttttacttttatgttgtaggagaaaacactagtataaagaactgtaatactaaaaataatctaagttccttcttcttagggtaggcagtctagaaatccttgttgaagcgttttcagtggtattataggatttgttttgaagaaggtcagatctcactggctggggagtcaggggctataggatctcattctggttctgccactagttacttgggtgatctctgggcaagtcacttagactttagtcctctcctatgtctcagaaataaaaaaggttgcaaattgggaacacctaggctacatttggcccacagaaacacttagtttgcctgtaacagtatttaaatgagttgataatttagttgggaaactttacataagaacataggtttttactttcccttgagaaatcagaagatctggccacaggagtggccattcctattcatttggtagtagctaccccctttaacagggaaggggctctccagggctccagtgactccatcaattcctattgcccttttggtttgccctaaacagagacaaaataccaactgctatttgtcaatgtacttgttctcagcaatattaaaaatatttaactacgaaggaatgggaactgactgattggaatggacactgacttttgtgctagagcagctcctggatgctccccactctgctccaattggtcatggggaggtccaagaactcttggaagagaagctgaggatgagcctcactcggtgagcttagagcaccatctctacatgagttggtaaggaccatcccaatctcaggtgcgcaccatctgaatgtcagccctgccaaaactgttttttttttcaaagtggagatagatatttccatacccatggctcttattgaaaacaagaaaatgaaataaaaatagaaaaaaaaagcagaacgatttttcgtgctctggcttgctttgttcatttatgaactggcctctataaacatctgagtttgatttcctggtactaaccaacctaaaactctcttccagcttaagcataaggagcctctaattttatccattttataaatggagtgaaaattttgcaaaacatgttgaagagagggcattatacagaatttatataagatctaaaccactgatcgaaataataaatcaccaataaattatctctgttttcttatcaagcttttcaattttaaaagcactttgatgttctttttctttttttcatttttcatttagctgtggctatttttcaaatggaattaatgaccaaaagctagccttattctctaattacagtaagagacactagacaggagttgttccagacactgacccatcttggctcagggagaggctctgggcggttttactgtgtgctggcttagtacctggggccaggaaacatctgttataacatgtggtccagcgggtgccctgcttaattataaaatggcattgcagtgtccctttgagttggctggctgtagcttctaatgctatgctatcaagcaaaatgtaattcttgatgtcctgtgaactgaacctctaactcaagtgttgaatcactcagagaagaataaaaaaagttaaacctttgccctcaggaaaaaggtatagggaaagacaaaacaaagaaatgctttctaacagcaactgagaagcttagatatgagcaagcatcccttatacagggaacggtggtggggggtggggactgattccagaatgactcacacttctagaatgagctgtttatatagcgtttcctcctcttcattccagggatcctgttaggaaggtcagggacaatgacaatcaagaagcaaagggaacactggagaagggtggtgggaatgcttggaacaccaaaagattcattcaccttgaataagaggacagatttctgtaaagggttatgcaatcagctgtggcccaggacctaacaatttattgttggaacatgtacacctgggaattctttttacagtggtgtgaatctcttattagcatttatgagaacttaccttcccaaatcctcttatatgcagatgggagtatagagcccattgccagcagtgtctgcttaggaatatcttttgtcttatagcctgttgtaatcacttccagaccagtggtatatttatgatttacatcatgttacagaggaataagtcttaaggattcttttctctaaatctttttgaattattgttttagactcattgccaggtttttttttaaagggggaagttgatgaacttttaaatatgtcattacatgctccaaaatggcaactctttgttcttttacagtttcttgtagaaagacatttaaagggctgtgtgtgtccacatgagtgtgtgtgtgtgtgtgtgtgtgtgtgtgtgtgtgtggtgtttagaaacaggtagataaagaaaatgagtgaaaaggaacacctgaagttcatattttgtgtttttgttggaataagatttggcaggtttgggggaatcttatctaacatttggggagagtttaggaagggcagatccacattcattttaattatgtttcaatcaccaggggcagcaactgaagggttaagccctaaagcaaggaaatatctctaagtcagaaaacaaagggaaacttgcatatttctgaagatgacatcggatcagcttgtggatttcaagcaattatgcgatgtgatgattcccactgagtatgcgttagttggaatactgttctttttatttctccatgtcctggggttgtacactgaaagagccctgttcaacttcgaatgtcagggttttgaaggcaaaattatagtaaaatatgttttaaaacagtggggccttatatgagtgaatataacattttccaaggctttcaaaaatccttttgttaaaaatacggttcttattttgtttcttctttcctttctttctttttaaattattttcttttattcaggcttttgcctcccctccttcccaaagaaaagaagagagaagtttcaaaggatatctataacccagtctacatttagggcctggggacacataatggagttattttaaatgggacaccccacatggaaaataagtgagaaaagttcatctgtgtctgttacttcagtaccagcagcaatggtgacagtcatagtatctcagtaaatgtcccctagagtcatcttgtgagaaaaatgattattaattgaggtttctgtgagttgagaaatgggttgtttacaaaggagagaaacttttttagagtacaagcagctgaagtctcagctcaggagttgctctaaaagaagaaatgtcttttaaaaattgaattaattaaaaacaaagccaggcacagaggctcacgcctgtagtcccagcactttgtgaggctgaagcgggtggatcacttgcggtcgggagttcgagaccagcctggccaacatggtgaaaccctgtctctactaaaaatacaaaaattacacagcaatggtggcatgtgcttgtagatccagttactcaggaagctgaggcaggaaaatcacttgaatcagggaggcagaggttgcagtgagacaagattgcgccactgcactccagcctgggcaacagagctagactctgtctcaaaataaataaataaataaataaataaaggaattaattaaaaacaaaacaaaaagcaggcatagcaaaaggcatagtttaggaatgatgatgaatgaatgtcacgtttattttattacatgctatgcttcctcccaaaggagagaagtagtttgttcagtaaggatttgtatttaactggcagtaacagagaccagacttcaatgtcttaaacatccaagacttattcccaacataagagaaactctacctctggatgcacagggctcatatagtggttcctcagagtcatcagagccctaggctctttctatctctctgctcttccagtcttaggccatgatatccctctagttatcatttattctctccaatcatgaaaaaggaaaagaggaaggcaaaatgagaacccctcctagcttagttagttccttttaaggagcttctccagaagtacctggggacagggccaggtgcagtggctcatgcctgtaatcccagcactttgggaggccaaggtgggtggatcacaaggtcagcagttcgagaccagcctgaccaacatggtgaaaccccgtctctactaaaaatacaaacaaattatctgggcgtggaggtgggcacctgcaatcccagcgacttgggaggccgaggcagaagaatcgcttgaaaccggaaggtggaggttgcagtgagctgagattgcaccactgcactctagcctgggcaaaaagagcaaaaactccatctcaaaaaaaaaaaagaaaaacctgggaacattttcacttacagctcattggtcagacctttgacacacggccacacttagctgcaagggaacctggtaagggaatcttttaagaggaaaaattactgtcccaaatgaagtcagagttctgttactagtaataacagaagagcaagtatgggatgggaaattaaaagtccttgtcatactcacatataacatccttagagctgatacatcatccaaggcttattcactgcttccgtttgaattatgtggtgtttaaggcactagcttgagaacccagtctgctgtgcattatctcagagtacatggccaaaataaatactttcacacatcactgattgtttcttcatttgagtagtttaagctatggaactttttaaaaaaagagatgggtcttgctaagttgtccaggctggagggcagtggctatgcacaggcatgaccatagcacactacagtcttaaactcctgggctcaagtgatcctcccacttcagcctcccaaatggctgggactacagggatgccaccatgttcagtttaagctatggaactttttgtgtgcataactaaagagcagaaaattccacattactgttggagcttacaatcatgttttaaacataatttttaaaaaagttaacattttggaatatttgtgggcttataaatgaaaaaaggaagaaatagtaaagagtagcttcaacttagaagacactatttcctgcagggatgaccactgtaccctcaaatatcttcactgcttgaatatcttcacttctctctttcatactgcttaacattccactggttaaagagcacttctaaaagtgtcattttttttttttttttgatacagggtttcactctgtcgttcagggtggagtgcagtggcatgatctctgctcattgcaacctccgcctcccaggttcaagtgattctcctccgtcaacctccccagtagctgggattacagatggaagctaccacgcccagctgatttttatatttttgggtagagacagggtttcaccatgttggccaggctgatctcaaattcctgacctcaggtgatccgctcacctcagcctcccaaggtgctgggattacaggcatgagccactgcgcctggcttaaaagtgccattttttttaaaaaaagagagaaagttattactcattcaaaaatctgtgtcacttactttaatcagattgccttcctacaatgatacaacttcactgcatggaaggtgtttatctgtctagtttttcttctcatttgagaaataaaatatactcaaggccaaaatttcaatctgaccaaaaagatatactgtataaaataaatcacctttcaccccaaattctgagattctttccctccatgaagcaataataagtaaacggtttgtgggtattattgaagagatatactctgcatgcttaagtatacacaagtgttaacacacatacacatacccacaatgcaaatatataaaaattcttttgtttcacccaaatgagcatgtagtgtgtgtattattatgtgccatttaaagacagagtctcactctgttcccaagactggggtgcaatgggatgatcaaagctcactccagcctcaaactcctggattaatccttacgcctcagccttctgagtagccaggactacaagtgcacaccaccacacctggctattttttcttttatttttcctagaaatggggtcttgctctattgtctatgcttgtctctattcctgacctcaagtcatctcctgcctcagtctcccaaagtgctaggattacaggcaagagccaccgtgcctggcctggagaatgcttttcatcagcacctatacccagtacattaaaagaaaagactctgttaaagtagaagcttttggtaggggaagagaatactgtatttttgaaagacggagcattttgtttcaatattttattgtgaaggttatagcagcctagggcttataaaggaaaattttaagaggaaggaaaagggtggattgacctggaactctattgacctaatagctagctgtgcccaggccccaaatgtagactgggttatagatatcctttgaaacttctctcttcttttctttgggaagaagcggaggtgaaagcctgaataaaagaaaataatttaaaaagaacttctgaatttccctaagacaatccccacttacgcctattttcctatgatagtttttaatagtccccactttcatcctcaaagtggtcccagtttggatgacaaatctgtgatcactctagtagtgatcactctagtagtaactaatggacagattaactagctaggatcagctgaaaggattacaaaggtgctccacaccagctgagggtgggggcttgtctggatgagacattggctcacatttttatgagtggcatgatctgattaagttaattaactactgttttcctcagtttcctctgctttccaaagggaataataattgcttcagaatggtattataaacatttcataaaggaatgcacgtgagagatttatctggttcatatttaggctcaatatctggttcatatgtagggctcaataaatgcagctatttatattacttattattttcacatccctccttccaactactttattcttttctttctttcgttctttttttgttttgagatggagtctcgctctgtcaccaggctggagtgcagtggcgcaattttggctcactgcaacctccgcctcccgggttcaagcgattctcctgcctcagcctcctgagtagctgggactataggcacgcgccaccacgcccagctagtttttgtatttttagtagagacggggtttcaccatatcggccaggatggactcaatctcctgaccttgcaatccacccgcatgggcctcccaaagtgttgggattacaggcgtgagccaccacacccagccccaattactttattcttacacagcacaaaatgttattgattagggtttgtttaggtgaacaggcatcatctgcaaaaatgggtcatggtacagccacttaagaagaaaaaaatgaggtaagcataggaccgtgattgttacctggagggacctatcccatccctgcccaccctccggccctacagaagagataaatcagggtgtagtttgaaaacacagcagcaccttgtacttctgatttgatttgaccttggttttgatgtgaaaaatttttaaagttcagtaacattgagaaggatggaagcctcccacaattaacaaagaagaaaggcatttgagatgatagagaggcacgcattgttgctatctgtattacacaagcagagttcacaggtattcacaacctgttgatgatggaattacctcaaagagagggctcagaacttataaccaatcacctctcagcatatcttaccatctggtgtatctctctttctacatttattacttcaccccatatcgtcccttcatgactctgtttctaataccaaacaatgaatgacaattgtttgctgagacaacctgaaactcctgaggccttttagggaaggataaaggaagcttgactgagcaggagtgggagtggaaagacagagctattgaaagagcaggaacaggtattttacttcatattcattttcttaaaattgaattatgtttctgtgaaaagctgctgtgtaaaataacaacctctttatggtttcaccagctgagacataaaagactatttgtggtgtgctgtaagatccgaatgcaggtgaaaattcccccacttactcgctattttaacgaaaataagaataatgttttgtaaataacctgactcataaggatctcaaagtccttatgtcactgtggtattatatcgtcactttggctctgcatgagagggttacaagagagcttaatttacaatcacactgcagaatttccttctttttcttcttaggttatcagattttatttatttatttatttatttttggagatggagttttgctcttgtcgcccaggctggagtgcaatggcataatcttggctcactgcaacctccgcctcccgggttcaagcaattctcctacctcagcctcccgagtagctggaattacaggtgcctgccaccacacccagctagtttttgtatttttagtagagacggggtttcaccatgttggccaggctggtctcgaactcctgacctcaggtgatccgcccacttcagcctcccaaagtactgggattacaggtgtgagccaccgcacccagtcagattttttttttttaattgaagaaaacaaagtctcatttgaccctttgggaacaggatataggaatatttctggcttctgccattacttcttattcaaataatatacaattttctaaacacatttaaaataatggactcaatccaataaatagactcacctctgctgctactacaagttagtggaaaattctgaatgacaggcagcaccacaaaaactcccttttaccaaggtctgcaatgcttctgggtcttccaccatgagaagctccatggaagcaagggaaagccagttcaaccacaatcactgaggtgatgaaggggtttacaaaaggggaattcagagctgagggctaaaggcaaaatgtaaaaacaaactaggactgatgcttgcctaatactttcaccagaatttggcccaataaaatggtgatgtaaatagaaaaatgtatcggcacaggttaaaactaaagggaaatgtcttcattcactttgcatcaattccgaatttatccatatagaaaacaaggaagtcacataatcctcctagagtcaagaacactgagtatacatgggaaatgattagagcaagctcttcatttatgataacaaattacaggaagcagctgtctaataaatccaaaaaaaatgttgttcttatcttgcctggacaccccccgcctctatccttatgccagcacattaaactattttggagagtagcaatgaccaggagcatggtgctttttatacatgatctctcatccacacaatcactctgcagaggagctattgccatccctgtttcttctaaaaagagtctcagtgactgcacaaagccacacaaccaggaaggggccaagcagggattcgaactaaaggtggtagaagctaggtgctgtcactaattcacctcatctgttcttccagcactcagatctcctccatactgagtggaggcccctgttccctaaccttaaattttcctccttcattgttcatctgatttcctgttccgggaggcaaatgttgcagtgagccgagatcgcgccactgcactccagcctgggcaacagagcgagactccgtctcaaaaaaaaaaaaaaaaaaaaaaagataattataataatgcctatttgtataccttctgtatttggtgtgaatctgtacaccatcatggatgcaaaaagcattttcttgtgtttctttctttttcttttttctttttgagacagagtctccctctgtcgcccaggctggagtgcagtggtgcagtcttggcttattgcaacctccacctcctgggctcaagcaatcctcccacctcagcctcctgaagagctgagaccataggcatatgccaccatgcccagctaattttttaatttttgtagagacggggttttaccatgttgcctaggttggtcttgaactcctgggctcaagtgatctggttgtctcagcctcccaaagtgctaggattacaggtgtgagccaccacacttgcctgaaaagcattttctaaactgtaacgattttttaaatagtaattatcattactttggaccaatgtctgggaattctaaggaagtcatagacatacatgatgcaaatacatccaggcagctggtgtcattttgtgactaagagcaagtgtgcactgtgtggaagaagaaatttttttacctacggcctaggacaggccaataatataattgggatttggggcaattaaggcaacatcaggcaagaacagtatctggagaagcaatgaaagaacccagtggaaattcacgtttactagaatgtaagctctgaaagggcagggtaccagaaccgtgccttgcacatagcagccactcacaaaaatatcggttgaatgaatgaataagggtgaaacgttttgagtgctcctaattcaagtcccttacagagggcaactaagagagtggtaccaagatgtttgcataaagcaccagcctttcaggtctggcttagctggaaaaaatgctaaaaacctgagaatttgtttgttggtttgttttttaagagggaagttaaaataggcccttgtagtttgctttcgactagcttgtctctcccattaaaatctaaggtccctgagggcagacaaaaaggcaactggcctctagtaggtacccagtcactactagctgaattgttgagttagcttcctaaaaaagttataaagtcttggagataccctctggaaggcaattcttttcgaagcaaagaagaggcttcttgacgagtggatgaataactagctcatgtttgagaacacagcaaggaatgtgcagcttctgtacaattgttgacggcaccagggaggcagaaagtgatgagagagagagagagagagggagagagagggagataggagtctgtccatttgtggttcttatttatttggaagatgaccgatccactcttcccagtagaatataagtaagtactgttgcagtgtcaggggagagaggtgactatattttgctggccacagggccagctcagagcctgacatgcagcctggctcaatagggaattgtttggaactaccattttggaaaatagtttggcattatctagtaagacaggcacaccctcagtaaaaatcctcaataagctcttgcacgagggtagcaggttacgtgtgcaaggaagctcctagcagcactgtttgtaacagcccccaaatgcaaccaacatgtgtctatcaataggataaccaaaaaaagtcatatattcacccaagggactattacacatcaagaaagatgattggaataaatgaactgtagctgcactactagaaaaatgcaacacatagagaatgaaagtccaggaagaaaaagcaagcaaataaagcaagggatggtagaagcttttgcagaaaaaaccatcctggtgatactagatgtcttgaatattgagtttctcaggctgggtatctggaagcctcccaacagaatacagcacaatttggagagaagtagctaactaatatcagcttatccttggcctcaataaaaccagtgtggaactcttaagagaaggattattaggccaaaggaatatgacaaaaaattgaaaatgaaaggtaataggttcactctgtctttgaaactcttacctacagtttaataaagaaagctcggtagcaaattcaatgagaaatagctgcaaattatctaatatgtgaagtttaactgcttagttagtctgtttacagctttattcataggacagttattgagtaactctcaaattaaactccttgtttgagggcccagatactgaaatacaggtatatcctagtacactattgattatatttttggtgcccagaaagggtggatctgtttgcctcctgggttgaaaggaaggaggtattctagaattaataattcaaatagggctgttacaccaggaggagagaaaagagtgtcaaggcggtgctaagaatctgggaaacctgccagcatggtttgcatgatgagtgtgggtaaaaatataaagagaaacatggtccagtggttgatttgtttcctcttcctttataagggtggtttacttttaagcaaaattatgtgattctttttcaagttctgttaagaacatagttgataacagatctcttttaagaccagagtttctgcaagcatcatgcccgaccataagagaatttgatcactttgtgttttcctgcacctttcatcatggcagagagcgtactctgaagatttacatgggatcatctcttctctggccaccttgtggaatgcaaactatatcgccatatctaaaggggagcccattacaatttacaaattaaaagtcagtgggaaagaacataatcttggcaactgcctcttgggaaatcttacaactgcaagagcgccatggaagagcgctttaaataccatcgtgtttcatccaatctcctcacaattgtataggagggcatgtggccaaggccttgcagagaaaaggccggggtgcccaggctcgtgattggctggggggcgtgatgcttaagcgagccacttagcccgctcttgcttcatgaggagcacgccacatgcttctttgcaccttcttttaaatccttgtgtggttggcatttggaaaaatatcgactgcaaccagaagtcgcaatcctgatgacagctcccgaaatctcatctttctcgcagcaacatctactgtcagctccccacccctgttacaagagagccttccccacccaagttgtgctccaaatagaaagaatttcagatgtacatatttggctctctcctctagaggccttgacaaatattcaggtagtaaacagcctgagagaaatgctgcgataaaattagttcaaatatttcccagaaaacaaacctgacaccaccatgatacttgatagctcagcctcagcactttcgaacctttccaaacccctttgccttcaaagcccaaatgtcctgttttaaattgcttttatttttctcctttccaaacctgatccttgctacttcctcctctcaaaaaaagaaccatatggtaatagagtagattgtccaaccagggattttacattacaaatgactacgttgaaggttaatatccaaggtcaggtgtcattaatatctatttgaattttgttcttctggttgatgatatgatctcagtcacctcattgatttataacatggtaatcccataccatcattcattttcctgaaattctattcatggcctggtatcaaaccctctctttcatacccttttcgttttgtctgatcagtagctttacagtccttgcatttatctccttcccacaggtcacactacaccttgcatccaagattgtttgattgattttcaccttctctttttcctaaatcttactgtagaaaaaaaaatgttaacccttctcttgagtattttacagtacttcactctccaaagccagttcacatcttgattttcaggtaagtagcctctgtaagtacataggcttgctgatttgtctgtatcaaatatgaggcattcgctccaacttagctaaagttcttggactcaaactcctagcaagagctaacaatcctcagggctcactatgtgctagccactgggctcagggctttgatggattcttatctcatcctcacaaaactcctgtgggggtttgtgtcattatttcacccactcagccgatgaggaaactaaagttcagagaggctaaggaacttaaccaagatcaggccgcatagtaactggcaaacttgggacccaagccccacagtccatctatttacaaaccttgtggatatcactaactttcaaactgccttcttctaactattaaagtgaaaatttgtggccagttattatagatgatacagccatcatacagagggggttgggaggcctttgcaaaacacatattatttgtaaaattatctctgcacctggcatacctacatacaaatatttttcttatacatctaaacataaaattaacttttaaaaagcatttgaaatgtcgcatatgttaatatgaataacacagacaattcttacttagaaggaaggaaaaaaacccaccaatattcctagcaactcagagaccaccacagttaacatttaggtatacagccttcttgccatttttctgagcatgagcacaatttatatatttgtaatcttttataaatcacttcttcacaggtattttctacttttatggttgtcatcatttctaatatgggatcagagacacagtggaatcttttttttttttttttgaaacagagtgtttctctgtttcccaggctggagtgcagtggtgcaatctcagctcactgaaacctccatttcccgggttcaagtgattctcctgtctcagccttttgagtagttaggattacaggcatgttccacggcacccagctaatttttgtatgttcagtagagacagggtttcgccatgttttccaggctggtctcaaactcctgacctcaggtgatctacccaccttggcctcccaaagtgctggaattacagacatgagccaccacactcggtgacacggtggaattttgataaatgtgctgaatcattagatgaaatctagtcattcattaataatttcattaggtttttgagtatatattacatacacttgtccaaaatttaaatgtagcataatatatgtagcaaacatctccctcctactcctgactcataaggataccttgctctccagagcttgaaagcctaagttcccaaatatcttagtacccacaacttaggagcatatgcttggatgagttagtttcttaaattctgaacccaaaagaacagagtccatcaagaaactctgcccctagcaaaagtccaacttcgaaggtcctgtctcctgccttaggactccaggtcctcaggtgagtgacacacccttctgaagagcactatcttacgctacaggacccaagaattgatcataataccaagcaccacaataattcccacattatttaagagatgctcataaaggggggagaaatatttttatcatgcattctcacagaggaactcatgagagcctcttaggggacaaaatcaatcagtgttattatttctgctttaagccagtggaatctctttactatatgccagtgtttaaagttcagtatgatgaatgttagtgcttctatttttatatatttattagattgtatagacaaagtaccagcccaggggaagacagccttggagactggaggggaatatttttaaatgtagaaattctcaaagtccattccatagaatatcagctccttggtgtgttattaggtgctccatagcaaaggagggttccacagacaaatatgtttagaaaatgctcattaaaggaaagtcggttgcatttttaattgcaagacttaacagaacttttaatatcacactgtaaactctgaaattttaagaggagaaaaaatgtaaaatgaaactgaccacagaatgcttttcaaggactagggttccacacagcaaactttgggaaatggtgtgagattctgacagctttggcactaaaaaggtgtatgacttggggttaggtgactaactgttcatcactgtgtgtcagtttaatcaggtaattaagtaaccaacatcaacaaattattttttatactggcttttgccagtaactattagaagcagatatagaagacctgtgaaatcttgggttcagacgagtgttcttttcaatcttgctgtactgctttagagtagcaagcacggtgacatcatttggtactaaaatattattactatgcaaccatgagcctcacatttctccacttgaaacataactaaaaattaaaagcttttgagaaaagtgattctaaaataaagttaaatgtaagccaggtattggagtaaaatatttgcaatgcatataacctacacaatattagcatccagaatacatacagtcattaaaaatcagtgagaagaagaaacaaacaactcaatggaaaaatgagcaaaggatagaaattgaggattcataagctataaacatatgccagtaaacatatgaaaagactttctaacttattaggaaaatgcaaattaagacaagatatcatttcacatctatcagaccagcaaaaaattttccagtctgacaaggtaggcatggggattggtacaataattcttagaatattttagcaatacttacagagttaattaagtgtgcttactctacgacacaggatggccacttctaggttatttcttggggcagtattttccaatttccccattatgacacacatagagaaagataatactcatagagcacagtggggtaagccgaggaggctgctcatagcaggaggtgcccatttagggggctgtggtcacctcaggtcccacttcttctacccaactgtgaggcactgctatacagaattgtatataagctctgccctagagaagcttatttctgtgtgctcaagaagatgtacaaaaatgtgtaccacagtatttttatcataccaaaagccaagcaaaacaaaatgagaaaaacaacttagatgcccatcagtaagggaatgcataaaagtattataggatactacagttaatattaatagcttgaattacaaggatgagttgcaaaagcataatgttcagtaagaaaagaaaaatgcagccaggtgtggtggtatgcacctgtagtcccagctacatggaggaggctggggtgggaggattaattgagcctgggaggttgaggctgcagtcagctgtgatgacgccacagaatgagaccttttcaaaaagagaaagaaagaaggaaggaaggaaggaaggaaggaaggaaggaaggaaggaaggaaggaaggaaggaaggagagagaaagagagagggagaaaaaagagagaaagaaaaagagagagagagagagaaagagagagagagagaaagtaaggagggaagggagggagagagggaagggaaggagggaaaaatgcaaaagaatacatgtgctatgatactcagtgtacaaaaccttaaaaccatcaaaagtctatatacctacatagtaaacatataaaaattatgaatggggaggatatgaccaacttctagatagcaattgcctctggaaacggaggagaggcagtgggatttgatagtggatgaggaagtctaaggatatctgtgacattgtatttcttaaaaaataaaaataaaacaaatgtggcaataagtttatgtgttcaatctaggtagtaaatacatagttttaaaatacattttcactatttgtgtatatgacatgtcttgtaattaaaaaacaggaataactagatcaatggtttcaagcctggatgtatattagaattacaaggaagtttttaaaatttttcatgctggggctgtatcagagaccaattaaatcagaaacttaagggttggggcctggacattgcattgtttaaaagcttctccagtgatcatagtgtgtagctttggatcaagaactgcaatattagatgatcgcaaaggtttctttcaaacaacattttctgtttctaaacattttaattgcagtttcctcatatggcttcatgtgaacacaattgtgtgtaacatgaagttaggccctgttaatattcactgagaactttccttctgtcacaaccacttatcttttcctggtgctcatgattcttttgttttctagaatcacatgtttctcctctcccatttaagttgttgttcatccctccccctttctcctcccacctttctgagtccatcccaacaagcaattcatccaagcaccacaaatttaagctctgagtcattcatatgcattgcttttgaacatattaaatagatccatatgcttatctatactaagatatagatttttccttcagaaaatagaatacaaaaaaatcattccaatgtgtacactttaaatattttaagcaggcatctaaaacgaagcagaaattaaagtaacttggaccagaattttgaacattaaaacattacagcaaattggtaaaacataaaccaaatatatagatgtctactttatatccaaaaaagttactctttccctgccatacacacagacaactctcataatgggtcctcctcaattagagttggatcacaagcagaacagtaatcagtgtggcctttcccagcatttccacccccaaagactctttattatccttcccaacttcagaaatttctatgacatcatcatcaaccaatcagagcttctaatggtttgaaataactgatgtagccagacacattgagttgatatagaatcaaagaaatgtgacattctccttagtctgggcagttgtgtcatggataaacatatgatttccattagatttctcaaaacacggaaaaatcgctttcagaccttagcactacctctgaagatacttattttagattagaactactaactaaagtgccattgtcttaaaccctaccaaaatctgatctcagggacagtaagaaaaggaatgctgaaatacaatatatgtcaacagaccaggaaaacttccagcaccacttaaagttcattggaaagcagactgatgcccccaaaggaaaaaaaggcaagcaatcatgccacagttataacaacagacagatctgagttttatgtggatcctacagttttctaaggcatgaccttgggcagattactttaccattctaagcttcagtttccttatatataaaatggagaaaataaaaatacttccatacctgatgcccagatctaaatggctaattttgggggaaaggaatgtacaagagaagcctgaagcatcttgcaatgccagaaagtaaggaaggactaaaaaaaattgatatgtcaaaggaatatgagggtaaactaaaagagtaaactcaagtgtaagagtaaactaaaagagctctcaacagacaaagttgtcataatttgatttttaaaaatttggtactaaatgcaatagactgaatttttgtgtcctcccaaaattcatatgttgaaacctaattccctgtgtgatgttatttggaggtgaagcttttggaaggttattaggttatgaaagtggagccctcatgaatgggatcagtgcctttttaaaaaagatccagagagctccctcggttcttcttctatgtgagaacacagtgagaagatggccatctatgaaccaagaagtgggcccccaccacacatcaaatctgctggcacattgatctggggcttcctggcctccagaactctaagaaatagatttctgttgtttttaagccacctagtctatggtattctattacagtagcctaaacagactaagactttggattataaccaaaagtgaagcacaaaatttcttgagttcatactgatataacaaaatgattgcatatataaagaaatggggggtggaatagacacatttcacatacagaagaatatcaatttgtacagatactttcccctcaaaaaggtggaatataactccctaccccttaagcatgggctgtgcttagacattttcttttaaagagtaaagtatagagagaagacagcaggagagtaactttttagcggagaaacctgacaaatactaccttgtcattggttcaaactcaatattatcagtgataaatcatgatggtagcaggaatcctttatatgatgtgatggacactttatctctgtggtcttgttagggtaggtagttaggcagacaagaccagtgcaggagatgccccccccccaccccccgcccgcttccaggaatgtcaggtgaccattaggtgatgatcaggtggttcttaaactgtctctctaaattaatagttggtcagagctggtaccagggaaaggcagtctcccaatagataggaaggaaacacctgaagctggtaatcagcagcttcctgataagatctcagaagttgggtgagcaggctcaagcatgtgcactaagaggatttaaatgaaatatgacttttctccaggaaccatggactggtaagggaaaaatgcctcgagtgagcacacgtacaacttcagtaaacacactgtgcatgtggcccctccaaagtgctgacaggccactgtgcatgtgcatagcccaccccaagggaagaatcaggggagaaaaaaaacacagaccctggaaccatgccaatgtataaaaccccaagtccagggctgaacaggacactgagaactctcaagttgcctacttggccctcttccaagagtactttgcttcctttcactcctgctctaaaacttttgaataaacgtttactcacttctgctctaagactggcctcagtccctccctctgccttatacctacttctggccgtcagctgaattctttcctccaaggaaacaagaatcaagtttgctgaagacccaggtggattctctgctggtaacagacttcctcccaaaaacccatcacccggtataatcatgagagaaattaaattaagaaacattctatacaatacctgaccaatatgcctcaaaacttacaaggttatcaaaaacaaggaaagtctgagaaactgccacagccaagaggagccaaagaagacataatgactaaatataacgtggcatcctggatgtgaccctggggtagaaaaagggtattaggtaaaaaaatgaagaaatttgaatatagatggacttcaggtgatcattgtctatcaacattggtttctgaattgtgacaaaatgtaccatactaaagtaagatgttaataatcaggacaacagagtggagggtatacagaaaacctttatattatctttacaacttttgtataagtctaaaactattctaacataaaaagattatagactgggcacagtggctcaggcctataatcccagcactttgggaggccaaggctgatggattgcttgagcccaggagtttgagaccgacctgggcaacatggtgaaaccctatctctacaaaaagtacaaaaattattcaggtgtggtggtgcacacctgtagtcccagctactcaggacgctgagatctattgaacccagggggcagaggctgcattgagctgtgattgtgccactgcatgataacaaggtggcagagcaagaccttgtctcaaaaaaaaaaagaaaaagagattattaagaaaaatggttacctcatagggtggttattctcataacaccaaacttaaagcgtttagcacagcgtttggcacatagtacatgctaatacctggcaactattattggttagcattattaagcagggttaatccatgagctgcttagcaatccatctcaaaagcagaatactcatattacttgaagaaagatccgataacttccaccaccttaagtgtttattcatgtttttacaaatcaacggtcttgcgaatcttatcattgttatctttgctgggcaagtctattttcattaccatcatttttccagcattattctgtatttaagataaaactccaaggaatgaattgtattatgcctctggattattaaactctctcacctttctgtgtagagctcggtaatgttccttctaataactttcttccaatcgtgtctccttagccaacaaatttaatttgtagtcatatgatcagaaatgtgctgcacatcctcccagtgcactggaacatctttgtcacactgcaacattggctatggcctaaaaaaatacatttcaccatctggtgtctgctcaccacaatatctccatgtctggttcctacttaaacttgcattccttctacttcattcattaagcctctttgaccctgcccccaactcagattggaagtcgtgttaccctcttctgagtgctttgagtactggaagcacagtcctatactgaaggtttctgcaggcattctgtgtaatctctcctagtttgttaactccctctgggctaaagccaactctgctgtacctggtaaccttttccacatttagctctgagtccagcacatctaggactcccagtaaacatttattgaagtgatgctaatttgaatgtcatccaaaaaactaactcaagcactcaaatgagcttgcctaccaggaggatttatctcacttagcagagcactcccgaataggctttactgagttgtctgcagagaccatttccaagaactgataataaaacaaaaataaaaataaatgccactagtgactgccttattttcctattggtttgtttttgtataattataattcttctggtttgtttatcggagtcagtcatcttttctttttcttattaaggccagttacagtatttttggtaaattaacaaatacagaaatggttatcccaacatgttccattccttcaaggtcatgagagggaatgctaaatcagacaaataggtaaaataagacttttgttatctgtccatccacccactcatccatctgtttatgtattaacttatccatcctacttcaatagtcatttacagatgcctaccacatgccaggtgttatgcaaaacactgcagatgcaggggtgaataagaaaggcctatccctcaaagaggtcccaatctagtgggggaaaaacagccaaataaataaataagtacaaattcaacataacaagtgctattataaggataacataggacagacactctagttggacatatatgctcatagagtaatgattcttgagccaaaacaaacaaacaaacaaatcccaattatattagtctgttctcacactgctaataaagacatacctgaaactgggtaatttataaaggaaagaggtttaatggactcacagttccacatggctggggatgcctcataataatggtggaaggcaaaagagaagcaaaggcatgtcttacatggtggcaggcaaaagagcttgtgcaagggaactcccatttataaaaccatcagaccttgggagacatattcactaccataagaacagtatggggaaaatgcccccatgattcaattatctccacctggccctgcccttaacaagtggggattattacagttcaaggtgagatttgggtggggacacaaccaaatcatgtcaccaatcatgggttgtttcatggattccttcaaatggcttccatgtcttgtagaggacttggaagactgggaatgaagcctcacctctgacatttcctaactgtgatcataaacaagttactgaactgccctaagtctcagctgccttctctgtacaatagtatcattgcagtccttgtttaaaagttcctgacacgggagatgtgtgtaaactctaaagggctgtaagaatataattaattagttaatgaattgcaattattattattatattgattacaaggcaaaggaaaatatttttcccttataacctcctctggtccactcaatctccgcaagaattggaaatttttggtaggaccagttttttctctttatctatttagtcaaggtctacatttctgcttttactagactggtgtctggtggcttcctcagaaccctgggtgccaagatgtcagtgtatgctgtgacagagcacctggcagattgactttaagcctccatatgtgtgctagctaccccatcgctgctcagaacaggaggtccaaacagcagttttggatgctgtgatttttagaactcaggtttttagtctagtcagatattcattaatatttcgggacagccaaaaaaaaaaaaaacctaaaaaaaaaaaatcaagagatgcaacatcttaaggaagaaagtttggatcctgtttgaaaaaaatagtagtgattgggggttggggagaagggcagtagtgtcccaataccagctctgagagctggcaggggctttgtggcctggatgaattcaaagcaaacaggcctacaggacatgaagccacatgtttttctcgtgagccccacaaatataaagctcccttaatccacactaaaataaaactgaaatgtaagccggccccgatctgtatgcagcatgacctcttccaccaccctacagttcattcattctccaacccagtggttgccttgccacgctaattttacctcgtaaaaaattcttcctcatccctcctcatccccctcccatattcttttgacttttttttttttttttttttttttttttgccacccaaacagcatcccagaatgcctcatttggtgacatcacagatagccatgggttgcttctggtgtcccatctgttcctgcaggccttgcctcagtgcgggtgagatatgaagggagtgttcagttgaggctggggtgtgggtgggggtggggatcgggcctttgaagctgttttctatcagggcactgcagctgtcagtgttggctgcggaagccagtgattgtccttgtagctccctgttgccggcagtgcactgtgcttgcggatattaattgggctttcattatgtgaatgaacccagaggcttttgcagccgattcctatatctatattgatttattaaaaatgccaataaataatagctctcgcaaagcagcttttaatgtatttgataattagttggtttatgtttttttcaccatttttctccctttttttttctttttacacatcacagcataatagatcacagaatctttgggacaacgaacaggcacattggctaaatcaccttattacacttccatatagttgaaaagaggcttaatgttaaattatgagatcccagctattgtggaaaccaagaaagaataatgctccaaaataacgactgtggcgcctctgtgccactcattgtcccaggaactgttggcacgcctcccatgggagctctccattgagtcagccgtcctctgaaatgaacagtggggcccaaattcaggtggggagcctctttactttttggtgtattataggctataagatatcttaggacctgggctttggggaaaaaaaaacaaacccaaaacccttatattacatttgtgtgtaactgtgggaaaaattggcacaccccaaattcagcatgtcacaggagacttcagcacccaggatactatatattatccctcaaaaagtggagacgaaaggagaaattgctcatttgtttcatttcactgaaacttttcaaaggaagaaaagatgttcattaaaagttaacagtgaggcagttttgctgaactcctaaagaaaatgtcattgtcacaggagcctgtgacccagtatcattctctgtagctgaatctaaggtgcctgtggtctttgagccattaatggaattgaaaaagaagagaggtgccccaagaatgtggggatgcagatggatttgggaggaccattgttatagcctgcatgtcatgactttataggaagtaaatataatttggattctaaaaactaagtaggataagagatcctaacgaagctcttcctttcagttctgggaagaggagttgaaattgatttctttataataaatgatttatgtccaattctctctctctctttctttctcactcttcttctttaagtaaaaagcccactgatattagatgggcaatagtggaaatatggaacaaatgagaaaaagcaaaactgaaccttaacaaaattgctgttgtcatgttcaactataggttgtttctgcagtgttacatatggttatttctaatgcagtctctgagaaaaacaagcaaacaactgtgtttcaggtaaatatgcaaagataactgtgtatttgtgccattggacaaattcttcttgaacagctttatgcagttaacagttcagtgatgacaatggaactttaggtagcaaatataataactaagtgctaattttggagaaaacaatccttgtttctgactatttaatatggcacttctctttataaactgtaaaatgggtaaagaataaaagtatccctttatcccccccaaaaagattcagaaattattcacaagtctttatctggcccaaaactaaggacccagggtcattttaagaaaaccatcacattcctattcaagaccatatgaagtcatgcttattactttgtaaccatattctctttcaacttaataagagaaataaaaagacagccagcaatatcatgcctaacctttaccccactgaggtgttctgacatagtagctatacaaagacaccattattaattaaggtatgttaataaggaagaaataatattccattcagaagggtacagagaagatataatgggtacgtgctgcttttcagagaaccaagataaaacagaaaagtgacacatacggaggagatggcaccatactgtcattctggttttctcatgtcgcctgggtggtttcctcagcaatataacatttgtagtaatggcctccattcatttagtgcccactatgctccaggctccatgtaatgtgctcacatatatgaatatttcccatactattgagttatattactggaaatgtcaagaccaaaggctgcttattgattttttttaagggcttagagtggggtaaaatagtagaggtataaaaaaacaaagaaagatacttatcttcatttcgtggattatttctcagttttcagtttaatttctctctcaactaaccttgcagaaatttagggcctatgggaaggggattaacttcataatacctatgctgtttcttttccccgaaacatctacaatttatcccccagcttctgtattatttctgttaccatttccaaataatccttatgccagctctgaaagttcacctcagtagtcgctctacattggaaaaccagccctgcaacaggaaggaccttctctagagcagccatattttctgaaccccacactgagacacattgtctaagaagttgggacctatttgaaagaaaaactggttaaatttgtgaaatttagactcacagaaaatccaaagcacagagttgacattcttttaggaatcccagggttacatttcagaactgcacagcagacaacccagaagtccacagacactgggattctttccatactccgaacggattcccgacaagaagcctgtaggctctgcttctgccatttgcgctgttttagaatgtttgctccaggtcaccgagtaccttagcaaacgcagcttcataggaatgaacaggcagaaggtccgaagagtttgagggtgactgatggatctttatggagcagagcaagctgttaaaaacaaaatagaacaagaacaaaggggtcctgtacactcgaggagtttactccactaacagtcttgctccgacatgtgaatcttttagatcggtgtcagctcaacagtgatattctatgaagtcattcagtgtaggcatttgatcatctagacctgtactgcccaata

SEQ ID NO: 158 - DNA, 232205 bp, Homo sapiens; identical to SEQ ID NO: 156

SEQ ID NO: 159 - DNA, 193078 bp, Homo sapiens
tagcattttgatggttctctttccagtttttattttattcattgtatcatgctttctaattgtctcatgctttttcactgaatgttatcacacaagaatcagttacaagattggcctttataaactaagttttcaatgactacataaatataccaaatctacctaaccattctcctataaatgagtgtatatatcaattccaatttttgatagactaaataaatgctgaaatgtgtatcttggtgattattacccttgaaacaaattagaattgattctttaaaaaattgtcaccagttcaaaggatttgactattttcaagtttcttcctaaatatttacacattgttttgcaggagtgttggaccagttagaattcccaacagccatgcttcaatgcacacagagccagtttcacatggaactcctgggacgtatttctgaacaactgtttataatgcttttcaactctttcaaagtccttgctttacccatccctatgcaggtgcacatggcctgttacaaacctctgcctccagaatatggacagtgagacacagaggggttgcctgctctcactaaatctccagctttgggactcactttcagtgcaagcacacagatgaaggttctcaagagccctcctgattcattccctcccacaggccaggaacctgtggcacaccctaaagagaattacactgttgtgtatcctccaggaactatacgaggtttagtgtggtggttcttagcaacagaacaaatctacagcactttcacttgttttcaagtaaccagattagcaccagtcgctaattttacatcttgccttcatacactcttgactacactttatttcccagtaagctagtagaaatgataggagcacatgacaccaagtgtttccacttccttcgccactcacctcctcctccccaccggctctatgggggaattatggaattgtgctggatagtggccatgcaggagacactgctcacgctttgttgtaaccatagtcttaaggaaaggagactggacaacaccaattaactttttttgggtgctctcctggaccagatgccaacagagcttttgcacatatgatcagctcatcaggcactgttggcttccttttctctttcccgcagaggctgggatggttctgagcactgagttaattacatgatgctgcagtacggtgggctccatcctctctgccctgtgtatgcacacacacctttaaacacagataagcatacacacacacacacacacacacacacacacacacacacacacacactggccaggcgacttggctgcagaagtggacagatgagcataaggttatcctaccatatatcaggcccaagagataactatattccgatgggagaatcagttagtttcactgacatatacaagtgataacaccacaagagtcaaacatgcctacactccattgtccaaaattacccatgggacgcttggggcagagaaaagagaccaactacctagccaagctaagcagagacacattctccaaagtcttttttccctaaggacttggggtggcaggacatgagctatgatgtatggctggggtcacagggaggtagatgtgtctcatctgtttccattttccaatatccaaggctgacaacacactaaataagcctacacagctctgaagtttttctcagtttgatgaacagctggagaacaggagttccagagtcactgttgctctgtgggatcggggtcccgtctgtagctcaagggtagggcagaggctggtaccaggcatctggaaaagatgaaaccttagcagacttagaccatggtgcacaagatatgcccataagcctccttattcccctcctcctttctgtttacagtaaatatgtattacagttctgaaatacagtaaatatgtattacaaaatgtattaagagcctcaatatctatggagcagaactaacaaggccacagttgaagtccaaatcctgggtcaaccaaacaactttacttttgttccctggccacggatgttacacccggccccaggcacctgactcagcaagctgtatgatggcacgtgtcttagacagcaaggggaatgatcaggacaggatgcctcacctatgtccctgaaagaacaacctcaaagccccatcttaccaagtatcactttttatccaaaggtgagcatgcaagtgcatgcgcgcacacacacgcgtgcgcatgcacacatggatgcacacacacacacacattctcagtgacaagtcctcctgtggccaaccttgcccctcactaataatttgcacaaattaaaagataaagcagcttagggtcattcaataaatcataagcacaaatcaaaatctatccactcaattaaatctgaacctagctggaatcacatcgtttttgaacgctgaagtggctaatttccgaaggatgtaagaagatcattcaacacatggttattcaatatcagccccttttctctgtgatttttaaacttaattagcatttagtaaagatggcatgatgttccatagagcagcgatctttgagggattacctccagctcagaaggggggaatataaaaccaatcagtccattgatagaggggccccgtgagctgcccagcattgaaacaagcaccagaggtgggaaatggaagaaaaagaatgagtttgaaaggaatcctgccagccctgtgtccccagagtcatccccaccagtcctggcccacagtggtccaagaacaacaaagacagcctctgcagggagaacaccgggctgtgtttgcatctctgaccactcccccagcagtctggatcctgccaaatgaccgctggtcaaacacgggcgggctccagctggtctcattcctgttatgactgcacttgggttcattaacacccagccctcccctgtgggcatgcaaggcaggaagccttctcactggcttgttttgcagcctagctttttctttctcagaagtggggcaggtggtactacattcgagtaaaatcatgcttagtggggaagggaacaggctgcccaggcttggggtggacacctctggggccacatgctcagaggctctctggctgcctctctcgttagtcagcctttcctggcatacccccggtacgttaaaccgtcgtctgaaatacccagcattctgccgtggaaagaaaacattgagctcggaaaacaggtgggatgaggatattccagggacctggctcgagagcctcagcagggatcatgttccccagggttgtccccaaagacgggacacttttgtgcacaagctgcagagcatcagaaaatcttggggactgcaaagcacatcacatgtcttataggccagagcttctcaaattgttttgaagggccattctgtaaaatttcccatctactgtagatggatacttttgtcaaatactagaagaacaaattactagaagagtgaaacttgaagctgcaaaatacaaatgcattgagtatgtgctgggatgttgcatcaatatcaagttgctgtatacatttctaaatgctcactctcaatgtctgtacctatctcagcacaggccactaacaactcgttcacagagtatatgctgaattgcgctggtctagatccttgccactcaatgtgtggttcaaggaccaagatcatcatcattacctgtgaacttgcaagaaatgcagaatctcaggctccacctcacacctattgaataagaatctgcctttgcataaaattcccaggcaatttgtatgcatgtgaaagtttgagatgtgctagaatagaccaggcttctgagctaatagattataaatgttttctttccactcaaccttcacgatgtctttgagtaaaggagatactcaacgttgaagtgccttaactaagttggagagcagagggggatgtaaaaattggcagggtctgcaggctgaaatgttttatgggagttgagtaactggcaagaatgaagaagaaaagctgagaaaactgaatagcccatctgtcgccaggtaactctatggttcagaagccaccagagaattacggcactcacttgccagatccaaaggaagcccaggagagtgagcacaaagggtgagagacatttatgaatccagtattgggaaatgggcattgcaccaggatgaagcagagagcccaaggtcagggtgctggaggagacaacttgattctgtaatggagattgtgggcggcccacgcagagacagcaggatgtttatttagatcttgtctacttagctggttgactggctgcaagtttgattatcattcaccaggtctctatgccctcagccggaaccatgttcctaatctgcttggccattaagggctctctgaaccctgctctgtctccagcatagagccagagaggctggaagctccccggggtctctttctgcacctccctcccgcggcatgtctctgcttctgtctgggactgcaggccagcttcaatcaattcccaccgaccagcagcccagatcttaattaaaacattcaacctgcacacaagtgaggagagtagtcacagccccctcagtccagctgaaaggaaatcacaaggaatatgtacagattcataagagacttctatctcagggtgcaggtggggtacagccaatccctggttcccttttcggagcactcccatacacctgtcctccctattcctgtctcacctgcactgtgactgtcacttcgatccgacttccataggagttctctccccttctgccccaaatcactaaaacacagagctggggagaccctggaaactgaggacccccaatgttaagtatcttgcccaaagtcacccagccacattgtgtccctgcctgagagtaacaagaaaatgcatgatttgtaagtcaatcattcatattagtcccagtcaccagatattccaccacgatgataattttgtacttattattgtattgtaatagtctaccctaactaacaattttggttcagaaaaaaaaaggtctccttattaatgtcttttctgtgtcctgaccatgtatttttagcaatccaactaaggggttccagctgttaaactctttgaaggataagtacgtatgaagagtttcacccaattacttctcccaggggtcctaagaggctttggggccttaagttgggactacattggcttcaagggtggataagacagaaactgtctcaacctttgggttgtagaattcagggtgggatgagctcaagcctggggctcatgccagccctcccttccaattctacaagattctaggaagcattagccttcattattctattcctcaaagcagggcttctttctggcaagtcccataacatgagaggagcctgaatcccacaagccatgactggcagctcagagcagaggcgtgtccttcacacagctctggctggaagagacaacattctcaaaagaaaagggccccactgatgaccagtgatgatgagctttttttcatatgtttgttggatgcataaatgttttcttttgagaagtatctgttcatatcctttgcccactttttgattgggttgttttttttcttgtaaatctgtgtaagttcttgtagattctggatactagccctttgtcagatggatagattgcaaatattttctcccattctgtaggttcctgttcactctgatgatagtttcctttgctgtgcagaagctctttggtttaatcagatcctatttgttgtctattttggcttttgttgccattgcttttggtgttttagtcatgaagtctttgcccatgccaatgtcctgaatggtattgcctaggttttcttctagggttttcatggttttaggtcttacatttaagtcttgaatccatcttgagttaatttttgtataaggtgtaaggaagggatctagtttcagctttctgcatatggctagccagttttcccaacaccatttattaaatggggaatcctttccctattgcttgtttttgtcaggtttgtcaaagatcagatggttgtagatgtgtggaattgtttctgaggcttctgttctgttccattggtctagatatctgttttggtactggtacgatgctgtttttgttactatagccttgtagtatagtttgaagtcaggtagtgtgatgcctccagctttgttctttctgcttaggattgtcttggctatgtgggctcttttttgattccataagaaatttgaagtagttttttttccaattctgtgaagaaagtcaatggcagcctgatcaggatagcattaaatctataacttactttgggcagtaagataccatctcacaccagttagattggtgataattaaaaagtcaggacacaacagatgccagagaggatgtggagaaataggaatgcttttacactgttggtgggagtgtaaattagttcaaccattgtgaaagacagtgtggagattcctcaaggttctagaactagaaataccatttgacccagcaatcccatcactgggtatatacccaaagtattataaataattctactataaagacacatgcatatgtatgtttactgtggcactgtccacaatagcaaagacttggaactaacccaaatgcccatcaatgatagactggacaaagaaaatgtggcccatacataccatggaatactatgcagccataaaaaaggatgagttcctatccattgcagggacatggatgatgctggaaaccatcattctcagcaaactaacacaggaacagaaaaccaaacactgcacgttctcactcctaagtgggagttgaacaatgagaacacatggacacagggagggtaacatcacacactggggcctgtcggggggtcgggggctagggaagggatagcgttaggggaaaacctaatgtagatgaccggttgatgagtgcagcaaaccaccatggcacatgtatacctatgtaacaaacctgcacgttctgcatatataccccagaacttaaagtataaaaaataaaaaataataacaataaaaaagaaaaggcccccactgaaaacacagccatcattaacttctctgtctggcaaagcaagccccaggatgtgccacatcatggcccccgcttcttctctgccccatgagtcccagcccccttctgcccaccaaccactctccttcttgtttcctgagacacacccagccccaccctgcctttcagcaggcacttgcactccttgaaagtcccaaggagcttgtacttcctcacattggttgggcatgagctgggctaaggcctttctgttctccttttgtgcttctaatgttgaaaaatgatgtctgtaataagacagtaaattctttgctggtgactcaaaagccggtaagcagagaaggcagtggatgggaaggaacgcagagggcaaactctagttacttctccccataccacagcatcacagtcttagggagtttcccttttgccccatccctttcgagtaaagcaaagggatgatggaatctagtttctgcttcccctcaatgccagttagcattagtggaaaggagagtctgtgcccagccaggaggacggaagggtaccagcagctggcaggagcaggtatgtgcacgtgtgtgcatgagtgtgtgtggccatgctgcaaggtggcatcaggtaggtgacatgggaaatgcaatgcccagcatcagtctcagggcaggagaactggggctaggggaatccacttcccttcccttactcgatctcccccatagtgactggcaaagcatgttgaagaagaagtagaaactccttgcatttgtcttctgttactggggacagcttgtgctgatatgttctaattacttctctggttcacccatgtgaactaatgggcaacctcaagggatagtgcaggatcctggggctagccaaagtaaagcacccttacaaccctttagcctgagggagcaaagaatggggatgtttattggaagctgaaaggagaatcgtgtagggcagatgactttgagaagtgatcttaggtaaaggatgcagccaaccccaggctacccagcaggggtggacagtgggttaggggggcagtgctaaaagtggggaaccagtgtgaattaatctccaacctctatcctttccatcccaccagtctcctgccggggtcctcactgtcctgttcatccagtagtcagaggccagggaggccaccgaggcagactccacaatctttggagggcacaaggctctggagcatgaataaaagattcctggaatggctgggcccggtggctcacgcttgtaatcccagcactttgggaggctgaggcaggtggatcacctgaggtcaggagtttaagaccagcctggccaacatggtgaaaccccatctctactaaaaatatgaagcattagccaggcacggtggcaggtacctgtaatgcaagctacttgggaggctgaggcaggagaatcactcgaccctgggaggcagaggttgcagtgagctgagatcacaccattgcactccagcctgggcaacaagagtgaaacttggtctcaaaaaaaaaaaagaaaagattcctggaagaagcacacattggtgtgcatgggaattactcattgatatttctgtcctactagaacataagttcctggagggcagcatctatgtgccaagggcatgatgggccctcgataaatatttattacattaacaagagtatatatgaagaaatgaaggaatggaagggcatcatggagggaacaaagctaactaaccttcttgtagtctgtaaatgtgcacctgctatcaggaggccccagcctgtctttcagactcactctctgaaaagtgcggacactgtttctcccaatctgtcctcacaatctttccagggctgccactccctgagtttcccaggtctcctgggttcacagtcatgatactccaagctggcaggaggctcacccctggcaggtgatgctccaggcaggtagccgagtgccccagaggctctggcagtcactgtctggcctcagtgctcttctacagtgaggtgtggcgcagagctgagcatcgcgcattgctgtatgccctgtttcacagttactgtggcaacagccaggcttcagcctcgcctaggttgtcctggggaggatgggccgctgttggaggctacagcaatcctgtgagccacagccatcctggtcattgtgcaggtccaggcatctcaaaccagggagtagacacagacactggagtcctgctgagccccaggctggccaggagacaaaacaggcgtgatcattcacaaaacccaggagccctaggagatgccgcctccctgtgtccatctgagcacccaggccctgcagcagaggacctcctccggttggcacgaaggcgcttcacagcttcctctgcagccacgccttaccccatcccaccctaccccatgccccagccaaataaaactattacagttttattataccaattgtcagtttcctcctccgaattttctcatgctgttcctcatccttttcgctggaaatgttcacttatcctccaaggcctagctcatgcttaccttctctatcagcaacattgacccccaacacccccccccaccaccaccaccactgaccccagccccacccacccaagaagactctcccactccccattctaggctcctacagagggtgataaatcccactcccctgccagactgtgtctctcatctgattatcagcccagcacctaaggcagtgaatgggtaccttgatcatggtaccctcaagaacccatgatccagagaggctgtattggctttaacctgggtgtcaaactaaggagtcaagagcaaacagccccacatatgaacctggatttgggcatggctgattatcatgggagcacccttcctcccaacaagctcatcactcaagtcctacttttgttagctaaacattcattcattcattcatctgagaaatatttagtaagcatgacactacacaacactgtgctaagcactgagaatgcagagtgcagcaagacatagtcccggctctctagaaactcctaggctaggaggagagacaaaagagtaagtagacatggcaagggaagtggagaggatggtgggaatccacagaagaggcccctgattccatgtaagagagaaactggacatttagaggcttgaagttcagcctggatgaaactagcagagcggggcggcaccaggacactaagccatcttcagaccatggcagcagagcccaggcttgactcagaagcggggctgtgtaacaatccaggcttttctgccaacttacgacaagacttattagagattccaggcacagtggtattgagacacagaccactaatttgcaccccaccctctttttttttttttttttcgtattaactggcatctctgcctgaccttccccaatcctctgacagcctgggagtttgcctggctagcagccatccagatttctttttttctccaagccctggccaagacccaggatacatgggagagggggaagggaacagtttgtgctcatgcaaagcttgctcttgcatacagcccctgggccgggatggagccgagtttcctctgaagcggggcccagccagtagagctgcctctgtcctaccccctcgagacacccaagccgatttggtgcagatggcaccagcagatgccagtccctaggagggtccctcctccctagctaatgaggggagcaggtgaagggaccagagaatgtgatcaggagtgagaagtgaaacaaacactagattaagagttaggaacctgggttctagtcccagctctgccacaaataggctatatgactttgggcaagtcacttcacctctctgaccctaggtgtccctgttgtctgagtctgtgattctagctgtcagaagtgcaaatactgctttaaaagaaaggaaaactgggttttcacttctgctctgttgttaacctactgtgtgatgttgggtaaattccttcacctctctgggctaagattagccatcttttagaagtcacatcgcacgcaacatgcaattaaaactgagttaatgtgaggccagggccatgaatgacccaggaagaaatcatgagaatctatgaagaacctttccccactttttcccactgtccttgccctgggattctagtcatgaggaagctgctggtccacccactgcatgtgcagtcctgctctgagctcctgcccttcctcccgcactaaaaaaatctctctgcttcgccagaattctctgaggccatctgtggctctgatccaccagtcaggtgagccgtgggaccagccctggggattctcagccttcagggatcctgggcctcatcacatgcagatgtagtcctgcctttccggggcaggtgtggctgcacactccagcgaaagtgaagctgcatctctctgcagccttacagcaaatgggtagccaccacagctgctgataaacagctaggggagccattggccaaataacccacttttcacacctggaaataatgggggaaacactcaattaggcattcaggtgtaggtctggactggagtggaagtcacagcctgccctccaggctcctagaaatcactggtttgaggctgttgcaggatgacaggaccatgggttttatgggggctagttggcatggctgaggacaaggggctggctggtgaccattcaggcagaaaggaagatgaggagtggggacaagatgaataagcactttctttagagtctgaggccctgtgagaggaagaaatcaatggaaaccttgggagggaccccagagagagtcctgctgagagagggtgtcggccagataaatttgatgatgcagcactgagtgggggcacaaagtcctatttgaagtattgcaggcaggctggcacgtgcgtcccacctgtgcatctcatgtctggccatgtggcccctgacatgctgctgggcagaaccagggggaagcagcagccagttaaaccctggcacccatgcaggcagcctctgataggcaaacagcctggaagctgggagcctcaattagcctcttggagagaggggagagtattacttgattttctttgccgcccagaaaaagcaagaagtccagatgcaagtgcaatccatgaccacttgctctagaaggaatgaccaggatccccatggccgggaaacaaatgatgaagccagttagcagcctgattccaaattagagtttctcccattatacctatgcctgtacacatgttcaagacacagaaagctttcactgtttgggggtattttgttttctcacaaaatatgggcaactggtatcccaagagctgccatagtttggtgagatataaatttctggtcctttaagcctcactggagatagacagtgatgttgcctggggacttcctgggacacacagctgaacaaaagtaggggtaaggcaaatgtaccctagagatgaggagctgtggtcaaagtgatcacatcaagagaaagccttcagccagccccctgggatatccccacaatggatgggcagaaaggactctggagactcagtacagatactgaagagtatgccatgctttgaaaattggggagttcataaagggaatggggagagctgcaggttccctaggtatctatggaagtttcggaaagagatgaagaatagccaacacatatgtagcactcatataaattaactctaattttcacaacagcactgtaagataagcactatttttatccacacttgatagataaggaagctaagccacagagaggttaagtagcatgtccaaggtcgaacaactgattagtggcagggctggacttgggttttgggttttttattttttttgtttgtttttgagacagtcaacccctatcaccaagtatggagtgcagtggcacaatctcagtttgctacaacctccgcctcccaggttcaagcaattctcatgcctcagcctcctgagtagctgggattacaggtgtgtgcaaccatggccgactaattttttgtatttttggtagaggacggggcttcaccatgagatgaggctggtttcaaactcttggcctcaagtgatccacctgcctcagtctcccagtgtgctgggattacaggtgtgagccaccgcgcctggccagcagggccagactttgaacctcaggaggcttctcccaaagcctgtgcactcttaaccacggtgcagtgcaccctctccagagtgaagcaggatgctcgtttctttagggaaagaccctgccttggtgtgggaaatagagcctccaggggcggccctgccccacacctgcctggggcctagggaaatcctgccccaagatccagacccagacacctgccactctgacagctggcacagggatgggggctggggacatcacaccacccgcattctctgcagggatacccagccatccattttaggctaaaagccttctccgcatctcagccttccccaaaattttacaaatactagaagataaaagcgcaggaaccagcatgaatgaagttggtttttaagagacagtgtttaacatcaagatccttctgatgtgagtaatttggattctgatgcaattctggattgtttgttgaattatgcatcagcagcttctgttgctgtaaaaagcaccaccgtcactcgagctaatctgaaacctgcagcaatgaagacagttgggttcacagtttggatactgagatgcgtctttgatgatagtgaaccagcagaaggagagaaacagacacaagggcaagtggagagcaggtagtaggaagaattgggggaatgaggtaggattaggtgctttatttaccacacactcatgagagccccatgctgggagaaagaaaagacccaaagaggtgagcagatatcagcttcccccaaatccaggaaattccacaggatacagaaagacaagaacagagagaaccagggattcattctggcaaaggatgaagcagctcctagactgtcaaatgcccactgtctctaccacctgaaatatgatgctctccttcaagctcttgacctatgctgggggccttcctactgggccaaaggccatcatggtcatcattattaattattttctcagtgttttaatatgtatttcaggttgatatccttatttaaaagcaatagctaaggacagtatgcctatttgacgaagggcacaggggagaaaggtgatatacctaaagtcacacagctgcttagcaaccggaaggaaattggaattccagtctcctgactgccagtcaccttctcttccatcaccccaggctttgccatctcactatggaggctcccaggatctctgacaacccatcagacccactgcttaggctgggaatgccaagtcccatgcctggagcagtagaaagcaaaggcaccaaagccccaagctaagccacctagtccaaagccacgctgtgcctctagcatggtgtgtccctgagcaagttatggaacccttggtgtctcagtttccttatctgccatagacgcctgataatagttcttgcttcatggaatgagatgatccatttgaaacctttggatcaatgctaagcagaaaataaatataacctgccattttcattattgatattctcctgtgaaactgttgtgacttcagaggactgatcccaaagcctgccaggaagaccctgctgagtgtcccgctctcctgaatagcccatgtcctcactatcacaggttctattcgtgtcgcaacaaggaaccacacatccaaggcagccaagccaggagggccctgggtgtgcgggagtcagctctgtggagatgccgtccatgcccggtctgacgggaaccccagctctgcgtttctccttttcatgaagccagtgagccaaaaccaccctcctgggctggcccagtttaagagcctgggctccagggacgcagggaggcccctcagcccaattataaatcaatctagcagcactcactgaggccattgccataaatggctctaaaagctcagcctctttcggcccaataggctcagggctccaggattaatgagcatcagctgccggcaggctggtggggacagatgccgacctaatgagcacagtggcccagccctcgccagctcgaggtggacagggctgatgagcaggtgtcattgtcatgatgcccctttgccaagtgtcactttgaaagggagggctgttgtcatcaagtggcatcttattaccccacctcaggacacccacaggagattctaaaggctgtccacaaagatggcctttgtggctgccacctccactcctcagctggccctggcaccaggtttttctcaaggcctctcaaccacagggctggataagggttttagaatcctgggcatcccctcccatcccatgccatctgattggtgctgcattaaagtacagaggtccctgctagaatttccctcagtcacgtctctattacacccacgggcttcaagtttgcctggagtatttacacacagttctgcagattcaaatggattcaaatgggcgcaagggctcagcatcacactggtcaccaaagggacacaacccagtccctgcaagacatatcagcttgtatgtcagtcaaagacacaggccttagagggactgatcataagcataaaacatagcaacaacaaaaatagtcatgatcacttcttcagcatttattttgtgccaagcactgttccacgctctttatatgtgctggcttatttagtaaatgtgaatgaaagactctgaataataagagtcacgttatattaaggcagtcaatgcaggtgaaacaaaaaaaggaaagatcacttcggctgactggagaaatcaagagaggcttcatgggggaggcgggaccacactggtcctagtgcagtctgggaagagtgttccagaagcagaagcaggcacacctgggcagggctacagtgagtttgctgaaggtcacacatctgtgctttggagggcagagctgcagggccacaggtatattcaatgtagtgggttctggcatctgaaaatgttgttaggatgaaatttcaaaatcaggttttattcctgatgaaagtagactgctcttaactggggcttcactgcttcttttccatttctgtttggagtgtgatttttttaaggtaagatgtacacgcaatgaaatgtgcagatcttcagtgcacactttgatgagtttttgacaaatgccttcacctgtgtaactaacaatccaatcgagatctagaatactttcatgggcatgaaaggggaggaatgtgacctttgtgatcagatggtcccatacctacatcttctgggcatttgtaagttggaataaatcaaaataatcaacttcctcccttaccccacgccagtccacctcctacccccggagaaaaaataaaataaaattcatccacatctaaacagacaaatgcctacctagtctgtctgtgtatttgttacctttgtgccccagaaccaagcttcataccaggcacagagtgaatgatccatacgtgtttcttaaaaaaaggaattaacatcctcagattaaggtctcccaggaagtaaaggactccactttctctaagttcccatgtgacactgacaattatattttcctgtcctctctgttgagattaggaaggagtccctaggaggatgcagaagagtatccttttgtcctgtctcctacctgtcacccagactcttgtgttctctacagccagtccatcttaggcctcaaattccatatgtttgacaaaatcaagcaggtagttcaaggtgctcgtctctcctcccagctattcagcagacaaaatctgtgacataatgtaccccagcctcagacacgctcacccttctttcccaggccctgtgtgaatgggccaggccactccttgatagttttcaggcaaaacacatgagaacactcccaggaaagagaagcctccaggggtaccatccgtatgcataccacgcatttacttcctagcctcaccagcgttttgggtgtggccacagctactccccaaacctttcatcttgcaagtccctagatgtcctcctcgggaaagctccctgcgcacagcttgtgggagactgcaggctcataaacagcataagccagcattccaatcagattatttctcacttgcaatattgcacaaagagaaaaaaataatgctgaacattctgttcgtggaagaaaaaatagcaggagaaaactgtcacattgtttggtctattttcaatttcattcccgagccctgcaaatagctatctgtgcaagcaggccagaagaggactccagcgacctgacatgcacgatctcagatcaggtctctagggcctgtgaaaaagggagagacctttggctggcacatatctacacatgtgataaaattgcacaagactaaatacacactcgccaatgcaaaaaactggtgaaatctgaatggataagcttggtgggttgtaccagtcaattttccatttgtgatattgtactatagttatgcaaaatgatgccacgtggaggggagaactgagtgaagggtacaggaacccctctgtacaatttattgcaattgcatgcaaattcacgattatctcaaaaggcaaagttaaaaaaatgcgcttccagtgtctgatttaatgggactaggttgcagcctgagcatcagagttttaaaagctccctaggtggttctaatgtgaagcccaggctgagaacctttgctcatgaaggttgggaaggtgagacacacacatgaaatccagaaacaatcagcatgtgatacagtaccaaaagcttcatgaatacttgtggagcaaatcagtgaactgctgaacagacgcataaggttagaggaagtccggtaggatgagggaagacttcatggtgaagtggaacttaatcaggacggggcataagtggagaattcagaggacgggaaagggccctctaagccaataaagaagggctcagagattgtgtggccatactggggaggaggggaagaactgaacttggggacagctgaggagtgaagatggataaaacttttcataataaactggctctatccctgtgcttagacgagtggatctttcaaacacctgaaccagctctaagtccctgcaaattgccaagagcaattttcagcaaaaagccaattccccagaaggcacttggcatctctcagataagcaaaagagggggaggctggagaggcttcagaatatagtatcgatgggtataaaagtaagcagtccttgtcatggttcatgtcactttgcctgactgcacttcagctggccttagattccccagtcgagagcccagccaggtgctagaaaataccagaaatgacccgggaaagggtaaaatggaaatctcaagcctacataccaaagcgaatgcacttgactcagcaggtccctagagtaatcatgcaacacctctttattcttattttatacacaagtctaataagcttgagtatctgtttccaagcccgtagcaaattaaaaagaacaaattaagtggcagcaggagagctgcatcagacaggatcagtgacaacagtgagaagtgacaggtgccagacaccctgacggtaggcggggagacagaaagctataaaaagtaacttggggcactcacctaacatgaggaagccaccctagcgaggcacaggggctccattgtaaaggtggagaaagagctttaagatactcaagtccaagttctaaatgccttggagaacatctctttgccttttcctgttattaattagtccaacatacacacaggggagaggggcagtgtgctgctgcaggctgccactatgggaggggcagctggctaatcatcttattgcaggaaataccccctgccaaaaacacagctcccctctcaaagcctgctttctcaccttgtagcactggccactgccatcacagggtatgcagagcaaaggacaggctgctcccgagccgctcagtccatcggatcaatcaggtttaacaaggaggcatccgaggatcaggagaaacacctcctacattattaccacagcaccatcactttgcatgagacaggtctggctgggaacgccacctccagcatggacagaaactgcgtgtccttgacccagttgtttcatttcttgtgctgagcacgcccacccattgacccccaatccagagagctagtgttgaagagctcattaacaaaacacaaaacactcagctgacgcaccgccaccatgcaaatgcgtaataactggatctctcttcccccacagctaacctcaagcatctcttcttggccagctgcattgccttggctctctgtgtggttcagagccagagagggcaggctgggcagccacttccatgccaacatcccaggaggcagtgcttggagcaggaagatgagagaagatgatctctcccactacacagagcccaggtcccggccccagactcagaggccctgacgcctgctatgcctggtccacaaaagcagcagggaagggcatggatgctggcaatgcactgccccctcaggagccagcactcaatcatgttctctctaaagaatgccagtgtcccattttcatccaaatgtgaaagttgaaaaagagaagtcaggcaagggagagaggcttttaagatttcccctactcaggggaggagctggcagcgtgagcctaaaaccaggcaggcaggtaacgggagggggccctaattgctgctaaagatcacggggtaaccctgatgacacctgaaagtcttccgtggatcctcaggcacaaaacataaatcatctccctctcacttcttactgatcgcgtttgcttgctgtgtcagctgaattcccaaattggcctgggtttaaattgggacttttttttcccttcctggcctggcttttcctccactctctctctccaacctcctcccaccccatgggaagtgatgacagaggaatctgcctgcggactccaaaatgcaggtttgtggcttcactttgtggggtgggagggaagaggcagagagcagggaagagggcatttgggggcttacttcggggacaggacctgagggatcaggagggagaaagtggccatctggacccacttgccgacttttggtgtcctgtcctccttccaagtaaaccccttctcagtccccagggcagccaggagagtctgcaacagacatgctccattcagtaggggcgggactcaggaagtgcaacagggaaggtcagagccggataacgggtctgtagttggccctgctgttctggggagcagatattcacctgggctctgtggtgggccaggagacaaggctttctttctttcacttcttttgtttccacgggtccccaagcacctccataacacaggatgggtcagagcccattgaggaattaacccagaggccttgaccctaaatagctccatgagaaggctgaaccttactaaccctccaggaggctgatgtgaggctacacacaatgccaccagctctgatgggcccgcccaacacaactccaggaaatgtcccaagaaagctttccaaagaccccttttcctagactatgggggactccccccagtgacttcatcactcaaaccacaaccaaaacgatatgcagcccccttagcctttgtgaggcagaggagaaggctggtgcgcagcctccaccactgtcaccaaccagccctcacaggcccagagccagggggcagtgggcaggtggcctcccactgggtggcagaacaggatggccacacaaccaacacggcttgctggtgtcacagtgtccctgttacatggacctggcagtgcaccaggtgacatggaggccacacactacagggtagtgattaagaatggactcccaagtaagactgcttgattggcatcctaatgagcaatatgatcatgttatttaactttcccatgttttgtcccctgttaaagggggtgatagtaacagcgccacctcataggggtatagagattgagataattcatgtaaagttcttagaacagtgccaagctggtgtaggttgtgattattattctgatgcctactactactattattatccctgtggcccaggagaccagaaggtatagagggtggaaagacgaagcttcagggggagtactgcacagggtggggtactactgccttcctgtcaccccagtgttcccactggcttccccagggctggtcctccttgttgtgaaggatctgagtctgacgttctactttaaaataacatcaaggggatccattgtttcagcaaaataataagagagggcagctgagggtatgtgtgtgtgtgtatgtgtgtgtgtgtgtgtgtgcatgtatgcatgtgtgtgtgtgttggacacattctcttctgagggatgtatgttttctactccatagctctcagaagcagtttgctgaaacatggtactcccagcttggctgaaatcgggaggcagggcagtggagcctgggccttggtgattaaaagtctgggtttgaaatgggctaccgcaatgccgagttttgggttccttgtacactgatgaggcaggactaggctgtgcctacagctgctcttacttaggaaatcctaggaactgtgattccatacctgctacattggactcaccacgagatgctgagccagccatccccttttctctctgatctcactcttccttggttcaacttccctggtcttcaagaaaaacagtcagaggagcaggggccacaggaaatggagagtcctggttactgccagccttggaaagatgggtgacagctctcggtcctcccaggggaggaggtgtcggcttagcaggcctcctcaatctggagcccaggctgcaaagccagggacgctgggctgagtggatgccccacaggtcccacagcccatcacttgcagagccaggtggtatttctggttttcactacacatacccatgtggcacaaaacatacattgtgaggatgtgcagagagcatctggattccttagacttcaggttccccatcctttagggcagttttaaaaattgtttcgctggaggcctacccaggaaatcttactcacattgaaaaccaggatgaaacccaggaaaacaagtcttccccttgctacctgtaatgcactcagatatttttctttcttactctattccatttaaaagaaggttggccacagcccactacattgacttaaagccatacgatgagtttgtggccccctggcttggaaagcaccatttgagcagcagggcagtgacaatgactcaatgtggcctcagtgcaggcagaaatcccattttgcaaagggacagactgcctgacaaagtcagagtccaagtgtctccaggcttacactgcagggttaaaagaacttttcagatccatgaacctcttcacagagaaggatttctgcatccttccaatgactaattctcagcccagacagaagttggctcatttgaaagggatagcatgccctcctgccacacaatggtctgagtattttttccgtggcccataaatgaagctgacattagataagtcactcacgcacttcaagaacttcttcaaaattggagtcagttactcagctactccaattgtggcttatttcctcacttctgagatttttaggaattgagtaaactagagcgcgttctaactcacctgttgttcacctttaactctcccatctttggatgctatgggaaacccaggagcctcctgaccacatgaatgaaaagaatagggcttctcctttggcctcctagcttcagagcatctgctccctcctagccaagtatcacttacttaggcatatctgatttttatcatgtctcaaatttataaaaccaaaaaaaaagaaaagaaaaggtccagggtttacctcatccagccttctgtttcacaggttaaaagagcatgacccaggggcatttacgactcacctggaaccacacaggttgttaagagtgagggctagaatttgggtgacctgtctcccaggagccacgcaacctctctgtgaatgaaggtaagaagggccaagttcaaatctcgaatgtccttgtgcttccccaactctgcatttgcagagaaggttgagtgggcaccgagagaatcaaaatagagtaggtgttcattttgaggggaaaactcaactttctaggcctcatttaccccttttctaatgataaggaaaacaagcccaaacgggatttccactttcataagaacccttcatctcccaagtcctcatctgccttatggagtctgggatagaagggcattctagtaatagctacactgatggccctgactgatgcacctgcaaagacagatattgacgctctcatttattctggtagtcctgcctgacagactgccctaaaatgagcaggagctcattatctcagctggccttctccttaagcaaggcggaaatggcccaaccctttctgggacaccccacccctgggactcggaggccctctgaacagcagggatgagatggactgatgtggatcatcatagtagccaaatgaggccctctggtgattttcacagagaggtgtgtggcacccattttctagtgtgagaagtttctagtgtgagaagtgtgtttttgagtccattgatccggcactctggatttcctccagggatgtagatgcatcctacatgcatgcacacatgcacatgcacacaaacatgcacatacaccaacacacaaatacacacatgcacacacacttgcacacacacatgtgcacacaaattggctgctcaggtcctgcatcccagcatgccccctggaaaccaacctactttgttttatttttattcctgggactacgtcaatacatctctcctggtgtggagggtgggcatcagtttgaggggcttgtcctagtcagttgggctaaatggggccaattcttttgctttccagggtggatgcagggctttgttgaattgtgaagaatgttaaatgaaactgtttattcatatcacaatctctgctatgccacagaacatgaacttagaacacacagattttatacatcggaaacaagaaatgtctaccacattagcaaagacttaataaaatttcatagctttctagtgggaacataaattggaacaatacttttggaaaacaatttagtaacagatagccaatctttaatgtgttcataccctctggcctagaaataccgcttctgggactctagccaaaggaaatagtctgaaatacagggatttaaaaaaaaaaagacctttatgcacaataattttcatatcagcattatttataatttaaaaatgagaactaacttaaatataaaacagtaggagagtgggtaagtaaactacaatgtatttgcataatagaatattaagcagatgtttaaaattatatttatgaagagtttacaaaaagtggggaagttagttgagttacaaggttcactgaataggcaggaaaaaatgagacatagagtataatcttatctatggaaaatgattaacataaaacatcgaaaggaaatattaatgatagctgcaggcggtggcattctgggggtgcagtttttacatttcttatagatttctaaatgttttaaataaacaagtatttttcaattcttttttagctttgaacacaaaaacactttatttatttatttatttatttatttatttttgagagagagtctcactctgtcacccaggctggagtgcagtggtgcaatcttggctcactgcaaactctaccacccgggttcaagtgattcttctgcctcagcctcatgagtagctgggactacaggcacgtgccaccacatctggctaatttttttctatttttagtagagatggggtttcgccatgctggccaggctggtctcgaactcctgacctcaagtgatccaccagcctcaaactcccaaagtgctgggattacaagcatgagccactgcacctggctaaaaacacattatttataaaaggaggtccagtcacatctctcccattacctctgcagatgactgcagagaagtgccctctctgcctgcctccctcccgccccccaccccatgtcatcttctctaagaggaatgcgttggatcacatgatctctaaaacccactctgctctcacattctgtgtcttgaaatatcatccccctgtgtttgagactgagaatgggatctcaaaaaggggtccaagcagcgaaactatgctacaagtaaaacactgtaatcatcctaacaagacatggacttggatggtcttctagaagatgcagctgttcttttacagtcttcagagaaaaatgctgacttgatgtccttgggattgaacatctggagccaaacatccaaattaatggggtcgcgggcagctgccctgtgaagccagaaatccaggttagggaggtgggggctcagctctgtgcctccatccaggccctagctggagctgaccttccagggtactgcagtagatggcttggtggcccacacaggcacagcaggacagatcccatgtcctataaccccctatggcagctccagccccgagacgtcttcccttgaccaaactccatgggattctttttgtccgttatgagcatggggcaccttcttacaaatcatctgatggtctcatggtttccagttccatttcctcaaggacattgtctgtcaccccttgaaagtctgtccctccttcgatcatcccagagtggttgagtggttcacaggggaggggaaatgagaatccacacattgaaccagctccccaccctggatgagggggttaattggatttttcactctttcaaggtggaattccatgatttgataattacatgggactgtatctctcccctggactttggccatctttcccaccgttcagagaaaatacgacttgtttctagacctgatattcatccagcatgcaccaggatggatggaagataaaatactgaaatgtttccacactggttggtaaattaccgtcacctgcggatacctcccctgtagtcccaacaggctggctcgtcctccgggagatcccccagtgacctccctaagatgtgtcacctaaagggttaatgcctggcccggcagggggcccccagactcttcacccagcattaagtctttgtgcccttgaagtttaaatattttgaatctcacctctccctgctccctctttggaattgagtcccttgggttgagagaagctgactgtagttgcctgggataaccacgatggctgaaatgtaataaggaggaatttaggcttggatcctcacactctccctcctgcttctaggggtgaaagttgggggatggcaacagttttgggcaaacaggtaggaaagggaaactgtgcccacctccccgtgcccccctcccccagcccatgctattctcagcattcacagttcctctttacagacaggactgagaccctctgagccagcactgtagaatcccagaagcagcacagtgccttccatctgagcttctgaagtacatttcacacatagcaccttcagaaggaacaggaaggagagacacttttcctgacttcgcccatgaggagaaggaagcacagagatgtgaagctgccttgtcactcgcacagctgagacagacccaagcctagccttcccccctccacagggataaccgttagaactgccaactctgtcccaacgggcagtgaggagatctgacaggattacgtcatgtgctctgtaactgggagacacatttatgagctgacaaccagagaggctggtgtcatagaggaaggagggttaccaagtgctgccttttgataataaaggtttcgtctgtctaggctgcctgtctccaagcactctggccaaaaacagacatgcaatcactcccctccccaaggcgctggtggggaagactgctatcgtttatgcttttactcatctccatcaggaggtgtggaaggtgccacaaacctgcctcgactccagctagttccccttctgacggtgcacccacccatctgtccattccccacagcaggctagcatccattctaggtggaaactccactggaagcccaaacctcagacgtgagccccaggagataccagcctgtacagcaagccccagtcctcagtagcatcttttagaaaaagttctggtgctttggccatcatcccgattacgtttgcccatgacatgatccggctgtcatggaataaagaaacatgagggtttcaatgcaaggaatgtttagaaatagagaacgaaaagaatgtgcttgatctcatgttttcactttaatgtattcagagctggcagagaaagggggacatttaacttctaattaatgagttgctccatgtgtccaaacaactctcccatctcttccctcactgcagatgaaagcccaagttctcttggagctgggtgattctctgtgcaggttacatttccccagactctgaacgggtatcttccaccaatcagattgggctctggcacctcgccacctgttcgggcttcaccctggaatccctcatcagcagccacttctgatgcgtaattgacaagaccatagctgatgaagggtatgttacgggcttggctctcaccatcaaatctattttcagttgaaactgctttgaatttactgacaccaaagagcccagaaggtaagaatgggctgtcattgccattgttacgattgtggctgtttttggaaacctgggtcttttcaacttatcacaaggcttcagctaggccctgatttcaacttctgccaccatctgagcacgagccttctgagtccaaattccctgtatatgttgatatcatctcagtaaacattgaggaacaaaggacatgaagaaatgagtgtcagtccgtgtgagggagaagaaaaggcccagaaattctggcatccccagttcaaattccactcttcaccaacttcaccttgcatttccacaccacagacttcccaggagcttggtctctcattcacatcgatatttatgcttggaatgtgaaggatcccaaattctacgtccaatcacatgttcacatccctgaatgctctgaccaccccagacatttctgaaatggcttagctcctgcctgcccctccaaacttgaccaatgccctctgcctcccttcatgaaggtctgtccacagggagcctttctcaggccctcaaaggtgccgagtttgttctccacttcacaacccccaggtaggactgtgtcctcgacttagaacactcttcccctcacctcagctcctcacattctttaggtctcagagcaaacattccagccttccattctgagtagacccccaaaacttgattatcctctatttcaaaaccctacttatttatttcaaagccctgataactgtttattattttatttatttgtttggtttttggcatatctccccctccagacctcagctccatctgttgaatgaatgaatgaagttgctagatgaaatggtatgcctactatgctccaagcatgcttcccatgctgacgatacaacagtcaagaagtcaggtgcattgccctcatggagccgatcaccttgcagacagcgacctgcaggaaactgaaatcataggagacttgggcaaagacgaagggagcaggaaagaggcagaaggaagggaacagcatctcgtgagctgacaacgaaatcctgtataaatatcacacaaaaatctattagtgttaccagcatagagggcaattgctttttaatataataagatcttccttggaggcgattatgaggcagtgataaggatcaggtgacatgttgaggtttggcacagatggattaatttctgtttacatctagttgttggcagcatgggggagttcttcgttttcagggaggaggtgggaaagaggacctctggggaaagcagccaagacacaattcttgtaggtgttattccagagagctcactgcttgctgtggatcccagagtgaactggagagaaaaccagggcctggagcaccggggagggacctccatgcaggacacgctggccaagctttggagggacgacccctctcctttcctcctaaaccttggggtgccatgacagaggtaaactattgctgatgtggagggattagtgactaggaaacaaagatctgaggtctttagaaacaaagtcacttgatagatggggggtggagagagaaggaaggaggaaaatggaaaagaaggcatgctgttcttatacagttcattcccgacactgtctcaagcattaacactctcattactagatactattcttccctgagtgttacacagaggtaaactgaggcctgggcaagtccaggacagacccaatcgtactggaacagagtctgcctccggactcgctgcacaggcacacagcaaagcctggaagcaactctgaagatttcctcgatggggtctttccttccttccctggagcagcccaggggtttgcttcactggctgggcctcctgtctccagtaactcctggagtgaacaccaaagtcccccagcatcaagacaggggcacacaaccaggacaactctgaccctggagccagggggctgtttattccaccatgtggctgctttttccaacatgtgacagatgtcacgattattctgccaccaaagaggcaccctctgccactcccctaaagcaccaaccccaacagacatggcctcaacctaaacccaactcagagcaaaacacaatggaaaacacacctaagcaattcaatggtgccttacaaatggagttactccacggttctggttgcctgaaactgctggtttatgtgtgtggcccaggcaaaatattagcaatgccctcttttactttttaaaactcttccagtttggaaaataaattccagggtcttcctacttgtgatgtacctggaaacccatatattatggaatctacatagagatgatgctattttagagtatatacacccatgaccactatacactcctcactcccaaccccatatcaaccatccagtaaacaaaactctcaacaccccattcacaacatgtagccatcaagctgtgctcacaaaaaaaggtatgcactccgccaccagtcatactcttacactgctagtcactacacaagtctcccaatcatggcagatagagctatctctcttccactattcgggcctagacacgactacacatatctcataatttgggggagcactgggacatatgcacccacttggacatccatccaaatcagccttcagggattttaaatggaaaagccccggttgctgtaatggctacaaccttgtaaggacatgagtccaagttcattaagaagctgggtacagatgaaccctgttgctgttgtgattaataatcataatagacagtcagctggagggcttgccagctgtgccttccaggtcctggttctgggatcccctctcatccaccagtgagtaatggtttggtttattggaaactctcttttcattttttatggcttcaattaagcgatggggagaatccatcatgtaacctttttgctgcactgctaaagacttccggaggggaaaatatttatcaaaccccaaaccatcagaggagagactgcggtaaacctaacaggagactggggtggcagagaggtgaccgagatggtagggaggggagaaaaaaatatccacacagaggtttgatgcttggacaagagccatactctctgtaaaatatctgcttatttcacaaatatcaggctactcctcacctcacatcccataaccacagaaagtactccactgattatgagggtggctaattaatcagcccccagtccccagtcatgtggattcctatagcccaacaggttcaaggtggcaagaagaacagagacactggcaagaggcgtacgtatcatgagaggcataggatgtgctatgagttccatggaaacatggcacccacacgaaaacctcccacacacctcatggaacccgcaatccctatattgataagaatgccaaaggatccatttcctagttgtaactacaaattctttccaacgccaaggacaacaaatcctctcccaaatcaatccattggaatccacaacctcctatccttggccctacacaggcccctaccctttccccgacctctaccaggcagccctgctggtaagcagagccgtctcttattctgcccttcaaagtattcacaccctaatcttggccactggcattaatctttcatttgctatttagacatctgattcctggggcaggattgagagatgtcccttgggagatcaagttggccagaggggaggtccgaagggagttggcggcctgcagagcaacaagggcctgcctggaattaatggggtcatcgccctgctccccatcgcccaaaggaggaggagccacagccagaagacacagatgtctgaagaaatgagattgcaggtctgtctgctttataagacgtgtgtgtgtgcacgggtatgttcacatgtatgtgtgtgcgagaccagggatatggcctctcagcttgtgtcagtgtagctgctgttaggagatttgtatctgctctggtgcagggaacagaggtatcaggagagctgggcaaacagataagactcaaataaaaatgatacacatgtgggccctgggagacggtattgtctccatatgctaactagtaatactacaggttagatagtcagcctgcaaaacataactctaataggagatagatggtggaaatacacttccctttctccctctttctcctcctcactctcagctaacctttatcaacacaaagttccagggactgtgccaagtgttctttattaattattttcatcaatacagcaaacccacaaggtaggactatcagtacctgtattttacaggtgaggaaactgaggtctggataggttaagtaaactgcccaaggttctgcagctagtaagtggtcaaggagaattccagccaaagaagtttcactacagataccaaatttaaccaatgatttaggaagaaatgaacagataagtttgatatagactagagagcactggggaaagaatagattatagctatgctgtctgataaccagctactcgtggttctttaaaattaaattaaatttaagttaggtaaaatttaaaatctagttccttagtcatactagccacatttcaagtgctcagtagtcccatgtggctggtggccaccagaatgactagtgcagatatgaatattgccatttttactgaaaattcactaggtaacactggttagaggataaggctagatgatggcaaatagaaacacttttcaggataaccagctggaggaaggatggcattaacatgtgagttcttcccatctagaaaggacaagaaaagggtgaagagcaaagaggagaacctagggcagcatgacatggatcaattggttgctgttattaacaagtgagacttcaagaaatgccacagaaggaaggggccttggagattagcatattcaacctcttttcatacattacaataaggccagtgacaactggggaggccaatggcccaggtcacatagccagttatgtcgaaggctcttcccatcccacccagcctgtcattctgggtttttcccatcatcctcatccttgatcccttctgagatgtgcacagaaaatatcagagtactcagaggtgatttccaacacgtcttcacactattatgactcctgacaggtaaatcactagctgtattgctgcatcttcctttcttataatggcacagggctgtccaagaatgagacattgaacatttgtaaaatagcagcaattgaaaagataaatggcaaacctggagtttgggaagcagcccagtaggactgtcttcctattcagtctcagtaaatacttcttgaataaaccaatggatgtttggctggatggaagagtggatggatgacacctaacagttcttcaaccactttatggactagtgccccattctcccacccccatactgttcatcacaaactcacagttgcttctctacaagctactaaaatggaaaacatctcagcatgtggaaaaattcaactgcatttcagattctagttaaaaaaaaaaagtgactatatcctgccatgcctatataagtcctgcaacggaatgttgctgaatgccttcttgtctgcactagaaattcacactctcttaagctaagtgtatgcccactctacagggactcccgcttccccctggcctcaaagatcattacctacctctttgcgtgaggccaatccatcctcttgacagctcacttaccacggaccagggctgtgggggagcctctgacagccagagatgaaatggcagaaagggctccttgtctggacattcttgggcatctcctacccgccacattattgtcaccatggccaagtgtgatccctgtgtcatgaggcctgcgcttaggattggggctgcctcctctgcttcttcctagacccttgcttcgtggttgttccctcaaactacatattcagtcacttaaatgacgcaattgttttgagactcagtgaaaaatctcaggatatagactttgtccagtagataaggaatgaggtaatgctttagttcacaaattccttgagggcagagattttatttctgtatcttttaaatctgaattcccagtgtacagaaaaatgccttgcacaaaataaataagcaatacaatagattaatgaatgaatgtatatatgtgtgtgagggagagagagaaggagagagagaaaaagactgaaaaggagagagagagagaaagggggagaggtgggggaggaggggagagggagagacggagggagagagaaggagcaggagatcaacaaatgcccaatctgttactctggtttctgcctgggctgctgttatttcatcccaggaaagctggtttactctttggtccgtgggtctctgttctctttctctctgggccccctatctacctccttagttttgtggggaaattgctttctctgcaaccacctggtcctctaaagactctcttcttaggtcactttggtttatttggacaaaacgcttctaattcattattcctcctgtggaagactttttgagtttatttagaactagcattctgggcactgagtcttaatgaccatccacagacaagcacctagccaaccaaccccagctctttgctgagtccttctagactcttctgcagctctggcacaagcactgcccttcttgttgctgctgtatgttttatcttattttttaaaagaatgattacaccccttttccaggctctaaagtgacctgaactcaggaaaggttctcctctccatccatcaaagttcattcatccctcccccaagtttctccatgatttctactccagtccctcagactccagtggcaaattcacctcaaatttttggagttgtgattgctcctgttttccaccataatatcaggattgaaactttctgctgaacatagttccttggcctcccaaaactttccagatcaagatggatccagcccagcttagctctcaagtcctagaatcccctgctcagacaaagcatatcacatcctaatgctctgtgtggagggatgcctattgttaatgtctttgagaacatgaagcttggctaagaactggttcacaaactcactgcttgaaattcaacaggcatcctgggcaccgcctggagaaaggaagaggaaagcagggagctctgctcagattccatctctaagaccaaggcagaggctttgtagaaatcaatggttttccttccattgcaaagggggcaactggcagtgacgagcagaagggtggagcagggggtgtgggaagaagaacaaagagtaagcaggaggggaagaagtgagaggcagagggtgtaaccatgctcccatcctctacagattcttccccttcacttcctccaggcctggattcactttcttttttaatggctggggccagtgatttgttcccatcgatcactattgatgtttttcaattgtatccgtgacacttttggcaatatgtttgtaaacacagagccttctgggatctcacttcttgtcaccacgtacaggcaccgtctccttgtcactgagtattagctgtcaatcaaagggttgggaagggagctctgtgtccttggtcctgggacttgcttctttttgtctttctgcctggaagtgaacattcctcattcattcccagagggaaaatggaaaccttcctctttaagtgggagaaaattgggcgagaacaaggaaaggtttctacctggggccaggcatcgtgtcctgggcagaggaaaccacagttcttctggggagaaaaatgcagcagagaatcttgtacccaccagtttagcttggatctgggctgcaggagcagagaactgctcccttgaccacaggtagctgagcagcctgcatccaaatttcatcccagataactgggtgaacaactagaaatttcctgggttcacctagacaaggagctttccaacttttttgatcaagacccataagtaagataaataattcagctcatgactgagaatacacatacatgcttaattgaaataaaagttaaaggaaataagaaaatatttaaggagaaacacagccttacaacaagtgatacactctgatagtttctgtccattcttctgtttttcttttttgaattctggtcatgttccattaagttgattcatgactgcctgctgtgacccacagtttgaaaaaatactggactagaccaagggtcagcaaacttttctgtaaaggccagataagaaatattctcagctttgcaggccatatggtctctgtcacaaccactcaacatttccgttgcagcatgacagctgccacagacaatacataaacaaatgaatgtggctgtgttccaacacaactttacttatgtacagtaaaattcaaacttcatgtcactttcatgggctatgacatagccttcttttttttttaaatcattaaatacggaaaaaaaatccttagcttatgggctgtacaaaatcagaggtgatctggatttggcctgggagccagagtttgtcaccctctagaccacaccacatcaaccaacgcttgcagcatgttgccagtccttctcttcaaggcttctggcatctacaaataggtgggagtgaggggatccccaccaacctcttccacacctgcccacgagtcaaggtcaagtccacattgctcctgtgcctctgtattagagcatgaattctaatgtatttaattgatggtctctgttcccctgaactgtgtcctccaagaggatgcacttcttgtatcacacgtttctcactctgccttgaaatgtctctttgcttgtctacccatgggactgtgatccagtagattcctgagctgctggtccaggggacagcaagagagcctctgccctttctaatacttttcttggctcatgcatagaatctatggctgggctcatcctctggtgctccttggtacctagcctcaggctccagcctccacagcctcctcagctaactaaagccacagggctcccacctgccccacaggtgcctctgcacaacaaaaagttctttgcctttaagcacctgaataggaagaagaacactcagttcttttcaaatttacattttaacaatttttttaagtgtagagttaagtggtgttaagaacattcccattgttgtgcaaccatcaccactgatatggtttggctgtgtccccactcaaatctcatcttgaattcccatgttttgtgggagggacccagtgtgaggtaattgcatcatgggggcaagtctttcctctgctgttctcgtgacagtgaatgagtctcacgagatctgatggttttaaaaacaggagtttccctgcatgcactctcttctcttctcttgtctgccaccatgtgagatgtgcctttcaccttccttccaccatgattttgaggtctccccagccatgtggaactgtaagtccaataaacctctttcttttgtaaattgcccagtctcaggtatgtctttatcagcagtgtgaaaatggactaacacaactgccatccatcttcagaactttttcatcttcccaaactaaaactctgtccctgctaaactctatgatcctattcccctgtcccccagctcttggcaactaccattttactttctgtctttatgaatttgactactccaggtactttatgtaggtggaatcatacagcatttgtccttttgtgtctggcttatttcacttaaacctcatgttttcgaggttcatctacattgtagcatgtgtcagaatgtccttctttttaaaggctaaataagagaacactcacttttaaaaggtggttcccaaattgccctagaatgtaagaggagttttaacatatgacattgacaacaaactctcttcatctcttccccaacaataccaaggatggatctcactccatcttcttatcatcactctgcccctagaaaattcccccgttctgctcaccctctctgtcttctctactatggtgtcagggcaaccgagtgggctttatttatggctgacatccctgaatttaaatcttagctgcttctttactttattgctaaagttttttttttttaccacagcttcagttacaaaacaaaaataactaccttctatataatgactgttgtgaagaagaaataagatgaaagatacaaaatatcaaacacaaaacttacaacttagtgctcaaaatggtaattattattattatcccaattaataatgttttccagggtcacagtctggtcctagtatcccaaataaaccctagagatccccaagagcatcccagaacctcttttttgagacaccaatttagttaccaagagtatcgcagtgggaaccccagcttagaactgagatgtcaaatacatcactgcttcgctgcaaccctgggcaagccaatgtctttctgtattcttcaccctccttggctgtgaaatagatcaaatgatgcttctaaaattctcccaacaatgaggtaatgtcttcaaagtgccctgagcctttcacagggaagtcgttgtcaaatagacacctgtagtcacagaaaaacggttatactctgggaatgatttgctcagttggttaccgaatggtctgagtctatgccttatgcaagccccaccctaggagctggaaaacaagggtgaacatgtgagcccagcaccctccttcaccctgtatggctctgcatggatgggatgcaaagaatctgacttcctgcagaacaatgggtgccttacccagacagaactgatctctcacctcagagagcaagaggggagaagatgaacatctatttgggatctactgggtccctccagattttctacagccacaacggcatttaattcttcccatgtatgtgcacacacagagaagcacggaaggatatgcaacttacccaaagtcacacagctggtgcatcattaaagctgagatcaaaagtacggctgccgacttccaaaatccatgaatgtgccacccttccaagcagccatgctaataggggccatcgtaattgtccagcagtaattcatccagagacagattcgtgttggccatatctaatggcctggctctcggtccccttctgtctcctttatgactcaagctaattcacgatgtgcttagtcagatgtccagttgccagtttattgtctattaggtttgcagagggaagggaagtaacatttgctgagcactttccaaggcccaggccctgttccaggagctcctggccatacataatctctcttaatcctcataatatccctataaagggggtattattaccccactgggcagaggatcataaagattaagtaactctggataaccccagaagatggacaaacgtgctggcctagcacctcgggaaacctctgaaagcgagatctgccaagcaaagcctcccacagccgagggagccaggcttctccacctcatcagaggcagagagtcaagggagagcagaatggatggtgtggcaggttctgattaagaacattcatcatccctgccccgctagccccttggggtggcatggaattcgttacacgactcctgaaccgtgttcatcctctccagcctcctcctgtgcgaacaccgtggaattagccaggaggggtagcaaagaaatcagatctgccctgcggaggctctgcattcccagcactgtgctgggtactttgcattgctcatctttcacttttacatcaatcagatttagtccatatttctattttgcacaattcatgttattatttcatttaacttttcccaacctgccaaagcttacgtagtgaagggacgctcccaagtccactcagctgggaagtggaaagctaggatctaggccctgttctgtcctccctcagggctccaaacaatctgtcacactgcagcagagagaatgaaggggtttccctcttcccattttgctgatggataaactgagtctgagagcaggaagttgcagagagctgcagagatttggggccagaatatcagtcacatgtatgcccatccagcttttctagagatggtcatgaagccaaagaggggaagtgacatccttaataaaagctcatttcagcaaaaaagctgaggaatctgtttaattgatcatcactcctcccttccacaacagcacagggttttaaatgggactgggctccctgtctggaattctactcctccctgaaatgatccgataacaacagagctgattgtgactggtcctccctccccttctctctcctgcagaatgtttttcttcatccctgttttgtgtcttcgtaattgcgttactcacatagcaacacatggggatggccacactacagccaccaccatcggggccacaaggagaaagcaacagcattctaggagaacgcaccactccccatcaggcccccttgaaccaggcggggctgcatggaggtcaatgcctctcagggctgccctcccctctggatcagctcccagaacatgccctttgcctctaaccacgagcaggggtcacctgaggcccttgattctagccccactttagctttcccacagagaaggctgagacgttgaaaggcatgagcccacgcctcctcctcgccagggtctcagtgactccccagccccaggaagaggagcagggagcccctcacccaacatcaggcccatgtcttggaaacgcaggggttgtggattcacatgctggtgctgctggtctgccccccgctccctggcctgggttttgctccatctctgagcaacttttggaaaagaggcagatctaggaaatccataccaagtcccaatatactctatggctgaaggggctgaggagggagctcagctggagagccctggcccaggcccacaagacagtagagggggcactgctccttgtggacgtccaaccaggctgatgtcgtcttcatccttctgtagggaccaaaatcttggtggaacccccacccttcctggcaagtcaggaggtcagtagaaccccccaggccagcattcctttcccagcctcattcctgcccagggctccctgtgacctgcccctcccccatgtgaggacactatacaccctggatactgtcccctttccattccatttgtaattgtccctggcagaaacagcctccctcaaatggtgaattctcacataaatgtttggggtgatgcatatcccagttacccagatctgatggttacacattacatacatgtaccaaaacatcacattatataatcaataacaattttatacataaataaataggaaaaaaacgaggttctgctagcgtgtggtttggcagctgtcaaatcttgtgctagagccgagtcctgaccatggtgtgccctccacgcatcgtccagctcacccatcctcccaggaaggccacccctctgctgggtgtcagcatcacggcacctgggtgggtgagccgctcactgccccgccctaccccagctgccctctctagccccactgtgccacgtccccttggcaaggccactgtctggagtctggaacacagaaaaccattcctggaccctccgcactgccaagtctgtaaaagagcaggcgcctagcctctctccttggaggctcaggccatgtcaatctcttctacgtctccctagtgccaagataataagggggaaagtttttttctcctccttccagagtgcagaccaattagcattttttaaattaccattggagaaatacacctaattagccactttaaaggaaagctttaaaaaaaaaagtcataaatttctaactggccacagcttggagacacttttaaagctaattgtgtgtttctggcactgacaggggaattggtgaaagtaagagaccgattttatgaccttggtgggaaaggggaggggaaggctgaatgacgtccttaggccaagaaagggttaatgtctgtctcccggaaccccaggcccctcctggctcctcctccccttcctcaccctccctcatcagatccccacctctccccaccttgagccctgccttaccccagtcaggggtacctgccttagaagaggcagacaggaaggcagacaggcaggcaggcagacagggccacacactcagccagaaaatcatacaaggaggaagaaaagggcagaggacaaagagagaggagaaggacaggggaaacagagaagaaagaaacatttgaggaaactgagagaaaggaaccaaagccaaattccagaaggctgtttctcatttgtgcttcctattaaactctccatcgaggtgggggcgggagctgggggctctggcctgctcttgaacatggtgcctccctcagacagttccagtggaggcagacaggggcttctgcagccctcgggcctcctgcccaggctccctgaccctgctcagtggccccaactccctgtccctgaaactgagaaaactcttcataaagtgcaggcacaggactctggggtgcctcatttaggaggaaggtggcacagggcagtttctggttgctcccagcctctgccactgctgtggattcattcctgcctcagaaaaggggaaagagggcctctcccagggggagatcagtgtacaactggaggagtgtcaagaagtgcggccaagcaagagaagatgcccagagcaactgcacagggcctccatcatcctgcagagcccaccgccatggctcatcagcccttcaatggcccccggtgatgacccagtagagcggctaaggtgatgggggtgggggtcctctccctcaggaacacccctccactggctgggttgccgggcaggagttagggtaggaacaggacagtatagatgtattgtctccacctctgtctgaggcacacagtgtgaccagcgctgtcatgtctgcccaaccctagctcagtgtcatgcccacctgacactaggtgtggcctccctgttggttgaaggggcagcagcaggtgtttgcattctatacatggaaacttagaggcccagaaacactgaggcaaatttgctctagtagcagatttagtaccatctaaagtcctgggaggcacattcttcattcactgagaccctcctttctatagcttaagtgagagtctggagaaattacagacagtttcaaaacatatagtcttctggaaagcccagaacatgcattctcaatgggtacaagagtgctccccagagggtgaaaattagagggcaaaagaaaaaaaaatcttagatataatgatttgtggccctccaaaggtcaacattactcaataaattcacatgtcgtctcattaaagagaatttaaattaaatttaacttgtctctaagggggaaaaggtgatttttaaaaagctgagaaatgctgacctagggcagtagcccctagagtcctagagtcccacaggccagagctggatccactcacctgtacccccttgggaccaagctcagcatatgaaacaagaaatggggcccaggaggggattcttccccagaactagtcagtgactcctactgaagacactcacaaactttaaaagtggtgggagacttgagcaacctagcagggcaactgggtaagacactgcaatgctgtctcttctgccagggcagagggaagagcttctgggagacaaaagaccttggggcctcttcctgctcctcaccccagaccttaaagccttcagagaaatggcgcactggacgtctgagctccaggaggttgactgagggcaggattggagtgcagggctggaaggattcatgaccttaaaaacagccaggggagctggggtgccccaagtagaagactagggtctacagcgccccatcagagcccctcacactcttccttttttcctcccctctctggttccagaggctgggaaagagggaagagaaataactacacagcagaatggacaggcccccacccacccagtcataaactcatgggtgacaattgtgggggccctcacctccacccctaaaagaattgaacctgggctagctcctctaagcgagtagtacagctttcagcctaacaagtatccatctttactggcagcttcaggggctggtggaaagagctctggggtcagacctgctgggctttgcacaccagcaagtcatggtctgactgtccctgtgatcttggagagtctggttcttgggaaggggctctgacttaccctattctcctgcccgatgccttctctagaacccatcatgcactacgtgcttcatacatgcttgcagaatccaatgtgatccttcctttgcaaatgtttttgcaaaaggaaaatggaagtgaccatctccccgcctcagggggttgttgggaatgttaaagagatggtgcggacatgcagggagaacgtgtgcataacaggcaaggtgggcatcccctccacatcccctctcctctccccttgctagaaaacccatatgcttctgcaaagcaggtgagacgaggcatgggggaggggaggacatcggcacagacagggaaaccaagggacactgcaggaaagcctccaggtgacatgggaggccccatgtaccccaagtgccctgcatgagctgccttctgcctgcccccaccagagaaccctgcagtgaagggacaaattcctaatagcggggacgtcccaggagggtccctttcctggggctctggcccaaagagccagcacctttgatgctttcccaaagatctcatagcagggaccccattctacccactcaggctgaaatcagtgggaagtccctatgctctccccatctggctctccctagctttctgggggtgatggatggctcaagagttgcaatttttgttctgttaagaaagcacaaacaatccgatgccaggaggcgaggaccttgctccctgttggcgcctggtgcaatccccagggagctctaccagtgtcagcagagaaagggaaaacagctgggtctctagggcccgagagcaggcgggagatttattattttggggtgattaaaccgaagcttccaacacctcagtgagtgtttccttcttgctacccctgctactcagacacaggaaccgtatggggcagcctggctcccggtggtcccctctgtcccggtccttgagaccactgccaagacactgcctccatcagacggccaagctctggccagcctccaggtcctcgcctacctcccactccattccctgtctgcaattgtttccaatcagtttaggaaacagctctgagaacaattagaaaagataacgaggaagaattacataattacagttctcctagatctcaggcacttcaggggaaaagaaaaaggctgaactgagtccaaacagggaccaatgtgaggaaaagatggtacttctggaaagctttcggggtgcaagggcttagaccctgaaggagagtgggaaggacaaaggcactcctatgtctgcctgctggtcagctgggggctgcctccagctcagggcctcaaaggacggctcagaaagtcctcatgcaatgcagacctctctgtggaatagccatgtagactacagaaccacgtcccccttcaagatcatgcagcccaaacttctcattgtcaagatgagaaagaccaagagagaaaaggtcttgccccaagccaacagaactcaggactccaagccccaggccaacactttgtccatgtgcaggctccttaacttctgtctttggtccctgggttacaattcactggtcccacccactggacagctgggaaattctaccttcttgaccaaaatggatgggtataggaagaactttgccctctagagtaaagatgggcaaacttttcccaggaagggtcagataaatagtttaagttttatgggccatgcaatctctgtagcaacaactcaactttgccatcacaccacgaaagcaggcacagacaatatataaacaggtaagcatggctgtgttctagcaaaactgtatttgcagacactgtaacttgaatttcatattattttcacatgccatgatatattgttcttttgatttttttcaaccatttcaaaacataaaaatcattcttcacttgtgagctataaaaacaagtggcaaacaagatccagtccatgggttggagtttgccgactgttgctctaggatgttgctagaagactttgtgcttctctgattattccacacccagagtttaaccattccttgactccataaacccagcatggtatttagaacaaggcttgatggtcagtcttttctaggtcacattgccgtggtaggccaggctattaccaactatgcaagccctcaggaaatcatcctacgaggtttactcaagacacctctgacgtctgtgagaacccagtccccaggagcagagtgggcagctggatgacagctttccctagatgggcaaacaatccctccccagaagaatatggaagaggaattgcgtctcaatctgcccctctctatgcagagggtatttgtggcatatgaggtaataagagaccaacatcctgagtttctatgcagcacaacctaacttaccactgtcttctcctactgcctctccgtttagcaacagggagtaccaagtatcttcattcattcaaaaccagcatattgagtgaatgcctattctggcatcatgccagaggaaaatcaggcacaggatatcagacacatacagacatcaagtctctatgcggttagtaccctgacagcagggacattactcctcttctgcacccagcacccagcaccgcatgaggcacacaggagaagctcaggaaatgctgagtgaattagtaaatcaatgtgcaagatggaaatggttaagtagcacaaggcagatcaaatcctatgcaagcagagaggagggagaattaggtccagctgaggaagccaagaaagggccaatgacagagggggcagttgagctaagcctgacaagatgagtcggattagggtatgcacagttggggcacagagaaagaggagagaaaaattccagccagaaagaacaactagcaaggcatgatggtgtctataagaacatgcatagctgaggttgcagtcttcatgcctcttgaggagtaatagcttgagtgctaacaacccagagttaagctgtttctagattgttgagggccaagaaagtcaggcaaaagagtttaaacatctgtaggtggtaggaggcattgaatcttctgagcaaagatggttgggtggcaatgagattaggaaagtgaacatggtggcagagtacataaggactggataagcaaggagtctctttaaagaaaccctaaactaggacaggagcagcagcctcggccacaccgctgggtgaagcggaagagtggctgtgggccagcgggaggaggtgggacttgtaaagtgattcatggttatgagtgtagacccgggaatcagataaactgggctcaagtccaactccagcacttactccctgtaaatgatcagtcctttctagaacccagtttccctatctgtaaaaccgaggcaataaaatggagtcatcatctcacagggtccatgtgaagctgagatgtggttaaacatgtgaagtgcttaccctcgtgccctgcatggagcagattctcaatagaaatttgctaatcttggtcaaattctgtccattggccaggagtcccagtcaggccagagaagcttgtttttgccagagaggtggaagggtagttgaccacagtccacaatcactccccacctcccctctccccctcccaatcctgggtggtaaggcacacaccacatcctcaggaagctgacatacaccctcctcgtcactcctcagccagctagtgaaaaccaacaaccagaaatgtgcagtcccatgtggggacctttgtcaggcaagtcaatgtgctcaacagaaaactcatagccccaacactgtgagagggaaggaggaagggagggggaagacgtgactcagaagttaaatgccttctttcttagaacacaggagtgtcacagcattcaagccaagacctctgacctgcaagacatctgacctgcaagagggctcacttttgggaaccctcatgctcacgatttaggcctctgacctgctaggaacatgatcagcatcttggcagagagagcacaggccctgcatccaggcagccatgagctctggtcttggcctcagcgctccctggccatgtgactacgtaaataaggacatcagttaaataagggtacgtgagataatgtgtgttcagcacagaccgtagcccagtgctacagaggaatctggaatttggagacacggttgctcacacctgagacgaggataggacctcgcctctcataatcaatgcctgcctgagaccttggtttctgcttaggtggaagtggttttaaccaggctcagaccctcctcatactgcctactggtggcctctgtcatgagctctcccccacacctttttagatggctcctctgtcttcctttgcgtggaggttctgtgtttctccacaatagtagtctcttctcttccctggtccaattacagcccaccctcctcactccaagaagctgggtatcccatccctgcatctaacggggtaccagaactggtgacggacgactcaccagtcactcgtggcattctctaagaagcctttagttagtcctctctgcaactcccttcgaatcccgtttatgagtgaccagtctcccaaaagcaagaatgccagtccaagaaagcaggaatggggatttgagaaaaagaagaaaataaatgtgtttctgtgctcagggaagctctccacacaacacagctcaacttcctactcctgcattgccatctggttgctactggcaaccaggcaatcatatttttctagtcccagatataatcatcataatcaatatagggtatttatcccactccttggttccaaggaactcaaagattttcacatctattattcttccttcactaacgtgagggagagaaggggaggaggtctgcttgttgatggggtgtggggaaggactatttcacagatggaaaaactgagggaatgggtaagaaggaggctgtgggaacatctcttaagaaaacagtattgctaaaagcagtttgcatttggatagtgcgttcacttttgaataaaagtgaaaaaaatctcatctaatttttacaacatccctctaaagtaggttcatttatcgtatagacaaagcccccaaaagtaaaggatctttccagaaacacaccactagaaatgacattgcctaaactcctaggcctttcgagtcccttttagcatttttttcccgcagcatctctgcaaacaagtacagtacattgttggagctatcatgtctcttgtatgcattaccaccccaccattgtaagtgtttctcattatacttacattgtgcattacagtggctcttacacataggaggtttctgtctagttccggttgatacacacaccaaatgggcaacagggccaacaaaaatgactagactaaagcacttgactgcgttggaaaacttaggagccatatttaatttcctaaattctataaatgttcctttactagagtaaaacttggggggaaaaatcaatagttttgactctgagatcactcaccgcttttgacaactctgtgatgttaccttttcctacagccactggtttgatgtcaccttttgtcacagtaacaaagcaataccaaaaacatgctttgggggtccctgaagtggacaggaagccttctaccctacatacccagcaaaggcttcagtgccacccttgctcattagtgccaaacacaggtggctggaggtaaaaagacactcaatgaaacacaactgcaagagaaaacatgtggccacggccacagcagaactgttctaagatagggcgtctttctgaggtttgtgctcagcattcatttccctttggagacagtagaaacaccactgaaaggaagagagtagctggcttgtgcatgaagcttcctctctgttctcagaaaagagaaccagctggacaccatcttatcttttatcatttcctacttagagagctgcacaatttaccccttagaaggagaggccccaaacagaagacctgacctgtgatacctgtgatatccgcgacctcctgagcaaggagataaaaggactcaggtcagccctgacttcctaacctcatctggcacctcttcggattctagaaagaatcaccatattggaaaattccctccataccctcattccattcagttgagtaggcagaggggggaaattagaaacaaaagtgcctgacatgctaacaccaggctaaggattcacagaaggaaaagttgatgatcccagtccctagagatggatgaaccagtgtcagcccatcaatgaaagcatgttcagcacctactaggtgccattactatgcaactattccaagctgggtcttgaaaccaggctggtctgcccaccactgcgcagccttgcctgactccaaggacgcttcccgcctttggttgcccttcctttccgttcctatttcctcagtttctgacactttgcttttgtctctccttctctctccccagtgccctcactggcatcagatttggcactccggtgctggctttccaagctctcttttggccacagtgtgcacccagctcccggttccatggttttctggccaccgtagtgtacccacattgctgtccctggggcccagctcaccttatccatcttggttggcatctctgccatgcctgtcccagctgcccagggtgggaggcaaggagggcagagaggtaggtgaacactctgtgcatgctatcctgtctctccctgatgtttagcaaaattcagacttagaagttcagattccctcaagacacaaaccagtttgtggcttttcttaagtcatgctgtttcaagtctatcttaaagtagattcctgactacaactattgctttctttgtataatacttgcttctttccaaggagcttgccatctgctatctctttttagccacataacatctttgggatgaaacgtagtcagatgaaagaacatgaaccccatcttgcctcatttggggacaccaaggcacacagaccatgaatgatgttatcctaagtgtggaacggtgagctccactttgctctgaccaccttcagctgcataagctggcacagccttgacgggtacagatgtagagagttagaggattagtctcttgtgtggatgaaacactagccttgccagggatttaccaaagtccccactctaatttttcacccaggatgaggaacccaagtccagaggctcaacacctctttccaggtctctgctctggggccaccctgggaagagacacagggctgagatccaagttcccagtctgttccatctctccccagcccttctttatgcataaaggacacttgttggggagtcagtctgcgcttctggcatctggacacatcagcctatatctctaggactcgagcaggaagtatgtttgcctcgcctcgggcttcctggccacacagacccacgtcctcatttagaatggtggcatcatggagccggctgagatctgcagtcttcagtgtcagctgcgggtccacaaactcctactgaacacgtacccatagccccaggggaaaaaacaagggaggaaagaaaataaccaaggtggggaggggggagagattctggaatctagacaacatcaagagccctgtttccatgacaaccactacttaatacagttgctcagactgcagcctgttctaatcggccccgtggatggagcctgcagacccagaaatggcctccagccacggggctcccaagcagcctggaggaccaccaccatcctccaaccaccccaatctcctacaaagagaacagagggcaaaggaggggtgaggctcacaggggaggtgagaaagaacaatgaggagtgttgaagaaagtggaaagtgaaaggaaggagtcagagatacagccggacatccggggggttgtctgtggatgtttgctggggccacctgtgttcggcaacacttgtctttgtgttggtgagcctgtgagcacccatgagacgcatgacaggctgtagccagcgtgagtgtgaccatccacagcacgtccactgagcccatctcccttccccttcctacacattggagtacccgcttcctctcttctctcttcccctacaaagctctaagctttgtagtccaaggataacccctgtgaggcaaaggccagggtcagcagccagccagtaggtaccagcagcttccaacaatttctcagcaaattgttgggatagaaagaacaatagtactaatattctctaaattagaggtttctggcttaggggcacccccgaaccctgctcctcacagacttctccagttcccagaaaatgatgggtgacttctaggttttcttccaatccacatatgagacctcagaggctggcaacttgtcaaagtcacctgctgggtcaggtgtcagcctggagactctgtccctggaaagccacacatctccctgcatactccaggctgcactctccttcttcctgtattcatctggcaatcacccaaacacgctgcaaatcagatgacatatgacatgctgcacactccgtccaactctgaagggagtccgtctatggggacaatgggtctggtttatattttaagcagctagagtgaaaaacggggagtgatgaggtaaggccatggcaacgaacaccatgccactatccaggataattacttcgcccagccatcctggagccaggcggcggaagccttgccccatagattatgagcaatgagacagggccagccagcttaggaattcccttcctccacctgcaccttcactgcaaatggaaacacagcagaaggaaccaatgcagtgggagatcccaatcaaagcaagatgacctgtccctcaatttccaatcgttggagaaatgcaaagaaaagtccctatgcatacccctcctccaagttgctacatggaaaatcagagctctgaatttcggtgatggctgctgagccaagagacaaggaagacccaaaatcagcataggacagagatagtgaaaaggtcagtgagcgagagagaggaaaggagaagctgaaagatgtttgccgcaagctaggaatgacctattaaaatccccagccactccctcaagctgggatgcggtccctgttggtggcttcacagctgctataccccactcaatgcaggctgcttcagggctccaggacacttgtactattggccagctcagatgccacccctgcaggagcatgtggaaccatctgacttggatatgactgggctttcctgctgcaatgccctacagatgctccatcgccatatacacatgccttgctcagggatcatgcccatgttgaccttggccccaaaacacggatgggaaggagcatgcccagggagcagccttatattttcttttcctttgttccctgagtcctcagatgaaaatggctacaagctgatgctctggagaagagaatccaattcagtggccacaccaactaatacagggcatccactttgctcttcaaagacaatcagaagtgcaatagtcagaacatggcgcataggaagatcctgaaaagtccaggcctgtgccagctgcctcccttcgtggtcctaagtgcaaccccttaaagtatccgaagaaattgactcctgaggggcagaaatctagcaaggagggatgtgaccacacgtgtgtgtgcatgtttgcatgcaagcacgtgcacagacacacacattcttacaaatgaaactgcaatcactggtgatgtgtgggtgtatgtgtgagagttagggggttgtgcatgtgactatgtgaagctcgggatcacaaatggaaggagagctgcatctgaggaaaaaaaagaaaaaaaaaaaaaaaacagaaaaagccaccagccctgtaccctccgcaccaagagatccttagcttgttgcactctcattggcctcttcagcctctcctattttcagtgaaactctcctttgtttctcccaccccaggttggccccagaccactaaatacacaccacctgaagatacagcaaaacccagaagtggtgaccacagcaacatgagtacacacactgcagactgtcagcagcaggagggtcatgtgattgcagagggcagcctgacaagcccatgtgattccctccacattaagtggaaaacactgtctccactgagaaagagaggtgaagaggtgggaggagtgaaaagtgaaattaacttgagccaagattacgcccatgggttctgtggaggccaggccggaaggaaagtcaagaggaggggcaggaactgcatccagcgtgtggttgtgtacggttgtggttctgggaggatggagcttttgagaagtgtgtctctggtacaccctatgcaggaaaacctcagcacgacttacaggtgtataagcatgtgtgtgggtttgcacgcagcatgccaaaagcatatttataaattgggttaaaggttggttaggaccacagattctggttaaaataccagctttagagtatatgaccacttagagcttcagtgtcctcatctatgaggtgtagataacagtaagtaactatcatagggttgctttgatgacataatccatgataaagcacgggacatagggcctggcatgtagtaagtgctcaataaatactaatttggtttattattatttgatgttccccatgatctcaggtctaaaatgacatagcaaaaatagggtaggtagatacataacattattatttgcaagaaagccacagttcatattacccagttaaacagggaatggctaacttctcaaccacacactgaatatcaagataggatgataattctaactggataatctcagtattagtctaacatatatttaaaagtatcccatagtgtcattgtaaagcaaggactttgatattagactatgggagtattctatttttgccacttgctggtaattaggctggcttagcctaatgccctgcacatattaacacctcaatagctgtttttaaaaattacagctctgtggagttttagatgtgcttaatattgacaattctgttcttggtctaatagctttttttttcaatcatccttatagctgattgtcaacatatcaaaacaaaaagatttattccatatcaactgcccactgctagacagtaagtcatcgatggactttcacaggtttatatgaaacatatggatgtattaattcttcaacccacattgagatgaactgtcacgtcccttttaaactccatcacaggcagcaagtattaacctgcaattattaccgtgtataacgtgctttacaattggcaagaacgtcaacagtccctggttcattcagcagccctggtatcattcacaaactgcagttctcttttttttcctcaggcctggagggaattgagaagcagaaaataatctcaggcagatccagctgccctgacacttgcagtgcagctggcaggtgccggagcttcagacacgtggcccacaggtgcaacaaacccaccttgcttgggctctgcaaccatagagtcccgccccggccaatgaagccatccctgggggtctctgaaaattctccaggctatctgcaaactggtctctcagaatgtgtggccagctacactttagaatacatgaacaagcaatttacttggtgattcacattgtacatacatgtatacacacaggtacacatggatatacaaatacacaatatatccatacatacatgtgcatgcatatacacacatatgcatatatatacatacgcatacacacatacacatacaatgtgtatatccatgcatagctacccttcccagtcaccttgggtgacacattttgctggggatctttgtgggagaaggaggggcattttctgctgctcaaatagcttttggaaccaaaacatttgcaaaccacttgtttagggggcaagacctgaactcaaggagcaagacctgaactcagaggttcgcacaacaggtgaccaaccaaagtttgcggtcctaattatttctactctcttttccctttccctaaaggccctaggacagtttcctctgcacccatggtcctctaggccctgctgagtagggcactactagagagagaagcacctggttcctgacctcaaaaattcccagtggtgaatgagcagtgtggcactttgtaaagctttatggaattaggataaatgcttctggctattggaaaaccttatttcacatgtgcacacatgtgtgcatgtgcatgtgtgagtgtgtgtgtgtgtgtatgtgtgtgtgtgtgatctgtgtgggcttgtgccatgctgccataaaacacaaatttatcttcataatagggtcaattacattctccgatttccccacaagtgaggcaacaaaaacaaattttgagcttcaacctgcaggagaatgccaggatctctgtgttgaaaaagggagccttggtttaccctccccctgccttgcacagacatatgttgcacagacaaacacctggaaggtgcttctcaattctttgaggttgctgcctctcacatgcagctgtcaaatcacaccccatcaacatgacacagcaaataacactacgacacgcaaccagcaacttttgaaagtatactctccccacacccagccccgtctgccttctccagcgtgggctgctgtcttcaaactaaccatcctgaaactgctttaaagagcctgacaggtaatttattctgtggcagaggatagcaatttcattgtccagaggcaagagatccaactatatcagaaaatccgtactctcaaggaacacaggtttaatatgataacgattctaagggtgtgtgttcataattcttcctgttctttcctccccttccctaaagctgctagtgaatgcttttgcagttttttttaagggccctccaaagaactgacataaaataaatcaaatattttaccacgaaaggtgattatcaaacacttatttgtgaaaagagtcaaccagaaggggtcaaggcctagctgctgttatgggatttttgcccacaagtaaaatgtttttaaaaattgcatctgactctcttggcagaaaacctgctgggatctataaggtttcacttgggcacctggtagagaaggggatgaagagcaaaaaaggttggtgaacaggacaacatccgcttctagaagcaaagtcaaggccgctatgcacttatttttccaaaataatatgatagttattttcacattttatttgctaaaatccatgcaaagtaagtattattatttccattttacatatgaaaaaaccaaggcttaggatattgaagactcagcttcctcaaatataatataggaacagtagaccctgggtccctcccaatggtaaatcacaactttgcatggtgagctcccatcagaaatagaactagaactgaagtctcctaactcttagtctctgcctgctagctcccaccccatgtgactgcatcagatctgcattgcaacaaaaggtaaattcgatgggtaggtgatttttaaactcgcctttgtcaacgaacttgtcataagatcttggacaagatgcttccctttttagtattttggaagattgaccagtaaggggaggctgatagctcctcagatcatcgtgagttctttctgggtggcagtgtccagcacagtgcctggagtacaatatatcctccataaatgctcactgcattgaattgagaataacaacaaaattctcttaacccccactgatgttccctagctaggagcacgttgcgctccgaagcacaggacattgcccacagatcccaaggctataggacttagcatttccatgggctcattgcactaagctcagtgtttttaggtagtaatgaatggaattcttttttaaaccctgcattcggagtctatttcatgcctttttacatttcacattatatttatatttttaaaaatcattacctattttacattacacattttaaaaacctattcagtcaaataataatcctattccttggctgccagtcagggaaatgaaggtctcacaaacagtgatttgcccaaggccagcaaagactgaatatcagagaaggatgatcccaaaggtagactcagcttaatgaggccagaggtctgttggggcttcactttggagaagtccttcagggtaaggagtgccaactgctttgtgaagtggcatgccaccaatgctcggtcaaaatcacatgcaagagtgacactcctgacctcaaatcaccagttgatcagagtcaggggcaagacaagggcacagatcttctgaggctggagaaccacgtgctcaccctatctgggaggagccccaagcccttaatgatctcacgtggccttcagggacacccaggcactccagagacaaaaagagaagacagatccagatctgaaagagcagagaatgagttgtcagtcagggacaaagagtgggagattaagggaacatgctaagtgtcactagcctggattcttgtgtcagggccacagaggtccctgatgccaaaagctgggataagcctgtgggttgcatataagttgcgtatgaagttactgcttgatgccagcaagcactgaaacaagaaagagaagcctgtaaagatggaaatgaggcaactcccaacccccatcccactttcagaagttttaacagatgtcctttccactcccttttttcttgggaatgcctcaagattcttacttttctcgaacgggcaactttccccaccacctacgtgttctttctagattccaatctgctgcttctccatggggttctttctgttctttttcttttttcttttgctgacctttgtcctcccaaatgttatcactcagagaagtccccctccgcaaacttccccacttaagtgtgctctgtgcccaggccctgggctaagcacgagatgtggaaaactgaccaagacaaaaaacagtcccaggccaacctgacctcacagtgtcaggcattaagcaagtaaccaagctgcccgcatcagcaataccttctggcccctgatttttctgtctctgcgatttaccttgccctgatctagcagacttaaagggatcagtttttggggctggcacggcctgagaggtcaaaccccgggacacagtgcccaaggctggctggcgtttgatgggatggcaccagtagggtcctattggttgctgacaaatagagtcggctctgcttacccagcccgtgctgcaccagcttccatctgaacacccctcctgctggttttatcacgaaggagaccaaccaaccgaagcctgagatcatggtacagccatgcagatagtcagacctctccatgcttttcccactcctgtgtcttcaggggcctagctccctcagattctcttggggaacaagaagctttgcccaactgagggatgttcctttgctgatgtttggaggttttccttcctttttgtggccatgttcctacagccaaggcaaatccaatcagcagtaccatccttgttgcaccccgtcctctgtgggggaactttcccggcttctgggctgttctccatctggttccaaaatcccaagccttcagagagagcagtcgcactgcctgaagtttaaatcaactaggcaatttgctttctagaactcaagtctgccgatactctgtacagtttttctttcctcagtgcaaacgagaaactgatggtttcatgactgtgatctctctgccctctcctcccagatgtttctagagtcaattccagctgccaccgggcctgttgtccatttcctggcacgtgctcagtcaatacaaataaagacgatgagccgacactgcgcgtggtcgtgaccatgttcccctggattgccctggacttggtcttcctttagacacttccctcttcattaacctcacgtctgcatcctttctttattacacataagtgaaaatattgctattgaaggattcagcagagaaaatttccaaagaccaacatgtggcatctccagggttccccttcattttctaaattggtacttcactcaaaacatttctggcataacttcttttcaaaaaatgtgtgcttccattccaagcaacataataatagaccaatcccatcagtgagcagaggagggccatggattcctttggctcccctgctgccattcagtgctaaaacactgtccaacaaagccacatccacctcagtgaactgggtgggatccccctgcctttgttctttctctgcaaatgcctggcttagaaactaagcctgattgaaaacctgcagaccaacttaagaacattgtcttgctgaatttcagccttgattaatacccttttctagaatctgaaagtcctttgtcttgaaactctagtccacacttactcctgtccttcaaatttggaaattaaaccagatactcaccttctcatcattttaatgatgccctttggctcaggtgttgttgtcagaaagtaactcttctctttctttttttgagaagaagtctctctcttgtctcccaggctggagcgcaatggcgccctcttggctcactgcaaccacctcctcctgggttcaagcgattctcctccctcagcctcccgagtagctgggatgacaggcatgtgccaccatgcccagctaatttttttactcttagtagagatggggtttcaccacaatggccaggctgatctcgaactcttgacctcccaaagtgctgggattacagatgtgagtcactgtgcctggctgaatgtaactactttattgacaaagaggacccagttctgtcctttgagtatcttgaatggcaggtgtcatctaatgaacatgtaaagggacctaagttccagtaaccccaggcagcctggtgcacatctgtgttaaggtgtgtgtgttggtgtgggagggtgtgtggggtttgtgtgaagctgtgccaacctgtgggtgtgcaaccatgcaccctctccactttccccacacctgagtggtctgctggtcaccgtcagtagaccatgcatgcaaaatcattcttctggacgtgcaggagaaactgaaaaccagcactgtcaggtgtgttaaaacccttaagattggttctcggctgggcgcggtggctcactcctgtaatcccaacactttgggaggccgaggcgggcggatcatgaggtcaggagatccagaccatggtgaaaccctgtctctacttaaaaaatacaaaaaaattagccgggcacagtggcaggcaccctgtagtcccagctactcgggaggctgaggcaggagaatggtgtgaacccaggaggcggagcttgcagtgagccgagattgcaccactgcactccagcctgggtgacagagcaagactccatctcaggaaaaaaaaaaaaaaaaaaaaaaaaaaaatttgttctcatgaacttcctggcttagccaaccacatccacccttccatgtgtaggttaatattcccaatctgccacctgctcctccttctatgtgatttctcgagcagatgcaaagagacttgtctggggcaactcacaccccacaccatcttgatttttgtctctggggtcttcaaagccctctccttgccacagccgagtgagcgcccctgccttggcatccactcatctgaccatcatcagtgcccctgtgggtcttccccctgaaagcatctcacacaacacatctagttgcctactgccatggggtacagtagataagagacttgtctccatagtgtgaaccagaatttattgcatctgagcaaatcatggtcacagctatgtagctttgacattcacttctagatagataatggcatttttcacgccaaaattctttgaaagcaaatatatgatctggcttcattccacaaccagaccagttgaaacacctcacttccctgtacagaaaaataaaagtgagaaatacaaaaaagcagtcctagaaatgccactgaccccaccctgtggatggaaggcagggtgggatgggaccgaagggtgccaggaagctcttctctctgggggctctgctcagccctcactgtgtcccccctcagggattccagctcctcacacagcctctcaggctcacgtgataaggtgggaaaatgaaggtcaaagttaaagagcaaaaactcccgagaccttgatgaaggaggttgtttgctgtgccctgaaagttgagctgatgtctccctggtaggcttaggtcagctctgctccaagttaacacaagcccaggagccccgatggaggaagggaaggcccaaggcggggcaagactaagacagccaggtgtggtcttgagcacaagaggtagactgacccccaacctccctgagctacacgtggataacagtgcaaaccctttaccgttgttgatggttaaacaagaaattgcatgtagcgtgcttagaccagaggctgcacttcatccccactagtaaaggttaggtaatattaataacaacatacgaacaacaacaaataccccattatacttctttttgtcacctcacagcccaacaaactaggcacaggcactgtcaccatcccattatgcaagaggaagtccagcccgtgtgccattaactatctgccccaagtctcactgctaaaagaggaattgaaaggggaatttgaaaagggtggaactcatggattccactggaggagcccagagaagaaacctggtaaaggttttcaaatggcccagctgcccagacaatgcatgaaatctgaactctgactctatctctcttagcctttgaactgcctcctcgaagagaagtgaaacttaactttataaaccagacactaagatgcatcttttaaacaagaacatagagtagctcttcccctatatcaagcatcaactatccaggtaactatgttacctcattgtatcctcacaaaaaccccaccctatccgaattcccaagggttccattttacagaggaggaaatagagagtcaacaagctaaggtaatgagtctgaggccatataactagtaagcggtagatctgggattccagcctagagctagctggtctttggcaccattcccctttgcagcaggcctgcagcagacacacacacctttgaattcctcgacaggcctgtgcctggaccttccatcctcccttcctctccccacccgcccacatccataatgcgcattttcattaggcatctttgcccagtgatctgctgatttgttatattagaattgcaaacaaatgctctcatttcatcctcctatcccctctcttgccctcctgacatctgaaattcagcattgatttttctggccccgctccactgcctaactgacatttccggttgatttcaccttagaggcttgcagttggctcaccaggctcccactagagcccagaatggaatagcgcatcacctggataagcagaattggacctcatcccctacttcctgctctcagtgctctcactgtgtcagaactcagtgccctctagactctgtccccattaaccgattgatggatatgcatacctcagtccttcaagattctcaatgggaagggaaggaggggaaaactgtggaaaatgtcctgggaggtgggaccaggtgaattttgatctcctaagtactgatgttttcagccatagctggggtaattggacctcttgtggaggagaaaggggattatgaggaagaccaaatggactgagagatagaggtgggaaggggactgggataccatgttacaaacagaggatctctcatatcttaatccatcagaagactcatagaatgatcacttatctaaaatgggacttaataatccccagaggtcatctaagtcagtcttctgtccacaccacacagcacatcttaggaaggtgagcatctctcctaagtttaagaactcaagctgggtgcagtggctcatgcttgtaatgccaacactttgggaggccgagttgggcagatcacttgagtacagaagtttaagaccagcctggacaacatggtgaagcccacctgtacttaaaaaaaaaaaaagattaaaacactttttaaaaaaattagccaggtgtggtggtgtgtgcctctggtcccagctacttaggaggctgaggtaggaggattgcttaaacccaggagacagaggttgcagtgagccaagatgatggcgctgcactccagcctggacaacagatggagatcttgtcttaaaaaacaacaacaacagaaaacacctcaaacaaaaaaaacgtatagcatctctcacaccttctagcttctgtctctgataagtacattggactactaggttccaaacagagctacgttttcctcccaggacttcccattcccagtgggtactgaccagtgggtatccaagttggttttttatggaagcttccattttgtcaataaggaataggcccagtgtcctgtgaagtggtcagtggtgaccagctccacaaggagaagacaactcacagaggtacactagagtggccattgccagctcacaatagctggttgttacatttttaggaagtttgtgatccagttgttaaactattggtagtttgcgaacaccagggtagaagtatttacaccatagaaattggcatctgctataaattagggcttcttttttctgcagagccaagagtttcatgaagagggtgcccagtcatgtggtcaacatagaaagagggagaggcatagaaagggtggggtgaggaggacgaggtggaggcaagtcagggaaaccacattctttagtatcctcggaaaagcaaactctaaacaatcacctttccttccttcctaactaggaaacatcttattccctctgcagctatatgttatttcttctctaaggaaagcagttattgtttcttgttctcagacctaaagtggagaaaactagagacagaactttggatcctatcatttctcagaagccatgagtcagagaaggaagaaccaacaaagggctctgaactatagactgaattctatatgcacatttatacatagcccagttctagttgtctctagagatttcttatgtagaaatatctatacaagacaacagctaactgtagagctcatcaaaatcagggattgtacctttcatttcttatataaccatggttgtacctggtaagatattaatgttacaacaggtaatgaataaaattttggtttattaattgaatcactttgaattgaattggattggtggcaaaccactggtttatgatcagatgtcaagacttttcaaatcccttttctaagaggtaaaaattagctggttggctggctggctagaccaatagacactgattaggcatacacatgaccttataagttatcttgagctcacacccctggctctactcattcctgtattgtccagttggatggctttgcttctttctccacagttctcctggcctcttactcagatccatgtgctttgggcttttggttcttagtaagctggtaacttggcccctgactacattcaactgtgcaccttgaacaacccaaattaaaacaatccaaagcctagtcaggtcaagacaatgaagctggtgccaccatgtccacattcagaagtggactcagaaggcaggaggaaccatgttctccaaacccccaactcaatcagtgtttcccactgcagatgatccatttcagggaaaccatgcccaaagagatgaacggacagatcctggtcacatggcaccagctctactcccataaaggggtgaggaggcagaggtaccttatttagaaacctgtccttttctggatcctctgtcacacatgactgccactgtcacacatgactgccaccattggtcatgcttctctctttcctgacagcttcctccagaaccagaggcaaagcaccttcagtgccctgtacaaaagcccaggtttgctgggctggggcactgcctcaacagagaggcccatcctccccaacctagtggcagaagtccagactacttccaccctaatctggcaatgggtgttcgccttgggggaaccaagacctctctgagaatcttctcaaatattttggaaaatgctcatgcatccattgttttacagacaaacttacagagctcagcggctgtgacagtccccctgggggccctgggctaatggcctctgatgaaatgcctctcccagtcacactgtccatttccttcctggacaccagctcctgtttttcatttctcgagtcccctctgtcctccaggaaggaagatgactgctctatggtacacctccacatacaggtgagcacactgatatccacagaggccatgcaacttgctcaggctcgcacagaagttactaggagagatgggatcgggatgtaggtccaggaggctgtggctctttctagaatttaatgcagccacacagtgctgtgtttgtggatctcagaagcaaccacatcaaaaccctggcctctactcttcctcagctatgaaggaggtatgaaacctcatacatgaagtttcaaaatgggagggagtgctcctccaaggaagcaggtaggtctttgctcagaggtaggcgggacacgtgattagctctgtgtgtactggggtgatgtcttcagaaccaataccgtaaatgcctctgacacaccgtttccactgttaatgagaaagctctaagagccattaatctcattactgttctatcagcagccagtgatcatgttcatttcactcctcctctccaactccttggtcactcagctactgagaagggtggactgggaaggctggaaaggccaggaccctgccctcaactgaagtcaacggtggcatcactccagaattcttggagcagaggaacctgctcagcctgctataggaacaatggccaaggaggcagctgtgtccccaggactcctagcccccttagtgggcctcttcagccctctttctctctgagattctggagtatttctgtatgtccatgagggagcactctgtcccactatggcctggagctccctgagcaagtcggaggcccaggaggcccacatggatgagtcagtccctagtcctcttgttttatggctcaaggtcctctgcaggggtggaatctttgacccaaggctaaggagcccagaaagatgattcaagtcagagaataattccaggtcaccctctcttctgtagccacaccttcaaggtgtagattatacaaacccagaagtcctagttactcactaacccccagccacttttgtgaaaatggcacttgactgctatgccttatggaagaccgtgtctaaggaaggagcgtgaggccaggtgtggtaagtctagaccacgagggactcagggcccacccttcacagctgaggcctcatccacgctggtccagaagtcttcccatcataagcatctcatcttaaggagcggctgggttatattccagtccttctggctgatgtctgcaccctgggcctcctctttgctgcatccttgccctgaggcttcttgaggttatcacaggaaaagggttagaggcagcagcggctgctgacgtcacatcagtatccccttcaccaccaagagccaatgtgctgagcagcttagagggtatttgaggaagcatgtccacaagggcagatgggcctggtactcgggaagttgggaaaatacaattagacagaagcctggtcccaaatcaaaatttcagtaagggcttgcctgcactgatgtccagcaaggaaaggctatttcctttgtggggtctcctgtactctgttgtcagccctgcctgatgggcccagtgggtaaagggcagtgagctgagctgtcattgaaatatccctgcatgtagagagtctttctagaaggaagcaagagcttggtccacggactcccatgagactccaaaaagagaaggcagtgccggcccctggaagagaccaagctcacactcctaagctaccccagtggcccaggagtgattggcacagggatgggatggggctgtgtgggaagggcaagttcattggtaggcagggccctcctggccctgacagccaacgattcccatctttcttcaatcaataaaacttctgctcccttcagtctgtctggaagctcttcccaaaaggaggctcaaagtatcagacaccaaaatattacatcacactccctgcccacttccttccccaagagtcctctcttattccaaaaagggatgctggaaggacacacaagagtttcttgcccttttcttttggttttatttttgtctcaagtctggcttagccatgggagtcagagtagagaaagaagatgttttcctcccctgctttggccaggaggataattccaaaggaaatcaaaaacctttatctgtcatcatctcccccagcaaggcatcccagcaccatgcatttaatagaaagagaaatcgttccagcatggagagatggaagagacagcaataaaaggccaggcttctgcctcccacattagcgtcccacccatcaggaagcatgccaagtcacttcagacccagggagcctgtggcatgcccatctctaccaagtacatgttagcagagctcagaaggccaggaaaagaagaagtaatgtgtccaacacaaggaaagcgatggtggccatgacgtcttgggaaatccaaaaaaacatggcacacagtgtttctagtctcgcatctctccctgcaaggctcattagtgagccctcacacactgcaagatatggtctgaaaggtgtaagggtccagctcccagctccctgggggcctgatactctaccctctcgcttctgtggggagagatgcaaagaaaggcaatatggccatctcttcatgggcaactctcttccaacccaagctctctgatcttcaaaggggagagatggggttggacatgagcatcagtgcaagggctcagagaaatgtatcagctgcaagacagctcccaagatggtcagaaatgcaggtcctaattacatccctccattggctatgaccttgggtcaccacacaccaattatttactctggcaaagtgattagggaattggaaccagggaatggatatgtgttggggtagaggcgggaacctgggggttcagaagatgaggatggcagtggcaaagatgctccttctgcatctgcctcctcctaattggggtcactgcaggcaacagttagggagccacgcaccacgttctagtttttggtcatggggaattatgtagaggccccaaaatgacaagagaagtggaggaaaaggaggagagaaggataagggccaaaaaaacagttgcccatgaacaaatgcaaatcctatgtcaattagggagaggatggaagcaggtcaacaaacctgcccttctcccaagaagagagagaagtcagatcaggcaggtgggagagcagcaaagatgggcaaggctggagagaaaggtgacacagaccccacacagggactcagactgcagggccatggttctccaattatgaccctaggactagctacagctgcatcactcagcccttgtgagaaatacccctttttggatcccaccctagctctattgactcagaaactatagaggtgtgttttaacaagctccccaggtgatcccgattaaccttcaggtctgagaacagtccccagaaggaaaaggaattccagtttcccattgcatcctttgcccacagtgagggttttttttttttcttccagacagtctcagtgtcaccaggctggagagcagtggcgcaatctcggctcactgcaacctccaactccctggttcaagcaattatcctgcctcagcctcccgagtagctgggattacaggcacgtgccaccatgcccagctaatttttgtatttttagtagagatggggtttcaccatgttggccaggaaggtctctatctcctgactttgtgacctgctcaccttggcctcccaaagtgctgggattataggcgtgagccaccgcgcccagccaatgagtgcttttaaactccaaattccccttcaagacctcatatcactttcagtgactataataatcatttctctccagagatgtagtctttgacccaccgtcagcagaaaggacatcagagtgtggtctattttgaaagagcagaatgaggtttgcaccacatgctgagcacacccttgtccctgctctctggtgtgggcaacagcctagcagcccactgggtttagtgtgtctgtcatcaccacactttcctgtgcaggaatggcagcagcaacaatgctgtcaatgaaagtaaaggaagcaagtaagctttgagcacccatgttgggcactgtcctgagcatttgatatgccttctttcatccaatcttcacaacagccccatcgtatagacaaaacatgttcagaggggtgaagccatttcatcaaggccacgtgactcttaagcctcatctcaaagttcttgttcctgcttctgcattgccttcttaagaacaacaacaagaagcctctccattttctttgcagttaatttgcaaaccacaaagccaaaagctgacttatcacccttgcaagaaaaggggcttgggttctgtgaggggcatttcttggctttaacaagaagctgcctgggaaatggccctacaaaaggaggccaagtagagtagggcatagaaaggacgttgttctgagctgaagtgcgcccccccaaccatgtcactgcctttccacaaattcatatgttgaagtcccaacccccagtacctctgaatgtgactgtatttggagatagggtctttaaagaggtcattcagttaaaatgagatcactagggtggaccttaatgcaaactgactggtgtccttataagaagaggaaatttggacaccagtaggtacagaggaaaggccatgtgaagacacaaggagaagacagccaaagagagaagcctgaggagaagccagccctgcctataccttgatcttgggcatccagccaccaggagagcgaaggaataaatgtgggagccacccagtctgtggtactgtgctatggcagccttagcaaactcatccagatctcttcctgtcctacggtgggctgtccaccttcccacagctccttcagcatcctcgatggggccaatgctggccaagagaagcaggttctgtgtatccctgcactgggtggcagcctgaggctgtagaagtaccaccctgactgaggaggttgggagacgtctgggaaacaggcagccccggctgtcagcctgcagcctcgcctggacgctgtttgcactcacacacactggcaggtatctgtggtcatcacggtggctgttccgctgtttgcctccctcctggcaggtgcctgaaaataaagcatgaagcccagacagcccaaggatggaaaatcatggagctgagacaaaacacgtatttgcagagaacaggttcaacttcaggggtggggaggggcgcctggctctcaggatggtgcagagggaatgacagagaggaaggtatcaggtgtgcagcaaagcagaacatgagaaggaggagagggccaggccacattcaagtgtgcccaagtatatgacacacacacacacacgcagagtgagggccgctcgaattgacacttggagacatgccaaaccccaatgcactcactcacacatatgcctgcatgcagaccctgggtgacacacacaagcacagtcttcctgtctgttgggagcccgcgcagtatgtttgctgagtgaaaatgctccttggagaatcctccgtttgcattctccacacacaccctttctttctgggcttcgaaattgtgcatcaagcgtgcagctgtgaaaagaatgatacaagcagagaagcctgccaggatgctccatgtggcctagcggaggggtgggggagtggggcccagatggtcctcagccagtctgagggtgtgggtgcctggctcccagtgacctgacttacagtctcagtccctctcctcccctgcccagacctgaccatcaacccctctgcccacctctggaggcctgggaggaagatgtggggcatgcaaagttgtcaggagaatgcaggtgaggccagccttctgcagctcacaggatggacgagagaaggtgcccctcccttgtctctggccctgatgggcctgacagggcgccggtgggagggcaggagggagacaaaaccatttatatgtatttctggtggacatgtttgggggtccctcttcgcatctcctctgttcttttttttttttttttttggagatggagtctcactctgtcacccaggttggagtgcagtggcacaatctcagctcactgcaatttccatctcccaggtcaagcgattctcctgcctcagcctcccgagtagctgggactacaggtgcccaccaccatgcctggctaattttttatattttagtagagacaggggtttcactgtgttgcccaggctggtctcgaacttctgagctcaggcaatccacctgcctcggcctcccaaagtgctaggattacaggtgtgagccactgcacccagcctctgttctctttttataaggccaagagcgtgctctgaacttccatctcaaccaatttcctagaagaggctggaggtacagaactaagccaaaacaaccagagggactaatcaaccgggtctggacagtgataggattaaagtcagtgacaaattttattatggagctctaaccatgcccagataagtgtgtgacgagaagataacgactcagctgcgaaccggcagccactggggagcccttaacagactgagcccaggatgggccaggaagagaagagggcagtggaggggaggggaggggaggagggctggggaggagttgacgaatcaatcagaaaggctgagggcagggctccctctccattcatgcccaaagaccaccctcagcccagcccacctgggagaccttggatggaactggttcctacatccccatagagataaccgacaccatctgatttgtctcacattccccagtttccatttacactttaatggttctgtattttttttaacctcatcattacctttcagatctaaactcattctgccaacactgaaccctgtctcccatgtcacacagacataaggtatttggagctttttctctggtacctaagtgagtacctgtattctttttaactttctattttaaaacaattttagatttatagcacaattgcaaagttaacccaaagattcctgtttatcccacacccagcttccccttgtgttaacatgttacgtgtaaccatggtacaattattgaaacaaaattaacattgtactgttaaccaaactgtagccttatatttggaattcatcagtttttccactaatgtccttttgctgttccaggatccaatccaagatcccacactgcactgatatttttcttcctatccatttcagattattcattactgctgaaagtaaacaacaatttgatgaaacacatcttaagtcatctctcctttaagcacatgtcccccattgcatccatcaaccttccctcacaatgtaataagaatcacagagaggagctaaacaactgggcagcttgtggtgccatttatgatgtttcatgaaggtaggttctgaggatgacatggtgaaagtggagagaaaatacctccctgtgtggttggccagataatagtcctcaaagacacccatgtcctaatcccttatacattaccttctagagcaagagactttgcatatgtgattgagttgaggaccttgagatggaggagattaccctaaattatctggtaggtcctaaatgcaattgcaagtattcttttaagagagacacttacagaggatagagggagactttactacactgagagggaggcagtgtgaagacagaggaaagagatttaaagatgctatgccgttggctttgaagatgcaaaaggagccatgagccaaggaatgcagccccagaggctggaaaaggcaaggcaatgaattctcctctggaggctccagcaggaatgtggccttgtgcgcaccttggtttcaggccagtgaatcctattttggacttctgatccccagagctgtaagagaatacatttgtgtcgtttgaagccaccaaatttggggtaatttgttacagcagccataggaaaccaacacatcgtgtcatttagaatagtgggcactcgagacatactcattgggcgaatatacccaggtgtatctccttccagaacccactacaccatgcagtctgaaaacgacaatgtaccccattcctgctattttctggtgaggatattaaccagcctactagaaccaaaaagttctttagaattatctagtatatgcttggcagggtctaccaaagcggtacacatgccatgacctagcaatttcactcctaggtatatttccaacagaaatgtgaatatatatggtcaccagaagacctgcatgagagtatcaagggcagcactgttcatagaaggcaaaaactgaaagttattcaaatgttcatcaacaataacatggaaaagtcaatgttggtgtacccacacaacggaatgctacacagcaataagaatgaacaaactacagctgcatagagtgagctgggtatctctctcacaaacttaagtagagcaaaagaaaggagacacaagagagtatggactgcaggattccaggcacatcaagcagaaagcaggcaaagcacatctgtgccatgagaggtcaggatggtggctgtccctggtgggagggaacagaaggggacttctggggcatgggaatgttctatttattggtttcagtacaggcaacatggaggagtttagcacgtgaaaactcaccaagatgtacacttaggacatacgcacattcctgcctgaatatgacagtgcaataaaaagttacccaagaaaccccagtttggaaacagtccctctgccaagcccatccactcccaagctgtgtgcagtggagagctgggcgaaatgcctaacgggacaagcactgcaaatgaggtttgcctattaccataattacatctctgggaatgtgcaaagccctcattttcccttcatgtctataatattgtggggacacaggatgcaattacagcctgaaatatgcagcttaggaagtataaatacacacatctacgtagacctaggtaaaccgtgtgcctttacagagcacgaccgaaccagagcccgcgctcttcctcctgccacccagccgtggagcatttggaccctttgggctgctgtctgatctaagacggcagctctgaggatcaattcccctgagcagacagttttctgaaccagaacccctaatttaaaaattgcctgaagaagcagaaagtaagaactggaggaacagtaatagttatcactgctaattttaacaccaacaagatcttacattcggggaaacgatctcccaccccttttcttatttgaaatatagccttcttgatcataatctgtcattcaagaggagctggatgcaagtggattggcagtaggagaggaaccccagggaaagaccaaagagcaatgagcaggctacagtcaatttgattttgtggattcttccagggccagcacttgcggaggttagagatgccggaaggggtccaggtcttgggtttgtgtgtggtttatttccctcgggcattttcaattcatattcctgctcccctagatattcaggcccatgggcagcattttagcaaatctgggcttgtttcaacaccagcccaagcaggcacagaccagaagagaaatctgttggtggtggggatgctgggggcagcgagcctgatctgaagtggggaggctccctcgatcctaatatacaatatcccaaaacaaagtgaaaataaagtttaaattaccttccggtttcgatgatctaaatcacacctcccttccagaagtgtagataattggagttgactaaattgtgaaaatatctgattttttaaattcattgtgtacaagagtgcccccaccccgccccttctcttccccatgcccctcctataattaacctacacatcagcatataataccagtacccaatgcagtcacgatggcaaccgatagcaagaatacttatggctgtgtacaattcagatacaactgtttaaattccatttggctgagtactgtggctcactccggtaatcccagcactttgggaggccgagttgaggggatcgcttgagcccaggagtttgagaccagcctaggcaatataatgagaccctgcctctgccaaaagttttttaaaaacttaggcaggcacagtggtacacacctggagtcccagctactttgggaggctgaggtgggaggatcccttgagcccgggaagtcgaggctgcagtgagccatgatgatgccactgccactgcactccagcctgggtgacagactgagacactgtctcaaaaaaagaaaaaaaaaaaaacctcaaattgtaatttctctaaatattttcaaaaatagctgcatggaaaaaattagctctgtgcccacccttctctcctgtggctctgtggggtccacttctcaagtgacagcttcataggcttcccagaggttcaggtggcaaagaaccttgggtgatgttttgccagctggaaaccaaatcaagtcaggacaactggagatcaggccaccagctgagaagtgtgggactggaaaagtcaaacctagcaggcaatatttaaattcaaaattgagtatatgtggtcacagcctctctaagcctcagtttctccctgtctttcctttactaagaatgaatcctaccctctgctaatcccacacatcacccaccacaaggatgattttggtttttcagtaaaacaaaagcagaggggggatgggagcagatcctaaacgtttcagaatggtgttcacactattctctcttagactcatggtacctctgcacacagcctctctttgtaaggctgaacaaacagaagcaagcaaccaagcaagcagaaagatattgcagccccaaaaagtaaaaaataaaaaagatgaggataatcacaagaaatattttcctatgagatagatttaccaaaaggaaaaaagaaagaaaatgtctgggaaatgtcgtttttcagtaagattcaagaggacttttttctgaaaaaaatcaaagtaaacagcatctcaaaagcaggggtcagcaaacttttccattaaaaggctagggaagaaatatgcttggctttgaggccacatggtctctgtacaacaaggcttccctaaatagaaacaatatgtaaatgagggagtgggactgaatctggcctcttcctctgatccagagggaaggagctgccctcaggtaaggttgcatgaatggctgaagttaaaacctcactataagaagcaggaagtataatgcaaaaaagaaagtgacagacgcacttgaaaagctttctcagaaataagatgacagtgaggaaaacaaaataagatctggaccacaaaaccagacaccccagtatgtacatacaaggagccctccaaagagaaaacatcacagagcagacatcttgatgagaatgataataataatagtgataataaaagcctttcctgcattgaaaactggaggctatagattaaaagaacatatttaaatccaagggaaaagaaatcaagtcaacacacatccatatcctaataaatgtttctgatgtgtggagaaaattctataaaccttcagacaaagtaaatgaagagattacctacaaaggaatcaaaatccaacgggcctcaggctcccctcctgtattcattgctctaagacagcggagtcatttcaacaactttgagggaaagaaaaatactcagtcaagtctccatttacatttaaggttgacataataacagtctcaggtatccaagggcttaaatattattcccttcatgggggaaaaacaaagtcttaatggcaaatgccgatctactaggggacaaatcaaaattaagaaaccacaggtggaaaatttacaatgttgcagatctatgagcaatgaaaagctattaaagttgtccaaatacttagtataatttcaattataacatagtagaaacgtcaaaaacagtgtttgaaagggatgaatccatgttgaaattatcataatgtaaaaataatacaggtcttaaaacctagatcatattaataaaaattggaagtagggggaggagaaggactaaaatcatactgtttaattcttaacttcgatgctttagggaatgtgggtttaaatgtgctttcaaaaacttaagggtaaccactattaggttaaaataggatgaatactttccaaatcaccaaaagggaggaaagcagagaaagtccaacccacatagcataattaacaagtgataaaaaggaaataggaagtaaatgcatcaaaaagaaaaccaggaagcttaaagacaaaaaacagaaaaacaaggattgtgctatgaaatattaggctgccactaaaaaccatgtttgaagggtacttaatcacacaggggaatgttcacaataaaaagtagagatgaaaacataatatgtacatatatatactctcaactttgtctgtatttaaggttcatagagaaaaaggcatagggatatactcaagtatcttcttttatttaaaaaaaaataattattattattttgtacagacagggtctcactatgttgcccaggctggcctctaattcctggcctcaggtgatcctcccacctcaacctcccaagtctttggtattcacaggcatgagccaccacgcccagcattaataattttttgaagatgatagaatttcaggttattttttttcttgtttattcttgttttatattttccacaaataacacacatttctataattttttttttttttttttttttttgtgagggggaccgagttttgctctttccacccaggctggagtacaatggtgcaatcttggctcactgcaacctctgcctgtcaggttcaagtgattctcctgcctcagcctcccgagtagctgagattacaggcacacaacaccgtgcccagctaacttctatatttttagtagaaacggggtttcaccatgttggccaggttggtctctaacttctgacctcaagtgatccaccccccttcagcctctcaaagtgctaggattacaggcgtgagccatcgcgcccagcctgtaataattcttaaaaacaatcaacattataaaaaataaaaattgtagggtaccatgaaaccaagctgattgttcttcccaggggaggaggaagggccagagaggatttggaaggtattatccagcacaggttaggtttgatcagtcagtggatgctgctgggttggaaactggattttccatctaccagtgcacactcagccctcagtattcttagagcacatgaggaaaaaaaatcactattaagctttaatttccagagcccttactgtgtgctttgtgcaatgtactttattctcacaacaacccagagatgtaagtatttttagcccatttgacagatgaggaaattgatgccagagaggataagagacttgcttaaggttacatagatgggaaggcaagctgccagggttagaaaccagcccgtttgttgaatccctaataataatgtgtccccttccttctggaagttaggcagaacttgtgtggacttcactgctattattttttaatctgctcattcttccctctggcttacggggacacaccatgagggccactgtctcttactttcagctggactatgaatccacatgcccctgattctttcacaaagatgctgcaagccacccctcacaagggcttcctgagcagacatcttattccttccagtccagcatcagtggataaaacagaactaaattcatcgctattccacccaccccaacttccttccttcataaactagccacagagcagaggcccaggagcctgtccaatacatctcagggtcccaagtacttctccccacaccagcctaggaaaccagggctggctgtcagcaaaatgaataaaattcctatgtttgcctaaaaggcaggggaggggagtggagagcttacctctgaattgcaatgttactaggacacagtttgctgtaataataccaattaacatttctccccacttaatagtttctagtacaggataaaaatagcaatacacgtggtgctgagatgcgaaaaataacaatggaaatctgctctggaagagtcctgctctgtctcaccagggaagggtgaggaggtaagtgggaatattaggggagattcaggagggagctgcagagaacctgctagaaattaagagtctgccattgtcttacttctcttctgtcctcagtcaccagctataccaccagaaggcccctgtggcatggcgagatgccgtccggcttggaatgagaagagttgattgctgggtctccactctggcactaaccagttttgtgaccttgcctgagtcagggaacctctttaacctgattccttatctgtaaagtaagactctcagcacctgcatctcaggtgggtgtgcatcgaaatacagtgaaagggctttgcaaaatatgtggaatatgtgaaaaatgtgtcaaaatgctttgcaaaatatgtgaaagggctttgcaaaatgtaacccgagattcacatgtgagggtaggtccctaagaatctgtagtagtgatgcaggtggcacttgccaatacaacaacctttattgatcaacaaaacgaaaattaccaggagttagtccctcccctcagcaggactaaaggatgccagtggtgtaggcattctatggcgcaagctcagcggacctacccttcaaggaccagcacctgtctacaaaaagattcctcagatggaaacagctcttcctaaggacgagtgtggcctggccagaagcccattttcctcaaagctctgatatatttggctaggagagaggatgcccagtcatgctggagaaatttcctggaggctggcttctcttcaatggctgtcactcagagcctgacccagccccggggagcccaggtgccatctatggggagggtgaatgatgaggcactggaagtttccctccctcctttcattccctccaccacttgcatcccccactccccagacctcaccccaacaactggacacacagcccatagatagggtgatttcacgattcagtctagacccccccaccaggcagtgtggaggctggggcctctagttgtgctgcattgggtcccctgagctcccccgaggtgtcctaggagtctttggggaacactgggaaaactgagagggaagctctgaaaccacttcgtacccaccaacatacaccctcaacctgaaatgatttttaccagtttaatgtttggcttccacataagattttatacaaagaaaaggttctgtctctaaactctaaaaagttttacaatctttgttcctggggcttataagaatccagggaaaggggaccttaccttggtccttggattggagtgaagtcacctaaggacccatccaaataacgaccatgttttattcctagtgggaaaatgtagtccaacagtaacaccatccaaaatctctctgggcatgtggctaccacacctaagtacaaggaattttctgtttcttggaaaaagcccttcgtcctctcccatgtgctgtcatcccaggatcatggggcctgggaatgtcagttcgggccagatgagttcaagtgagcaatgtgttatcacaaacttggaaggggagacaggaagcaggtttggtgggaaggaaagaaagcagaaagacccagaggagaccacttttcctgcagagctggaggagagagggactggaagagcccacagagacccatctgtgtttttcaaaacgcatttttagaaaaagaggaggctagggaaacagagacacctgcttagagccagagaacattcccttcgaagggattcaaaagcacatgggcaacacaagccactgtgccaggtacccacgcaggtcaggggcctggtctcaacttgggaaacatcaagaggccagcaagctgaagcccctcagctcagcttctcccctcagagacgaagaagctggaagccatcagccagctaggcagaaaggggtcatctatcattgcttggctctgaaagatcttagagcaagaaggatccaagagagagggccagtgtgaaagggggaaatatgcaggagggacaatgtctgacattttttggaggctgtaggtctcgggcaggagttgtggctgaccacactcagctcagcctgagcccaacagggcatgatgaggacccgtatgggctctggagccaggagtcaggccctgcattcaaatcctgcctccagagcctgagacatgtggccttgggttagctctttatcctgtccggacctcagtttccttgagcgtccttagcaacgataagcatatctactttgtagggctgttctgagggttgaaagagttagcagatgtaaatcacgcagagcagcatccacacttggtaagcctgcagtcagtgttggctggagctgctgtggggaaacccccttcacgctgagccccattgggtccagccctcccaagatgcaaggatggaggtgggtggatgaagttcccctggtggcagtgggatgtgaacagcacccccacagcaattctctttatgtgtaaccccctccctcgggggcagtctctccacttccatcttttctttttctcttctctctccattttcctccttttttaactttttaatcactttctaagttctccccctgtgttcttttagcagatttgcagagccatctatcaagaagcttaaataatgaaggaccatagttgcaattgcctgttcacaggctcttgggctttctgggtgattagaggagactcctgctgggggaagctgcctgactagaatgttttctaacctcttagagaagctcccatggctgctatgccttagctgccctccatgatcattagcgactccctaagcagcccggtcaggtaaactgcacactacttgctccacacatggaaaagcctcagagggactgagaagtcactggtgggatggggactgagagtccacagcccctgaggctgcctgtctcccaattcatcaagtcacaaaataagatgaggagctcctagcccacctctctggggtcatctccacagctctgcagagtggctggtcttggggccaaaagaggtgcgagggtaattgacctatattggggggtgagtttgcattatttttccagagctgagtccgtcacagtccctcacagccaaggtgacccattaggcaagagctcagggttccgcctgagaccgtgggccagaggtatttgctgtccccctgcaggggacccgtgaaagaccttggccttgttactatactgcttcatacaacttgatcgtcccatcctaggctctgaaaactggtctgctcaccaatggtactcaccaaaaacttctttgaagatcccacctctcagctgggcatcatgtcccagtgcatgtcctaagcacatcctgtgccaagcacattttctggtcttcagttcaaaggtgggaaattaacacacagagagagggcaaagtaactgccaaagatcacaaaattaaaagacgttgaacctagggacccagactcccagcctattcccatgatggcccaagagaatattcccataggtggtatgggagtaagttgtttcggtctttctaatacttcaaataacctcattattcaggatggtggtgtccaagtggtgaaacagaccatccctggatggcagcactaccgaggaacacacttcttggctgtgggatccttttgctggctcactttggaatgccaacatgttccaaatctctccaacttaatgaaacacctgtcccctctaatgccatcagcagtaactgcacatggctctcacacttgcacacacatgcacacagctccagctggctcactgggtggttccttgggtacatctggctgcactcctcaatccatcctggtgtgaccgagttggaataaaccccccagtccttagctctctggaataagagaaagttttacaaaaaaaccctgtaatctggtatcaactgggcctaagataagcctcaagtaattacaacagagatagacaaatcgtacattcaaactgccaaggctttaaatgacacacacacacatacacacaaacacacatacacacacagacagatggtattgttgaaaacttaaaatataattcatatttacaggacatgatttagaaattgtccccagttactattttgtaaattggtgcttatacatatgccgtatgtattctatatcaataatttttcctaataatgttattaccttgcacactcaatcccagtgaaccctgaaggaaaaaattctcatctcaagaatccaaagagctgaggtcaggtggggaagtcttagccttatggtgaaaaactagaacaggcagtcgaaggggcaggcaatgcttctatcgtccctttttagaacactgctctgtggccctctcactcttcctgcagatgtaggagtagaatgagatgaggagaaagagagaagaatgctttgaaataagttatccaaaatggcagacaggtcctcctccacttttccaggaacacctccctcccttcaacacacacaatatgcacacgcacacacacacacacacacacaatacacacacacaatatttatgcacgactgttacatacacacatttgaggagagaaggaattatgtaacacatcagctgttcattttcacaggcccacttgaaatggagctcaatcttataagtatagaagtctggggtgagcgtctaggaatttcaacaggcactgagaaaatgcccactctgaagcacagaacatggcctgtggaatgctcgaaagcttccagcctggagggcgacctgagatgttagtaccaagggcttcctctccagagcctcagtctccacatatccctcagactaacccctacagagctgggtatctcgtagggaaactaaattgagctcggaaatgcacaccaaccaaaaaaaaaaaaaaaaaaaagaaagaaagaaagaaaaaaaaaagaaaaaagtattttagatccaaaagggagcagtggcacaatgtcacgatgtaatacaagggcatgggttttggagtctgtggatgaagaaatgccttacctccctaagtttctttagggtaaattggagcaaaaatcctcaccttgcagggttgctgtgagggccttagaccatacatgtgtaaagcattgatagcacaaagttcaccatggagtagttgctcactgttttctcattttccattccctctcttcctctccccagccctgactgattggaagtcatttccgctttttcagcagacccagcctcagctgatgattcacctggttgctggaagtgagttctgtttctcaaccctgggattgaagactgactttcaataatttgattgtggagttcttagccttcctgaaacagggctccatttggatgctttgcaaagccaagcagagaacatgtccttccagtgagaaagtagcccatgggtcttcattccaatatacctctgtggtttctcaatgcattcgtccattctaatttttctgtctacctaaaatctccaagaatagaaagaccactttttccttatttgatcatcacatactgcctaaaatcacatcttgctcaacagtaactgttaagcggaagatggcagtagtgccaggaaattatcagaggaaaacagaaacaaaacacaacataagcctggtcagtcacagtttcccttgatcagtaaacaaccaaggtcggtggtgactcccctttgggagagaggacaccatttgccactgtcacaactggccctgtatactgtcgggttcagtggcagatcttctcattgggttctaatagctgctccacatgccagagccaccaaaagcctctctgccttgtccagttaagacaaagatgaacttctcaaaagttttttatgcccaaagctcttccaaaaccaaggggaagaaactctgtatataatgaaacctcaaataaagtcaatgacactgagaagtttacagagggctcctctcaataaatatccaagagggagagctgacagttgtcttgaccagtagagttcactgggctcagaaacaagggggggcctgtcctcaccccatctggcttggatcagaggacctgaagtgctctagttgggaatgatggcaaagtttggtgggattgtcagtctttgtaaaaactttctcaccttctctttggatgtgggcctctcagtagacctatctggtcccaaaatgccatcccccaaacttcacacctatccccaatcagttttgcagatgttttagaggaatctccacttgtataggtagaatcatgccccctccccaaagatgtccacatcctaatcctcagaacttgcgaataggttacctaacatggcaaaagggacttggaagatatcatgaagttaagaaccttgaaaaagagagatgagcctggactatccaggtaggcacactcatatcacatgagtccttaaaagcagagaacttttcccagccttggtcagagggagggagacttgactatgaaagaaaggccaaaaacatgtatcactgctggctttgaagacggaggaagagaactgtagctgaggaatgtgggtggcctttagaagctgaaaaagacaggaaatagattatctcctagaacctccaaaaagggatgagctcctggaaaggcatgaagacctgccagtgcctggattagcccagtgagacccatgtcagatttttgacctatagaactgtgacatagcttggatatgagtccccgcccaaatctcaagttgaattgtaatcctcagtattggaggtggggccttggggggtgtgattaaatcatggggtggatttctcattaatggtttagtaccatccgcttggtgcggtttttgtgatagtgagagagttctctcgagattttgttgtttaaaggtgtgtggcacctcccccatctcttgctgctgccttatctatgtgacgtgcctgctctcgattcgccttctgccatgactgtaagcttcctgaggcgtgcccagagccaagcagatatacaccctgtaggaccatgagccaattacacctcttttctttataaagtatccagcctcaggtatttctttatagcaatgcaagaacggtgtaatacaaatagaccgttgtgtgtgttgtgtgaagttggtaaatttgtggtcatttgtgacaacagcattaggaatggaatacactgcccgttcctggtgaggtgcccctcttccttcatcccttcatggcccaacttctctgaaagtgctgctggctgagtcctcccatgggggcacctcacctgttactcccagcgatcaccttggccctgctcctcatcagtctccttgccaggacagcagcagcagcctgttctctcctctctccagtttcaaatggccctggttccttaaagggccttctagatcttgtttctaatccctgggaccgtttgagttccaaacatcacttgtcagaaggatagaccacagatgccttggagtgggaggaggaggaggggcgctctttcaaactctggttcccccttcacccacttccccacatatggacttgtaaaacaccagccacctcgctttccataccaaacaacagtacacgcaagaacaaacaagcagggccacggcctttcttactggaaccaggtatgctttctggcttgtttgttttctcagaatttaaaaatacatcgagtgtgctttattgaactgcccaaaaagggacacacctgcagcacctcataaacttgtttgatcaaacaaacaaaagccaaaacacttttctgatggagtatttctcggaacttgtactctgcagaaaacactctgtaaagtttgcttgtaaccacgctccattatcgtctacaagcctcagaagtctgaggaatctgagcccaccctgacctttctttccgattcaatctgcatacttgctttttgatcatgaaaataaaaaaattttgccctgatacttttttccccatatcttcatttatttttcttggggcctagcaaggtcttttggcaagaaaatccagatcttttctcgctcagaaatattttccttattggatttggcttgtttcttaacttgctctggtcagttgcacaagagcatcaattatctatattttgctggattcttcatatctaccatggcttcccttatgattatcatatttttaattccctccttgggcacaaatgcaaatctttagaacaaggaaactgggagctgaaaagagagaggtaagaatttcagaggaagaaggaagcctctctcaacagacagcagcaggggcaatggcaggagccagggcagtgcacgggacacacccccagccgaccgcctcccaagcctgctggggctatggaacccaattccaggctgtcagcagagacaaatttagcaccgatgatctcatcttgcagaacagccccagggctcagggaaacatcactggaaaagctgggaagtggacgtcactgctagtcccataatgtaggtgaaaggcacagggcccctctctcagctcactaaaagggagcaccaagaccacaaggagcaggtacaggtgatggtgagggcgtggccagcggggaacaggctggggggtctggggcattactagcctgctctcctcagagtccccacaaccccaagcacagtgagctgaagttccaggacaggtccacagatacggacacacttcgtttgagatgagtgacaaacagtactaaacattatcattgtggagttacagcttctcctgtcaggcccacatcaggatgttacgtggcagagtatttacaaatgcagcagcaggcagaaggtagagagagtgggggcacattccctcttatttactgaaaataagaccaaatccctgcaaaggggggcaaggatcccttgtctcttgcagtgagtcagtggcagaaaaagatgagaacttgtcaccaggtgcaaaccccaaatcttgccactggctcaagctacctctgcatggctctgaagttggtttttctggcttccttagccggacacttttgctggtcagtttccctgcagtttcttagtgtgtctggtggtcagattctccctcctgttcctggagcaaagaggcctcagcggctcccccagtgtttcccaaaagcagtcccaggagggcagtggcggcaggtcctttgctgggatggggacccctgtctcctgcttctgtagctaatggacagcatcccatgaacctttgtgaagaaggaaggtatgaaaataactaagaaaagcagacttgacacctctcacaaagaaataaatacatttctaaatgtcaaataaacataggtacttacagaaggcaagaccctccaaaaagagtggttcgtatcacactgctaatggggatggatagtgatggcaaataaatattgtcacgttaaaaaggccaggtttatattcaagcacaccagggccactcctgtgtcagtttcagtcatattagagaagatcagctccctgagaacaagggctaggaagctaataaattccatactgggaagtgccatgggaacgtaatgaggggttatcagagaaattagaatgtgcaagactccgtctcaaacaagaaaaaaaaaaagaaattaaaatgtactgagaatttggggtggccaccaaaataaaacctctcccacccaagacagcatgaacattattgtggttaaaggaaagaaagttcaacaagcaacttagaacagaactgacagcatctcttcaagtgaagacttcagagaaagctgcaaacagaaatgacaaaaaacaaaacaaaacaaaacaaaacaaaaaaaaacagggcaataaacacctagaaggcggcattagggctgtgcagcagagcccaaatgcaaaggcagcattagcagtggaagcaaagaatccttacggggtcagacccacagggctgagccaagatcagatctctctgtctcacacacacacacacacacacacacacacacacacacacacacatgcacacaccagctgcagcactagggcgtttgggaaagacacaaaattagtttagattgtaaaacatttatcctgtagaggcaacgtgagatttttttctgtagttcttttaattaaaagtgagctcataaatcaaagcccctgtttccagcctgcaggaggtagtaggagtgaacctaagccttgcagagctgagcctgccccgcccatcctgctttccatcacccaggttattcaccccaattacaacaccgcacatgttacagggactcagtgagtagccaagggtggctctgatgaattacatctcactttcttcactggggtctccgaagttctcccaaagagatattgagcacatgtacacacacacacacacgcgcgcgcacgcacacacacacaattaaatcctatcagaactggttagtgcatctatttggagcatctgctgtttcccctgcagagccccacctctggagaccttcccctcctctgcatttctaccttgcctgggctcacatggctgtttgcatttgtgagtctgaagactcttcttagaagttttttaaacacagaaagtcttatggatccttgccatcttcttaatttgttttaattttttcctcctgggtgaattaaagaatgttctacagacatgaagtctcactaccctcagctcattcataagagagatggagggagggtgcatacattaatatgctcattactccaaaggtgacatacgtgtggataaagaatttgtcccaaaccagaagtgcagccagaaacaaagttaagatttcctggatgtcggttccaagattttaagccacacccaggcctggctcttaacaatttagagggatggctggccccagacacagaccagggcagacacctgggcatgaagattgcaggagtcctaggagcagtagtgggaggcagcagggtggcccacagtagctcccgttgcccctcccagccctccttgggattgacagaatggttgccgtgaccagcggaggaagcacattgatttcccattttcaagctgccccccagctccaagcatcttagagctctttatgtgcccatactcacatgtgttcacagttttagtgggaaatgaggacaaagaaacggaaccccctctaagagagaaaatgttagagatagagatgaacttcatttcagcttcctgcccggtatctacccttgatgccaggaaccgctctgtcactgcatcccccaatcccactgcttccttctgcccctgcccccgcacagaacaagaatccagacaaaagcacaggtcaagggagaaataaaggtcccccttcccctgacccaactccctcagaaacaatcagattcaaggcagagagattaaattatcactaagctaattatgggactcacacttaggctggctgccgggaagcgaggtcagcaagcaagagacattaacatgcaaattgaaggcagatgcaaggagcacttaaaaaaaagcaaccgggagactgattccccccacacccagaggagaaagaagccactctggtggttgaggcactgtccatctgggcaatggtcagggcatttgacagctaaatagctctactctgtcatcatcctgaagccaaagtgggcgagtcagaggtaaactgattaggtggtgtgccgctaatctcccagagagaacatgagggaggtggatgcaaggcagagcccagcgggagcagccccaggcttgagtgcagagaaggctctgccggttcctatgcttgcatgtgtgggtgcctccctgtgcgtgggtgaacacaggtgtgtgtgtcagctgggtgtttgtgcatgtttatgactatggatgtgtgtatggagaggggatacagaatcaggcatgtgtgagtatatcttatccacctgaaaatagaaggtgaagagcttagacagaatcaaagtgcccctcctagcataatagccaccgggcaactccttaagagctttctgagattgttaaggcccctgcaattgctgtcaccagctcagccatgaaaatacatattatggtacccagttatggatgactgatgcttccccaggcatcatcaatatgatgcgagtttaagacatgttggccaaaaacttggcagtctacaaaatgactttgagagataaaaatcaatgtttttcaatgcaatctgcaggatagcttcctccactcaggattctgactctgcaagtctcttgccttttccagagaggagcaggttggcagggaaccctgatacggaggcatgtgagcttgttttaagtcagtagacagctttgggttccttgtcctgagaaatggaatttaatgggcaatatcctgcctgtgtccagagtgaatttttggaacccatggttggcaaggggggttcagaggggaagtgggggaatctctggagcttaaattacttagggaaaattaatttggaaactttatttaattataggtaaaagaaatgcttccataaatttgggtaatttaattatccaagagacatctgctgaacacaatctaatcattgtatttaagtagaaaagtgccctcactcttaacaaaactaattttggggagatacaaacattcagagcctgactaatgaaagaaaaggaataatttcagtttcagttttaggaggaaaaaagtaaatcacaggaaaatcatctgagagaggatttagttttttaaaaatcttcaacattatatctggggttgatgatataaaatcagccatatcctatattttttgcacatcttctccaatactaagcaaagaagagatcacaagctctttaagtcaagaagtgcctagcgcattttagatgaccaagaagatagttcttgactgaatgttgatgttcacaaaaataaaccttatgataaactgtatggacagaattatccacaaaatattcattgcccttctctcccacctccctgcatacatacacaccagccccctccccaggctccaggcagggttatattttccacaccattcactttggctgggccaaaaaaatgggagtgggccaccaccaagcagtagctttaacaaccacggcacggttctgccatctctcttttcctttggccatgagatcaacatgtcccagacaggggctgcccttccaagtctcccagataaataacatggagcagggctgcagccagcccagggtgcacatgaacgtgagttgaaaatagccttcgttattgttgttgtaagccacctaaacttgggggtcatttgttactgcaacataatgtagtctaagctagctgatacacacacacatgcacacaggcactagaagaccctaagccccagtggtccatcttcaaatacatttttttattcagcatttgttaccttcgggcagtactgtgggggcaccttcagtttaattggaagaaggtataaacacactggggaaatagatccagctatattaatgaactgtattttctatgtgaagaaaatgaacaaattcctttcagaaaaacatctcagctacaatgttgaaagcttctattgcctataattttggggtaatcaaaatgtggctaaataaaaaccaaatttataaaatggatacattatgaggctattaattttagaaaataattctccattttagaaagagattcattagtttcctacaatgaatccacatttcctacccaaaaagagataaagaagcccacagcctggttgaggcagggaagccatcagtactatcagcatccctccagccatggcccttcctaggtcacagagcctctagggtccccagctgccacactagctctacttaaggtcaacattgtacaagttcaggcccacctagggcataagccaacactgcctaactaaacctccctggatctaagaaagactcattctctaagtgaggtttaagatgtatctttctctcccaagtctggtgtgtctgggaaaagacccagaacaactttgatcataaagatgaaataaaataaaatattccaggtatgctaacctgatgcattgaaaatatggttataattacatgcaacatttaaaaaaatatgtttactcatcacaagtgatacttgtagtagaggaatcctgtctgagacagaaaatcatggataagttttatgctctgtgggggaaggaagaacaaaagggacagagctgaattatcactggaggaaatgttggtctgttgcagaaagaccaatgtaaagaatgtattgacttatagatttttaaaggtagactgaagatatctaatcattttcattattataaaaaaccacgatgtatataaggcacccatatatgatcttaggtagaatcctgcctagaggccaaaatggcaatttgtatctgagactcccatgggaatacctggaacacagtaggattttgtttaagttttggatgcaatgatgagggcaggtcgtcaggtggcttcaacatcattctggcctctcaggtccaacaatacctgggaacactcagatttagccacctccagccccagaatactcatatcttggtggggaggtaaaagtggttaagcagaaagacaacccatctctttccttccaacctccttgccaccaaagcctcagaagccttctccagcaggggagaaactttttggaaggcagctcaaaaaagtctcatggccagacatggtagctcatacctgtaatctcagaattttgggaggccgaggtgggaggattgcttgaggtcaggagtttaagaccagcctggacaacgtagcaagaccccatctctataaaaaatgttaaaaattagtggagcatggtgacacatacctgtagtcccaggtacttcggcgactgagacaggtggatcgctagaacccagaagtttgaggctgtcatgagttaggatagcaccacttcactttggcctgggtgacagagcaagaccctatctctttgggaaaaaaaaaaaaaaattcccaaaaggaaaactgggactaggtgaggcactgggagtgtcagagggcagccccaaggaagggagagcctgtgaggtggggtaaaaccccaaaccaacacccatttctcacagatgcaacccttggagagcctttcctaaaaggactcaaaagggaaacccaggaagccaacaaaatagagctgggtccccatgcagctgtgccataacacagggcaaggggaatacggccttccacccgcaccttagtgagcccgggaccccacaatgagcaagggagagaatgccgcccggcagtgggtgtccaggagtggttttggggggaagaggattgctctttgtagattctttgcattcttttattaaccatttttttgggatagggtctcactctgttgcccaggctggggtgcaatggcacgatctcggctcactgcaacctctgcctcctgggttcaagcgattctcctgcctcagcctctggagtagctgggactacaggcatgtaccatcattcccagctaattttgtttatttttatattttagtagagacagggttttgccatgttgcccaggctggtctgaaatccctggcctcaagtgatccaccctcctcggcctcccaaagtactgagattacaggcatgagccactgcgcctggcctctttgcatttttttaaaaagaggtttgactatataaagaactatgtacacttctgaagtagtctccctaacctcccattcaatcatactattaccccaagtccccatatctataaagaaatagcaaagccaacacggcctcaggccttcctaactccacatcatcctgagcaaattaattggtcaagataacatttgtgagcacaccttcactaagttaaaagtacaatactacagagcgacaggaaggaaaaggtaagaatggagggggtgaaagtgaggaaagtaggcaaaggattgtgagaagagccgagaagctcaggtttgggggatagacactcagaaggaaaaagaaggttggatgtgctggtggtgacaagtgctccaggtgactgggagtcacaaggagactggctaattaggccctccattccagagcacttgcaaagcaataatgacccgtgattaggaagaagctgtcatcctccaaatgggtcaagacagggaccgtggataacccgtcacaggaaaaatcacccagaaccacagcacacagtcccacaggctctaggagggacaattccggtgagaaaccaagacaaagatgggcccagtctgtcacaggaaaaatcacccagaaccacagcacacagtcccacaggctctaggagggacaattccggtgagaaaccaagacaaagatgggcccagtctgtcccaggcagcaggccaggggtaagtggaaaagcacagctcggctgcctcctggaaaacctcctcccctccctgtggccacctcccactcggccacgggatccaagctccagcataattgctctcagaaggaaattgcccgtggaggcaggttggtgatgtgagagcagccatggaggcaggagtcccgtcgtttctaaggtgggagcctcttccttggtatttaaatttagccagggcccttgaggactcgaaatgtgaaggccgaggcagccagctgaggctgaatggctgagccagggacctgagtcctcagcatgtcaggtccacttccatgcaagcaaagctacaggcaaggggctgcagaagggtggatgagacaagtccagttttgtttttcttggtgacaagggtgagaggattagaactgctttaggaagctgaatctgccatctaggatccatccaaactgattttcctgtccctaaagtgctcccctctttaatccatcccaggaagatggattaaagaggggaaaatcagtttcaaccgccctagcatggacatcagggcctgagacagggcagagacagaacagagggaatgaaaggagggttctgagcaacaggctccagggtaggtaccagaggtccagccaccacctcctccctccatcagggaggtgacctaccctacagcccaggagccaggccttaggtagagtctgtgatattactcgatacgggtcccaggacaacctcggattagaccgtgtgacctctggggagttacccaaccccttttctcctgggtaaaatggaaggtgtaacatttaccccacccccaaaaaaaaacattgaggattacatgtgacaatcaatgtaagtaacatgtgaaaacatctagaacaatcctggtgcctacacggtgttcaaagctcagtagttccctctgcaccacctcttttctgccagccccaaacactaaggaaacgaccccttcctaagatgctgggtgcctccccacagaggccaaaggcagaagatatggattctccatggccacacagagttctcggcagctactgattcaaaatctaagcatctcttgtccatcatcgagcactgccctctctccagatgaacggagcacctgggactgcctgctgagcccccaggcctccttgttgaggaagtttcctcacccctggtcctgtgggtgtggcgactgcttcacagcctcctgtttatcctctggattctctactgtgtttgcacaatcaaagccacaagccaaaagacaggattcagtgcctgggccactggtgttcctgaggaaggccgtgtccttttccacactactaaaaatgaacttgaagtttgaaagtatgggttcaagtcccctcaatggctgagaaacaaagccctcatgtagaaggcagcctccaacatagcccccagtgatccccacctctgggtattcatgacctacagagtcccttcctggagtgtgagctggacccactagctggcttctaagacataatacagcaaaggggatggggtgtcacttctgaaaccaggtttcaaaaagacaatggcttgcaccttgctcagcctctttctcgcccccatctctcagacatcgttctagagaagcctgctgctgcactccttgttgtgcacgtggcctcatggaggggcccacatggcaatgtagggatctctcaagtgaggacctgaggcttgccaacaaacccgggagtgacattggaggtagactcttccccattctggtctttagcagtgggatgactgcagccccagccaataccatgaccctaagccggaggacccagctgagccatgcccagattccagaaccacagaaactgtatgtatgataataagtgttgttcaaagcctctaagttctggagtagttcacggcaatcgataactaatacacctgtgtctcctgggccaggagagaaggtatggagtgagtgtgggagcttcgagaaactttttttttttttttgagatggagtctcactctattgcccaggctggagtgcaatggtgcgatctcagctcactgcaacctccgcctcctgggttcaagagattctcctgcctcagcgtcctgagtagctgggattacaggtgtgcaccatcatgcccggctaatttttgtatttttagtaaaggcagggttttaccacgttggtcatgctggtcttgaactcctgacctcatgatctgtgtgcctcagcctcccaaagtgctgggattacaggggtgagccaccgcgcccggccgagagacctcttttaaaaagtcaccatggatgcttctatgagaagccagaactgctgcgaaaagcagcaccatgacatcatcaataagcaagcccagtggacacattcccaggaagttccctaagaacaagtatggactttcagcagaccccaaatcagaacatcaactcatgggctgtgaattggtccaactgccactgccttccccatcagagtggctgaggaaatcatagcaattgccggtaacaaagacctcccctggctctaccctcgctaggagtcttcactggtattgacatcaagattctattctcctatccagagtctagcaggtgtgagcccagcagtaaaaggaccacttatggttgggggctcattccctcttcttgcctctgcctcctccctcttcctctgtacatcatgtctttcatcctttcccatctttgttgtcttggttacatggccagactcctaatatgctgctagttttcattttaatgatatgtttttgtaaagcacaatattttacttcaattgcatgtgtcactggataaattcctctagtgcgtctgacatttgtgtatcagctgactgaatgcgctctatgatttggggtgtttgtgcagcactttcttcaattttaatgtgtttgcattttaatttatgatcaggatctttctataccaatgtgtgtatatatacacacatatgattcaaaaaagtggcacacgtatcaataaatcttgaattggcaaagctcatttaagactatctctttaaatcatgtgcactagcaatgatcacttggaaaacagaatgacaagtgttcctgagaaactctttgctgggatttcaatgtgtgtttcaggaggaagtcaggaggagaatgcaacaatgcctagctattggctgcagtagaaatttcacgatgagaacacctccccgggtttattcaggtcagcaaggagggaccacttgagatcccccagggatgtgcagggaaggtgggtgggcccaagggcagaatagtgagaaatggaaaaagataagaaaagagggccagtgtggccacacttacatcaaaagggtgattgagtgagggcttaatagtgttcaagaatataaaatatgtccaagaggatatcaaccagcttagttgctcttttagtcaactgagtaaaacttgggaagaaagcttaaaacatagcagaagagattgaaacaaggtgggaggaaggcccatgagaagtggatacattggtctgaggcaagatcagtctgaagggccagtcttagaattcccaggctggaaagactaacgacagaatgccgtctgtctgtggttgaacgtgaaatcagaggagggagggtggcacgctggcacacctgtgggatcttctgcctggagcccttcaacctcagcctccccttcacacaacccacagggtaaggtctatgcaggtttaatatttgcaaaaccagggatggaaaatgcagacacaatatagcaaatagagggtcttttcctgtcatggaaatcggtcagccctgatgcttctgcatttctttccctttgtgcttgtgatcaatcacacatgaacccatggcagcttgggctggagaaacatatagcacaacagaactacctgaccgaaccctgtatcaaatacatatgccctctgccctaaccacatgttcctagtctatttggtgttccaacattgtatctccatttgatttcctgacacttccatccatctgcagggctttctgtgctatgaatatttatttttagttaaagtggattcaaatttccagagtaattttaggaagaattcccaggtacatttaggaagcaacaaagcagaggctggactctctgatctgatattgctttgtgacttgagcactgaagatacacacacagcatctgttcctgagaagcaatgttcgccccaggtgggtctccctccactccaatccactcctgggtgattcccccttgtggacctgtgccgaaggactagggaacaaaagcaaattaattttaaaacaggcttgagaaaaaaaaattaggaagattaaattaatctacatgacaattcccaataagaatggtttttgtactatatactcctattgcctcttcatgggaatgtgcacccagtacctattcagagaggctggtatggattagtctgtgcacagacacatggatgcatgtcccgcaacaggctaatagcagggccagccagagttccgcttaaccaacatccatacagcgctccacccccttaggtgtgaacagtttaacctagcaaaaacatccagggaagacgcaatcaccagcgagaggagcaatcacacctcaagtggaagtttatgatgttttggttcacaatgaacattagtctctcccactaatgtcaggcagtaattcaccactgaacagcagccataaaaatgatcgcttagtgaaaggaaagcaagaggcagagaaagcaagagagggaaaagattccagcagaaatattcaagcaaagaaatctcgtgcttctgagacaacactgagctgattgtcccaactcaagccaaagatttaggtttgcttggccctaaagccagtcaagatggcatttgccttatgatttttacctatagtggaaatgttaacagtctgtaggttattgctaagttcctagacacctgcttatgactgtagtatttataggtcatatttcttaacacacatacccttaaagctcaccacaggaagaggctgccaataccatctgcaacacacacacatcagaaaacatcaaagacatctaaattggcactttcctcacctcctttccccccgcttcatgtgacgtgtgcactaaaggagtgaaattacggtcgtcaaagacaaggttgcaaatgattgggactcatgcctttcaagcaaaataaaaagtaattttgagagcagcccacggatagctcggtctagctcctggacccctgaaacccacagcaaacacccttactcttagcatccccccaagctctctcctgcccacctacccccatttccagtctcttgtcataccgtaaagaactctgaaaggtccttgatacacacaggagattattacagggctcagagaaaccaactctgtaattatggctacagtatgatttccattattctcacgccctggcctcagtcacttgcaaaacttccagcaaaatcctcctgcagctccacaacttgtcacggctgggcctctgcccaaaaggtgactgtggtcctgataacctctgggaaaagcaagtcagaattattacaaggaaaggggagtggtgcttagtgagtgagtgggggtggggaattctattgttcaagaaaaaataaataaatgggccacttttgctttttattatttcaaacaacagactcggcagcccagccttcctttcccaactcagactgttcccctgggccagctgtgctgagtctgcaggcacgggagccgggcttgagcaaaaccattaaaaggctgccactccaagcctgcagagcagaaagtttggccgccccagtggcctggctttccccgggaggaccgaaggctcattccccccaactgacccttgcgctcttacctttcaaatgtttatgcctcaccagccccaccactgctctggaaattagatagaatatcccaggtggctgaaacagaactgttcttatatcaacctaccaaagtaaaagatgggaatgccggccgcggtttatgaagccccagcctcttggtggggtattgcctgtgtcacctgtcactgcctgcctgaccgactgctggactctgtccttacctgcctcaggagggttgtctctgagcgccttgctggcccaggctcctgggggtgtcctgatcccaaactcatggtgctgcacttgacctccctgtcggggaacagatttggacaggcttccacaggcaagagagtaccagtcaccaaatgcctcaacccacccttggacaaacagcacaaaaatgcaagttgactatcttgggtttacaatgcagccatggtcaggaaacaccttcctttttccaagagaaaataactgttttgttatgtgcactgaactctcaatgttcatttcattgataacattcactgcccaaccagctcagacaatcacacacacacacaaatcctcatccagggtctactccatcctgccagctagtaaatggtcctctggcagctggtaggaaattcagcgggtaagactcttttagggcaaggcaggaagttacttctacattgcactgagattgagctcaccggagaaaagagttaaagcatcccccatactgcttgctgacttatttactcttaatggtgctcattcacccattgcagcaggtgaagcaggtctcagtgcatgaattgtacacagtaatgcccccggtatttagaattcacttttccagcagaccaaatttgccaaatcctactgaagaatcgagccatctgattcacctgcccaaaagctcatgtacttctctcctcagtgtggactgacgcgtgtcagacacaatttcagagtttggctatctggtttcctagcccaccaaagctggaagctgcagaatgagggaggaggaaaggtgctgaagtcaaccaggattcctggcagcaactggaagtgatgagtggccaagtgcatgagaggaagacccgggaaggcagcaaaaatcagacacaggagctgtgtggggataacatgcccatgtctcacagcgtcttccctgggcatccacaaaactcagttcaatatgtgaacaaaaatcacgaggagtctgaggcagcaaggaaagattccattgcgcttaccattttcttcacagaacggaggtatgaaatacaattctttgcagggaattatgaaatacaattcttaaaaatgtgtacacaatgattttgctgttttttagttgtgacactgaaggcggtccactcaaattaggcagttacttcctcctgggcagcacctgctgtgtggtacatcatggacaccattcttgcagagtaccatggtgtttccccagtgctcattgttttctttcccagtcattacccatagaattactccacacacaagttcccaagtcacaaacacactctggggtgcccgcctcttgtcctccacatgctcccattccagacacaccacctgtccgcagagatgccaacagaaatgattgctgggctgttacattgttggatggtaaaataggcatagtcctctaaatatgcccagaacatttcctcttgaccatccagagctagcagccagaaatacagcaaagggaaatggagggattaaggcttagtctcaatctttactcaatctgaatcacacaatgtccagagaaccccaaaagaagccaaaataaagcaagcaagagctccacatggaatcatcaatatttcctgggaaaggactaaaatgcaattattggccaacaggaaacaggacctcctgcctaccaccttagaaggacttttaacccaatcaagaagggcatgcactatagggccagttccaactcatgagatgagaagcctgaacacaaaacatccctgggcggatgactgctcccaacacagctgatgagccaagatcgcccaggactccagaacctgccagcttccggaagatgcaggggaaaggtcaggtccccagatcataccatctgacctcaccagagcaattttcatgttcccattgcacccgtggttttctcagcccacaacttggctctgggccccatttgcaactttaataggtctgcactttcctccatctgttccctgaatgcattccagatgatgcagcagccagaagggctggagcaaggggaacaggcatgtcccttccccctgcccaccttccccaattgctcagacctaataaagcctttgccttaagggcacaagcccaaattgaacacagcatacaccatttagaacaacactgcaaggctggtctgacacctctcatgtgcacaccagctctagggaggaggtgaatccacacactcaccccacaacctcagcacagaggcagagaaaggacaagatgatcatcatgacctcaacagcagcgtatctccttagctcaaatctgtatcacctgcccacacgcccaagttagcaaaaagatgtaagataacatccagcccaggagggacagactgtcttcacagtaaccaaaagtactgcacctcattcctaccttcttcagcttgccacttttggtgcccacaaaggccagagagtggttcttgtagacatatgcgatgacagacgtcatgcggtccctgtcctccgtgaagacgggaattccacgcaccatgtcggacactcccaggggagcattcatgtccaggccacagaagttatcgtcaatggttaagagctgcaaattttaaaaagagaaaaattagaagggagcgtcaaggaaattggcagagatattaagtcaggaaactatggaggtagaagaatccttagagatgaaacatctggtaacaatccctcttttttacatgaaaaacgtcactccagagaaactaggtgacctgtgaagagtcacctgagtgggcaggtgcagggacatggcagaaaacacaggtccgcaggtctcctttctccataatctgtgtgtctctgcccctcatccaacccctcccagcgccatcttgggagctttgtccatcattattatcatcatcatcctcacgtggaaaagcctcacgtggaaaagccctgggtcagcccagatgagcaggggctccaggccgctctgctcaggcacaagagggatgtggtctccgtatctatacacaaagaggaatgtggtcttcgtatctatacagaagagggatgtggtctccatatctggagcagacacacacatgaggactcaaaagtgtagactagggaactgaaaacattagcatgtaagtagcactatcacaacagaggcatgtgcaggcaatcagctggggaaaggagcaatgggggaaggaatgtgctgattcaactcaatgtgccacagctggtgctttatgagctccgacctcaggctccctgtgtcttttagagcattgtgaagaagggcagccctggccctgccatgcctacaccagcacttcccaaagtgccatccatggaaacccaggtccccgatatgctctacagataaaagggctctgcaggcaaatttctaggaagccttttaacaccatctaagagattcataacgattagttacatgaaaggtctgaaaagtatttttaagaaaaagtatgtttaaccttatctcagcctctcctaaacattttattcactgaaccttttcttccttttttttttttttttttttgagacagggtctcactctgtcacccaggctggagtgcagtgacatgataatggctcactgcagccttgacttaccaggctcaagcgatcctccaacctcagcctcccaagtagctgggaccacaagcatgtgccaccatgcctggctaaatttttgtattttttgtagagacagtatttcatcatgttacccaggctggtgtcaaacccctgagctcaagcaaccaccaccctcagcctcccgaagtgctagcattacgggtgtgagcccttgcacccagctgctaaaccattttgactgcaacacctactagtgttccttaaagagaatattctccagatatcctgtgagatactgaccctgactcgcttgctcctgactccaggaagtataatttcagaagtcaggaagctttggggccagttcccccactgtatttccagtggaatctctcttttttataccaggccatcaggtcccccttgaaacagagggtctcagctgggctctggggtgctggggagtggtgaagaccctggtagtagctggtgaaaagccctcggcactccccacaagcagcttgggtctcacacacacacccctctggggtgaattttccaccgtgtcttggaagggctatgtggtctcagaagagttactccgttttcctgtgcttttattttctgctctataaagatgacggaaacaatccccgctctttgatgggctaccataaagcctattgcactcgtgcctgtaaatgtctttggactttgcagagaaaggggtgaaataaaatacaaggtgtcacttttttaaaggcttcaatccagccaaaggaaagggcatctggagaacagcaggcaggctcttgccagggagtgtgtgaaaccaggccacaggcgttcacctggccccagcaggctcctccactccctcccagaagaggtgcgggcaggcactgtccctccagagaaggtgacctgctcagcatctgaagcctctctgatggctccccttcttcctacagagtagggacagtcagagcgaaaacggggagagcgtgggcaagcctgagcaggccacgtgtagagcagacatccactccaggcctttgatagcctctggcctctcttgcgtggcctggtccaccagcccaggccaaacacagctctctccccttcccttaaaagaaaaaaaaaaagaaaaattattgaccaggcatggtgactcatgcctgtaatcccgccagaggcaggcagatcatctgaggtcaggagttcgagaccaacactgtctctactaaaaaaacaaacaaaaaattataggagtcaaatttacaagggagtgttcaagatttagtctgatctttaccatttttccctaaataaggagatggggaaggagacaggaggcagagggttaaagggaggagtagaagaaaggaaggacaaatccaggcaaaggggagaagatgccctgtgcctgctggatatgaccatggcaacctgccaggccttccaagggcagcctggggtgctaggggtcctcgtggcccttgaatgttcctgcttctggttcacaaggagttcgcatccccaaatttctcaggcctaaactgtgctgcagggacctctggcgtcgcaaactctgtacatcacccattatgatccattttctgagtagatgtggctgaatgattgttcacactgcacagggtggggacactgaggcagggacaaagggagtccttgtttcacagttccccaccacctctgccacaaacataggcctcattagcctgaggaggcttcaggcctctcagctcccaaaattgcatttctgaggggtcaggattactgaatacgattcttccccttggctgggcacgacagaaggacatcaacagccacgtacaaaaagagagtatacatttggctggttacatcattcactaaccagaaagtcagggacctgtgactctcttcctctgcagaacctcttgaagcaagaagcccaggcaagatctgggacaatgacagatttctccctaagtttccccgtggcttggcttctctctctctgaatggggccccaagtgataaaggtgccattgagtcctttgaccaagcaccgtccaggtcttcatgattgctgaggtccccagctgtggcaggaggtggccctgctctttgtttccttgaatctggggtgatgggggagggatttttaagattgaaacagtggaaaaatcacaggacttgggttcaaatggcagctcagctgcttcccaattgcacaacttgctcctactgttctgtaacctgactttccttggctatagagcgggtaagcttattggagcgatggcacctggtgagctgggaagcacttcaatgtaagatatttcatgttgattttttgtgtatagaaatcctgcctggaacaggggtagaatggctgcagggtgtggccctagcatgcctcttgaccacagcatgcactgcaaacacagtatgcattgctgggtctgagctgaaaccaccagctaattacagtacctgaagcagggggagggagggtcccccagggcctgtagacctgggaggtggacatgtagagaacagatgccagggctgcctgggcccgggaaggtgaggctaattggtgaaagccttcaacaggtgagggttgatgtggcttcctgagcacctgggtgatgggggaagagaatgtttgctccagccctggctgagccttcccctgggccccattaacagtgagattagagccacagccagaggagccaggtctggactctgctattatcaggagcccagccatgccctaggcctggggctggcctcctgtcactccacaaatacacaaaatgtttggccatggttatgataacccttgtttattagagagcaactctactctcacaaggaaaggaaataagcacccattaaatgagaatttatatggagcccatttggacaaccctgtggacagacctagaagccctgagagggccacactctctgggtccctatccagaggactctggatcttttttcactggctcaaatgtcctcatagaatgcatggggtacaaattaagatggctgatccactgtgctccaaggactatgagctcaaggacaggggccacgttttatgcatctttgtacccctagcttagtgcctggcttataataggctaatacaatggatggatagatggatggatggataggtggatggatggatggatgggtggatgggtggatgggtggatgggtggatggatggatggatggatggatggatggatggatggatggatggttcgttggacagatagataaataaaagcctgagcttcacagtggctaacagtactgaaccagaaccaaagtgcttaggtttgaatcccaactctgccacttaatcctgtgtgaccttgagaaagtcacttaacctccctgtgccttaatttgttacctgtagaatggggattattacaatagtacatactttgttgtactgtggtgaggattaaataatttaaaacatatagaacaatgtttggcacttagttctatgggagtgttcactcttgttgtttgttgtcattagatgggtcagatgacctctgcggttctcagcatctttgaggaaattcatggtatctatctcagaggtatcatgaaaattaaaggggctaatgttgtgaagatgaaatagcaaaggtagttcttcccaaatatcttccagaatccgatagacatttggtcacaaagctgactgaaggagcaggggaatggtctcagatccaggagactgagcgctattcattagaaatgcaaattcttgagctccaccccagacatattggattaaaaagtcttgggtgggggctcagacatcttcatcttcacacctctccaggtgattccaaccccctcttgctaaggtttgagaagcactggcctggatcaccatggagggcccttcctagctgagggcactacagaacacagcatgtgcctagcatcccgactcgggagcaggaccctgagctggacctggatgcagagagccctcacagcagcctccccaggggcctgccacgcagtgtggtggtggtggaggtggtgtggggagctggagctgacactccgaattacaatctaatagcttatggcgcttccctcgtgcaccgcagcaaaggttaccgtgcaattacgtgtcgccacatacaaatgacagagcagttacggttactttaccaattacagggaaattgctcccactctgcagagagattggcactctgaaaagctctatcatctccatgaaaaggggattttaaatgcagacggtttccttcctccagcagttccccaggctcaggggcagagctgcaaagccactgccactgcccaaggaccccagaagtgcctggtagtctctgtggagactccctgggaagggctggaggaggaggtagacctggggaacagtggggggatctccccaagaactctagacatcacccccaaccctaggcctcaatgacacactcttaaggaaccaactatcacccactctgacagccacatcaatccatcttgaaggcagcaggtgatgaggcggggtgggcccctgatccccaaatcctcccctgaccccagcctgcacagcccctggtgtgagtcctgattgcacctcctctgccaagcaaagctgttttagccccggccctggcttgccccacctttgcagaaacctcacattgagtccttattacagaaaggtcagaaccaagccagagctcaatggcccaaatgcagtgctaatgaggtgaaggtcagcaggtccatccccctgtgggccaattagcttagctctgggacacagtctcttccatagccacaggctgccctcttactgcaggcatccactgtttacaaacatcctaagctgatcctgaagaggcagaccaggtgaccagcagggatgtgccatgcagccaactcctccagccacctatgtacctgccctgctgctctggggcagcagcagccatctgagccccaggatggaagacaaaatcagatctggtcttcccattgctctgtgggcaactcctgtggtccaggagagagaggatttctcccatctgggagaaaaccagctctcctgcccttcctgaatggaaaagtatcatctagcctcatactcctccacagctgggaagtccccactcctgtccgttgcatagggtaagaagacatcagagattttcccaagctcacccatggtggggccaactggatctttagaccaaccttttcccaccaaacctttggttccttgggctattggaactccctgcgttcagcaagggaaataggcactagatgaagacaaggctatttacttttcctcacttactaatttgcttaagagcatttatgaaaaacctactaagccccaagcactaggtgagcccctaagaatagaaagatgaaaaagtctcagttcctgccccaaagaactgcctctttcccagtgtggggatggacagacctgggccatgactagacaaagccatctgggccctgcttcagttatgtgcctgggggagtccagagaatggaccaccaactgccttggggagcaggcatgactttgaggaagaggcgaggtctgggctcacgtccaagttctctggcttatgaaacagtattctgcccctctttcacacatcatatttcagatgcggaaaataactcaggatcataaaatccaacagccccattttacagaaggggccactggggcctggagagtgaggtgcctcccctagttacctatcaagttgctgagaaaataggtaccaaaaccccaaattcctggtgacagaaaaaacaaaacaaaacaaaacaaaaaagcctgattttttttttagatggagtcctgctctgttaccagggtggaatgcagtggcacaatcttggctcactgcaacctccacccgccaggttcaagcaattctcctgcctcagcctcttgagtagctgggattacaggcacctgccactacacccagctaatttttttatttttagtagagacggggtttcactatgttggccaggctggtcttgaactcctgcccttgtgatccgtccaccttggcctcccaaaatgctgagattataggcatgagctaccacacctggctaaaaaactgatcttaagcacgggtttcctctggggttgttagagggtggtcccaaagacaatctattccaggatcagaggaaggcaggggactgctggggaagagactatgtgtccagtccctttcccagcaccagggatgagtgctctgccatctccagaaactggaagcaaccaactctcccctcccaaggaggcccctgaccactcacttaagctgggcttcttcctttcctgggtctgtgcatcccaaaggaaagtgagaaatgacgttttgaaaagaaattcaagttaggagaaaaagggaagggaagcccatgagctgcctattgatacagaaaagaaaaggtctttatattcttcatgttgagcagccctaaatttcttcccattaattacacttatgcacacttgtgcacgcacgcacacacacacacacacacacatacacatatcctggttgctgaccatagcacacctccactggaaatggggaatcagtgaattacacatgtgggatttctttttaaagggagatattgatcagataaactgtaatagctcatgtctaaatgcaggctccagttgtaaagctctgcagtacagggagataatgatcacccacttattgggaaccgtatctcaaatatgacggctgacccctaaggtgttcataaatacacaaaatgcatccaccccttgagatgacatcgtgtttactccacaatacctcctcaggggtagaggtaagtggagagtgtccacagggaggtagaaatatctctgggagtctctagtaggcttaggtttagctcctcagaaagcctattattctataagatatttccatgtgcttgagtgatgattctgtaacaaagaaatcaaaaagacctgactatccaatcctctgattgctttcctgtaatgcctaaactttctcttttatgactcctagccctccccagaaggtctgccttcagacacgtgacattgagacacaggacccacgctggccctatgagattgaagtctcttgaaagcaagccagagaagtcctataataggtgaaagttgacccctgcaccctggttgtgagcacaggccatggaaacaatgctggagtgagggctcatacactcagttactaatgcttcatctcagaatgattctttcgggtgtctttttcaatgagattgtagggaaaacgaatgtgtaacagaaagagggagagccagcaagccacagtcacaacaacccagttagacaaacacatcattgcaggggcttagagaaaagtgtattggggttggaaaaacaacccaacaaattatagtagttcccctgatccttggcttcactttccatggtttcagttaccgcagcttcagatcaaccactgcccaaaaatagaagagtagagcacaataagggatttttgagagacagaggagacaatgttcacataatttttattatagtatactgtcataactgttctattttatgattattattactgttaatcttttactgtgcctaactgataaattaaagtttattataggtatgtatgtatattagtccatttgctgataaagacatactggagacttggaagaaaaagtttgatggacttacatttccacgtggctggggaggcctcacaatcatggcagaaggcaaggaggaggaagacaggtcttacacggatggcagcaggcaaaaagagagagtgtgtgcagggaaacacccccttataatatcctcagatctcataagacttattcactatcacgaaaacagcacaggaaagtcctgcccccatgattcaattacctcccaccaggtccctcccacaacatgtgggacttcaagatgagatctggatggggacatagccaaaccatgagagtatgcatgggaaaaaacacggtatatatggggtttgggactatctgtggtttcaggcatccactgggggacttggaaagcatctcccaaggataagtggggactatcatatggccccagttctcaagaaccaagagctttgcttctgggcatctcaaaaaggaggagagcagaccagaaaacaggatagaaagtcattgtgttttaggaggtggggctggggattttgatgcaaatattcattaaatgaatgcatttaactacctatggaatgatgaaagccatttgctaaaagcaacacttcttttaatactcattttgaagtttctatgtgtgttttgggaccatctgtggcccaagcccaccagatatctaagtggtctttcactcatcatgaaaacaagctatccttctaatagggaactaatgtcactaaattgagcagttttccctggagaagggcattaagccaagcacacattctgcaggccaggctgtaaccaatagcgagctttagcagtgcaccccttctaggggttgctgagcatagcagccaaagacaagcttcagctcagaatcctaggggttgaacccatgaccttctcctcattagcttagctgccaagagcctcgtgttcctccctctgagaagcagacagggccatgccctgggaatagtctggacaggccagagctctaggccagcctaccaagagaattgaaattctgcagatggcattatccctgggggctggtttagcaaccaacaccagacccatgggaaatcccagggaagtttctcagcattgcgaatggtaacaaccaaaacctactggggtgccacctctctccttttgtactttagctccagagaaccccagtggctacctgtcaggggcagataaatcccatgccaccagtccatcaatcccaaatcccactgtccctcctggagtctatggcaggcagactcagcagccacaagggctgtcattgaagtgagaaataccatgatgattaagtttgtgtgttttctggtgggtgctgggaagcagtggccctgctccccaggctgagttatggggtaggtcattccctcattagtggaaataaattttattagccccactctcacggcaatgtatcttcctctcttgctcctcgggtctaggtgtgggtctgggtaatgttgcctgcgtgtgggataaatcagccgaacaaatcccattatattttggaacactgacggagacacagtaatggcacagagaccagggaagggagtgggctgcttctctcccactgaccccgtttcctgcccatagggccacacacactagggaaaacatgtaaattgagaggccagatggagaagagctctctcagttgtctctttctccttctctccactgactttcttgataaaagaaacaagcctggtgtggtgatgtgcagtccttcccttataccttacaaaaactaagggacatgtgaaggtaacagcagcaagcactggcccaaaatgtgtcttgtcacccaaatgcattatcttatcattcataacctgtgctatatagaaaggaaggcaattggagggaggccgaggtgggtggatcacctgtcaggagtttgaaaccagcttggccagcgtgatgaaaccctgtctgtactaaaaatacaaaaattagctggtcgtggtggcgcatgcctgtaatcccagctactcaggaggctgaggcaggagaatcgcttgaacccgggaagcatgggttgcagtgagccaagatcgcgccattgcactccaccctgggcaacaagagtgaaacactgtctcaaaagaagaaggagaaggagaagaagaaggagggggaggggaaggggaaggggaaataataataataaaggcagctggagcacatcctagggcctgagataccaaacaccacacctgcattaagcacagcccaaatctctcaaaagcaggtattggtgaaggaaaaaaaattctaagcatgaaatcactgcaatattattacgcccctttctgtccccttgggtggttattataactaaaggaggagacacaggatgatgctatgaagatgtttgagtgtcctatgaatataaggggctgtgtgtctatcgttattaacatctgtatatttctctttccttaggagcttccggactctttattaaaaggatacttttttatcatctccttcttgaagataaaatgtgtgattcaaagcaaaagggaaactgcttgcccagtgatatctcacaagctgggactggctgagacccaaagatcctgactcctagaccagtaacccggccaagacgccaccctgtgaggacgaaaggaattgaagggaaggcccagaagtccagatctggattgttaagtagggctggtctatgtgcccattgaacaagaggtctggcttcccattttggcagggttatctcacactgcatgaggcgtgtgtgtgtgagagagagaaatctcattgtacttgctgctgagcagagtgtgtgggggtgagggagaacaagtcacagaaatagggagacagagaaaggctaagagaggaccgtgcaccaagagtgtgagtgagtgagcaagaggagagaaacagagaaagcaacagacagcaacgaggaggacagacatcaaggacagaaagaatgggtgtgtgcacatgggtgtgctatgggtgtgtacgccactgtgctcgggctcatgacatgcagtccatgtctcagtattgtgagagcacacatcctcaaacctgactttgtgctaagctctcctggcagcagtctgcgttaaaattcagcctgtgtgactcctgggtcccgcctcactccctgctgacccgatggcctccagggtgggcatcctgggagagtacatccagcctaggaagccagcctcaactttgctcctgccaaacccaacacatcgcccagggctcagctacctgtcacacaaagcaccatgcacactagtctgggatgggacttttactgcaaaccctgctggccaaaaagagggaggtgggcgggcctttcacctaaatacctgagacaggtgccatctccgagagagtgggaagacttgattctataaagattggggctgtgatatgtcaggcacccagtgctaaataagaaatctggagtacagggtcatgggccatgagaggtgggcactcagaccaatgtgttagatttttgatgtgtgcatttattgggacatgagtgtggcatgggccatggtgtgtatggcaagtgtagtggagatgagagaggaaggatggtgcggggaagaggaggagttccaggtctagagaggacaagagctgagcagaaaaagcaagcctcgtctaatgccataaacaacaggatacaaccccatcaagtctgagccctgtgcttcctgctgacagggaaaagaaaacaccccaagaagacctgcagaagccaggccccagagcctgggatgcctgcctggccattccggatgctcactttcgtggagtttcaggatctcaggcgccagaccaacctgagtaaccacccagactggaatgtgaggccagcccaagtccaagggggtgaccctgtctcctgctcaggactgccatgcctaggaaaccagtgagtcaaaggaacggcacgtggaaggggacctccatcgccacccagtcatgcacacagcagggcaggaaggggagctttgggttaaaaagaaacagctccatctcctgtgcctgtgtggcccttgtgggactacacagggctggtgggtaaactccagagtcaggtgggagctgggtctagcaatggttctcaacgagaggcttctggaaatgtgagaggttttctagtcttgtagtggctgggaacttccactggtgctcagcactgtagggccccggatcacaaacgccctacaatatcaggcagtccctgcaccaagaactgcccaccccagacactgctagcacactcttgtgaaacaccacgggaagagcaccaagctgagaattaggatacagaacagccttcagtttactaattacatgaccttgagtgaaacacttgagttttgtgttcctccattccctcaactgcagaggatgcctgcccttccattatcctacagtattgttgggagaagaaaagttgtgagaaagcccttgttaaccatcaggtaccatgcaaactccagtgtgttatttccagacagccgggaggtctctgccctctgctcccactactggggtttgacaggtgtcagttggtgatgctggataatagtttctgctccaaggacccaaattttctagttgagggacactcaggtcaaggcttgacagggagattgagaagctgatttctgcaccttctgcatgccacctttctccacaccgcctaatcagtactatggccgagactatctgactcccatacccatggctcaatcagttccaaagtcagggaagactgaagtggagtgaatgacagtcactcccatgaccacagccattgttcccatcacccaggccataatgacctgctggtgtgcatctctctcctccactgtgtgggctcctggagacagatgccattccacaatgcttggtatccaccaggagggagtgcattgccaagcccttccctagggctccatatatgtttcaccattcattagtttattaagaggtgctagttcgttagtgttggatgaggttgccccaggaaggtgaagaaaggagagaaggtatagataaccctatgcctggggaattctgggatgccaggtgcttggtcaaacccagcatcttctccagccagctgcccactccaagtcaggagtgtcaggtcccccccagagaaggacagacagccatcaccttctcctgcataaggtcctggcacatgacagaggccacaggtgtgggctccccagccttactgtctgtcacatgctctgcagacagggggcctcagggagcctggatggcagccttcaaaaggggctggggatagagatgcaccagtgataagccacagaaactgagaaatgaaatcactgccattccccacatgagtgctcattagcaaatcagtctcagcttgacctctagtcccctgagtcccaagacaattggggctctgacagaccctctaggaccccccctcatacccatgtcctcatgagatcctcagagttactttcagatactaacccacttgttctgggagacctctttccacccaggctggagaaagccaggacaggggtaaagcatggctcagagggtgaaggcggaagctgctgttcccaccctccactgacaccagaaagccccagctgcttccctagcctccacacttggtgcccactcaggaatgtacatttgtgacaggttcgtttatgtccacagcaacacattcccatgaggaggccactcctggccaaccagccctcatctccaatgggagcacagccggccttccctgattcacctgaagttgaggtacagctgagctctctgggggctgcaggtcagcaggttctaccccaacggcccaagacttttccctctgtgcggtcctcaggctctggcctgcccagtgctctgtggatgctccctggcacaaggggccttgtagtaggggttcttcttcccattccttcctatcccccaaatgaacacagccaaagcaggtgctgggaccttgtgaaggaggcaggtggcccaggagttttgcggatcccggctctgagttctggaggtgtgagttcagggggaagaatgtgggtctcaggatgtggaaagggctagaaaagcctgaagagccccatgggaggagcattctaatttagagagctggtacagcctggagcacagttgacattcattgctactcaaatcccttcttcaagcttttagagttgtaactatgataaaacccacaggggaccccttaccctacaaaatacaagtcctaaaagccaacctcctgggccttgccctgccctctgtcatcttcctacaacagaaacaccacaggacagaggtcatctgggactgagttctcaattcacagggctcaagggagtgtcagactccgtgacaagagagatctccagagttcatcttgttcatcctccacctctaggcaggaagggaacaagaaaaccaacccaacagccttgtaaatgagttgaggaagagctgggtttgcaaatggtgccatcggggcaacacagagcctggcctggccgatgtcgcacgaaacacgtgtggtctgagccgactccaaaggaatcgtaacaggagggtgggagcaaaggaactcgggtatctgccaaatcaaaggaaactgatactgtgcattaaacaccagcctggcctttttcagactggctggagagacagccccaggcctgtgcagagtttctggcctcctcctttctactctcggccctgaacttgcctgtaacttgaaagggctaattaaagccaaaagaaaaatcaaaagcttgttatcttgctccattactccccgtcccggcattagcctgtcttgcaaagctgttttccctctattctctccaaggctaccacacggtgttaggacctgcagctctgcagacttccatgatgaacttggctttttgtattgtggcaggaagcaacggcagcacgaacacttgcccatgggcagccagacggacgcctgcagctgatttttctcccaagagcatcgcccaaaaagtcagggttttaagaaagttttctacaggaaactgtcagagattgccaactcctctggtctcaaaagaacttgttgttgtttagtaagtgcacagtataaacttgccgtcttctaacataggcctgcatatgtgtgcatgctcgtggggaatttattacatgtatgcatgtatgggtgtcctgcaggcaagggggattctcttcaattggtggctctgttactcactcctaagatgtgtgaccttgggcaattcattcagcttgctgagtcttgagatactcaatgcaaaatgaatttttaggccaaggctctctaaaggccttctcaacaccaacattctaatacatctcaccacagacccatgtttgagtgtctaatagacatgtccagaacagcctctgtcattagctgccttcgtttggaagcagtccatacccccgtaagttcacagacctgtctcatggactctcttaagtggctccactactgccccaaacaaagggctccaggggcattcccaaaggttgtcacctgctaggaagactcagtagataaagtggagtcccctccattctccagtctggctctgatttgtcaactttttgctgccctgcttggtccatagcacctctcctatttcctttgtgacatcagggaactcctggattttcaagacctccaagaagagacgacatctcttagtttcagctggcccagtgcctggaagacttgacagtggaaaacagcttaagcctaatgccagggcaccatctttctcctccctcttccctatctccaacccaaatcccaaagaccagagtgatggcctctccacactctggctggggagggtgccagtccccactgagatctgcctggcacatagttatactttatgaaaggaaatttacacttttttaaacaaccaaaatacatttcctaatatggaactccaccaaagtttaaggagtcaagaatcacatcagtatggatgcgtacttctgtccaatggatacattttcctttcttcttctccccaaattaaaattagagaattgatgttctcagactaggttcataatctttaaaatgcacagttataaaaggaaaaggacaagaacactgaagatgctgatagctgagccttccaagtcacccaaagaatgatagtgaaaaagcaggaccattgtgaagaggaacagagtcaagccacaagaagggggatgcttttcatggtggggcacacgtgagctaggctgtgacaggcaggagtctgtgtcccctgcttcacctggggtaacccagcaaggccatacccaccagccatgcgaagacccctaagccaacccttctcctgctctccctctggctccccacagctctcccatcatcccatgctgctctccggctgcttcctgactttctcacatgtctcttccaaggcactgtgcacacagaagatgctcaataaacacaatttgtcccttcccatcccttttctaagttagctttgctttctctatgtgttcactgcactcttacctgactgtgctctcattttagcatttcctaaagacatacaaagggctaaaaacacacctctcctgaaattccatatctatcccaaatgtaggatgactcctcacattctcctctccttctaccatatggtttttattctaagctcccaggaaagttatttgcaggcttggtgagtacaaagggcatgtacgtgtcttgcactacagcacactgtgatctagactccagccatgcccggtccctacgacatccatttgacacaattcctacctatttccagcactccccgtcataactagtgagccaatatgaggcagagaaaagtacactgatgggaatttatgtttcagctcccactctgactcttatacattcaatgtcatagttgcagaatatttggtgacactctgggtccaatgagactcagagatgggatgggatatactcacttcatctgcaaaaggggaaggatgatacacatcccatgggggctacaggctggggttctcatcctacactcccaaccatcccagcgcgcagccctccctgtactcaccgcactgctgcaggggatgtccttcaccttgagccaggccaggtccagcgtgccctcgccccggtaacaagactgcagccgctccttaatgcggtcatttatctgcttcaagatgaagatgcacagggccgactcatccagggatttcattttccgcttctggcccttggagaagacggtgaagagcaggtcatcatctggatggactccaagggtcctgccaagcacggcccccgctttggacaggtaggcagcctgcagcaggcggtactccaccccactgcgctcacagccaatgggcacctctacataggagttgaaggctgtgtcctccttgcaaagcctcacgagcttggatgtatacacctgctccttggtggtggagcctggtggagacaccatctcaggttggagggtcaaaaagtagacaaagttgccactgctaaaaccatagacatagtagatatcaaagtcagggatgatggtgaaggtgtccgaagggatcttaatcatcgaggccacgaactcatcatggaagacgtacgcgaacatgccatccgcctcagagttcttggtcagtttccggctggagatggtgggaaaatactcgggcttcccatccactgccgtggcaatgaacagcttgtcatccaggttgctgtaggagacgatcactccaaagactgagccgctctcgttgacacctgacagatagtgctccttcttatgataaggctcccccagcttgaagaggtcctccagcctcagcagcttgcagatgccttggtacaggctcccacaggcaatcagcctgttctccttgtagtctatgaggagcatcttgttgacattgttggtggtggtcaggggctcattgcaggtctggacgatgcggggtgggtaacacttggggttgtcctcgtccggccctgtctcatgcgtcaccaagaccttcaggtcgctggagagcttgtaaatccgattgacggcccccaagtaaatgtgtcctgtcctctcatccaccaccaggtgattgaaaccctcggcgggctctcctcggaatgtgacaaatgaccgctgcttctgggacagcggggctggctgccgggtgagcaaagtggaggagcccatgcccaccatgaggaggtgggagagaaggcaggtccagttccagggcatggctttcatggcagaggcgggtcccagtggcacagcagcactcaggcacagtcgtcccctcagagggccaggactcagcaatgcagtctcccctactggagaaagggaagacaatgagctggataacaatgccagtggcttcatttcaccccacagcttgtctgcctggactttcaaaatgttctgcacacactgagcagaactgcactggggggtgctggaggctgactgagtcaacccccaccacgggcatgtgacacagtcagagccgggtggcagcagccccaggaggacacatcagtaacgataatggtggtgatgataatgacatgataatagcagtgatgatgatgatgatcatgattaacagccattatctactgagtgcctgaatttgtgtcagacactgtccagcactgtcacccgggtcaggtgccaccagcaggcagcatccgcaaagactggctggaggagaagagggagggagggagggagggagggaggaagggcaggaggcggggctgcctgcactggctgcaagctttgtccggtgttccccacagcaggcctctgcacacagtttctccgtctccaggctctgtgaaccacctcctgctggaccccatctggccgtagaggtggtaacagagacctcactattactatccacccatactacattgccccttaaagagccacacttttatgaatagcccctttattaaccttttctcaaaggaccaaatttgtatgtgctgtctattacctgctgggaccctgattggtagacctccgaagtacatcctattgtagccacattttatagctaaggaaagcaagcttagggaagtcatgtaacttgcatagctataagtggtagaggtagctccaaatatgagtagtgtaaatgtgcacaggttcgcaatcttaactgctaaaccatctcagttcaccccaaccttgcacagttggggctgtaccgtggtccctgtcccatgcagcagaagaattaaggttgatcccttctcggggctgtccattacagccactacctccagttctctgtgtctgtacctactactgcaggagaaactttcctctgtgcctcctctgctggatgaagaggccaaattaaaaacccacatcctcaatctcgtcacactgcagctgcaaccaggtcctctgggttcactgcccaaccctgagccctaatgttattttaacaaggcagatcttggcttcctcccctagcagggcctcctctgagaggttttcattaaagggagagaaaaaatgctttaagaagcagtcaagcaaataaataaacaaataaatacaaaactccccgaggaacaagatcactccccatcctgagggtctctttctattcaaggtgcttcctgcatgtgttcccattggacagctttatgtttcttccagttcgagagaattcagggcaggaattgccaacatcctatctgggggcatctcagctctgtggaatttttctcattcacccccaaacacctcaaaagtagagaatgagaagaggtagatcactaagcaatggaaaattccccagcagggagcaaacgctaggtcagatggaaaccaagagaagaaggaagaaaaccaaataaagactttgcattgtcagccagcatcctaatgaaaagcacaggccttctccagtcaatatcagaggaggaagactggttagtggaacacaccacaaccaagagcagtgctgaaagccaagggccttcattcattcacccatgtggcaaatgtttgctcagaacacacacaaaatgtgcaagacactgtggggcccaaggagcagatcctcaacgaatgcgtagtcaaatcaggccgataccaccagaacctgaactgatacgcacgacaaaaagtcacatggcatacaagagagtgctttgaaagttcctaggaggaggaagacttctaacttagggtgagagagggcaaggagcaggctgcaggaggccttggggagggcatggaatttgggctgagctgtgaacttcaagaagacagtcagagcacgaagggaaagaccttctaggggaggggtctacatagcagaagcatgggcatatcacatgagggtgtgtacaaggaagagtacgtctggagaacatagttcatgaatgaatcaggtggaagatgaggctgaaaagagagagcttcagccttgccaggatgtcactgggaagttgagactgaaatgcacagtgttgaagacagaaatgaaattgtagaggaaaagagcaaaggcccccagagaggagcctctccctttccatttagccttagcctttgcagaaggagagtttggagctgagggtctgtgaactccacagggcagggctgggtctgtcttgctcgtcaacacattcacagctgcacatatagaggaggctcaacaactgtttcttgactggcagaaagaggggctggaagcatagacgaataccaatatctgtggagtatttactgcaccccagagcccatgcaaatactttcacatagcttggctcacataatcctcaccactgttccctgggatcagaattgtcttattcctatttcaggtgaggaaactttagctctgcaaggacactggttaagatgtagcagaactgggtttgaagtccaggtttcaatcaatgcaaaatccatacttttctagaaatgcacatttccagagcccagaagatagagcacttagaagcccttgttaactcatgtaagccccaaacagaaatcctgggatatcacctaccagtatcatgagaaaaacaaagtcctctctgaccttcaggggctaagctggtagataacaccgatcaggtgagttctgtggtttacctctgaaagtattaatgactgtaaagcagcagctgcacagagcctctgcctagcacagttaagtgcttaggaaatgatagttgctgtcgttgttatcgttagcaagattaaaataggattagaaagattaggattatgataatgagatggttcctggtggtacatctcaagatgagtgatgaagagtcaagatggttcaccttgaattgcttgtgcaaattcaaatatcaaagaagaatctataagtttttgatctaaaagagataatccagcttagtgattcccaatccctgattttagagacaaggaagttgaaatccaagaggtcagatgaaattgcaagaggtcacacattgagttgaagacagtgtaagactgggtctcacactgtccatcccatgctctttccaccaccccggcctctcttctgactttatgtgaattcactccagcagctgcttccagcctttgtctgaaagagactgctctttgggcaccatatgctctgccggctaacagggccctcaaaacgtctctgccaacaaccaaattccagcagggctgataatcccccttccagacaggcaggtgcaggtcggggctccgccaccaacttttctgaggagagaacttcgcacagtctctgtatcacaacctgccgtatgctggggaatgtgtgcctaccccacgacctgccttactgtacatacacatggatccatggccaatcagcagctctctagtctgcaagaggtgagatgaagaatcctataattacgaatttactgagcagaaaggtgccatggctcattctgcatcttctattaggcactgaaaggagacacagttatgcatctcaaacacttatcaccctcatctggggatggtgagattactacacccagagaggaggggggcccacagaaacaataacatgtactgggaataaccagcctttcattttacacactaagaaagggactgattaggaaacaaataagagagaaatggaagagaaaaggggaaaataaggatgtgagctccagcttgcctcaccaaagaccccaccaggaaccaccacagaggtgacaccccgccgagcttgggacccacagatatgcagagccaccagccccctgtctccctgagctgtctaaggctgctccaatctggcaaagcaagagtttccaggggggtttcccttccaggatgtcaattcttgtaagcggtaaccccaacctaggaaacccccaccccaatatcagagcctacccaccatttcgctctcaagtcaccatttagctagtttcaaaaccaagtattagaaattacattcagcccaactctgattcttaaaggcaagtaatgggaccaaataaccttcacgattgccccaaaggattcatcgaactacgtagagtgggtaagaaggcaggagaactgaaagaccccgtaacccaactcaaacatgctacagttttcccttctttgaaatcagattttaattttgagtagtctcaggggagatgggactcatttatagaagctgatcatcattttgattaaagaaattggggttgtctttgttttaggcagcaagtttcaaagaactgaaactaattttcatgaaatagcaccatcctctcagattcctgagtggtagagaggaaagttattatagagtcgtttaaaatagcaattaccctgtgaaattactttagagtttacaaagtgttttcatggatattaccttgttctgaatttcttgttcatgacaaccctgttaggtagatgaggtatttataagtatgccttctttaaagataaggaaaccaaggcatgaacaggtacagctcttggctaaggtcacacatagtcacgttgggcattggagagctgagctcttcaggcctcactcagttattcacaatatattccctggccccttggacagagtcctggtcctcagaccttttattatggggtaataggattctcagaaaatgtgccctaagatggcatttcaaaattcacgtcacaacacaccatgaattaggtgagtcacaggtgttttttgttttagtttttgttttgttttgttttgttttgtttttgagatggagtcaccatctgtcacccaggctagagtgcagtggcacaatctaggctcactgcaacttccacctcccaggggttcaagtgattctcctgcctcagcctcccaagtagctaggattacaggtgcccaccaccatgcctggctaatttttgtacttttagtagagatggggtttcaccatgttgggtcaggctagtcttgaagtcctgacttcaagtgatctgcctgcctcagcctcccaaagtgctgggattatgggcatgagccactgtacctggccaggtactcttcttaatgaaataaaatagaagggaaaatactagtatgtcacatagaaaagataagcactgtttggtgagactttttttttttttgagacagagtctcactctgttgcccaggctagagtgcagtggtgtgatctcagctcactgcaagctctgcctcctgggttcatgccattctcctacctcagcctccccagtagctaggactacaggcgcccgccaccatgcttggctaattttttgtatttttagtagagacggggtttcaccatgttagccaggatggtctcgatctcctgacctcatgatccgcccgcctcggcctcccaaagtgctgggattacaggcatgagccactgtgcctggccggtgagacttttgttttacccactatatagcaaactacatattgaatgtgatgtaaatatgtgtgatgtaactgggtccctgggatggttaattttatttgtcaacttggctgggccacggtgcccagatagttggtcaaacattattctggaagtttctgggagggtgtcttgggataagattaacatttaaatcagtctgctttgagtaaagcagactgccctctataatgtgggtgggcctcatgtaatcagttgaaggtcatgaatagaacaaaagactggcctcctctgagcaagagggaactccaccagcagatggcctttggacttgggtacaatattggctcttctctaagtctcccatctacaagcctaccctacaggttttgaacttggtgcctccaaaattgtgtgagccaattccttaaatcaatctctgtgtctctatgcacacacacacacacacacacacacatcctcttggttctgttttctttgaagaagcccaactaatatagtcatggtcaaaaaaatttgaaacacactttcagagacggtgcatacctgttgtttttgctgtcattcatttatcctctgggcatctgtgcctttgcccaaacacttctgctggaattgactccacctctggttcaaagcctgagccactcagcacagaacgggggtcgggagggcatagtgattggatcaggaatgagaaactggttaaatcaggtctccgacaagcaacaggctttggatagggatactaggggagaaagttctagctcttccaccagatgtaaccttggagaggcaagggcctaagaaccgctagtgccatcttgtaatcacaggggtgagagcaggggacaggagcctggaagaatgaagccaaagtactgagaagagcagaactaagccaaaggatagagagtactgggtcccaggcctggcgacatcctataaatgtctcaattgtgtccactgaagccagctctatgcctgtactttccggttacgcaagtcaaaaaaaatttttccccttttgcagaagccagtttgggttcggttttctggcacttgctgatgtaaggatcctaacctatacacagaaaaatcccaaagagtacagtgtctcccaccacaacctctctaatacactatttttccatgggatcaagtgagcaagccaaacagatctgtgccttccactgcccacagagataaactatggttttacagatagcgaggcacaatcccaggtgatgttcgaacgtgtgtgcacgtgtatgtaccaactttcagaatcaaacacaacacttccctatctgctgagcatttgccttaggagctgcaccagcagagctcttgggaagtcttcaccaattcatgcttccgggccctgagttagactcattgttcaaatgaaaccttctctgatcaagccactggtctaagatgcccctactatatattagtgcaggaaccagtgccaccagagtctcacattttacaaactctgttatatttgtccattgatgctgtctcctagcataaaaatatgagctccttgaggacaaggattatatattgcccctcttttctccagttccaagctcagagcctgaaacacagtaggtgtataatagatgtttggaaacacgtgaatgaatgaatgaatgaatgctccatagcagagtatatgagatggcagtgggtatcatgtacagctgaagtacaaagtaaatcttggtgcttcaagtaaatctttgagccagtcaattcaaacagggaccaacctaaaaaactggttgtaccctgttctaaaccagggtttataaatacttaaaatactccattttgtccttttatttatttatttatttatttatttatttatttatttatttgtatttaaaggtaaagctcttttttaatttttattaggacatgagttcaaatgcatcagagaaactacgtctttcgtatatgatttacatggagaccaaccggtccaccagctggaatatcataaaaagctgtcttgtgttagcaaattggactttgagaaccaccatcctatgcagcaaaggaaatcagtatggacctggttgaacagaagaagctgagcctgaaaataaaattgcagcatggaaaacagacaacaacagaaaacagccacaatgcaggagatgccagttgctagaagtcagcatgcactcctgtattcagccaacgactattgatggagcacataccacatgatgagttctgggctgggtgcaaaggatagatacattccagagcaaaaaacagtgtccctgccaggagtggtgactcatgcctgtaatcctagcactttggaaggccgaggcaggtggatcacttgaggtcaggagtttgagaccagcctagccaatatagtgaaaccctgtctctactaaaaaacaattagctgggcatggtggcacatgcctgtagtcccagctactcgggaggctgaggcaggagaatcacttgagctcaggaggcagaggttgcagcggtgagccgagattgtgccactgcactccaacctgggtgacagagcaagactctacctcaaacaaacaaacaaacaaaaccagtgtccctgctctccaggggctgagggtcttctagaggcccctctagctgtcccactggcaagctctgcagatcctccccttcccagcctctattagaaacccagaacttcctacaacactgtacaacaggtcatttaatctcaattgtgcaggtggattgggaagaggaagctaacttttcacaaataacatgcgcttccctatgcgtgaggctgctggtatgaagtcagtgagaggtggccatcagcgatggatgacatttcccagcctctccatttccacatggtatccaggtgtgactgtgtgaatagcaaggtcatggtgacatttccatgccaaagcagggaagaaataagtgtgttttctctacggtttctttcaccacccagctggataaagaggaccctgaggccctataggatggtggagcctcaagatgaaagattcgtgcacccaccaggaacatcagacaagaaagaaacctttactgtgataatactgaaactgtggatttgtgtgtgacaacagttaacctcaccctaactcacaggcagaaacacagcaagctcactgcatctcagagctgggattcaaacgtaatgctggggggctccaggcctctgttctttgtggtgcatcaggctctggccctaggaagagttctctttagatgtcagcagccccctcccttgtttccaaagccagattgcaagtgggtaagcccagagatagaggagatggccaagctaacatatacaggatagagaaatcttcctgctcaatggccatttccaagtttggggctcagggaggtaagtgtgtgtgcagctgagggcagtgagggagttggggagcagcaacaggcctcatttccatttcatctaagaaacttcaaacacttattgatccatgcaaacaaaatggacacatgctatttgtagatttctactccaatttgtaatccgtgcattcaacatagcgtcttcagtaaggtcagtattttttcatgtctgtattttttttactttaaactcttggtttctagaagtgggagccatgaattattttacaactttccctggagaattctatttacacccatctagggcccaatcatgcagctcgctacagtctggggcccatgacagacaactgaccccatgtacttggccacctcactgcagctccattcgtcccggccttcactgtccccttgccccttgttgctagctatctcagaaatgagtgtcacattcatcaaaggaaagagccagagggtagggttgacacagcaaaacccatcactaccactagggggaaaagtcaagtcaaagcaactgtcttcccaagagaaggtcactgctggctttgggcagtctcagtgtgggtggggcctggtggggtcagctcagccacaacacagccttagtccagaaagcagcagtccagcaggggccatgggagccctccttccggtgtgcttccctctgcctctgcttctcttctgagagatgggaactgtgaaattgatgactggtgggagggctggagaaaagtataaaagatggggaagagggagcgatggagggccaggcactgatgtagagtcttggcgccaccaggcaaccagcccggtcccagggaaatccagcaccaagctcagctacgcggggctcccttcatccttacttcctagtttattaaaaggggatgaggagaagtgattaccatggacagagcctttggacccagcctggaagaagcctctgcaggaggctgagcctgtgagcctctccattcagagatcatgtcccagccggacctctgagatgtttatacatggtttccacgccctccttcctttccctcccccaggcctccttgtccttggcctggagggtgttccctcagggtacaaaaccacgtctccctggccaagtctgccgttcccagtagagtcgagcaggagctccagccgaggcccaggcagccccatgtgaaactctccattaccacgtggagatcgccttgagattccaggcactgtgccttgggacagtcactaggcaatggctttctttactccaagtgtggcagcaaggctttaaaaacacagcactctcaataggatcctggcttggggaggatagaatcctaaacttctttccagcatctcacttaaagaaacaggccagccaggaatttggagtcagatgccccagctggagttggtgtcaagacctgctctgcaaaatggcacaggctggcacctatgtggccactgtctcctacccagtccatgaggaacactctatccagggtctgtccaggggtactggctcctggtcttcaaaggggacccaatggcctctgagtgcacagaaatggggggacaccatgggaagttgctaagctgtagcaaagggagacttgctgtcacgtctgctgccccaagacctgagtggaccttgggaaccacagaaaaggggcttgggggtcaccacaggctggggatagtcacctctccagtaatccctgtctcgtgcatgtggcctgaggcttgtccagctgacattttcaccaggagaggaggctcactgcatccctgcctgccactctaacctacactccctgtagcctctctagctgctctggcctggccccagtaggcaaagccacattcagtggtcttcacccaaatgagctccttgctctcctttcatggtaaagggaagaagtgggatgtttttggctcacagccagtcatgcatcagccagtgtcacccataaaagcctcctctcagaattgccatggccaaggatactattggcatcaggtcattctaaccagacacgtcctgctaagtgacagcctttctttcttgttgcctcagtttccccatctgtaaaatggcgtttctggaaataggatggggaagagagatcacccagtttcttcttgtgctaaatccagaagtgagagtgaaatgttgtaggcttcacagaacacaggctatcattgaggttgggaagtttccacaaacagcctttgtggaggtgcagggcagagccacgtgatgtgatgattacaacacccaggggtggtgttcactgggtgacaaaaagctggtgctgaagtttctctccaaagactctttgcatctttgcttaagttgcctttttagctgcctgaatctagattgtggagagcctcaggaatgcctgccagggttgaattccacagtctgccctcagagaactcaggatactcatctgttaagtggatgtaagtcacactctttggagtctattttctcccttagataaaaaggaccaagcacattcttaacagctcaggtgttggtccatttcactgagcctgacaagcaagttgatctttctgggaaaggcctttgcttcttccggcctctgaggacctgggtccgcagcaggaggccagcaggaggcctccaagcattgaaactgccccacccacccaagggcttaatttagacccctcgacaggttgactctgccagcatgatctgacccatttcatttcctacatgtagcaagtaagaaaaagaaatggaaatattcccttctgcagactggtgtgaaatctctagctagacttttctaactgtaaaaacagtcagtgggcctagaaatgataatacatgcaaggttttggaaaaaccaagccgagagtccatacactcagatccttggacctcagcatctgtccggccgcccctccactcctaaaagcctgaccacccccaccagcccctgtcacagctgccccaacagctcagccacccaccttctggccccacagagtcttcactcgaggaagcccataatcccaccaaacattggcactgtgggggagcaggctatttggggctcactcagccaaatggcagggcttctgttgtcaccaacatctagtgggagtgcctcactccaggccccttttgtccctctaccccctctcttctttctcaattccccgaaaaatcaggaagtgaacagttgtctcccttgctggtctatattcatgtaattagtgctatttaattccacgatgagccaaagctcataaaatacaaaacatatttcagctgtgtgctgaaaatcttggcagaaatctccactgcagccggaagctgaacggagatatatttgctccttgaaaaaaaaaaaaaaaaaaaaaaaattcagaatgacggcaacaaagttttggggccaggcactactacctgagaatatgtaagggggtagcagaatagaggattttaggacataaagtttggaaataatctctatcaccatgacaacactaaatttaagaaatatttagtatagatcaagtaacaagtgtaatatatagtgtacatgccagaagaacatgtcatacatcataaggaggttgttttggtcccactcattccttactcccaagaattaacacgtgctttaaggatttgggtcccagtctccgagtcatcctgcctttcccattgggcacacacctgcaagtcaaatggccaagaagatgtgcagtttctggcaatgattccaaattaactaacacatcctcatctcccagctctttttcccctgacccctggactgtgatgaaacctcaccctatctctgtgtttgtgccagcaacacctgggcaaggaacaggaagtctcatccccttcctccccaacttcacaaaaccgggcacagaagggtgaagcaccggggactccatcctctcaggtgcccatgactgtaaagtagatgtgtcctcaacaagccgacctctacctctgaaatcaacaccaggtcctaacttgccagggctgctgacataacagattccctcccctggcacccctatgacttggtcatgccctcttcctttttcaggtgacaggaatacagaaaggagcatgttggtagagggcccagggcagggcctggcagaggggagattcatgttggatgctactgacatccccctttcaggacctgctcagaagctgtgtccatggggaaagagaggccatgaggtggactggggtgtgataaagggtcagatccactgcaagacccaggaggcctttcagtagactcagcagctcttctgaatccactctgtggatcagttccacggacacagacacagcatgctccatgcagaggggacaacacctgccagctcccactgccctcctactcttatgccacccaaaactccatcataaacacaaccatcaccacctctcattggtggaatgctttgccttctctaagctccttcataggcaataagccactcatggctccaaacatatatgaccaccccaacccaacccattaggattattgctgaggcatgactttggatgtcagagaatctcattaactttcccaaagtcatgcctttcctctctctatgcctcagatcttcagttgatccaatactttcctaataaactccaaagctggctgggtgtgttgactcacgcctgtaatcccagcactttaggatgccaaggcaggcagactgctgcttgagcccaggagttcgagattagcctgggcaatttggtgaagccccatttctacaaaaaatacaaaaattagccaggcatggtggcacatacctgcatttccagctactcaggaggctaaggcaggaagatcacttgtgcctaggaggcagaggttgcagcaagctgagattgtgccactgcactccagcctgggtggcagaggaagactctggctcaaaataaataaataaacaaaccccaaagccactcaccagagtcatcactggggattgtatagcaaaagtgggaagggaaatttgtctagaaggcccatgataaatgcacagatgttaactgggaagagagaaaagccttctgacttgttctggcctgtcaccttgataggccttgaaaacttgtgcacaatggagctcaaggaggtggcaccattgggcaagctctcgggggccaagggcttgtcagaagaaactaaccagcaggcagggaagatggcccatgtcttcatgcattcgttcaccaacacttattcagctccctagactctacaccgggaacctacattctgggggtgcagcaatgagtaagacaacaaggtttttggtctcacagagtttacatttaatagggaggatacacaataaacaagaaaaataactattttcagatagtgttaagacctaaaagaaaaaagaagcaaagtcatttgctacaagataactgttgcaagcgtgacctcagagagaccaaccctggcttctctagttggaatagccatggtttgtatctctgaggtgacacttgcagggggactgaatggccagggggagccagccatgcaaagatttgggagaggagctttctaggccaaaggaaatgtaaatgcaaagacactgaagcagacttggcaaggaaaaggcagaaggccgacgggctggaaggcccagaagagcacggaaggatgggtgatggggtgggagagaagagagacagcagatgccggagggtatattccaaatggcaggaaaagccatgaaaaacttctaagcaagggaatgacatggtcagggtctatggctagcaagctcagtctggctgctgtgtagagaatggtttttgggtggaagaggagttcactgaggagtgacagcagcctgactcaggtgacagtgtcagaaagcgagactggttgctccagcaggggttgctggtgatgtggaaacaaggggggcggaagagagggacttagtcacacctccttgatttttggattgaggatctgggtgggtgctggtaccatttaactgatatggggaaatcagggcagtggagcagagaaggcaagagttctttttaggatgtcaaaggtgaggttgtctagagggcccacctggcccaggttgatgctcaagagaacaatcaagggaggtgactcacagagaaccacactgtgtgttctgcggaaggcatctcatgtaaatgctcctaggaggatgctaatgtcatccttattctctggaagacaagctgattctcaataactacaacgaagtgaggctaagatatcaacctaaccctgcaaaaagccccatagagatgggggccttgtaactgtgacggcccctgggtagatgcagagattgtaccaagggtccttggctggaagaacgggatgtcaatgaaagaattttacttaggaacctagaatttgatgcttatttttttgtgaaggaagaactaccacagcaaaacttgattttaccaaagggaaattactgatgcttatgcagtacaggctactttataaacttcacaaattcccaaccaaagttaataacattaaaggattgaaaatggaaaaggggaaacagcattgatcatatacttcttagcaaggagccctctcttctctcaagtcataaagagtgccctgggttccccattatataaaacagtgaagggctaaaggccagcctgaaggaaattaggctgaaatcaaaataactcacactaagagcaagacttttttttgttgttgttgagatggagtctcactctgtcacccaggctggagtgcagtggcatgatctcggctcactacaacctctgcctcccgggttcatgccattctcctgcctcagcctcctgagtagctcggtgcccatcaccacgcccagctaattttttatatttttagtagagacggggtttcactgtgttagccaggatggtatcgatctcctgacctcgtgatccacccgcctcggcctcccaaagtcctgggattacaggcatgagccattgtgcctggcaagacttttttcaaaaaaaacatattaacatgtttaaaactcgtgataaaatatacattacataaaagttacaatcttcacaacttttaagcgtacagttcagtgacattaagtatacccatgtcatggtgcaaccatcactgccatccagagccatttcatctgcccaaactgaaaccctgtacccatcaaataccaactctccatcccctcaccccctgcccctgacaacctccattctacattctatgtctatgaatttaactatcctaggtatctcatatgagtgggatcatttagtatttttcctttgtgtctagctgctttcacctagcttaatgtcctcaaggttcattcatgtggtaacatgtagacaacatggtgtctttttgttttgtttttgagagactcggtctcgctgtcaccgaggctggcatgcagtggcataatcacggctcactgcagcctctaacacttggactcaaacaatcctcccacctcagccttctgggtagctgggacagcatgcacaggctgctacaccaggctaatttttaaaatttttgtagagttgattctcagtatattgcccaggctggtctcaaattcctggactccaacaatcctcccacctcagtctcacaaaatgctgggattacaggcatgaaagatggtttttaataaagatccattttgtggggggcaccagaaacttctgggttttaagtaactctggtttacagttgccagttcatggacacaggtgagaaagggaagacctagagaaaacttgtgaacaaatgcctgtcaagcctttttgggtgaaaacatgtccctttcaccaacctgcatctccagacccacaggattataataatatagcactgagaagaacaccagtccctcccaaggctctgccctgaaagggtcccctattaagcaagtatgagcaacactgcatcaccctcctggggagccatgatgcatgtcagctcactaaaagtcctcagaggtggtgctttgataagcaaacccatggaaggtttgtgaaacagggtttctcaaacttgtttgaccaaggaagtttttcttgcttaaaccctattatgacctctgggaacactgttccatggtacacaccttgggaaatgctggcatgttggtttccattcctcaaggcactttcacatctattttctcactgagtctttataaaaaccctgtcaagtaaattgagaaacttagagcaatttgcttcacttattgaaaagaaaacccaagctctcaagatttagtactggaaggaaaatctctaggtgaggagaagcaacgggtgcgagtggtatagactgcactccttgatattcccttcccaccaaaggctcatgcatggaacacattgcatcctccatcaccatggccccatggagacatagcagccctcccgttaatctcctggcagatgcctgcacgcctgtgacaactgccttctcctgatcctcttagcacagatgagagaggtcacaattttctcagattataagaaatctgacaggaaaacaaatgtagagaaaggaggaaggataaaatgagtctatcggaacaaagtgtaggtttcagtttcatcccctcctagctcattcccagactcaaaggccccgccaacccacacacccaaattgctgatttgacttctaaggtgccctgcctgaatggttcacttccttgctgcctgtagtgcatgtactcctggcgcccctgttggggctgctgttttatttggggataatgactcttctgtcctgccctatggggtaaggctatgcttgtgagggttggacatggcttctcaagaaggaggtgaacatttatggtggcagtcatccaggtggctctcaaataggtcactaggactgatggcacaccttcacaggtaggacagggccctcccatccctctttggtgcatagtcttcatgcctaaactttaaggggtcttgagggtctggctagtggtcaaagacagaccctgccccacggtggcacaatgggtgttaaacagggccactctacaagagacactgatgaagcaaaataaaccataacttggaaaccccattgacttgttatagtaactgtctctatttatttcacttttatcacccccaggccccgggttaaatcctgttaaatgtccagccttatgttagccatgctcttagaagttaatggacagttgtaaatccaaacttaggatgtagattattgggaagatgcattccgttctctggacccaatgtggccaaagctgcagttactggcagaagaaactgaaatctttagacaagagctgaggctgcaggacctcagcacctcctcaagtagacgttcttcctccattgccaagtctagagtctgagttttattttgctcagcaaggtaagagttaccttactgagaaaatcttgccatccacctctcaggagctactctcccagatacccaactgccttcaaaacttgtaggcattttaggcaggaattaccatccccattgagcagatgaggaaagtgaagtttaaagaggctaaatgcctttctccacgtcgtagagattttcccaggaaactacagtgagtaagggcagcacaatgtgtcacagtgtgaaacagactcaaaaaaaaaaaaaaaaaaaaaaagaattggaaagaaatgaagcaacctctagtgaacggactaacaagattcagtccaaagtgaaaaatcaatgacgcaaaggctcagcctgcaaaaatcgatgaggcaacggaccaataacctgtattcccagctgaattgacacccgactgcattacagtcatatttgtatttgcccagacctattccccatgccacctgccagcatactgcccacatgccagactcaacctccacgcacgtgcccacctgatccaatctgaagagcatcttccaacagccctgagaggtaactgatagagcctgcacacagaggcacgagaacagagcccctggaacaaggagataaggtgaccttctgagagttaatttagtaacaatcaagacatctgcatggaagcaccagatatctgcagaaaccaccttacaagggcaaggtgtccccaggtctccactgaaaaagcagggaagtgaagcccaatcagggtgacaaggtttcttccccaggacaagaatataacttaagaaggctataatctaaacagcttgaataaagaaggtattaaccaactcgggatggtcggctcggagaacagagtaagcagcatgagtgcttggtttttaatctcatgccagccagggagggagagttgtggttgactcaccaggaaggtgaactcccaggaggcgcagcagttggacacgaggcttctccatggtgcggactacattgttctcaagaacacccagcctcctagtcccgatccatgctcccccaaggagcagccaacccaccaatgtgtctttcttactggaatattcccaactgtattcaggagttcaccctccacacatggccgcaccccagaagcaggcagccatgattggaataagccaatgattcccagcatcaaccaacagctgtgattggattaagccagtcatgctggtctccttctccctgccagtgatgagtttaggaacagccatgccacccaagcctgatgaatgggactgaatgagaagcctgccaggggcttcaggaatataatttttttgctctttaaaagagactcatgtgagggagcacctctcttccttacttgtccacctgtttacaatgcctggaactgtggcagacttcttgtgcccatgagagaggcaccactgatgtgcctgcaatggctgaacagagagaagggaagtgccaggagtaggatgatgcaggggagctgctgaatgaccagttttagagccgcccaacttgggtcttcttgtgtgaggccaccattcacttatggttcacactattactgggtcctaccagaaggcgaaagcatctcactgactcacccagtaatccctcaggctacagctgtgctcgctgatgatactttgctgccatgaagactatgaagggtgtctaggacagcaacagccattctttcattagctggataagagcagactccagcaatgaataagatggcattttatcttaaatatcaatatccttgggactagaatgagttagtcctgagaatctgttcatctctgggtacacacaccagcaaagccagccccagtccataataaccccaccctggaaggccctacctggcagccactggctgcctcccattgcaggttggtgtcaccttgtttaacagcaatcaaagggaataacagaaatagcagaaaacacctgctaccttctcatccccactctacctcatatctcctcaaatcctccctactctgcatacttattttcatgtctttagatgagctatatctttcttacccacctcgtggcattttggaaagaataaaattaaatcaatatcaaaaatacaaggtgttacagaaatcatggaatttgggacatgaaggctgtgttgaaaatcttttcaacttactatgcattggattcactgggaaagtttttttaaaaacacagatttcagcaccccacccccagtaactctggtctaaagggtctagggcagacatcaatattttttaaaagcttcccaaataggtattcttttttttttttttttgagacggagtcttgctccgtcgcccaggctggagtgcagtggtgcgatctcggctcactgcaagctccacctcctgggtccatgtcattctcctgcctcagcctcccaagtagctgggactacaggtgcctgccaccatgcccggctaattttttgtatttttagtagagacggggtttcaccatgttagccaggatggtctcgatctccagacctcgtgatccgcctgcctcggcctcccaaagtgctgggattacaggcgtgagccaccgcgcctggcccccctaatggatattcttatatgcagccagagtggatgagaaccactgataggcaaaccctgtcacgtgcagatgaggaagcagtcccagggttcaaaatcacgcatctgctggaaagaaagccagggcccttggggtctgatctcttgagccccagactgggtatcttttcatcatgcttctgtgtcaactccagggtatttagatcattattattaatagacagagagaggaagcacaggaggaagactcaccaagggccatgaggaaacttctagggatgatggatatgctcattaccttgattatagtgatggcttcacaggtcaaaacttattcaactgtctaaacatgcagtttatggaatatcaattatatctcaacaaaactgtatttaaaaatagacccaaaaggtaacaaacataaagagacaacatatttgcaaatcaactatctgataagagtctaatatccagaatatataaagaatttctacaactcaacaacaaacagataaaccagtttgaaaatgagcaaatgacttaaagagatgtttctccaaagaagatatataaatggtcaatctgcatttcattagccattagggaaatgcaaatcaaaactacaacaaaatacaatttcacatccactagaatggctataatcaagaaaacagaaagtaacaagtattggtgaagatgtggaaaaatgggaactcttggatactgctggtgaaagtgtaaaatggtttattcagctactgtggaaaactatttgatggttcctcaaaaagctaaacatagaattaccacatgatccagcaattccactcctaagtatattccaaaacagaaattcagacagatatttgtacaacaatgttcattgcagacaacgttcaagagttaaaagatagaaacaacccaagtgtccatcaacagatgaaccaagaaacaaaatgtgatatatccttacaatggaatattattcggccatataaagaatgaagttttgatatgtctaaatgaatgaaccttaaaaatattatgctaagtgaaataagccagacataaaaggacaaatattgtaagaatctacttatctgaatctcaagaataggcaaattcctacacagaaagtagaacagcggttacccagagctgggaggagaagagaatggggagttattaatggcaacagagtttcagttggggaagatgacaaagttctgcagatggatgacaactttagttacacaacatcatgagtgtaattaatgccactgaattttacgcttaaaatggttaaaatggaaaattttatgttttatgtactctaccaccacaagaatttttaaatacagacacactgtagtcctctgccatccaactctcacaattactgtctgtatttgtaaaacatgttacagattaattaataacaaggaaaaggcttatgaaactataatgcactaagaactctacatgaattacctattctatttctcttaatagtctataaggtagatattattatgatctttattttatagacaagaaaactgagtcacagagagcaggaaatctgtcccagaccacaaagttagtatgtaatagaatagtgtttttcatctggtaacttcctagaaatgcaaattctcagacttcactccagacctaaggaagctgtgtttagacaagactgccaggtgattctgaggcatggtcaagttttagaaccgctgtaatagagccaaaatcgagttcagttaagaacctgaactttcgagtgctgtgacaagcagcagtcattcttaacaaagagcagtggttctctcacttaacgatgcatcagaatcacctgagtgcattcttgcctggagtgattctcacctggagcccatcttgagtaggctgatttggtgggtcttgggaagggcttggtaatttgcattcttaacaagtttccaggtaacactcatagcccagggaggacactttgagaatcactaatatacagaatctcattattatccacattttacagatgcggtaactcaaaatccgacattgtaaatcctagaaccacaaaaggggttagttattggctgggcctagagcctcagtccaaagtttttttcactacagcataaagccatcaccccagtgttccagatgcttccaggtgtcaacttggcacaacctcccttaaagccaacacaggttgaagacataaaagacgtttttacccattccaacaaactggcattagagtgatctaaaaaactaactggcacttgtgccaaagaaacgcagtaagaagacagaaaaaggaagggacaataataactagagcctagtttgggggtcaggactctgtcacagtggaatctaaaacctgaccatgcttcagaatcacttggtggccttttataaacacaggttccacaggtctggagtgggacatgagagtttgcatttctagaaagtttccaggtacaaatgcgttgatgcagttgggaagaactagaatatgggtcacttcctctttattcttatgaaatcagttgcctcttatgtaagtgaaagaaaattttctttcctgccttgtttgaaaaaatatgacatcataccatcctttatgcacaatgcattatccttcatatgttttattaccatcacctgtaatgttctatacatctccagattctcctctttccaaaccatttgtcgtctctgatcatgctactctgctactcgagaatcttcgatggctccctattgcctacacagtgagggacagacttagcattgtattcaaagacctccatcatctgacttcatggtttccactctaatagaactactctctattgcccatgcatgtcctgtgctttcctgttgtcatgccttcacccagttgttccctttacctaagattcctttttcctccttccttccccatctctacacttacaaatgtgacctgagactaactatttattccctctaggcctcagttttcttaagcataaaacagagatgacagtaggatcttccttgtaggttgtgatgaggaataagtagagcaatcagtggaactggttgccaccaccacaaatccctcctaacttccaaaccgaagggatttctgtccttcctttaatttccagaataatagaacctgtatacacattatcattatcatgttctactttgcacttgccataatgtttatacctgtattccctttgcagctaaggaaaccccattaaggtgaagatatgcttcttattttcagttgcatgcacagtactcagcacagtataaacacccactcaaagtaggaggaacaaatgatcaggactgttttaccttaaattgcttcctagagctgcccttgcagtgctctgaggtcccatcataggtagccaaatccttgggtggaacataaactcaggaactggagaggtgcaaggcccccaacatgaaaagaattaacttgtctccagacatcacctgttcaaagggttccctggaatccacagaggccagccttagcccaattttccaacccaagcaccttctaataattcaaggattcccatccacatcaggactcccctgtgcttacttaaaacaaaaaaccttggctccacaagaaaaccatttttctctatttgatgctctgggcctctgttctccttttgctctgctagtctaagaaactgcagctgccctgcccacctcggggagctctgatcagtggaagccgggcttcttgagcacacagcctgcaggaccagagagctctgctctcccttctgtgcctgctgccagcacccagcccttcctcccttcaccgcccatcttggagccatcacctatcccacactaacccacctccttgaacaaggccacctcatcctctcatcttagaaccaagaactctggtttgggaccacttcccacagaaccagacccctgtggggttgctctaaaggacagaataaggatattactattattattattattattattactattattatgttaacaagtcaccaggcaacaaaggcaatgagattcaaagacattccttggtggctgagtgaaggctgaagaaagggaaataaaatggttgctttatgagaactcccaaggccagcaaagaggaagaaaagaaaaaaggccagtgaagaagaagccgcagcttgagtgtgtgtagtagtaaagaggagaggggaacaggaattcacactgaaacagaaagccggtcagcttcaacaaggagaggatacaagactacttggctggaacagggatacctggtgagaaatccaatcagcaattccagatcttccctgactctgctccaagtctccccaagtcaccagccccagggccaccgcccctactaactacttccaccattagaccccctcccctctgtgagagggcccatgaaacagcagcaacttccaagtgagaggagccaagtgagagacctgaggttccttccaccccagccctccctaccctggcgtccacatatctaagcctgatgcagagaccgagaatctggctccaggggccctgtccacgggtgcctgcccgtgagtgttgtgtgtgcatagattctgtagtggcggaatggggtgaggaggcacaaagagcctctagcctgagagcagccgggagctggagcaaataggatggacactgggttggctggcactcaaagccttttattttagtagtctccaaaagaagggctatggaaagaaaatactagaacttctatttaaatctatttgtacctcaaaagactgaaacataacagctctactaatatttgatatgaagaatgggcgccattactgggcgtgttgaggggcatggatcttacaggtgcctgagagcagatggcaccatgatgctgaggctgacacggcgcccccattccttaacctgccacagtatttagcaagatatgacagtatacctgagccaattcaggaaacttacgatttactgtgttatttcacttcaataatccagtgttttaaaaactaggcaagtggctttaaggccttcctatcaggagaatatggatagaaaataacacataaataatgcaggcactggtaatcaataagaaaatgaagatgtgatccttccacacctagtatagatcttcatcatccatattacaagctgcaggaccaacttatcagaccagaaatcaacccgtctccaaataaaaaagaaatcaaaactatgaagactattttgatatctggatttatgttcaccatcattaatgatgaacctcccaatgagcgctgatttacttacagacaatgcccaatggatgggggcacatgccaaaaacatcagagaccaaacgtcattccccaactttgttgagggttctcctggcttgcagaggcagaggaggggctgtggtctggttggtgggtttccatgggagaacagcaagagggggccacactcaggaacctcaagacccagcccttggtaacggccttttgtggctgaggccaatgagcgtatctcccctcctaccctcttcctcatatcagctgcagagttggggctccagaggaaaggaaaggggtcccttggtattcaggaccctgattcatctcatttacctcgatggcagccgccccatagcccacacctcactgtcccaccaattcactaagaaagccaaaaggaaagtgtgaccccgagagaatagaacccaggtccttttgttcccaggctcatgcattataccttggccaagatcccctctgcaggccacacaggcaggatcttttcccgatgattgaaaaatcaaggcatcttcccctgcaccaataggagctaattacagagaacttgccacaggccaggcacgtggctgaacacttgacccccatcatctccattaatccccaccacaaccctacaaggtaggtcttattacctattagacagagggaaaaactggggtttacagagagtagatcattttaaaggctgcagcccagactcaaagccaggctccagaatctctgctcccacctctctcctgcttcccacagcaattgggcatgccaaacttggagaaaaacttaccttcgtcttatgaccttggacgagttactctctgaacctcggaccctcgtgcataaaatggggttataataggacatactgcattgggcttttgtgaagattaaatgagttaataagtgtaaatgcttcaaacagtgctgcacacatagtagctgctgtattggtgtttgcggttattattgccatcatgactgtgttacattgttctccctagtaagttcagtttttcttcccgtcgttccctataagtgactaatttttatccttttatcctagtcttgatccttgcaacagaccaagggagaagttgtgcattacagaggacaaagactaaattcccctccctaagcctacctccacctctgcatgcaccccactgacacatagaggtctcaacaaatagaacgacgacctcagtggtgcagaaggaaggagaaggaggcttctgaacaaggcttccttcagcccctgcagggcccccatgtggcaccgccaagcttctcctctgagcaaacctgccagatataggctgatctaccagggctccagacacctggagattaattagaaggccagtccttgggcaaatcagcccagaggaccagccacaaggagctgcagagagaggctggtaggctgtaatcctagagccagccacggagctatgcctggtccagcagctatggcagtggcagcaactcatacaccacccctaagcgaggaaatgctgccctaaacgtatggctgacttttacaagtcgaaggtcccaactccaggaagttagggcagaaagagacagtcatgaggaaagtatttctgaagaaaagcagattattttgagcacgaactgctgagtccccactctgtgtcagcctctgcttcttgccaaggagtgttgctaagctgatcttcctcccaggagcattaggctgatttaaaagatggcaaggaagcaagcaactagagaagtccgggaagccttgaagcgacaggttacgtataaactgcacttgggggctgctgcctggaggagcgagctttctttctggattcttccaaagggcagaagcagggcctgcaagtggaggtcagaagacagagatcttgatcctgtctgagaccacgccgtccacagggccagcctggcaatgggtcaagctaccccagacatatccaggcagcagccaggtgtccttttcgtgtgcaccagactcccctctaaggcaggaggttggagcaagcaatgcctaaaatgagctcttggctgtgtctggcacctaccaagcacgacaaatgaaaactttggtggaattaacaatctaatgataagatttggtggttcttttttggcctgacacaatgaaagtagcctcttaggaagaagccttaatcctctaagtccatacattgccctgaaggggccattttcagcacccaagttcctatttcaaaaaagttaagatgtgctttaagggctttagctaggattctctagttagagacaaacaccagaagcagaactgcagggtgtctcgggactgaggcacatgtgcctgaccagacccggaagagggtgggaggcatctactcaacatgctctactgtgctgcatggaagtgggagtgaggaaggccagacaggaagagagaagtgaagccaggccctctgagagtgaggtgtcaaattcacaatgacagcaaagcctctggtaagaatgggagctgggaaattcttaaaaaaagaaagtctttatctagatcaagcccttcctcaagccatgaccttctgttgtcaatttcatggagaagtgcacgggcagtgggggccaccacaacccgcacgctcagcctggacacacagcctgggatcatttatcaaaccagcagaggggaaaatcccccagcacagagcaactcctctgcaaaatgtagagcttcgctgatcctgcccgaccccaaacctgctcacatttcaagtcctccaagaaaaggatcagacaatcgctgtcctctcttgcttccccttctccagtcctcccaatgctgccacccacatggaggagaaatgtgtaccaggcttgcagacacagggtggcagtggagcccttgcctgcttccacgagcacctgcaccaccttcctctcatgagcccagagacatgtcagtgtccacacagcagcccagcaagagaggaaaggagtcctggtgctcccgaagcggagacactcgggccccatgaagttatatgatcagcacaaatgcaccggcaaggtcttaggcagaggcagtctgaagcctggagcatcaccagcttcacaggaagggaatacctgcttccaggcaaggtgaatggaactgaagtgtccccaccgtcaggaattcagacagagcaagcaccaagattgtaagtgagcattactgcaaaagcattaaagttgggggctatacctaaggctgccctggactccaggcctggctctgttatttgctcattgtgtaaacctttgaaatttctgaatctctcaaacttactttatctataaaatggatttcaaaaatagaatccatccctcacaactataaggtgtttagcatctgcccctgcacatgataagcagtgggtatcatattatggctggaagcaccttcaggccaggagagccaggatgctgtaggctgctgccgcaccccttgtccattatctcccggcttcccacactttgattccagctgctgccatcatgaccaaccagaggcagaccttgttcccctcctaacatcctgccctaagcacgagggaaagaaaatccctttccttggctcctctttgaccaagttgacattgtgaaaagcagagaatgaaaatctgatagtcacagaaaacacaaacacagtagaaataattaaagctcctgaatacaggtttcagatcctgtaataactcacatcttctatgactttttaacatcccagcccctgcctgtttccctgtgactgctgccaccctctcaccctccttgctcttctctctccctgctacaaggccccaggacctattgtgcctacttaggatcctgcctctccatcccagggctgtgggacacagggagtctcaagagattgacagtggagtacaacccaagtgagactctgtccctgccacaaagaccgtgccctgtccaaggccacgtagagccatacaatatcccttgatgagtgtgctgtgtgtacatggggagagggacagaccctccacctgtcttcccagagctcacaatacattccaaattaccggcagttacgaattggagggctccagtcagtggttctcaagttgcaattggtccccagagcagcaacacctgggaacttatcagaaatgtaaatctcaggcctgcttcagacctacaaaatcagaaactctgtagctgggttccagcaatctgatttttccaagccctccaggaagctctgaagcacactgaagtttgaaaagccactgacctgttatagtccggctagctgcacaaccttgagtaatacacttaagtctttccatctgtaaggtgggaccaaaaccagtttcatcatgtgttaagtgggaatgatgatggaacctatttcacagggttgttggttacaaagattaaataagaccctgcatagaatgtgcttagcaaattgtaagcactcataaatatttgctaatattgatcttcctaaaaacctaagagatgagttcttccacgatcactaggcaactatcaaggatctcagtgaaggcttagagagtttttgaaaggaatcgttcaaggtcactcagctatcaaagatatcttaatagccattccccagagaacagagcagtgttaactgaaggcaaggtgttaacaatgcctttccttctctctgacttgcaaaaggtctcctctggggccatttcccttccccgtgggcatctagaaatgtatggaggctttgtggttgactgagtgctcttggcttttaggatccagagggtcagggatgctcctcttgcactgtgtaagatggctctgcataatgaagaagcatcctacttacaatgccagtgacatctccactgagaaacactgatcaacccagagtttcggagctatccagagcatgcagcatgtctctgcctagagaatacgctaaacaatcacaacaattgctgtggagggctggacgtctcatgggacacgtctcctgctcaagtcctactgtggatgttgcgagggccagctctcactctagacatttcattgtcttatttaacatgcaattgcttcaaatctcatttaacatgcaattgcttcaattgccctagctccaatcaccccttcccaaacctgggctagatctccagctccgtgggcccaggcaaacattttccaacacggtgttagtaggaattccccaaatttccccaaagttcatacaggaaatggatgttggctcaagagagcagaaggtgtagtgtggaccgttctttttttttttttttttttttttttttttgagacggagtcttgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggtgtttcaccttgttagccaggatggtctcgatctcctgacctcatgatccacccgcctcggcctcccaaagtgctgggattacaggcgtgagccaccgcgcccggcctggaccgttcttaaaaactttgtgctatttattatttgttactcagaaagggagacggaggtaaggatgagaggagaatgttggtactgttcagaaacttaacaatcctggctgtcaaaaatgccaggagtgaatgtaatcagtagaatcaataaagatttatttcaaaggattcccaaggaaaaagtgccagacagagagccagaggggagaaaagtaacagcagcacacaaaagcatgcacgattcacaggtttcccgaagcactggatgaaatgtggcttggatgaagttggccatttcccctaacttaacacctctcttcccatacatagcccctttccctagagactcctacctagtgctttcaccagcttccccctccccataagagtagcaactgactgtgctaaaatgttccttgccccacaaaccattaagctgtcaagctgagttggtgaacaaacccagagagagccggtgctgctggaatgctaacggtgaaaaccgcaattattctttctgctctggacaattcctgcttcaactttactggccccaggtcatattttgtgatctttggatgctgatggaagagagacggcttgatagagaaaataaccagggagattatgtcttgatagagatggaagtaactagtagaggttttttcgttgttttccttttgacatccacataggtgtcatataatggcttctggttataaagccccctatccaaaggaaaaacaacttctccataaataccttgcccacgtcagtgaaatagctgtgttacacacttgagcaccattttcgaggacactttaaatagagcatgggttgctgctttcaatttaacgtgtgaacaggagctgctaaggcaggcagagatgataagttgtggggatgggctcagtttccattggtgcatctgctcagattctaacagatccgcaggcatttaaggcatctcagggacaagccaggtaagccacgtgagagactcactcaacaaatgaatgaacacctactatgcatgagtaaaaccagatgcgaatcacttcctctagatgaaatgggctttacatacaaattataacagttccaggaaaatctaatatatgtttagaagaagaggtgctttaaaaaaaatgaaataggtggtacatgacaggtaaaatactagacaagttcagaggagaggtgggtggtctctgtgttttcttgtgtaacaacctctactgagttttatgagaattaaaagaaataatacatgactggtgcccaggacagtgcctggaactaagtaagcacttgataatgatagcagtagtcaaacaagtaggattaatatggttgacattaagtttttactgataattttaattataaatccagttggaggtaaagacaggaggattatcagataaagcttggtaaataatgggtaacatctggacagatgaagatgagggcgtgggggaatagtataggccaaggtacagatgcaagaaaattaaagacttgctcaggaaataacaaatactacaatgtgtcttcaattttctatgtttgtactgtgacaggtctgaatgtagatttcttatttaacctgcttagagtttacagaccttcttgaatctctgtattgatattttctccttgttttagaaaattcatagccattacctcttcaaataatacttcttcattttttttctttctttgtagaaatccaattagatagataagactattctcactgtatcctcgatgtctcttacctaagttttctgtatttattatacttcattttggatgatttcatttgcccactgccctacttcattaattatctcttcagctatttctaaattatttaaaatacatccattgaattcttaatttcagttgctgtattttttcagttccaggatttctttttggttcttgtttgaaatctactatgtcatttttatagtttctagtttgctgccaaaacttgtaatcttgtcttatttctacttgaaaaatagtaagcatggttattttaaatccatggtctgataattgcactggaaattatccaggaaacctgtgagtctattatttctgctggttctcggtcatgttgacttatttccttgtgtgtcagcttatctttgattacatgctggacattgtattcaaagatttatttgtagaaataatacaatgactaggataaggtatcttcctccagatagtattgtttgcttctaccaggtaactgacttgcaacatagtgtaacattaatcccatttcagaaattgtcatttttcttagctactcaagggattcaaagcctgacttcacaacttgcaaaggctggtttacttgtagttccaacccaaaatgttcccatgcttaataggccctggactccagcttgtgtcctgtaatgccctgatgctgtcaaatgcattgcttagaccctcggctgcctctttagaagccagcaaaagtctaatccctctgattagttaacctcttgatttccagcttcttccaaaatttggccctatcaatatttaccaccttactagctttcatatgtcttcaagcatgcttttgaaaatatcttctccactttctgaatttttatcagtaggaaggtcagtcaattgaattagctagtctgcctttactagaagcaaaaacctcccagctggtatttgatttgactggaacattggatttacttttgggaggaaataaaagataaacccaaacaataggccagttccaaaacatggataaacttgaatgctaggctaaaaaggaaggatctttaataagcgatggggagccattgaagattctcaagcaaaggagttctccttgggagctatacttgaggaagatgaattggacacttacgtgccaaactgattagaggggcatgagaccaaaatcaggaaggagagttgactccttttatcaaactttcagagaagaaggcaaactatctgagctagggctatggtggtggcaacactaggaagacagagacagatgggaagtacagggttatttcatgagtgaggcacaccaactagaagatggtaacagaaatcagaatatggaaagaaaaccagatgaaggacagagggagaaaagtaaaatgatatgatttgcccattaactgagagtgggattgaaagagaaagaagaatcaaagatgatattgaggttttgaacatgggtagctcagacaagggaaagagattatgagggctaagccacaacccacccatcctctttttagtcatgagacagctcaaagaaaagatctgtttcaagtaagtgacagtggccactctccaacccaaaaccctcccagaggagagatgatttcatatgagaatagagaacctacccatggtgtcactacaatcaggcaggtgggacaacctcttggagagtcagagagcaacccattttgtgatattagagattctctaagtgaaattggctgacagcacaattcccgttttggggaaggagaaagctcccagagccacttgttagtaacagaggtcctggagcattggattacaagccaggaagttccatagaaaagaaggagcacacagaaatagacttaagtgtgcagagggtgaggggggcacaccctgtcactatgtgacaggtgatccatgggggcttctaggattctcactattggttctactgagtgatgaaaaggtgcccattagggttaacttcccaggtttttaggtagggtccgaatggagtggaaatgtaaacctttaaataattatggctttcttggcctagatgtctgtcatgcactacagatattttttcctcccttccatgtgtatgagtgaatatcaaaagtaggtacctgtaaaaaataaaaatagaaaactttcactttcattgcaaagatcttggagatgaaataaaataaaagtaaaatgtaacttgggaaagggctatataaatttcacaaataaatgactgaggttgacattgatctgaactggacctgtgctacaatagaggggactagtacagccacaccaggcaaagctctccacacaacctgtttgcttttcattttcttattgtctacaccaaatcaataagatctgcaaaaagcaaatgtagcaaatgtattttttttctccctattctgtaccaggactcctctccggcttcagacctggaatttaacaggatgaccacccctcccccagtgtcctctgtgctcctattgtctgccccaagaaagctcctactaattctctcaaaaggaccttacctcctgcagttacttcacatgctcctgtgggcagctttaatttatcccagtggaagtcaagatgtaggtttgtgtagaggcctgggaaacctatcaaaggagaatgaggttgaacaaaaacatcccagggatagactctcagctccctgtgggttgggccatgtttgccactcacactgaacccccagcacctggcacaatacctagctcataaaaaaacacactataaatacttgttgaattgttgaactgagagagctgggatgagaaaaacaagccaggcatcactttcttgtcaaataatccttgtacatttgccacccaaaggcagggcaatgggttgacccaaggtttttctttcatgaaacagccccaaagagaatcctccctataaatgtgctcattttttctctccaaatgcctttattccagaagaaagcaaaacagtgagtggatgactttcatttgttttttgcaggaaaagaaaaaaaaaatgaggattaagaaaatttggaactaaggtgttaagaagtgtaatagggtagaggaggctaagaaaaaccagtgttgctgtagtagggagaggtttgactgactgactgacaccatccaccacaaagtcatcaggcacctgcgggcctggaccctgcaggaggtggctgggtgtattcctgctgactgataggataactatgcacattcaaggctaagaagaggaccagcagttgccaaccaacccccaaaactgaccagtgctgagtagtcagtcacctttgataaccacaatcatcattagtgagtccaacaggggactggctttaacaccaacccaaatgctcagaagggtgcatttgactagcttgacctacatctggttcccctctgtgatgttttggccatcacccaagtacttgggatctttgtctctagctagagcttcaggaatagtagctcacctactcctaaaactaatcttcagaatgaaaaacaatggcagcactgcagaaaaagggctaggatgtggaaatgcaggaatagatgcttccaggaccacaaaaaatgcagcatctaagaaaggacaagtattagggatccctttcatatggtcttgatcttccctcctgctttgacagttttagtgggttaaatatgctaccctgttgggaggtaggaactgagagactaaaaatcccaatgcaccagtaaaatttttttaagtccagagaaagtagaactctggtgaaagccatttgtaagcatatctccagaatctaatatatctgtgtggccaaaaacagtgggcactgttaattcacaaccagacactcactgagactcaggaacagaagggggcaggtgctggtaatcccttgagtgctaagcttttttaataatacactggagagcagaggggagaagaaacagcattaatggaaatgattgaaacaaatgccccactagtggacagtgatcttgttttgggcttacaaaactgattgattatcagatccaccttaagcctcccttttgagaaggttctccatccccacccttgctcctaacacccttgtcgattctggttacatcagtctggaacaagggcagggactttgtaactttcaaaagttcctcaggtgaatctgaggacaaacaaggcttaggaatcatgggtccaacccatgagattcacaaaatgaaaatatgcaagtcaaatgccaaactggcccatctggtttcactattccaggaaagggagcccaaaaggatgctaatttgttacaagtggcctgaaaaatacatctatgttttaaatacttcctctcttgaaatagtaaactgaattacagcaagctagctccatggtgatattttccctgattccagttcacagagagaatttaaagtgaaaaatccttttcaaaaggaagatacaataggctgtgctcttcaatgatgcttgctctgggcccagtactgatgctgaccacttcacacacgtcatctcacgtaatctgtaaggaaggcatcatcacccccatcttacaaatgaagtcactgtctcagggagatttaagtacatttgcccaaactacaaactggtgggatgtgaattgaactttaatctgatttcggagtctttaccttgaagtctatacagtatgttgctttcttaaacccccccacacctacatctctgcttcagtttctaggtctttgtatgtcacttaacaagcatcccctccatgccaatgtggttgcacccatttcttcgctagggtgctcctgaatgcatgcaggcatgggtaagtgtatagtgagtagtaggagtcaagacaagaggctgggagctgtctggggctcctcctgggatctcctggtggggtgcagaactattccagggattccaactctggcctactgtacagaagaatcaagggacagacattccaacagccaggcaaaccagaaccacagagaaaacagggaggcagtcaaagccatcaggaccccacaaatatacccaccaggagaatcaaatcagggtctgcggaggcaacaagagagtttgttggtggcctagatttttactctttggaccactctgtatttcagcttcacgcagcagcttgcaaaagagccctggggatggcaagaaagcagaaagcacctctctttgtagccacaactacagatcccaagaccactatgaccaaattaggacagaaagccttcagtgacgcacacacaggccctggggagtctgaacacgagtagatctaatgctgttgaacaaaacgtgaaaccgaagaaaacacccagccacacagagccctttgaattggtggcttcactccagggctgcaagtggggagagagtgaaaagagacaaagcctggctttggaaagtctcaaaagagtttctaggaatgccacgtcccaaatcctgtggggtttgtgaggggtttggagagtcctgcttgttgaaaagcacttagttgtcatagtagaaagtggagttctagactcccctagccctcattacaaatcaatgagtagagtttaattctaattgtgagatgactgagaaaggatttttatgataagcagatgaggctagggcaatttcaagtgcaagtaaggtctttatttattggctttttaaaaaatgtcccaccattttgtatgtatttgggggttttgcttgtggagagagcccaggagtgggacatggaggtagacaacactgataacagtgagagacgctgccaggcagtctgagttctctgttcctagccctgggccaagagaaatgtgctctgacccaaggttaggcatgttctcacccaagaccaagaccaaggattctcctaaacattccaataaatacccaacgtagcttttaaaccttaatctgttatttcctagtttgcagagtaaaatataccctgtcagaagtgtttgaaccagagtgactccatcttgaataggggatgggtaaaatgaggctgagtcctactgggctacattcccagaaggttaggcattcttagtcacaggatgagatatgggttggcacaagatacaggtcataaagaccttgctgataaaacaggatgtggtgaagaagctggccaaaactcaccaaaaccaagacggtgatgaaagtgacctcgggtcgtccccactgctcattatatgctaattataatacagtatcatggtaaaagacactcaggccagcaccatgacagtttacaaatgccatggcaacatccacaagtttccctatatggtctaaaaaatggaggaaccctcagttctgggaaatctctgccccttttctggaaatctcatgaataatccacccctcgtttagcatataatccagaaacaactgtaagtatactccatcaagcagctcatcctgctgctctgcctatggagtagccatttttttactcctttactttcttaataaacttgcgtttgctttactttatggacttgccctgaattcttttcttgtgtgaggtccaagaaaactctgttggggtctggatcaggatgcttttctggtaaggcccctatcatcatcccacctaagaaaacaggaatcccagggaacctaatttcccctcgtacaaaatatttattaactactcacacccttgaggtgtcttggtaggaactgaaccacttagttcagacattggaagtgattccaaacttggctactcatgagaatcacctagggaacttaaaaaaaatcctgggtcccaaccctggtgatgctgacacatttgggccctcccaagatttttgaaagctggaaccatcaatgcaggaaaaaccttaaaagtgagtggaccctaaaatcttcctgggggcagatttccgtgcttctgggagggtcatttccctgagtcattaccctccttagtgttctggaaaatggcaaagtacatcaaatgcagggaggattcctcagcagtcatgacaattgctatttgggttaagttactgctacatctttaatattcccttggggtgagttgtttgtttgtttgtttgtttggggagcagcatgggggctaggatttttttcttaaaatgactttagaatgctcagcttatttttgtggatgggcagacaagttataattcaaaccacagtttgaacattaggtagagagaggtagagttatagtttgaaaattaggcagaagaagacagcacaggtgggtgagatcctcactttacaagaaggtggaggctgagcccaggatccagttgcagtttggagcaccaacccagactttggggttggaaccttgttctgctgtggctgttctgtgggttctataaggctagggctataccccacctgctgcccaagggtaaggtttaccctgaaggaagtgaacgttccctaggaagacaatgaaggctggaatgtgggtcttcattgcaactcagagtacccctgacccccacagcatggtggtgagcctgcccttcctctagggagcaggatgcccaggagtggggcatgaggcacccacaagtgaggacaggtctaagcctggagatgcctacagtggctaccttttgaagaagtgttaagttactctctgtgtttcctttattacccttgatccatcaaaaaaagttgtattcagacatacagcctgatctctttgtgctggaaggaatctggggaaggacctcttccaggctaggattaacagggagaatagcaatgagagggaggggtcagcatttcttcagctgcaggaggcaattagtagacacttaaagaggatctgagcacagctcagctaatttaaaaaatcagcataatttgagttttaaccaaaatatgactttattttgtatttgcaaggcaccaaggtctgctatacacaattaacctcccctgtcctcccctccctcaaggcttctgtctgacagactcagcgggaggaggaaaggaagagtccagctcctctgctgctgatgaccctaatagtcctcctaccccactgggctgcaatgaccacatctgcacctatagtccctcatccaatttgggacttattgcagtgcagaccttaatcctggtctctccctgacctcctggccactcacacacccagtatatctccatgctgtcccatagacacttcaaacccagctcctcaaaaacaagccccacctcttccttctcctgcattctctccctttgctagagcacaagcacccactcggtcctccgtgcccctcagctgcctcatctaattctcaccaagacccacttctgggcctctgccttcccttccacttagtacctcaggcccagtcctcatcatttctcccttggaccacagcagcagcctcctgacaattccccaacactcaaagtgcagtcctggcatgccgaacttggagacagcgagcttaggtgcacacccaggtccccagagcactcagcagctttcttcacacattttctcttcccttctctcttgaccagatacagaagagccagtgggaaattgagaagcccttaacaggatggtggagccacaacatggaaggaacctgggctcctgaatgactgtatggagcaaaatccccccacatactaacccatattgaactgtggtggtttgttacagaattaaccagccatgattaatagtgagcaactcaagaacaaaaagaacaaacctataatagaaaagcaatgcttttccattcacaaacctttcattacaaaatgccggtcgtgtcctacagccagagtagtgagtatacctcgctggaggctgcaagggccagccagtccccatacacaatcagagctctctgcaaaagacgtaataccaccagccctgtactgtactctctcaattgccctctagtttccccaccccaatattgcagtgtctatgatcactgaaggaaaatgaaatatgattctaggtgtcacctttcaaagggtgttagtgactgtcagctaaagtgatttaagccccggaaaaacctctgtgtccttttaacatccaaaactaatcctcttcacaccagacatcgatgttaaataaacagagatttccattaacctacacctctgtacatctatttttaaaaagcggtgtcactctcctttaaatgaacatactaattagtgtattaataaatagctgaatggaatcaatgagacatgtaatcaaggtctgaccaggagtcagggccaggttgaagggggtggggggaaggagaggagggaaaagaatcttattagcaggtttgctgaggagggacatgtaaaatcaatgctgcacatgcagccaagatgcagccgaagttgacagtagatggaaagctaagtgcttgctccgcctccttcctttgacaggaaagctcccggtgagagttaatgtgatgagcaaggaagacattaattggggcaggaaaagccattcagagatggtgtccaggatcacagctggcagagttacccagaacctcagtgctaaagccctgactcctagaccttgttttaaaacactaagaaagaacacacttacgagagttgatttagttctcagcaaacacttggtcaaaaagaagtcacagggggagttatttgtttggggctctttgttactcttaccccccttcaaaaattctggttcacaagcagtagctggaagtacctttgccccaagatgctaggcactgggaaatgaagggcctggattctctacaggcagccctgggggtgggaatggggcagcccgcttcttcatcagctcccaatttcctgtagcacaccccatagctagaaggctctggaaggtgagaataaaaagtccttctgcaagtgtgaggtttccagctgaagtggtatctgattacccgagccgctgctcactggatctcaaattagcactgatactccattttcttcatctggagacacaccccctttgggccacaaaacactggacagaagaaaagtggactttcatttccctaaagattaatatcaggagaaatgcctttctgtataaaatcaattaggtgcctgagaccctcaccccaaagccagctcagtgatgctagttgaagtagaagttgtgttaggataaaagaaactcaaaaaaaaaaatttgccttggggccagtactgcccattacaagccctcttaggggtgattctgccaggaggcaggggattggcttgttagcagttagaatgcttggctcaggattctggggtgctatgggctcccatgccatgaaactgaagttcttcctaattctggttgctggaaaagccagtatctctgggtggacctcacaggcagaaaacctgctgctctgaatgcctagctctggcacggcatccacacatggatgatctagaagccttgcagatgcgtcctgagatatgtttctgccagccccaggcatggcctgcaacctgctcaccctgaggtcagcatttcctggaatgacagggaggacacacataaaggaagtgtggggacatggcaggaggcagctctcagcagcccttaggctattttccacattactgcgaatggtattttgcccccaggaggttcataacagtcagaaggatctccaggttccccagacccatcagaaaagccaaggggtgatggtcatcagcccagggggagagcttcctgacagggtacatgaaaattaagtgcaaaagaggggccagagacagctgtcccccagctcaatctgaagcacaggcacctagagaatggccacacataggaccttcccatctggtttgagaggtcctagcaaagcacccctgcaccagtccatatcttactccctccattgacgtgctaaaagtctgccactggaacatggtttctttgggtcaagcatcatgctttctctttcaacaacctacaccttagtgtacctcctccatcacctctgtttttctgtggcccaaggataaacagaagagagtggagagggtgcaaacagcagggtccccactgatctacatggctatttgctgagaattagggagtgctgtcctctctggttgaccagaacttggtaaacagaaggcatcttgggggaagaaaagggcaactcttcctgagcaaagagatacaccaagccttggccaataaaacatgagcagaatttcagcccttatttgctcccagctcacaggtatacacactacagtgtatatcaccaaaagccctgtctaaagaaagaaagagagaaatagagaggagatacccaagtacttggggcaaaattcaactatttctcaattttgcccaaggatacccatttggagatagatatagatatagatacatgactattttcaaaccaaaaatatcaggacacacactcaagcaatggcacagaatatctgaaacacaggctgttctagtgaacacagggcctgtggtcactgtagaagggctgaagagtagaggatggcagtgacaaggaccctggggggacagtgtgacaatgaggtgccccttttcctttaggggacagagaagcaatggcaaatctccccatggtgtgctatgtggtggaaagaccacctccacaagaccagagccggactctctgctcacagatgtcccatcaccttcaaaatacactgacacactccgtttccagagtctccaagcttttgttccctctccacaggggcaaatcacctttctccacagtcaaccagtggttctttcctctctcagcccgagtgttgctgggaataatgcaatgtttccagcttaatcgtttgtcatcatgcagagatttcactgatttcaaagctaaggtgcctggaagaatcgagcacgctctgaaccagggtgcctcagggcagagggttctcactggctggctggctttacacaggagaatcccagaggcccttactcaccagtttaaggctatctttccaggaaaccagggcctggggctgaagacagctgagatgggcagtgttcataaatatcacctattggaggcaagtgaggacatccaagtatgcaaacaccatgtacactgaacacacctctctggtctctgatggaccacttcagctttctgacttcgttgcaggcaaacattagcagatgccccatcctgcaatgcttggcataattatcaggtaggctccaggcaataattactcactaatggttagccactgctttgagccaagagtctcctatctgctctccctacaccaaattcagagtcttgggtggtaaacctgaaggaaaaaaaaaaacaaaaaaaaaacagtaaccatcaccatggcctggcaaaaaaaccacattatctaagatatcactccaggtcctataaaaataacgtatgtttacatgtggatggctgatctgagcacagattgaatatataaacgtggctgttaattctagactctgagaaaattctgagtcttccaaaaataaaggaatccctacaaatatttttaaatctttttttaagaggtcatactctgacagagagccagaattaatgcaatgggaccagccacctgctcttcttcccttcccatttgcttatagaacctcaaggcagtagacttgttgaagcccagtgttagaaacagatgtgactatttataaaccaagaaaactgaagtgttttaatccaacacagggtggcaagaagcagaactgacaagctttaggaatctgaagaacaggcaacaattttcaataatattacctctccacttattgagcatttaatatgtgtcaagcagtgtgcaagctatttcccacgtattatgtcacttaattgttagagcagtcccttattttactcttttaatgataaggacactgaacctcagagaagacaggtaacatgctgacgccacacagctgagtagccaaggcttgatgatgtctgtaaattactttaaaatgcatcagcttaaacagagtggtataatgtaagttagttccaatccttacccaaggatggttagtcgacatctgaagtattgtaactaaccagggctggtgacttagcctttgaaagccttgcatcagagtctacactgtttgttaaaaaacataagagatgttggaaacaatttatcagcaggaaattaagcagtgtcgaatatgcataattggttagaaatgccatccaggcatctctgccctttgggcacaagaatctggcaagcctagagccctctgtggctccattcttggcctaggggtcctactagggtctatttcatctctcaaaggatgctgtcctctaatcccactagaaggtgagctgaaacctgcaaccacattgccacatctgcctcaaataaatcttccttgaaataaacttgtaagagttactaagtcagtgcctcccaaactttctcacttcctgacacttgcagaaagtgataatatttttaccacaccctggggccagagagggagcttctgctgctgcatgcccctcgtgccctctggctgtccacctgcagggttgaggtgacccgctatatcagcaaaccttgatacccttccccggcacactagttgaggcagacagcaggatccacactgagcttcaaaaacaggctgtatggctatttatgtgcctggttactaacaaatattggtaggtagggtagaattgagtctgcaacttgcttttgtaggaaggttgtggaggagaaggcccatagctctcacctgcctataatcactggaaatgagtccccacataatctgcccattgggcatggccaagttggcattaagttgggttgcagtgccagacctgtctgcctccaaagtctatcctgggtcctgggtgctcccctgcttctggagcctaaagaaagtgaatcaatggttatttgtcaaacccaaaagggaagctcttcagaaaatgccatgtcaaagggttccgtccttggcgctgtgctgtttcatacttttatccgtaagttgaatgaagactgagagtcacatttatcaaatttgcaacggacagattccaggacttgtgaaggtcaaatgagataatatgagagaagtcatttaatagtagagtaagactcaacccattgatgaggatgaaacaaagtttaagactatcttagcagcctgaaacagggtcaaaactggaaccccaaaaagaaattgaatgtgacaaacataaattcaaattttaggcttcaaaaaatattaatgaataaagtaccaggtggcagaagtttgtgtaagacacacatataatgagggtgggagaagcttagagacccactggttacgaaccagcagtgggatgggggctgcccagaaaccctgccacatgaatgaattttgacattgggctttgctatccacacctcctgcagatggtgacctgcacctgtgatcagtcacaaaattagatgtggagtcagacctacctgcaccatgagaagcaatgagctctccatcaatgtgcaaagcagttaaaagagaaggaaccctctatcacgtgctactgaagttgagttgttcccatcccctgcaaaggctcccaacttgccagcacagccaggatgtttggctcagagaaaagaggtggcaggagagtttatcaaaacctacaacttaagattttcttcacagaagatggaggaaatggcggcagggggggacgtaaagataggcaatcaattaccaaggagcccttgaataaaaatctctttatttccttgaattttcctttaatttatcttttttttaaaaaaaaaaaagttttcacctttgcaaaacctttggactttttgaccaaagacaacaggaagtcagccaagtttaatggagttttcattttgaaaaagatgttatctgcagctcctctgtgcctaccaagcaatatggtacgtctgtggtctagagaccaactcattaggtgctctgtttaccatcagctggtgaaaaatgataattgtatggaagaataatcaccaagacatggacatcactgcctgcagacttcgccaggaagctacttcccacttcctgtagatccgcagctgtttcaggatgtgtaatgccctctactgtcctaccattcaaatacttctcttttcaagctcagaaaaccaagtttaaggtagggagagagagagagagagagagacaatcaaacaaccttatgttgggtccagagggaactgcaaatgtgtctaagacaatgcctgctttcaagaagcttgcaattaagtgggaatatgagatgtaaatactgaaaatacaagccaataaatcatatattaccaggaaattcttggcaggctgagttttcagaaagtctctacgtgtactactgtctgcacacaaaaatgcccagacctggcatgtggctaagtctacttgtaaaatttgttacctggttaaatgctgttccatgcctaccaatatttttaagttttcaaatataagttttaggtgaaaatgccattctttcaaaacagtatgtgctggagaaatgacattttttcaaagcaaattttctatatttggtcatgtgatattctgtaagcttttttataaaggctctttagaacattccaaaaatgagcatcatcaaattaaaacaagagaacttctattacattgccacaaatcctagatgtaaataaaataccatttcactcaataatgattgccagaaatataaatacagtttagaaaaattatttaattagtttatttttaagtatttgccaagaaggcttcggtcttgctagtattaagtcctgggagaaggaacaaaggagagtgaaatgagctacagcaacttcatgcaattgggcctgggtttagcaaagctcactctctctcctccacacccccaacaatcggcctggggccaatgacagccaagattctttgtccaatttgacatcatgcacatggccagtaccccgcctctttcgcctttgcctgctttcttagatcttctcatccgagcataaagccagcagcccctttgaggacatctgataccccaggtcagtaagtagtctctaaaatgaaacataagaaggtggtacaagaaaaggggaaagtgtagggattccctacctttgttgcaggctctgagacagccttggagagggctcagctcaccaatcccaaaggccttacccgcagtggacaggggcatggtgaggggatgtaacaaggacacccccggtggcgtcaactgctctattccagtcctgaccacagatcactgtggttaggttactttccttcttagagccccaggccttgacctctgcctcctagtaaggaaacaatgtgccaccagataaacttggagaaactgctgaattccctgagaccaaaagtgcagctccgtaaatgtattacatgccgagaacagttgataaaatgtacaagggctgggaaaagaggcatgaggaggaatgaacagaaatcctgccacctctatggggtttttgaaaggttagagctcaaaaacacttaccctgccccctgtttctccccacaagacagcccaaagcacaagacaattttattagcagctctgagatacccagaagcaatccagagaagagggtagatccatcgtttcacttgatgttgtactgcaattttgcagctaaagacattctttgggcctgaactcccggggtccctcagtcttgaataactggtataaatgatgcccgggctagtcagaggccctgcactgtctggggcctctccccatccccaagtctcactaccttccgcagcagcacagagggttgaaagtgtctgggaagacttgaaggagttgagcatatctctctctctagcactctgctcaaaccaatggcctgttctctgcagttcctatgacatgaacactgtaatggaacacaggagcccatgtctacatctcctacaacaaatgaagaccactaaattataaagctctcctgcagaatgcaaagcatctgtcactaatatgctaacccattcattttttccccatgtattggaaagagagagaacagatactgcttgggttttactaagccctagactgtgtctgctattttaaaaataccttcatcatagatgtgtgaagcaaagatatgagaaacagggggtagaacctggagaggggctgccccacctaaaggcattcccatgataaaaatttttccttggcacttgacacgcctggaccaagccaaccctatctagtcgccaggtcctacctgcaggctttgattgtgcagactttgtcctacctcccagaatgtgggattagaccaacaggacattattcctaatgggcaaggtcaatattttaatcaccaatctcttagctcatggtggagttcatttccctagaccacactgttttgagcatgcgctcattgaagttggaggcacgcaccgaggaagggaacaagcagaacagaggcccaggtgcgctctgttccaagcttgctctatagcactctgggtgctactcaacctcccgggattgttctttttccactggaaagtagtgggactctcctaagggaaggtgaatacctgggatgctttcagaacaatttcaagtacattgtccaagacagtatgtttacgccgaaacatgaaccacttgaaaaatgcaagaatctctaggtggatcttcttgcttctttgtcaagtttctgccagatcccaaaaggaactcctaagtctgcaactgggtccagaagtaaacagcactaggtaagcatgaagttgaagctgccggggacacaagagccttgtatccgccggcctcctggtcacttccgcctgcaaatccacatatgccccaattcaccttgttcagaaaagaatgcagcactcctgccccaccactcccccgacagcctgcctcagtccagatttctccagctccactaatggcatcatctcccaccagctgcccaggcaagacacctgcaggacaaccccactgcccgttccttgctgcccaccaccttcaccgccatatccaccatcatctgtcagcgctaattcctacgatgcacttctcagatcagcccctttctctcctttgccaccccctttgatcagccccggctcaggatgctttgatttactgcaatagcctgcttccagttgttctccacgtggcccccgctgaaccttgctacagtacaaatctggtcttgttgattctcttccttggagatcgccaaggcctgactgctgcctgatggataaatcccttagctggatactgacactggtcctggtgcagcctctgccgtgttgccccttgccccacttcccacctctgccttgaactcctgcagaccccaagggctgtgctctcacctctctgtgctgcttcctccacgtgggacctctgcttatgagttcacaaagccaatctgagggatccttcaaaacatcctctaaaactcaactggatgcccctcttcctcctcctcctccttctcctcctctttctccttcttctcctcctcttcctcctcttcctcctcctcctcttcctctccctccttcttgtcctcctcctcctcttcctcctcctcctcttcctcctcctcctcttcctcctcctcctcttcctccccctccttcttgtcctcctccttcttgtcctcctcctccttcttctcctcctcctttctcctcccccacctcctcctcctccttctcctcctcctccttctcctcctccttctcctcctccttctcctcctcctttcccctcctcctcttcctccttctcttcctcctccttctcttcctcctcctcctcttcctcctcctccttctcctcctcttcctccttttcctcatcctcctccttctcctcctccttcacctcctcctactcttcctcctcctccttctcctcctcttcctcctcctcctccttcttctcctcctcctccttctcctccttctccccctcgtccttaacctcctcctccttatcctcctctttctcctccttcttctcctccgcctccttctcctcctcctccttatcctcctctttctcctcctccttctcctctgccttctccttctccttctcctccttatcctcctcctcatcctcctcctccttaccctcctctttctcctcctcctccttatcctcctccttatcctcctcttctttctctgcctcctcctcctactcctcctcctcctccttctcctcctcttcctcctcctctccctcctccttctcctcctcttcctcctcctctccctcctcctttctcctcctcctccttctctccttctcctcctccttctctccttctcctcctccttctctccttctcctcctcctctttctcctcctcctccttctcctcctcctccttctcctcctccttctcttcctctttctcctactcctccttctcctcctcctcctcttctttctctgcctccttctcctcctcctccttctcctccttctcctcttcctcctcttcctcctcctctctctcctcctccttcttctccttcctcctcctcctctgcctcctcctccttctcctcctccttctgctgctcctcctccttctcctccttctcctactccttttcctcttcatcctcctcctccttctcctcctcctcctttctcctcctccttctcttcctctttctcctcctcctccttctcctcctcttcctcctccttctcctctttctcctcctcctccttctcttcctcctttctcctcctccttgtcttcctctttctcctcctcctcctccttctcctcctcttcctcctccttctcctcctctttctcctcctcctcctccttctcttcctcctcctcctcctctcctccttttcctcctcctccttcacctcctcctccttttcctcgtcctcctccttctcctcctccttctcctcctcctccttctccttttcctccccctcttctttctccacctcctccttctcctcctccttctcctcctccttctcctcctccttctcttcctttctcctcctcctccttctcctcctcctcttctttctctgcctccttctccccctcctcctcctcttcctcctcctcctctccctcctcctctccctcctcctcctctccctcctcctcctctccctcctcctccttctcctcctcctcctccttctcctcctctttctcttcctctttctcctcctccttctcttctttctctgcctccttctcctcctcctcctccttctcctcctcctcttcttcctcctcctcctctccctcctcctccttctcctcctcctccttctcctcttcctccttctcctcctcctccttctcctcctccttctccttcctcctcctcctcttcctcctcctcctcctccttctcctcctctttctcctcctcctccttctcctactccttctcctcttcatcctcctcctccttctcctcctcctttctcttcctcctccttctcttcctccttctcctcctcctccttctcctcctctttctcctccttctcctcctcctcctccttctcctcctcctcctctttctcctcctcctcctctccctcctcctccttctccttcctcctcctcttcctcctcctcctccttctcctcctcctccttctgctgctcctcctcctccttctcctcctcctcctcctcctgctgctcctcctcctctttctcctcctcctccttctcctactccttctcctcttcatcctcctcctccttctcctcatcctttctcctcctccttctcttcctcctccttctcttcctccttctcctcctccttctcctcttcctcctccttctcctcctctttctcctcctcctcctccttctcctcctcctccttctcctcctcctcttcctcttcctcctcctctccctcctccttctcctccttttcctcttcctcctcctcttcctcctccttctcctcctccttctcctcctccttctcctcctccttctcctcctcctccttctgctgctcctcctcctcctctcctcttcctcctcctccttctgctgctcctcctcctccttctcctcctccttctcctccttttcctcgtcctcctcctcctccttttcctccccattctttctcctcctcctccttctcctcctcctccttctcctcctccttctcctcctccttctcctcctccttctcctccttttcctccccctctttctcctcctccttctcctcctcctccttctcttcctcctcctcctcctccttctcctcctcctcttctttctcctcctccttctcctcctcctccttctcctcctccttctcctcttcctcctgcccctcctctccctcctcttctcctcctccttctcctttctcctcctcctcctcttcctcctcctccttctgcttctcctcctcctctccttttcctcctcctcctccttctgctgctcctcctcctctccttttcctcctccttctccttctgctgctcctcctccttctcctctttctcctcctcctccttctcctcctcctcctcctccccctcttcttgctcctccccctccttctccaggagcccttcttcatgtcctgcttttcataactggatgggtgcccgtcttcctattcccagagcaccctcttcatgccccagtctcactctctgacacattgcatgtaaattctctattcccacgtatgttgtggccacactaagctgtgaactccctgctgacagaagtaggtctttcatctccacacaaattctcacatagtgcctagcacacagtaggcactcaataaatattgcttgaattgactgattgcttgatcaattgattaaatatttcataacatcatatcaacctctcttactaaaatatgcaaatatatgtgcatggcgcttggtgaaatgtaggcatcgaggaatcttacgaatccttttctttttctgcagtccccaattgaacctactactaccaggatggagatccccccggggacccaggcctctggactcctgcactgaccatcccctgccactgtctcctgccatccctgctgcattctcctttccgacctgccatccctgctgcattctcctttccgacctgccatccctgctgcattctcctttccgaccctctgcatgtggtttttatcccttacacctcctcaccagatcagcaaacacacgggagccggcaaggtgtgatgtgaggcctaagctcagttttcattctctttgtcttgattttctttcaccttgtgtgtaaatagactctttcttctgatgctcacccaaccctttaatatgcaaggccacattcatcctcacctcctgggctgcagacgcgaaacagcaagggcttattcctggctttaaagaggagaaactgaggcctagcccagagaggggacttgctgaaagacattcagtatacctaggattagaagctcggtctctgtattccctggccagtatataatacctcttcaattgctctgaaaatgaaaacctcaggattattttgcaggaggaaacaaaaataggcctggaaaaaccacagccacatttctgacaagctccattcagagggcaccataacttacataaatgatttcctattacaccgcaattgtcactgcaacacgacagtcttgcagcttccttgaagtgttctctttgttgttttttgtaaagatcctccagaaagaagaatcaaatatggtccaagcagggaaacaaagcacatgacatccgcagacccagattccccttccgcatgattctttctgaggaccaaagagaatgccatgaatagtcccccgtgggcctgagccctctcccacctgtcttcctcccaaagctctgctatatccttgcaaataggattcctttttttgaaaaaagaaaaaaaaatgaaagccaatggtttatgaagaagaaatgaagtggcaatttcccagcatggctgggaatcaatacaagctgttgtcagggttttcctttcaaagggtggctgccacacttctccaaagtcaagagcgacagagctccagtgcttgacttacaactgcttcatcatagcaagatatttttaatttaaaactcactgcagttgggttcgaactcagctgggacttgatttactgctaattcatttctctgattcctataattctaagctcagtcaccaaacagtttaatgctgatagaatcaccagtgcaatgctttatgaatgggcgtcaggggaattttgttagtgtgtgttagcaactgttattcactctggaaaggagcaccgtgcctgcaccaagcatgggggggctctataattgggcacgtgaattaccagtatccccaagtgattcaaacccaaataccactgagagggtacccccttttaccccaacccacatacacactcccacactctccctctctctctcacacacacacacatacaatcattacctatgtgagatgaatgccaggcagtgaaaacgctttccatgggaaatgcctaacttcactctccaggtcactacccagtggtggaaaccatggatttacagtctaattagaaatcctcagccttttcttggatggcaaagttttctcttcccaagagaaaatttgtttcaaccgtccaaagtttagggagatgtgtcttaataactcaagcttcctttgttaatttgataaagaacatttatctttgtcagttatattgaagcctcttattcaagcagttggagaaaaaaaaattgagaaggtgaatgtcattactcacatattttgcaaacatccatcttgatctgttatgtgcaaccaaaaagtgccacttgtgggaaacatgtccacaaacctgtcagagtggcattcacactttttgaatttgtttctttatgaaatatacacctgaaggcagatcacaaggccactgtcgctaaagttttgtgagaattcgcagtcatttctgggagtctcaaaagcaaatgacaaggacaagaggcaggcggtgcctctgaaagttggggtcacaagtccctacaagtccctattttatcagtacagtgaattcattcttctggttttttcacctctgaagtaaaccaaaacttgaaagcttccagttgaaggtcaccatctcccaaaatgcctttctatggaaccgtctttccaggagacatcaataggcttaaatactcccacacaaacggatccccatggcccaataacctgaaaagcagtgggcaaagaataaataggtttcccaacaacaggtcttcttcacctttaattcgcccttatgcatctcctgaagaggacaaaagagaggatgcttgcaaaacttacttggtcacagaatgctctttccatggaggattttatagactagtctttggaatgttctgctaaattcagcttggtctcccccccaccccccgccgcaatctatcagtgccaaaacccatagtgagttttacacagagagaaataatttaattccatgtgcatccatgtgcaagaccactgcacctacctgtccccaaccactatgacccaggatgctggagggtaactgaggggctcagcctgtacccatctggattcatctgaatcctctggaatagccagtcagtctgacttgatgtgatccctactctgtccctgctgcagagtaagaacccaccatattagtctggttcaccctagccttgatatttttaaggtcattcttctccaccttatcctactccatttattccttctatttttacagcaaatatttatcaattgcttccagtaagataggctctgggttgggcaatgagtatacaagaagtaagaaatgatccctctcaacctaaaacataaagaaatacatgattcccactgttttcattgccactgccagtagcagcttcttcaccattattaaaaagcatgaattgagttactgatgaaacaaaaaactgcttgaagcaggggctgaccctaccttctgggagctgcaactctcaggcagaaaccctaatgcaggcccacgtctctaggtcagtgatttgctcacatcaatcagtggttaggggcaagtgcatttagggaggaagatagggtcagtatctaatggacaagagagcagggaaagaggtcacaagcacagcatgaccattagtcctctccccagcctgaccctaaagggccttcaaagcacaagagtagtaaaaaacgttgatgaggggcaggactagctagaagcaatgacttacaggaaatattttatgcagaaatgtcccctgttgcattatatttcagtgctttcattatttcttaaaactgggagggtggcagaggtcattacgacctccccctgcttcccagcagccgtgccatccctgaaatagtcacacaccactatgcggaaggctggctgttgcttagtaagccccaaaacattagaaaagtcttcagaaatcggattggcacccattcttaatgtggtttctatttggggtttaaatgggataatagtgtagtcgactagtgttgacacagactcgtgaattctggggctcctaattggagtaccctgccctgtcttgccatctgactctgttctgaagaactttatgttctttgcatggaaaccattatcccagactcccaatttatgtatctgcccaaatctgctgagtcccacctgacatcacgccaccccaccccaattctgaactgcagccattttcctgttgaatccttgttatcattgccactgccaggagcagcttcttcaccattattaaaaagcaggaattgagctcttgattaaacaagacactgctggaagcagaggctgaccctaccctctaggagccgcaactctcaggcagatgccctaccgcagacccacgtctctaagtcagtgagttgctcacatcaatcagtggttaggggcaagcatatgtatttagggaggaaaacagagtcagtatctaatggacaagaggcccccagtgacgctttctgctgttcctctggccctaaagttcttgctgtcttttcttccttcagagtcaaaggctgggctcctgcaggggtaaccctgacataccttctgcagggagagccaaggaagccccagccccagggcctgacccacagaggctctagcttgacctggtattcccaaccccaaagtgaggggagttgactcatgcctcgtggggtgacttgtgaccagtgagctacagcagaccagaaggacctgtggattaactgctggctgtgcctcaccaccacagactattctgagacatactgttcacaccaggcttccctggatacctcctgagtgactgagccaccagctgcttttcactgggaaggcagggccagcttggtaatacactatttgttctccttccttccctacctctcctcctttgcttcatttttgcttccccgggatctcacccctcaataaagtcataacacatagcttcttccttgagctctactttctagggaacccaggctgtgactggagtgaaggacagacaggcaggggcacaaggcccaggccctccatagttttgacaagaatagtcctgcttgcatctgttctgtgcactggaattccatataaaatttcactggagcaaagattttcactgtatacatgttaaaatatgtttaatcaccgatctagactaacctcctcattttataaacaataaactgaaacataaaatgatttttcccaaaatgctttagttagagttatctacatctatttgtatccaaagcctagctttttccacaacagtggtttttaagcaaggggacatattggaatcatctaggaacctaagaaaatggacacgtgcctaagtagctgtctctttccttggaaagacaagggacaggataggctctgaagaaggctgagcaaatgctgaggccagaggtggactctgtacctatctggcacaattctgcttgagaatctattgctcacacaatcaccagaatccagtacttggtttacgtaatgcaaaggttcagtggaaattttcactgtagaagccacccctttattcacatttgacagtagtcatagcaaagtgcttgtcttagtccagtgtttctcagtggattccaggtccactacacagtttatatacttttgtgatttcacaatccatgtgagtgtattaaaggctctgagaagtcctgcagcaaggagtatctttagctttgctttacacccagggttttgcaaacttacttgactgcggaaacttttttgcatgtaatgcctattgactcccccgcagaatatactttgggaaactctagtctattttaagtattactttcaggaaagcaggcctgagatggagaggaagaaaacgaactccaactgactctagcaacattagctgacattccaggcaggctgcttcagttgcacatcctgacgtctgctactgtctcctctctcactctctaaccccgccacaagaacggaagcaatccaccagctatgccttgcttacttctttcctcttggcctctgggtcaaagccaaggaatgattggttcaccttctagtttgagcctccacactaccaaaagggaaatccagctgtgctcattcgagaagagttcagtgagtatgtcagataaggaactgatcttgagcgaagaccaggaaagcctttcaactgccatggttttcctgtcctaaatttccagcgacctcttcctccactgcttctctcctcatacttcataatgaaaatactctaccctgtaagacctcgggaattgattcagcgaggctgtgttcagcgcattgactgcggagactatcctcttagctagtgatctgttttgtgttggagtgacaaaacatcccaaaatccaatttgctgttgcgaatcctggttcatggaggaaacaccatagagggggaggggaagatccaagcttagaaggaaaagagaggatgcctgagatctctccaacacctgttggtttcagtttgcacaggactttacctcccaatgttttatccactcattcctactgctgcctcagaggggaggtgatgaaattccacgtgcaccccttctagccacctcaagttggacagaacttttactcacctcacagtgtagagaagtcaaagaaataatgcatggaataaaagtttgtcttttggagaaaaagaaaaaaaaaaaggcaagtaaccaaagtgcctcacttgtggctttttcctaaaatgttcagaccagagggactgaggttagccctggctttggagtgggacagaacccaaccaggcccatgggctccttcagggattcacacccacacctttttgcatcaggatgtaattcctaatgccttgccttagcctgcaccatctcaggtctgaattattttcttcatgcaaatggggacctatcaaaattcctctaagtgctacaggatggctatcccctgacatggtccgttggcaccaacatgcgatgagtctctgctgcaaccaccataggatccaggcacccagcaccgcatgatgtccctaggcactgatttcttccctgcttctggatcctgaagtcagaaactctaggagtaataaatgaatgaatgaacaagtgtcaagtacctaccgtgagtggtgtaatggtaagaatctttgcccaagagtgaaaaaaccatccatcccttagcaacctggcgccttggacatctcacctaaactctcttctcagccttagcttctatgctatcaaaatgggaataaacaatacctaccttgcacagctattttaaagatgaaatgaggaagtgttgtttccacaatactagcaatttgaagcagtcaccagggagaattagactcctatcagaattggagcctcatagagtctaaagtaaagatgggaacttcactcattcattcatttactcattttttcctgggagaaaatgggaattgccaaatgaggtgacagtcaccctcaggacctgagcattctgctagaatgatccatgcaattttataacctaccaacagccaaggagaagactcatcccccttgatgaatggggaaatcgaggctcagtgaataaatacatttgcctggcatcacagaggtagtgcaagagactagggaccagatattctaaacttcctcccaagcactcacccataaacctcccaagggggcagcagtacagtgagcacatatattctaaggaggaaaccagcacagtgatgaggagaaaggtcagattgctcacaagtgagacttggctccatcactaagtggctgtgtgatctgggacaaagtctttaacctcctgcatctcagtttcctcctggaggaaatagggaccgtaatagcctatctgggttgttatgaggcaaactacttaaatggtatctaaaccaaatgagtgctcaataaatattggccaccatcatcattaattatcatcttccattccattgtttttacaagaactgaagccagtactaacatcctcacagcctcttcctttgggaggctgatgccacaggaccggacaagtgtgtgggggcatacacagactcacatagggactcaggaaactcttcttccaggctgctccatgccatgcagggaagcagcctcctccttcaggaacaaggcctgggctcttgttccaggggaatcaggacccctgcctgcctttcgttttaaaatccatctcttaccactcagcagcagagcccccttcagtctccctgtgggctccaccttcctaccgcaacttgaatggtacagcctgggcagtgaggacaacatgaaagaagaaagaaaaagtctgtgcagctagaggggatcaggtgggagtctggggagggagcagtggagcttgcagcttttaaagagacagtgtcctgtccacagggccctgtgtggaccaagcatagctcgatagagcctataggccaattaccctaatcatgtgcatctcccaaacagccatttattagtgagacgtctttttaaaatgccgcttttaaatataaataacacttaatcatccagctgtcgttaaattcatgttatattgatttcttggagtgccgcaaatttgagggcgaatgggctggcggatgtgcgcacaaagccaagaggtagattagcaagtggtgggggcagagaagtgggggttggaggaaaaggaagggaggtgtcaagggagggaaatgaacctactcaatagcccagggtctgagccagtttcacattgggtagcactggacacaaataagaagagaggagacgctggcacatctgttgcatagtctaatgagagccaagatcatggtcgtgttttctgtattgctgccgcccccttgtaacccaccacagagccgctccaacaggtctctgatgtgcattgtctgcgtatgccttctctaggtgaggatggggagaagcagctaagaaatgccccctagctggctaggaggagagagatccacagcgatttctctgcatcaaagcctgatgataactatgaatcaagagtggttaatgacccagcccctttagctctctcccacttcgggactgctgccatcctagaaagcccccacttcattcccagcagccctcattgtgatgaaaaggatcccgaggccaagtgtatgtaggcagactctgccgtgcagatttccctgtctgcagggagtagcagcagcaggcgacaggaaggcacagagaaggagaaaggaaacaagttgactgccttggagtcctccagaaatgtctgcagtgtcccagtgggcatccaggaggaagtcctgggaggacagatgagagcccggggaggcgtgattgggtaagaaggagcagcttgtaggtgacccatgcctagtgctcacaggagagctgccttaagcaccgtctaccaggcagcgagggtctgctgaaaagaagcattcatggctggggtttttctagtgtgactcccttcccagtgagaaagacctcagagaacttaaaaggaagggcacagaagagtggcagagagggtgaatgacagcgtggcatgctccagggctgggcaagagagccaggaaaacgtaatgtatactccgctttacagagatgttaattaatgcctgccttgtcctagaaaccaaattggtacctaatgctaagtgcagaaagtgcagagattttctgaacccagatgtttagcttataaccagcataatgatactagctttgcattaaaatgatggatcctgaggctgcgaatacatgagaaaggaaagagggtagggaggaaagcagagaaaggagtggaggtctacagggaagacacagacatttcaggaagatcctgtaccctatccctttgcctcttccaggtcccatgagggactgtttacctgggaggcacccactgttgctggagctcattatttcttttgcaaaccatgtgctgctgtacgcgtaggtgggatctgcctgtccacgccctcaaggggcatgtggggagaaatgttccatttcttccacagcccggaagacagaggtggaccccattgtcacacatggcgggggcggggagctgaccacatttagccagactctgagaacgcatgtgtgtatatatattgggtgtgtgtgtgcacacgcccaccattcttaaaaagcaaataaggtttcttccccctactggggtctctccattgtgagagatttgctttattccatctatgcttttcaatcaatcaaagggcagctcacacagcacacagcgggaatacaatctccctcccggggtgtctgcgcttctccccagcctagccagagacctttgcaggagctgaaaaaagtttggaaatagcggagtcagggtgctgaaaaagccctttcattcagcccctatcttcaggatttacaaaaacaacccaaattctgagcctagcactgaggcctccttgttcaaaagaatgtttgctcctcttccatcatgttctgtaaggctcctaacatattttttccactggtgggtctgtgggatactctgaacacatgatcttggacagagggtacaagcttattcagttttgtgggaaaatgatatgatcatgttgcctagaaagctacctcaaagtgacagcaccagaaacacaggagcttgtacatatatattcaattccgaatttgatttggatctcatgttcttctccctatgacaactgagaccctaaattagttgctcttagaccccaagaagggaactatggaaaagcctcttagaaccccagccacttcctacctcctccagaaaaagttaaaatgagcagcctgtgaaattccagccagagagaacaagaatgaaaatgctttcgggaaataggaccttaaagcacgggcgtctggggagtgattctacaatcggagcaggcttgggctctgggggacgctggcagacccacgaatgccttgccttctccggtgggcagtgccgccacggtcgtgagggaggggagcctcctcttttggaggactatatccctcgtgcttcccccttctagttctctttctcagacacacaccacgaaaggcatgtgacaggtgttcgccagccggaggcaccggggaaggcagccccatgtgcccagggagggtagggaggtgagaggggacccaagtcctgtgtctccaagtcctgtctgcttgctgctaagcaggcactgaggctgtgaataaggtcttaccttttaaggaggatctgacccccgtaccttccctagacaagcaacatacgcggcgatgctttaagccgctttctgcctgaaatctcggcgcattcccggggaagcagtgccacgcttcagaaaggcgtttgtgctgcctcttactggggaaacgcagtgtctgtttcatatgcgccgccctacagaactgcagccccaaccgcctatctggcctcctccccgggcgctgggccaccactctctccaaatatgcgtccgaatatctgtgggtctgtctcccgttgaaatcccagggtgtccaaaggccacggggccgcgatgacactgggtaggtctccggaaacctctcaggacttctcccattttaaagcccagctagggacgaaaggggctgggagctgaaaaattgctccctcaacctccccgggtgggaggcagagccgggaatacacagaatcccaccccgaaagtcccgggaaagagaagtctgagtccaggagcgtgagaggagaacacacccgggaaatccctgctccggccgctgcacctccgcgggcgtccaggtgggacgtgggcaggtgcgcgagcgccgtgtgtgccggtgtggatctgtgtgtgtgcctgcgtgtgtgcgtgtgcgtgtgccgcgggctggctccgggacactgaggactcccgggtcggcccaggtctgtccgaccttgctgccctcgccgcccgcccggccccactccccggcgggccggctccttacctggacgcgccgcgtttccctccttcagcgggagcgccgcattgacactgcagatggagcctatgccgctgcctctcgccctcctctgaacgtgtgcgtgtgcgcgcgtgtggctgcctcctccagccccagccccgaacgca

SEQ ID NO: 160 - DNA, 453234 bp, Homo sapiens
atcccaaactgcatttttattattttttaataaactttattctatattacaaataagttttttttgttctgaactgcaaaataggaatgccttatatttacatacacaggtatacaattaattataacaaaggtacagaagcttgcctttaccaagttacaactgggctccaatttaaatagcacaggtttcctttttaaaaactttttaatttttttttaatattttactaggatactcttctttaaaaatcaaaaccagaagaccctcttcttagagatctcatccacatacatttgaggctcattttaacactgttgtctaaagatatgctttgctttgttctaacaaagggtcaatgttcgaggtgggagctttagtttgaaacagaagtgggatggggctggaagggggtgactggaacagagataacctgccctacctccttcaacggcttctctatgtgactcaaagacccctgccggttccttaaaccacccttccatcctgtttctccccttctctagcatttgaagctcaactctgggtcctctggctgggccaaaacccctgcatcatccccacacgtcggctcgctgagccattgtctgttgtggtaccctggagttgctggttgctatggtaactcagcaggaccctgctggaagagatgggctggcccctacatgctaaagtggggaggagggcagtggcatccaatccttccttcccacctcagggcctggaggccttgttcctgctcaaagcagccaacacacgactaagcaaagaccgtatgtctcaaggacaccaggccaaggtagggagtggtgaggggagggctgtccattctaaaacacaaaatcgttggtttccgaatggaaacaagattctttgaggtaagctagcttttcattttaagaacagaaggtttaacaagtcaacaagctaactagaacgtcggggagggagaggaaaggaggacagacagatgagcacgtgtatcccatcttcgtcctgtgcctggattgcggctgacttctgtgcacgaaagtgttccttagtcctgtttggtgaagtggtctcggtttcttaagcgtcctttgggttgctctttaactgtatcctctgttttaaattctacttttgtaagggagcccttccaaaatgtgcttgagtcaaaagatcaaagatactaacaaaggaagttctaattccaaataaagaaattgctggaagaagagctgcatagaccaagtctacttgcttttgcaatcctggcggagggaaagcttgggtcttcccatgacccatccctcacagagcctccttaaagtttgaggaaagctgataagagatgtgtaggattcggcagtaccaggggcagcccagagagccaagcatagacatcaaagcgggtgggaatggaataaagtgaggctcccgcaacccaggattttcagcctacctgaatcacctcactacctctgccaatacaaacagaaagttctttttgtatatgaaggattttgtttcgttttgtttaactttgctttgctttctggtaggcaccagtctactcaaggaatttaatcgggatcctaatgagtatgtatttctcttacaaccaaaaaattctatatacttttaaaacttggatactccctctaataaaataattttatgggggagcaaaaatttgtagtaaaaaaaaaaaaactctctcttgcatgtctgaaacttttactgcagtggattactttccaaatgagaggagtggtcatttaggtttcctgtcaagagcatgccacccttagcaccatgaggagaggtttgcagagtgtcccagcctcattcgggagctgtgtcagtgttacctgaggctgtgtctcagctccccactctataaaataaggctcttgtttcctacatagagaatgcctgtagggtgaggtggcaggaggcggtaggagaaggactccatctgtcaaaagtgtggggaagcaccaggaatagcagcagccatgtgagatgccacccctagcattgtcctcatccagggaatgtcctgacccatttttttttttcaatgggggaggctcctcctgtcctctgaacctctcctcatccccttggaagtcataggttttgctcccactaaccgagtaatttggacttaacatccatagcagggctcccttcttactttcgaactattaagatatacaaacaaaaaccaaacaactccaaaatcccaaataaatggcccacagttttgttttgttttgttttttttaaaggaagaggctgagggttcaaggcctcccagtcacctgtcctgagagctggcaggaagaggggaagaggcccttgatgtagacgaggaccaggagggatggcggggggggatttggggcatggggagaagccagggcacggagctgcctggggtaggtcttctctgggggtcaggtgagctcctggaggtgactcagtcatggaaagaccccttgaaggccttgaagagctggctggggctgctcactgggctcactgttcctggaaggagcaggggaagttcccggagaggggcttctctgggccttgtgcctgcagagcaccttcctacctatgtctgtctgtctttccctcactgcttggctgtctgtgaggtgggaggtttgtccttgactgataacaatactggccctttgctcggttaagtatttgacttcacattactgtgtccccttggtcctgggaaagaagacagatggaaattgagcttttctttttaggtcacagagggtggtgctgagacctgggcccatcacagcatcgttcacggctctggaaacagtggtaaggattcttcttgcagtggaggtcatttgggaagtcattgcttgtggatcctcggatggggacccatagggccttggctagacgagggagctcctacagccaggaaggcagctttgggtggggtaggatggggctggggcagtcacagagggctgggctgagaggtctgagcagctcctgtactcaagtggataaatcgccctgggacagaggctatgtgtgcaggagagacacggtggaatgaggagggacagggaggatgctcgtggcaggaggagcacaggcagaagccagacatgcaacgggagacacggtaccagggacctggttgcatgggggaggtggagatgctgggccagtacatcaaccttcactgctggtgggcgcaggtagctgggcctgaggggaccaggtcagagacttttcctgtgggtaactcctgcttcttcctgggaacagtcctggacagtctgcctcaaactttgggatttatttaaaataacttctctttcacttgtagctcctcacaagcagccaagctcacttaccaggctgcgggtgcacaaggggtaggctttaggggctggctttgggtgcagggatcatgctgccattggaatgtaccttggcctgtgggacacttgggttatccactgttcccaaatttaaaaccatactgaaagaagaaggcaagaaaatattttcctgaggaagtaactggcatgatggccaccttcacttagtggcactatttgcagctaccaagaaatgtcagggtctctccttatggggaaggacaaagaatgggtaaaagctgcatctggggggacttgtggccaggagaaatgaccagcctaccactctgtttcttgtcttcctctacttattccttaaaatttaggaccccacaaagcccccttcttccctgctaccttaagcccttctctctccaacatgcaaaaaaaattcccacctaaactttgtcagtgattttgatggctcagtctggtaccattttccctgggagggtacgggataagttggaggggaaggtaaggaagatggccttttctctccttctgtctgctcatgactcaacataatggtgaccctacaaattaactttgcctcgagggaggccgtgaaggggcctccatcccacaggacaaagttggcccaattcctttctctgggagcccgcaagccacatggacagcccctggatgtttgctctgccagtggggtaaggaagatccctgggggagtttggaaaaaagatttgggtgggggatggggggcaaggacagctttttgacaatgttgcttgtctttgcttttaaataccatatcacacgtgcaccaagaatccaaacggaagaaatggaaaacaaacagcagaagataatttttataagcaagatgggctgtggctctggatacctggctcaaatttctcagtccccaagcaggccacggggactgcagcaaacagagcggcagaaacaacccacccaccaattaaagtcaaaccagccccaaacccctcccccaggagaaatggggacagccagaaaatttgtctgtccttgtctcctctttcttcctaacctttctatttctctgaggtgtttgaaatttttcttataacaaaaacatggaataaaataaagtcctgtaccgccaaagtaacaataacaataatcatcatccagtaaaaaataaaagcttcagcagaaccgtgataagtcttttttcttttttttttctgcttgtttgattttttctcttaactgtgcaaaaaaaaaaaaaaaaaatcaaaatgcactcactcatacacacgttcacacacgcagcttccatccagcaaatctgtgttaaatacgtttgtgtctctttcctccccaaccctttatatgtgcaaaaatattgtagtgaccgaggtacttcctcagaccgtctcccacatgtaccctttctggccttccaggtcctgtgactgacttcttgggagggaataaaatgatcaaggatagaaaagtcaagcttctccacctggtactgcacttgccaaaacctttggttatttattttttttcttcctcttccaatgcattgtttcccattttcctcttcccattaggttgctcatgtcttttccaccatctgtcctctgcgatgtcacatgatgccctgttccaaggtccaggcctcggcaggcgaccaccctgatttcctatggacaagcgccctctccttccacccaccagctctcagcatagaaagcaagtaagtgttgaaatgtcctgaagctgcaggatgaatggatgagcaaggggaaagagaaggggaacacttcaaaaatcctcctacaaaggacaagaaatccttttgagctttccgcctacacctggggcagacacacacacacacatacatgtgctcacacacatgtgcacatattcatatccaaaggggcaagtgttcttaaaagtaccggatgctccatggactttgctggaaatggtgtggtttcttccccaaggggggctcattctgagtgggtgacaaggaatgatgtctgatgtttggggagtgaaggcaagactgtgaatccttctcctcaacctcacctaagatgtttctccttgtctcccatagtggtgaacaactccagagcagaggtgccaacagagactcctgcttaggatgggagactgcaccagacagcacctaaggtctccttaggatgaaaggttcctagaaccctccattagaccatctctccccatagcctctgcttacctagtatcaatttctaggcacacatttgcctgcctggctaaaatcgtgcatctgtagatgtaagaacagatggggagatggatgccaaggccaaggtcatttgtatgtccctcttcttaattccagccaggcccatcagctcgactctttgtccctcccagatctgacaagctggaggctgaggttggctggcattttgggctgtctccgtgaggctttgcttaagtctgtttctttcaaggatgactgctgaagagatgaggaaggagaatgatgagagacagctgagatgttgatgaaatcattcccaaagaggtctggacagcccagtgacaaagtcatctgcatagcaatggcaccggattctgcagagggaacagggactaggctgttggccccagccgtctatggagttctcaggaaggatgatggggatggagccatggagatggctggaggtagaatctcctagatgcactctgcatttcacgttgacccttgatgaaggttgacaaaggagggtggagatagatgctttctcttgacagcactcagggctctggtagtggactagacctatgactatgattgtgactcatttgaatttgagggtaaatggaaaacaaattctgcttccagggtagatgcaactctctttccttttctccccctgtgttacatttctgctactaggattcagatgaaaaggtcaggagcatctccatggtggaatgtaattgctattctttctcctgcctggctttctactggcgggggagcaggcagggcaggcaggtccctctggagacctggaaaaggacaggaagcctctggacaccagcccagtgggggagaaggagcctcaaggagcacctcccagctgcccacacatgccctgctccagccacatgcaggaggtgtagcctttcttctcacagctgcaaagcgatcagaccactggctgaaccactggagatggaactgtgggaagggagagccaggtgatgtcttcccagtaaagataatactgaagtccttccttgcctcttccctaggccaaggctcagaccaaagcaggggctgccaaagtggaaggtgaagtagcagcacagaaatgtcccctgtccctggctcctcattcgttatttgcaccctgctgctgacatgcacagggtcaggagcacctgggagacagaggcctctctgacatcttctggtcagctcccttgccatgggcctggccattcttggactaactgagggtcagtggcttggtccaatcgtgttggcagagcaactggaagagaagagatccaggaaggagggagaaacggaaagaggcagagagaaagagagagaaacagcgctgctcaggggatgctgctgatgccagtcggaacttgcacttggtaaagatgataatctagactgaggcacggcttggtgtgtccccctccagggcggccctggaaggacggttctcagctgtctaagctcatgagggttatgacttgttctagtttgtaggccagtttctgcttcccacactggtcatcgtggtccagaggtccaaggatctgcggaagggccaagaacagggagattactcatttgtgtgtacaggtctgtgttctcaggaggcacaaagatggtgtggatgtggtcagaagcccgggaagccacaggcatgtgcaggggcacacaggacactgcggggtaggaggagacctggggagcatgggcaggaagttgtggcaggcatagcatgtgagcatcagcatggcagtgagcacaggatgccagcacacacagtcatgtctgaatgactgtgtgcattctactggctacaaaagatggtagacagagggcagaagctctgctgaaagtgcctgtgccgagatgctgcagttacctgcaggttagacagcagctagttccatatccgatggaaatgcgtagtgctcagcatggagccggaatgtgatttcatggatgttaagacatcccacccttcctcccgcagaaataaaaatccatcagctccttgaggccccaaattctacatttagaaagtcatttgttttcactttgcctgttaaaaaacaaatgtccctagaagagtaagactacaagctttcctggtcattaacacctaatggataatgtctaccaaagccttttctgaaggcaggcagttagcagaggacaatgacagccagcaaatgtggcccatgatgaaaaatatgctagaattttactcagactcaggagatgagggatggagtaaaggctctgccagtttctagcttggtgatctgaggccaaacaggtaacctgtctgaacactcaacgtcctcaactgttaatgtaggaatgactaatccacctccaggggagaggatgtcagataacatctgtgagcaccctcaacacaaggcctgccccccgagaggcactagacaattgggtggaacctactgatgttgtagtttgaggggcagggaaaagaagggagggcaaggagatgagaaggaggctcaagggaggcgcccagggctttggatttcatgacccagttaatgtttctttagttgtggaagcaggatagagctggccaagaactgtcatttgtacgcgccatcatttcatagatgggttatttaaacaccaaggtagacaggtgtacttgtagactaacagagaatcctttctgagaggagacggttggaatattacactggtgcacactatagcatccttattatcttgcattgccgcaggcaggggaaaactctgccccagaccaatactaacctgcagactggcatcagggtccctcccctaagggacccagcactggctctcccatgatgtaagggccacagaattaggctgttcatggcctgcaggactccaggccttgggcctgctgggtctgcttctttaactgggggttcctggactctccttaagtgatgaggatgggaggaaatagagaactcggggcacaagcttcagcttctcttactaccgtccactcagagaaggtggctatgctgctgctcagatgcagggaatttggattccaaggatggccagacccatggcaagagagctgactagaagcccaggaagacacaggcctcctcctacccagcagtgtcgtgtgtgcccctgcacatgcctgtgtcttcctgagcttcctgggctgatcagaagatgtctgaggggcctctctctcccagctgctcctgaccccatgcataggcaagaaaactcccaaagcaccatggcactggccagaaagaaggccttgtatatagtggcaatgaccccaggtgggattttccagtgagggaacaaaacagaaaacacattctatttgttctgttctgttctgttctgttctgttctgttctgttctgttctgttctgttctgttctgttctgttctgttctgttctgttctgctctgctctgctctgctctgctctattcttttctattctattctattctattctattctattctattctattctattctattctattctattctactccgttccattccattccattctattctattccattctgttttgactcacttctgtttcatttctagtctattctgtttctattctattctacaacataccatatcataccatacaatgccataccacatagccggcccataggagtgaggaggtgcctgtttaaagagagttagatcagagaaagatgtggaaaacataaaaaagaagaaatacaggagagaaaataagaattaaaaaagacaatataaaagaaacaggtacttatttacatatctaagaagcacagggatgaatgcagaatttatgggatggagggtttctagcatcccagcctttggatcacagccccaggtcctcagtggtggttcccccagcagaggtggatgtgtctgtggcgatgatctcttatacggaggcatgcagggttgtcttcattctcttcccccttccatcccaatgggcctggagcagggcaaagcttacctcctcgctgtatttgcccacataggagaagatctctgagagtgcactcatggtgttgaactcattcatgtgcatccgggactgctcagccaggtatgcgttcatgtcttggtcgctgatggctggcatcttccctatgtctgagtaatacctgtggagggatggaaatagggagaagctgaagtcgtgcatacggagtagaggagagatggatgctcccagcaccgtgtctggggccatgagctcagcttgcactgcaggtagtgggtacttgtgctgtggccacctggggaccactgtggtctctctctcatctgggttgctgggtccgaaccaggaagagccctctgcagctctggatgcaggaggcatagagggaagggatttggggagtggccaagacaggagaggaaccgagagccagagggtcccaactcgggcatcctctttgctctcagctaccacacagagaggtctagactgtcttgagtttctctaacgcccctcccacagacgcaagggatctcctccagcagggcccgaaggctcttccgagcggttgctcttctctgatgtcctccactctctgggggctaaatgggaggaggcagggctgaggctactcagggagagactggtagaaggcaatcagtcactgtcacttgcagctgtgcactgctgtcaactggttaagtagatgccagcatttacatttttaatttctgcaatttgacattttatgcaccaaacctcaactcccccaccagaggggggttgcgcagtttcttaatgaggaactgaaaggcctcagtgtccccaaagacagccacttctcaccctctcctatgtacttttgggcttgtggactgcataaaagagaagaggtaactgcaatgacaggagggcatcataaacctcaaggccttgtggtggcccagctcagcctagcccaatccagcccatgccaaatccctgtggctgccatgctggagaaagtaaacctgaaacctaggatcagaggggatgggggaggacagtctgcagggcagggactagggtgcatgaagcaaggcacctaggcaccaagtttaagaaaaggcactcactcttggggttgtgcaagtattggtgacaatgacagaccctgggagttctcagaacttgaatcttggtcagaggctccgggacagtctccttctgcaccccagccctgtgtctttcccagccctatccttcacttctccaaccaggaccctgtctgtcttgtgctgtttccctgacctctaactgttcccatcagtgcctaggaggtgggtgaagactggcagagatggttttcctgtgccatctcagtcatcagctcaagggcctgcaatggaatgacagttcaatttgcaccagagcatccctgggctagtgagggctgggatggcttccctgctttgagccacagtggtactgggattgcagatctgttgttctgcctggaaaatggggaggcagagggagggagatgacagctgtgctccctggcaagggaaggggctggtcagaggggactcccctggccacataccagacactttctcaactgttttgctgaactggtagcattttggctgggcaggagcctgagacaggcaacaaggccaagggcgtaataacatggcctttctcagagcagcctgggtgttcagacaggccgccctgcccccgtctcatttgtatttccatccttcacatcttcttccattccccgcccctcctccaccttcagaaccctcagggcccagtaccccttcctgtttcattttgctttctttgctccatccccagaagagcctgttctcttcgaggcctgtgacccgccccaaaacacatcctcaggtacctcaggacacagggctctgagtaatttaacgacattccaggtataaaattgcagcgagacttgattcattgtaaccatttctggaatgcaataaatgccattgttccattttatagtgggacaccagagatttcagtagtagctcccaaccttgccattcccaaggagatttgtgtcattgtccccttagggatcccatgtctaccaagcaagatatgtttgtcaagtaaagggctatcttcacaggctttatttgtaaaaagtgtgaacaaataacctcactcacttttggtaccatggccagcagccagccacgcaactctggtaactcagctgagttccaagcttccaccagacaggtatactctgtcacctgtacacaatcagagcctctgaccaggtgaaaaacccaggttcccatggaaaggacacaactgtcatcaaaagcaaagactcctgtaatttctctcaccagctgtggaacctttcacagtaggcaggtggctctgtcaggctttttgcaaacagtgccagggaccttcttgctgcctttatagtccccgaggtgtaaggaatcctcggttaggggccactgtgtctgcagtgaagagaccatcactagggaaaaaaacagaagcccagcattctgccttcacagtgtcttgcctcatggtagcacactaaaagccctgtccatttctccaaagagaatatctagaagtatatatgtgtgtgtgagaaagacagagagagctgctggggtggagggcagggagttgagagtagggtaggacagggctggggccctgaccatctcatctagaggtcctgggtgacgtgcctctcctgaacacatcatcctctctctcaggtcaggtccttgctgggtagctcctgtctctttcctgttccctttgcactggggaggctggatcaaatcagggcacgtctgtggccacatactattgacaggtgggccaactgcatgacctcatcttcagcaagttctaaatcagctgagctgaatggccaccgacagcccagtgtctgtgggtgtggggcttaagtcttgctgagagtctaccctgtttttgatcctaagcctgcctgctgctaagtggtcccatcttctctgcagggctttgttgatgctgtcttgacccctcctgctcccccactcccactccctagccagcaccttgtgcctgacgctgactcatgcggcactacctctgccgggtgaaccttgcttccttctcgctcctgttgtgccggccccagtgctgggctcctccactgggaagccttactgatcaggaagaacacaattaggctctgttaaggaactttaaacaagcattctcatctgctggctgtgcattgaggaagggaaaggggaacctgggcccctgtgcttgaacttgctcctgtgggcattctgccttcaggtgagcccatctccaggaagtccttcaggacccctccgagctgccccaggcctgacctgctaagaaggagctggtcccaccactggccttccctggttctttttgctgagttgctcacagcagggaggaggccagcacccctgaggtcctgacatcaggcctctgggagcagccataaagatcagcaccccacagagccgcatcctccactgttggccagtctgcagggtcctagtctgtggatttctatggggtagtgggatgccagcagaaatcctgggcccagagagtgacagtgcgtatctcacatctgcctttaggttagctctgtagtgattgggaagatggtctccaatgccctaaactctttggaaaggacacagcgttggcattcctccacacacctcgaggatgaagatgcaggagtgaaagatatttccagcctgatgctctgatattcccaatatgtacctttcaaggccctgaacaagtcttttcctctgtgaatcatgggagggtctctctgggcccagcagaacgaggccccacaccctgacttccccactatgatgcttgtggggcctgctgagcatctgtgtggcctccctgaccacaggagctgcaaagaaagggtcaagttcaatgcatttcaagtacccaactcactcatgatggataccattaatgtttgacccatgaattaatgaatatgttaatgaaatgtctatatctcacctctagactatatcttgctcccagggtaagctgtcaccattttatgtatttgactggatggtttccataggaggcatatttaaatatttaaaattcttaaccttttttcatgccgtgacacacatgatagatgacattcaaatgtgtggcacactctagtccaaacccctgtggcctgctgtgactccattctacttacttcttaaaagctgactgatggcaagtgagtgaggccaatgttgctgcaagaatgacctttcaactcttccaagttaaaatcagaggaaatcaatcactactaaagtatgcaaatgttttgctactggtaatgacacaaaaactacaactaatcacaacacgccacttcatggtgatgacactgttgtgttttgtctgtaaggtgaaggtagtagttaactgctaattggaaaccaagagactcttctccctttttccagattcggccataagcaaaagcttaaattcttggatgaggggaatgaatactgggaatccacagtggggctacaaaccaccattattacaaggtacttggaggcaggaatgggaggggaggatgggtggggagatggtgggagggaggacaggtaggaggatgggtgggaggagagatcggagaagagatggaaaaatagatggcaggacaggagtgagggcaggtgggaggatggatgggaggacaggcgggacgatgggttagaggatgggtaagagaatgagtgagaggagagaagggagggcaggtgggaggacggatgagaggatgagtatgaggatggtggaaggatgggcgcaaagatgggtgagaggacagataagaagactggtgggagactagatggaaggatgagtgggggatgggtgggaggacagatgaaaagatgagtgggagggtaaagaatttctagaagactcaacatactggcagaatcatctatgccattcaaccaagagttattgaggcttcctgaatttatatgcttccctttttcacctgctctgaagagaggaccagccagggtaagccctattttttagttgtgatggtgcagaaaaccttccccaaatacatgcagagcacactccacagcagtgagcctctaagtaaaaagtcctgggaggactgtctccatttgaccaacagcaggggagcaaattcagaagtgaccaagccgtggccaggtcactctaccatcatcctcaactgcaggctgcaaatttccttggaatggggaggcgggagatcaggtgtgctgtggtcccaggtgaggtctgccctgccggactttactttcccctccagggagccaggcaagctcggaggatacctcctctgggagtgggagtggacgtggacttgtccctccatcaccaagtgaagaagaactctgggcttgacctcagccctgtctgtgctgttttctcgatctatctgtctttgtaccccggtcccgaaaaggagaaaagatttggggcttcaagtaagtgaaagatgactttcttgaaagtgtcagtggttgctaagacacgagtgggataggaaatggaaaccatcaaatcactcctaaaaataacccaatggactgagtttacttgtgacctgcagcagctgcatggcacaaacctcattgagcaccaagcagaaaggagaccacttgctcagcccatgcatgagcctcagctctgactatgcagcctgttcctgggaagtgtcctttatgcagacactttataaatgttcccagcccttcacagccctggtttccccttccccgcctggggcactatcacaatgacactgtggcactcggatgaccaacagcccagctgctgcctcttccccctctccctgctgaagaattggctgtccacatgggaggggctggagggcctgctcctggcagctctattgttgggagagtgagccactgtctacatagcaggaggtgagagcctgtctaggtgactcagacataatcagacactaggacaaaagagttagtttccttttggacagctgaggtggcatgtccaccacctgcatcagtaggaaaggaggagagggtatcaaagagcagaggggagagggaaaaacaaaatcaaacccttttagtgacactaatgcactgaggtggccaggactctactccctcttagttatttcctttttataagggaaggcaattttcaagtataaagacagaggctgtctctatcataggcaaaatgataaagttcattttgtcaccaagtcaagaacaccttctggactcttttactcttcaaaaggcaccatatctgagcttccctctaggtttcctatatttaagctacttagaataaagagaaagtctaaatgcaggactgccatgtagagttgcgcaggttattcactgcacaaaggtacttggacaagaggatgagctgggggtgacaaagcccatcattcagcaaactacgcacttggtgtggggctacctcattctgtaggaaggggcatctttcttaaaccatacagaggcaccatatgggttggcagaggccctgtctgaaagtaacgcaaataagtaggaaggttatttgggagtcagctaagaggcttgggatctagtttcatcttggttctttaaatcatcttgggcagattacttagccattctgcatgtatatttcttcaccttcatggcataaaaggagcttatagttcctgtcctctccctagtacagggcttctgtgatgaataaataaagcttcagctggttgcttagttcaggtgcttggcgtatggagctgatgtggctcagacaaaccattaaccttctttaccatgagtcgcactgccctaggaagagcccagccctgcggctcatagggggaccttcagtcacgagagctctgcaggacactgggatttgatcacaacgctgcaagaaccagggcattaagagctcatgcaagagtcaagggatggggagagtgagaaactgttcagacagtgacaaaggcatccccactgaatgctgggaactgccagccagacggtagcagatgggtagaggcctccagccttttctgcagcaatgatgtagtttggccccttgaagtgttatgatgacagtttttatttattttttggggggtgggtggtgaagatcagagctgggagccgcatctcctttctgggcctagaagacatttcagccactaggctccagggcctgttatctagggaagctgagctaccatggcaacctctggccaagttttcctattctggtttcaggggacagcagcactgggacttgggggtgtgggtgttgcagtggcaggattaggctttgtgaatgactcatctggaaacacagctggtttttgatggggaggggaccttttgttgagggagctgctggctccagcaaggggccctgacttggctccgtggcccagcactcacctctccacccaattcttgtagctggggatgtccttggcatacagcagcttgttggagggcgagtccttgcccagccggtgctctgacgtggagcaagagtccatgaaggtctgagccaccacagagaggcaggcgtctgtgatgctgttcttatggatgtcaaacacaaactgcgggttcttgatcatgttgacccaaaacctcaggggcaggctgcgtggaaggaagaggcagatggtcaggaaagacggggcagtggggctgtggtgtgggtaggaggggtctctggagaaggagagaagcctggggaactaatagaacttaagagccttctctatgctgcggatgggatgtgccagggaagggaggtgaggcaggtctgcagggccccaatttaccttccaggaaactgaggactggcaaggctgaataattcatccagagatataatgttggtaggtacttgagaggacttgatacccagccttgatggcagggctcatcatcttccctttggtctaaaaggcagccatgatgtatgctataaagcggaatttctaactctctgtctgtctgctcctaagcctggtacaagagcatctagttggcaaactgtaaggaattgcttggaatctaggctttgtatctgactctctgccatctactgtatgacttggcagaagtcacacccttcctccctgcctgggcctctcagcctactcctactggggctgagaagtacagtgtagctgactgatttttcatttctaagctggcacgcttgaaaacccacattcacccacctcatgggccccatcgtattccctccttcccctccagttggcacctcctgcccaccaggaactgtgcttgcaactggggatacagtgatgaatgagacacatcctctgctctcaagaagcctgcattctggtgggttcatggaaaggcagacatgaaatcaactacatgccgggaggactgttggtgctaggaccagggatgtgtagggtccagcatgggaccaagggaagcatcaagcctacccagagggcagtgtccagaatgccttcacaaagggggcacttgatggtgggagttttaaaacttgtgtaagtctttcctttcctttctttctttttctttctttcaatggagttttgctctgtcacccaagcgggagtgcagtggggcgatctcagctcattgcaacctctgcctcctgggttcaagcgattcttctgcctcagcctcctgagtagctgggactacaagcagccatcaccacactcagctaatttttatatttttagtatagatggggtttcatcatgttggccaggctgatcttgaactcctgatctcagttgatctgcccacctctgcatcccaaagtgttgagaatacaaggcgtgagccactgtgcctggcctgtgtgtttcttagcagggtgaggcctggaggaaggtggtggaggatgggctgcagacaggaaatctgcattaacaaagacaaagagggaaaagtgtgccctgcagtctgctattgtaagcctgttgcttataatgtcccaatcctgggaccttctgccccttttggctgtagccatccctgcaggctataatcctacggcttccaaccagcctgcttggacgcaggtgggaaagagggctaggcaccatgcaagggattgcttacttctttcctctgctcccacctctgcctcctgccatttcccctgatgttttattgttttggtggttgttctcactgatggtaatagttagaatattcattatgtgtttggcttgctcgttagaacttaaattctttgaattacatcatttcaatagaaccagtacaatatttctatacttgctctatctcccagcagccagcatgtacaaataacaaatgctattaatacaggaaaacctaatgttcaagactgccaatcagtcgacaaggatctattaagttcctacaaagtgtgcagggcgggactcaggcaggcagcattgaggtctgaaaatgtttggcggtgtttgcttcatccctggaaatccctaataggaaataatgggatggcacccaggaaagctcagacagccacaacacccaggtgaaagtaggggtcattccagctgcccagccttcctgacagctgggctcagagccctgaatgcaggactcacgacttccagctaacgaaatctctgtttacatcttcctgttgttccacaagttacaccaaggatagggactctgggagtccacatttgctctgccggttgtttcttccctatgcttcccggtcctcaagccagttttgctgacaggcacagcaaacagggaagccacagcacccacctgaggttcccgcctaatgaaatattagcatattattaacattagtggtggcactaatctctggttgattgcagccactcaggctaaatgagcaggaggtttatttaaaagagaagaggtagggaactgtggaagaagggggtggggagagggtgggttacaccttgggccaggaataaaaaaataatcacttttccatcagagacaattaactccaagtcaatatgcagatcttaaaattcccagactgtgtcttcctcagcatagcaatagatcaagtcagggttgggggaaagtgtcctcagggttgggggaaactgtctactttctgggatttcctttgctcagacctgagtacttggaagagctggcatccaagaagatttggctccactccaaggacattatggcacccctggaggtggccttgccccagcaggagggatggggtgaaaacaaatggtttagataccattgtaggtgatattcttgcactgtgctactaaaagcaggtagaaatgtttagaaagacccaactttctccagctaggaccgagagaagttctgggcagagcatttttttttaaaaatttcctgaaggctgctaacattcaatggaggcagtaagtaggaagactcactaacagaagcagattggtaggctggggacatgccccactgaacagctcccagtagtcacgccacaaagtctagaagagttaaacgcatcttacctaaaggcaggtcctgggagatatcagacccagcacagctttaaaaggaggaaatcgcatcacaaagttttgctacactgagtgagcaatctagatttttgagtcttatttcagaaaggttggaagaaccccagaacgaaggtcttctctcactaggagttaatatgggagcaaaccccatgctttggttctgtggtctcaaccttggttcctacctggtttttcatattcagcagggatagtctcttctcccggtgaagaggatgaggagccagagtatactacattgaatacagttttggtaccaaagcctgacttctgccttcatctgtgcattgctttggggcccagggctaggtgccagggtgcttcgctgagccctaatgctttgcccatcctagcagttgttggtgcgggcaacaggcccacactgcctcagaagaatgatctggggaagaagatctggaaaagctacagggaggcagttctggaagcaatgggacaaaggataagccagctttgcctcaggtagagctctcaaccagagaccaccttggctctgcatctcatcaataattattgagacccagctttatgcaagcttccgtactaagtgctgaatactgatgtgcgatcttgaaatttcaacctgaaatacaaattactcacaagtgaaaggaaggatgatccatgttaaaaggagagaggggatcataggggagaacacctagagtgtcaattagtacttggagaatcctgttgtctcaaaggaagacatagtggttaagggcaggtctcttcaccacacagagcttggaaaagagaagagagcaattgcttgaatagaataggaatgccctttgttcacctggctggttcctaagtgtgtttcaaaactgcttgcaagtcactgttagacattgcccttctaagatctggttgcacacgacacatcctccatcttccatagcatttgtcccacaccagcagacttccttgcctctcaccctcatctgtcagttcattgagggcaggggccatgtctgattagccccgtgtctagcataatcacaggcacccaggaggtacttggatgggagagtgtcctggccgtgacatttggcatatttttcttgcttcttcagctggttcaataaatgtttgttaactgactaagtgataggaaagaaagatgcacagacagatttgactagagggaagtaagagagggagtgagcacaaaaatctaggaagagtggatggggaggaccagagaatgtgcctgctcagagtccctgctgatgaaaacaggctctggccagcccttctcctggaggcccagagtcccaccaccattaacttgaggctgggtgggctcagggctcccgatgtgccccctgccctcccttcactcaccaattgctcttccaggtatggcggacgtgcgggtcatgaatgccatgtttatcagcctgctcatccaggaagtcaaacatgtacttgatggccaggggcagggcagagccacggtgtgccgtgctgaagatggtctcaaagaggtcatccacaaacttctgcagtgtgccctggagaggcaggatacgtccagacacagctcgactcacgtagttctgaggatggcttttaaaacctgcctcacagacctaggcaggggaggatggtatacagcccaccctacttgggtaaaattgggtaagtccatgcattaaatcattttttcccatttcatctgtctctaacagctttaaatttcccctgcacatggaaaagagatataacactgatgactggacctacgtaaggcttcctctgccaacaacacggtttggttgaacaccctctggcggtgttattttagcacttttcacaaatgctaatgaacactcacttggtcagagcagacaaacacaatctgctggctttgtttgggcattactcacactggctaatgaacagtgactcacttggctctgcagagagcagagctgagcccagtctcaggagtgaaagactagcactgcaggcaagcaacgtccccagaaccaggattagaaatggtgccggaggccagacacggtggctcatgcctgtaatcccaacttctgggaggctgaggcggacggatcatttgaggccaggagtttaagaccagcctggccaacatggtgaaaccccacctctactaaaaatacaaaaaaaaaaaaaaaaaaaaattagccaggcgtggtggtgcatgcttgtagtttcagctacttgggaggcaggaggattgtttgaacctgggaggaggaggttgcagtgagcagagattgcaccactgcacttcagcctgggtgacagaacaagactctgtctcaaaaaaaaaaaaaaaaaaaaaaaagaaaagatatggtgcctgggaagtcgtgatggagccccgacttccccaacttgagattgtagatgataccacagagaagaaatcattcttttataaggcatggcagaagaatgtgaaaagaggcagttagagtctcagtatttcagaagggcatggagaaggggtagaaacaaatcttcagattgcatgccaacactgatgtattggcagggtttgcctggagttctggattgagaaggattctgaggttcggtacggggaatggtcagcagtgcctcctggggtgggtaatagagtgggcaccagcatgaatgctgggtactggctactctggcatttctgtgggctgatgaagtccctctccatagcctctgggctccctgcacccagttctcaagtctgataccttagtggccaggagtcgggtcaggtagatttcagacaccatcttgctcccccggtccccctccttctggtctccgtgctcgtggttcttcactaggtgccacatcttgactccactctccaggtcaggagtgatcataggtgtccgtgagcggaggctgtcggggctgcccgtgtaccggatcatgttttctgccaaggcaaggatcaccccccgacatatgtgaggccacacagccttagcccatcacttaccatgcatcccttgctccggcagaagccaacgactgtctgatcattcctgccattggtcggtgctgtcaccttgccttggtttggtgcattccctgaaactgggatgcctttctcaccacctccaggaaactatctgtggctaattctacccactcagatctcccccttcttcctgtactctgcatcgtgtcaacccttaattattcaatttgtaaaaatataagcctgtacttttttaatgcttttccttgtaagagttctcaagtcacgtctcaggatgtgttctgtgcagccaattaagtacatacttaagagcaggtagcctgtctccctcaataaccgctgatcggatgagtaatcactgggtaacctgctcaccttcgtctgtcctcccctctggcctgcgccaattattcctgtttatttgctgaaattcctgccagtgtttgtgaagtgttgtgaaatgagtactgagcaggaaaaagaaatggcggtcctactgtgtgcaggcactattctctgtattcatctattgattatctagaatgatcctgttcagtcggtagatttttcagtctcttcttctggtaaataaataaataaccaaggctcatagtggtcagatgactagccccaaagcacacagatagggcagaacagggcttcttctggcttctaccccacctccagcaccctctcctcaccactgcagagcctcgcacctggtctgtacctgcactccactgcaaaataacagtggctcttacaaatcatttagcctctgtgcacctgagttataatgtactaatctgcataatagggggaaataataattatttaattcactagattgttatgaacatgatgtgagataatagctatcacacagcctggaagacattcatgaaagttggctttacttcttttgctcgtggatgaaggtcttgcttatgcatcagagtgcccgactgaaaccagggtcctcttcccccacctggctctcttccccgatggtcagcctgtctgatgccccatctcccctctccaagagtctcctgccttctggctatgctgctgtcatgacaacagctgctcaggacacccaggcctccctaggacactcggtgggatcttaccatatttacttgctgaggtcctggagacggtggagttgttcactgcgttataggctgtcacctgcttggacactaatgccaccacggaaccatctggcacctacagggaaaaagcttctcagggcctaggcacagcagctctgccactccaggaaataaggacaaatcatgatgaacttggcactaaggggaaattggtgccttgctggagaactaggggactttggaggctgtcagctttccttggagcagaacaagacacagatctggatactgacaagtattctgttttgtggcttctcttggagtaacttctggcaagagctcctccctagcattctcaatcccagtgcttccctggaagatgacccagccttaaatgcccagaggaacttctcaggagagccttccctggggactctgcccatgccctgcagaaagtgtgcatgtcaggatgctatctccaaagaggtcagggtttcctggtttcttggctgggagacaccaatttcctctggatcactaagggaacatggagtgctggtgaggggcttggtgtctacccctgttattccagggcaatgatttccagggcaagggacttgtagttggctagctcctcccctttccacattcccctcacctggtagtgggccagtgtgttcagtcgcttccaatcattctcaatcttggtggtgatgtcttcatcctgcaagatcatccttgccccacttccttgtcgccactctgccaaaagagcggtggcgtttcagagaggccctatgacccctcttgtggggaagctgaggaccctgtgtaggtacctatgcagtgctagctcaagggtgtgtccattgcaagtgctagcacatgctcctgcgaaaatggagtgccaaagctctcaacgcagagaggccctgagttccagttctggttctaagcccaacaaactatgtgaccaaaatggggctaacatcacttatccacccttgcccatctgcttgctgtgaatggctacatctgtaaaaagtaggtgctcaaaaagtattggccaaacaaaagaggcacataataaaacactaagctttgacaaagcatgaggcaaatgcaaagtggcatagttgtggtagcgtgacttgtttggaagctcttagagctgatgaaatcaaggctgtaggctcagtcactgaacagccccagacctgttccaggggtgtatcctacagggtgaaactggcaggtgtgtcacccttgtcagggagattgggtcaaagagtgtggaaaaaatcagcaaaacccattctcacgcccatgaacatcccattccctgcaaagtttatgtaaatgatatcaacgttgtaatctatccaacacctaattgtttgatgttacaaggatatatttacatccccatattattctcacgggtccaaacacctacaatacatgggcttactgatggatcacacatggaaatgggaggctgtttctcatcaaccaaatccccaccaccatacttggtacaaatcacgtgtaggtggagaagtgcacattcttatctcgaaatgtacacacatgaaaatccatgtgcatgtcagacacacataaactcatgcagcacacacatgtatgagctcacgcatccacacataccattctcatggacatataccagaaaggaaaaacagcctcttaaattcaaatgcaacgtgtgttccagccaagaagccagacgtttggtttccaggcagcccagatcctgctcaatgcctctcagatgctgatacttctgaaatgtgcaaagaatgctgggctcgttcagagtgtcgttagttgctggattaagtggcctggcagtcactgcttgacccaccagggatttcttcctatgtctcacagagccacatgttcagattctcttcctcgtttccctcctgccaaggctggtccatgaccagccacatttgtggcagagagcaccaattcctccctgcattgtgtatttgttgtggtctgtgctgccaaccccatttcacagatggcatgccctttggaatagcagagatgctcctaaaatctaagccccttgcctccagtccctggggctccagtccctggggcttccctgctgcctgatttacagcttagcatcatgtcaggtggtcaaaggaatgaaagcatagggactacatgcttgttcactggagcaagaagtctctggggaccatccatcccttagtcctgtggatgtcacagctgggattgctcatggtgattatggtctggggtggttagactaataggcaaaggggaaaatgcctcactgaggtatctggtcactagcgtttttgcttgttattgtgttgtttttttcttcagtttttttgttttgttttttattttatggaggtatgcatgcatgcacttttgagtggttggagcaaaggaagaggaatctctccaagctggccagacagctgatgtgctgtgcagttggatgctggtggacaccagtctgggttggggagtatacggcagtgagcctcccccacttgcatggtgagtggcacctggttaagtcagaggctacataggggtggaggaacagctttggggcacaacaaaaaaaaggagccagcattctgctttcctcatatttagggtagggagagggatgcaatgaactcagctctggacactaagtcctctggctgggcccaagggagtctcctccactgaagtgaccatggggcttgctaggactagaaggagaaggtgccagtggagagacagccctctagcttagcaactgcaagggcactgcttgctgataaagaattgtagcacatctcaggagcatctgaatgaataaaccacatggcctggccaactaggcaatgacagttggtgactgattctgggctccagggcaggtcttccaccatgatgcacaattccccttagagctgtgcagtgcacagcctgggcggccatactcaacaaccctggctgagtcatgcccggaaattatgagaatgagagtccacctacctccatgcccctatccaaaaagactgggtagagcatggtcatgtctccttgggaattatctcaaaaagtcaggaatgttttcccaaaagccaatatggagagagggggctggaatcaaggagtacacttagcttgcttttagatctctcaagcctattattttgttatgtcctagacagaaaaaaattgctatgtgctttttttctgaaatatcagaaaggtgaaagaataagaagaaaggagaaagaagaagagaaggaagaagacgaagaggaaaaagaggagaagaggatgaagaggaagaagaaggaggaggaggaagaagaaggaggaggaggaggaagaagaaggaggaggaagaaggaggaggaggaggaagaagaaggaggaggaggaggaagaagaaggaggaggaggagaaaggaggaggaggaggagaaaggaggaggaggaggaggaaggaggaggaggaggaggaggaaggaggaggaggaggaagaagaaggaggaggaggaggagaaaggaggaggaggaggaagaagaaggaggaggaggaggagaaaggaggaggaggagaaaggaggaggaggagaaaggaggaggaggagaaaggaggaggaggagaaaggaggaggagaaaggaggagagggagagggagggggagaaggggaaggagaggaaggagaggaagaagaggaagaagaagaaagtagtagttgaaattgttgttttgtagcatctacaacttagtcctgatgaaagagagcccagactgacgggcagctggtgtgggcagctccatccctgaggctttcaggaaagaagcaaggatcacaagaagcctacccagctgaacccagaatggaggagagagggtggagtataactggcgggcagccccacattccctggcacagaataattcaagtaggctgacaaggaaagccactccttaatgtcactcttctctacccaaattccttacttttaccctgttggccagaacccactttcacttccatacttacctgccctccttcctttcctgaaaccccttcttcaggccagttatggtctctattttccctaggctcatcacggaatgtctcaagaagatcagatagtgggcatgggctcagctttctggagcgctcttgcacgacttcctgaccttctctcaatagaaatctgagccatagagctctactgagtaaagcaggggccaggaaaagccaaggtcaaagaccatcgcaggtggcttccctctagcccaggaacagtgccctctcctaagctgcatggctgggctcataaaatctcatccccaccccagaagtaaagatcccaaggtcaggttgagtcagctgaggatgagacagccctgccaccttagatatgaaggccagcaccctggtcccctcacggtgtgcacgactggctgaatcagcctcaggaggccctctgtgagggcggtatctaattttgtgctgtgttgcatattcagtgtgtgcttagttttaataacagtaatgaaaataaatagaacccaggtcccccagtgcttgatccagccctcttttcaccagatgggctccttctgtcttgcctataaaaaatgtcactaaaaatatctctcttttgagtctctaccttgctccgtaggaggtgaccacattaggacagccaagaggcaatgtcgtagctcagccaatggccagcatcctcccgtgaaggctgagcctcttgggcattttttgcctgcctgtggggcacagtgagaagctggaaaatacctcccaggcatcaaatgctatgagatgctgagctcagagagagctgtagcaaatcctggggcagagtgactcctcacaaacaccttctcctacaaaagaggacacctacagtcccatctcacaagatgcatctcctgcagtctctgtggtgagaatccaggtccaggaggtgttgcagctccacgctcactcattcatcaaagaacacttgccatgtgcccccagtgtgctgggcatggccaactgggcatgagaggtagttaaacagggaaacgggataaaacataagcccttgcccttgaagactccttgtgtggagaggctgtgcaagagcctgctggtcagggcaggggtgagacagggaagaggagctatggggagctggtgggaaagggctgcccaggttaaattgtgaaggatgagtaggcgttcactggctggccagggggacaagtgttctggtccaaaggtggcactcatgttgtagttctagggatcgatgagtctgagcaggagaaagttgagaggctggagaggtgtagggaggtcaggagctaagttaagaaagatccagcatgccatgccaaggtgtctggagctgagctgaggccagggagacagagcggggaggggataaggagaggagagcattattagaggggcaaagaggcatgagccctgtcgggatggccacctttgtccaaagcagaagtggcagcgaggacctaagtgaaggtagtggggcaggggtgtgggtttcagggatgctcagaagatggccaggtcatgcctgtagagtctctaggaaggggagaggtagggggaccctggcctgcctccaagtgtgtggagatccatgtaattggcagtgggaagctgaggcatagataggaaagagatcctccacaggccaacctggaaggagatgcttgcatggaggaccccactggcctggctcttgaagagtcccctacctaccagtaggtgccatgctgagaggcaaactctccccagggtgcacagcacctgatagttctggccctcacagtgtagacatgcaggtgggcccaagggcacccacacatgtacacacacatgtgcacatgcaccttttccaccaggctggggacccttcaggctttgcaataaccccacttccagtcttcctatcatcatctctcctcagacccatcccaggaagcttcaggaagggctgctgaagaaaggaaagggtggaaggagccactaaccaggctaggtagagccagcaaaatcgacctgcacagtccacgcaggaccaccttcatgaccacatgcctggacctccacccctgccaccttttcttaccttgggggcactgtgaacaggttctcactaggagcacacaccagcactgcacagggcccactccaccctccaaaccccgggctgagaaggaggctgtagggggagacaagattctatggctctgcacgcctgtcagcaggtgaaacccaaggaaacacctgacagggagccctgagaccttcaacacctggccacgctgaagtgctgggagcaggcaccggagaagagctgggagagccaagagaagatcagagtgtatctgctaaaaaggtcagaaaattcacctgggagcaggaggggtgacatctaaaaacgttctgttttttttttttttttaattattgtgacagcaagtgtgacacctggtgcttaaaagaagaagttcctgaatagaagtgcattatttgcactgaaggtactagatctttgtaaactgtaaagtgctgtgcactggtcagttgttgctatttggggatgcctagagagcgaaaggcaaacgcaggctgagccccgcttcctgatttaagagagacaagctagaacttagtagatattcttgaatgtggaacacagggctctggcatggctccagacagtgtggtgggtcaaagaagagtttagagggcaggtggtgtcagtgggaaggagggaaggtgaccctggcactcatatgcatggcaccaagagaaaattgctagctctgacctctctcgcagcagctctgcccggcagccggatgccctgctccaggcaccaagcacaaaggacagacacactcacaatccaatttgttacatttccaccttccagggagagagggaggtgaaataaaaaataaagaaaaatcccattatctttatctgtccttcccatcaggtgcagaggaaaatgcaaactggggagacagctgctgtgaactctttatatttcactcagaagatagtgtatctttttattgcctacaggaattacttatttgaaaaaatatatcctttcagcttgctcgacttgagccacaagacagagagagggtggtggagttctgggggctattgatagagcatttgcattaaactacaggaacctctggaggtcacggacagtggcagaggggagaggaaatgggtcgcagaggagactgcgtgtgaacggaatgggagttctctccacctccctgctgtgtaacctgggcccaggcactgtgagaactcagagaactgagctgcagattctccatctgtgcaggggaagagaatggcaccagtgatttcccttgaggagtgaagggaggaggaaaaaaagctccttagttcagatagaaaaatgtcctgtctctgctagtctgctaagaagtggggaacatctcctaggcaccttggcacccccaagcctggcacagagctggccacagggtaggatcttctcgtgtttgttgaagagtttagtgatgcaaacaggtacctaccctgcccagatacctgtgggtggaaagggacattttaaacctggttgtggggacagcctcacgtgtagcagggggagtgctacctgggcactgtgccttagagctctgcctcagtcccaactcctcccgctgtggtcgctgtccttccccagcttccaacacattgcagtgaaggtgggccctgcggtttctgggatagttaattctacgtgtcaacttggctgggccacagtacccagatatttggtcacacattattcgatatgtttctgtgagggtgtctttctatgaaattaacatttatatcaggatggattttgaataaagcagatttctctccataatgtaggtgggccccatccaatcagttgaagtcctgactggaacaaaagactgacctcccttgagaaagtgggaattctgccagcagacagccttcagacttgaactgcaatgttgcctcctccctgggtctccagcctgccagccaaccctgcagattttcgacttgccagcctccataatcgtatgaccacttctttaaaatgaatctctctctctctctgtttctggacatacacacacacacacacacacacacacacacacacacacacacacacagacgcacacacgcacacaacccttgtttctatttctttggagaatccttactaacgcggtttcccatcttggctccttaatgcctgcacaagtctggcgagggagtagagggagaggagtgggagagctcgtctgagctctgaggagcaatgaatagacatgtcaggagtgagcagttaggcaaagccaggggccacagtgatgatgacaggcaggagccaaaagccaagcaagagccgggagggttgggctggatttacttgggacaatgacggggtggtgcaaaatgtctttgcttcttgcggagctggcctgggatgggtgctcctgccgtgccaggggctgggcatcaggagagggaaggcagcctttgctggatgctctcagcagtgggagaagaaagcacagcgggtgcggggagaaagtcggggggcatgctgtgctgtcttggtcctgtccagcccatggggctgagtgagtgccaatgtgctatgcgtccctttggcataaatagtcacaccttacatttgtaaattgctcttaggctttcaaagcactttcacctacatgatgggaacaacttgccttgcttctctctccctgtgggggctgtgattgaatagtgtggaaaaagcatttgggtctctgaggaggccccatttttcttgcgatgcaatctagctttggtaagaagaagcctagagctttgtaagcagctctaaactctagatttaaaaggaaaaaagggaacttctcagaagagcacccatcatggttgagcagggagatgttgctgagcagctcagtgtgatgccccttcccagtgagaggggggccctgaggttcaaactgccccaggcctctctttgtttctctctgctatctgtccctggtgtggggatcttattcctccaagtgtggcccagcagcaaatgtgatggcagagggatcctctctgtttgtttgggtgcctggagcttgaacattcatggtgagcactggagacctgtttcctctgggaagcgggtagcctttctctggcttgtgcagcctctggctggggagaccagccaccctcaggcaggtccttgttgcagagctgctcttgggcttcctttcatcatggcgggtggcaggagcgactgtgcctgctttgtctgctgctgtttccactccagatagtctagaactctggcttcaggaggctttgcatcccataaaagacttgccttgctgggcttgcactcccaggctttttaagggagtgatttaagggactctcaggacaaagttcacggggctgccttctgtgagcccctccatgggaaatcacctattcttaagcacagaagcacacatctcttcatgcagctgcatgcaggtgctccttctgtgttctggcacaactttgcaatctcagcttccagcatgaaggagcctgctcctatcacagctccccctcttggccccactctgtctggactctcctcccacctgaattgcattaaggaccctgcaaagctgaaggtgccccctgctatatggcccacagatgaaacaaaggaacagtgggtgctagctggttccactaccaaactcaattctccctggaaaaacccattaaggagtattccactcaattgtttggacgtggggaacacaaaaatcctccttccaggaactgttctctctcccactgggccgtaacagtttcctcaccccatgagtctgtgggctcttcatggcagcaaatcaaatgcacacagacacacaggtctggtctggctctaagggcacacatgtgagcacacacccatacccctccccaccaccatcacacattggcttcctctgtgtcccagaaacagcatactcagagacacctccacagtggagggagacacatgctcaccgaatctccctccctcaatatccaagctcagagcacagggccaaacaccttcagccaagagccaagagagaggaaatggggttaaatgaagaagtgagaatttagaggagttactacaacttcctgatcctaagactctttagacatcagaattcagagggagtggggtgaggcagtgggaggcaatgaaaattccctctggattctagaaaatagcatagatgcccgtctgtcttggatggcttagccaaagccagcttagaggccagatggatggattagaggtgtctgaggggtcctcccaccactatgttaccaggaatctccagatacgagcacatacacacatcaatgcttctccctccatggccagcatcaacaaacaggcacagacagtatccttgtattatcctcataatcagtgacagcagccaatacttactgaatgtgtacaatggatcacacactgcattaaagacgcttttacatgcatgatctcactgaattcttactacaaggcaggcactatgattatctccatttatagctaggaaactaaggcatacacaggttacttgaccagggacacacagctaggacttgacggcaccaggactcaaatctagatgtgtttgatgctggccctcaaggctggaaccacctctcttccccactggcctcttcagatcctggggctccccatgaggatttccccaggatggcatcctatgaaatgcttatgcaaaccataactggctctaagtacaggtggccctaaccagcatgcccttgtttatagaggctgggagatatattcatgtaacagctaaaatgtcagacttctctccagcaggctttcaaatctcattttccctatactttctctccattctctatcactgacccagatccctcaagctgtaggtattcagcaaaaattataggcatggaactgagcagaagggaagagcctcaggcaacaacagaggcggtggcaggaccttgggccgcaggagctcagacaagcggactctgcccttaaatccccttctttccagatatgactccttcatttcccacccctctgctattcaaaggaccccagaggcatgtcctgccaggcagatcaccaacagactaccaagtggcccgtggacccctctctgcaaactgttcactgaccagctctggtcaattccaagcaggccaggaaggcaaccccatgggctcctgcgggggtccagccatgcctgactccctccagccagtgattattcccctcagatctctaccccagccctgcctctgctgacaggagaaggtgaggtgtgttcaggagcagccacaaggacagcccctgggtggacagcctactcacccagatccatatctgcagctttgggccggtgggagcaaggcacattcttgaagatggcatccagaatcttctccttgacctgagtgatggtgtcacagttgaggatctttactgggacctcggggctgttggcattgtctgggctgacacagctcaggacctgaaggaaaggtggggagaggaagcatatgaaatggggtagcaggaaaagctcctagatccccagcagcaccctgggattccgtcctgaatggctcatcctctccaggatgggctagggaggagtagggtggctccaggccatctgtgctcccaccaagcccactgccctttcctgtccaggcaagcaggacaatgccttggcttcaatgtccttgagggagtgcgagctgcacacttcactccctgtcagaacaaacttcattaaaatcctgatttttcaaagggacaatgcccaagcatgtggaagcagtgaggggaaatttgcaacagaacagacaccagtgcatgcatgcacacgtgctatctctctcacatgcatacaggaggcagtgtctcagcggcacacccagaccctcgcccacttctgaaaccccctgcccatccatgtttgtctgtctccttcttgtcactccttcttggacacacacacacagaactaataggaatctggcttctttctccaaatatttcacaagcttcaatttttatgaaggtttcattcacctgattagaggttggcaaatctataagacacttaatgtattctttaaaaataaaaagatgccctttaaagattgcaggttcaggacacctgagattctttcgtggccctgaatagggcccctgtgttgggggaagaggcgactgcatagttcagggcctccatttctccttttggaactagtaggaaaagttgaaactgcttcaccaaattatctttttattttttttcctttaaaaagttctgggcttttcctttaaaaagaacaaggcttttcttctcttgctgttctcacagtgggatctttctacatcgacggcaccgtgtgggctcctgggtggactggaggggaacggggtgggtgctgtgcgtactggagtaagtgagggcacaagatccaaggcagagaggctgggcatcctaggggtactgatgccaagtggccctccccttctgggctcccgaactctccctcgggccctgctgccagagagccctctgtgtgtctctctccttctcggaactttcactccctctgtgcccccataagcatttcccaattgtcccatctggtttgcagagccagacagcagtctctctcccactccacccccttcttgctgcatgtggtggcaatcagaaccctgggctctgggcacctgcctttcattagcaactagactgctatgagctcaaatgcgaacatgcttattccattaagaaggggaagaaaaaaaaacccctgaaatctataaaaccaaactttcacactcaaaatgccctaacctgaaaacaatggtggagagactgctgcctcaagcgctccatgtgtgcctcctcccagctctcccctccttctaagagtcttctggccccttccctctgctcagcagccaggcaaagcctgacccttgggctgttctggcagcccctgctgtcctgtcctctgggccctggtggggcagctcagccttcccaagacagcaacacagcttgccctgggcttcctcctctgagggacccatggggcagaggctgccacctaaacgtaatcccctggcatttctaattgccgcaggaattcagcgtggcctcatgagaacaactccatggtgcacttcagggcaggagttggcgttctaaagtggaagcagtggccccacagaaggacagagcccctggccactggccaagctagagctccacccacaggttcccttcctccatgctccttggctagtttgtggacaagctgcctcatgatttctctgccagggaagtgcctctcaaacgctaatgtgaatagaagcacttgggggctttgttgagatacaaaatctgatctaggaggtctgggatggggcctgagattctgcatttttccaggttcccaggcaactagctagtgctcccaggttccccggtgggcatctagcgctctagcaggcttccaggtgcgcatctagaactctagcaggctcccgggcgggcacctagcaccctggcaggctcccgggcgggcacctagcgctctggcaggctcccgggcgggcacctagcgctctggcaagctcccaggtgggcatttagtgctctgacaggctaccaggtaggcatctagcattgcctggttccaggctcccacgtgggtacccagtgctctagtgggcttctaggtaggcatcttgcactctgcacccagatgttgctgatgttggtactagggtgctcccactggcatggtccttggccacaccagtccaagctccagcatcaatccaataaatcactaaacccctagaggcacacctgactgcaaagtggtacactcgctttctccccaagcctcttagagcctctccgtggttctctctcctgcccaagacaaggctacttttagcaggtccatagcactctgggctcctccagccaccgccgagttccaggactcgtctgcacgccctgtgtgctgctgtcctgcacgatttcttgccatctgtccacaccctgagggggctgctcccctgcacatgtgcaaatactttccccaggcctgaaggtggctattaaagctccctgtggccgtttcttctccaggcaaaacaattgcagtttctttcctctttcctcactgctcctgtcctcaagtgttcccacctaaatggatactggtccctgaaccactccaatttcctcacattctctttaagttgcggcacctgaaatcagctcagtgcactaccagtactgtggcctctggaacaaaggatgttgcaatttggggacagaacattattacaactgattgtgttggattcaatattgggagggtgctgaggagacaggaaagaaagggagtggaacgggggagacagggtggaagacatttacgcagtacttctatctcattaagaaatccattcaggtctctatttttggaagggttttccccctcttttccattttaatcggagcctctctctctctccttccaagcagacggtaactgccagaaagcaggggcctcattcacaggctgctcctttgaatcttcataacggagccaatccccacaaatctgttcagacgtctactgggattcccggggcttttggaaaatgagagtgggataggtggatcatggtcacagccttcccagccagcagggatggctttgttcagaggtgggaactgtctccccagctagccacaggctctggaatttgccctcagctcagagcagttggaggggttgtctgagaatcacactccctcccagtactacaatgccccagcctgctgtggctccctctcccgaccgctgcgtttgaacttcagtctgttccccgtcctcctcgttcccttctgtctctcttgcctccattcttgggtgccacttgcatatcacccccaacactcagcttttatcttttcatactccctccttccaagtcctctctttctcagagaaaaagggctggttggagatcactgtgatctccaaaaaatcccgagagtgagctccctgggtttgaaaggacagtgagcagcgagtggacgcacggtgacagtggggagaggcaagcggggcctgcgtgaccaagcactagtgcatgagtatgacgcgggcttcactgcctgttcatcttgtcccatctgatcctctgcacaacttcactctgagcaactatgattatccccactttagtcggttctgttggtgttctcattttttcagataaagagacccaaattcagagagattaggaacctgccccaattcaccctgttggtcgaaggcagagccagggctcaaatccaggtctgtctgatcccaaaggccatgctcttgaatgctaagccttggtgcctcctagggtagctgtttttgtcaggtgagggagcctgaccttgatggaggggatccccacgttccttcaacaactgccttgcaccactaggccaccttggccttgcgttatacagcttgggtcacagttgtatttgaacttagagcagaaggcagtgggggcttcagagctatgagtaactctttctagcttcctttcctctctgtcccccactctctgcctgcacggacctcttctgtaaagcgttgactctaagctgggaggacagaagagttcacctgggtcaagggctttgaccctataactggtgtggtcagaaacccccagttcattggctgaagtgtcactcaaatgtgtctgagctactggtccccaaatccaaatgccctggtgaaacagaacagaggaagtctggggtgatggacacagcgggagcacctggctgggcccacacagcagacacacctggagaggcagctgttcagcctttcagccatctccactgctgagcagggctacccaggatggaagcccgcctgtcaaagccccaggggaaacagatgggtgggctcaccagggttttgtagtcaatctgctggcggatgagcttgtcctcgctcaaggagtagcgggcctcgcccgtgatggcgtcaatggggcccttctccatctgctgcttgatggcacagaacagggagaagaggggctccccagcacactcctggaggtgagaagaacgtcattaggaggagctcttggaacactggagtgtacccccagtccctgcttctccaaagggctgcttccatcccctgccaagtccctgcacctgcccccacctgcttttatactcagctcttcaatctccttctctccatctcctcatccttcaggctggcattcctcctggctctttggaccacagggtcttttcccattctacccatttctcctttcctactgccgcctctccagggctctttcttcctcccccgctcccctcccctcctgccctcctctctgctctccctccccacctcaccccgctctctcagaggccccatccaaaggcagaggtcagtcctgggtggcaagaactccttagaacataagttaataattggaagctgagcctcttccacctcccaggcgcatccttggcttatctgccgcaacatgcggcttctgcaccggccggggggccttatcagcctcagtaagtctggggctgggagagggaagaggaaaagcagagaaataatgggcaaattgtttttaacttcaaaggaggattcagctttagggaccatgcagggcctctcagggctcatctatcccttgcccggcagtaggaaactagccttgggaagactgtgtctttggagctatgatggactgcaggcctctgtcttcctagacagtccatgataaggatgaattccatttcttgtggggttataagagccaggcccagtaagggaggactcgggggtgtggagcgatccccagtcaggctgcagagaatgaacgaggcaaggccagaaatacgtccacatccaaccctaccttgaggaacttgtagaggaggaaagtaaaccaattggtcagcatcttctcagccactgactcagtcctgtcagcagtcaccgagggaaccaacggaacaagacaaagaaagaagcagctggtcagagcccgtgggctgggaagggcaagggaggaattgtgcattgatcttgctgcttctagcgtttaggccaaaccttgcgatcctaatgaatatgagagtttcatggactcctagacgcccccataatggtaagacaagcttttcctacaaagctggaagatgacattttgggcagcaggctgtgggtgggattttggctggaacgccttagagcaccgctgtccaattgcacgttctgtgatgatgaaaattttctctacctgtgccatctaatatggcaaccaccggccacacatagctactgagcacttaaaatgtggcagcatgtctgaggaactgacactgaacttgtatttatttttaactaatttagatttaaatagtcacatgtggctcatagctatcctattagatagtataaccttagagaactttataggctagttgtgttcttttgggtgaaaaaaaaaaatcccaaatcctggggaggtaccaatttggcagggaataggaataaaggtggcaggagaagggttccatgtcagaaggtcagatggccaaactgagtccacagcctcagctaaaggctcccagcattcgccgcagcataaagccatatacccagctcagcccaagccgtgttaaaactgtcctattgcggctgggcacggtggctcttgcctgtaatcccagcactttaggaggccaaggcaggcagatcatgaggtcaacagatcaagaccatcctggccaacatggtgaaaccccctctctactaaaaacacaaaaattagctgggcgtggtggcacgtgcctgtaaccccagctacttgggaggctgaggcaggagaatcgcttgaacccaggaggtggaggttgcagtgagccaagatcttgccactgcactccagcctggcgacagagtgagactccgtctcaaaaacaaacgaacaaagaaacaaacaagaaactgtcctatggcaaaagattccacatcctttggaacttcccttgggagcccttctagagtttcatttgcaatgacagaaagttcattcttgagtctaacttgcatctttcatgctacaacacaagcccatctactcttttactttggaagtgaagatgcagcagcagtgcagtcagcccaaggacattttcagttgcatccatttagagaaaacaaattacgttcaaacttgcactaagcatgcggccagctccagagagaaactagcccatccaggtatgtctggatagagtttaaagttgcagttgccagaaaatgctaataactaaaatcccaaggtagttgggaggctgccggcacaaaatgaagctggtaagagaaaagaagaaggaacattgaaaggaggtgggcagccgggggcaagaagaagaaaaggaaaggagggcagaaggaagcaagagcatccaggagaacaggaacggaaaacaaggggaggagacacagaggcagagcgagaccacgccagaaagttgtcggtgggagctctggcaggcagtggcaaccctagaattatgccagtgggtggctgcgtggtgaaagtaaaacaaaaatcaaaatgatctaccttgctgtttccaaagctgtctgctggctcttatatgcagcagacttttgcagctgtgcaggcaaatgcccactgctccaggaaaaaccctgaagtaaacacttctgaaagccaaatctatctgctggaccaagtgggagccactgaagctcagcctgagacccaaagaccaaagatggaagtctgggggacaggcagacagcaggcagacagcacatgagtggtctaggcagagggctggacataatgacatgacgtgggagttttctaacttcagatatgccaaggccaaaggtattggaataatggcctagaggagaaatggccttcgagtacacaaaaagttcaaacagaagcactggtagagtgagagagtttctaattcctataaggcgaaagtcataggataaggttatgtcttcacacaggacctttaaggtttcaacagtatcaagtttgaggcctccagggtgttgagtggtggactctgggcccatttacagcctacagcaggtgcgaggaaacacttgctgggctgtgctgggtgagacatcaccaaaggactttccttcagtgcttctcaaactttaatatggattgggataaactgggttcctcactaaaatgcaggttctgattcagcgggtctgggagggcctgaaattctgcatttatttatttattttttaatttttttttagcgacagggtcttgctctgttgcccaggctggagtgcagtggtgagatcatggctcactacagcctcaaactccagggcttaaaggatcctcctatcccagcctccagagtagctggaactttacaggtgtgcaccatcatgcatagctaatttttatattttattcttgtagagatgaggtctatgttgcctgctatgttgtccaggctggtcttgaactcctggcctcaagagatcctcctgccttggtctcccaaattgttgggatcacaggcatgagccactgcacctggcttgtgattctgcttttctaacaagctccagtgtgctcccgatgctgtcctctgccacctgatggcatgaggccacaggtcttctctcctagtccaactttggactcagataaggccagaggatggtctaagtgacctctgaagattccatgagaggagattgcagtagacagggtcaagattaagtagaagggcagagaaggaaaaatggagattcgacaaaggggcaagagaacaagagggtgagccaacaagtccatgcatccttgactcctgaggacagtggacaggttcttctaagggggcctgcaatgtagtcctggctctgggctagttagtgacttgaacttgggaacatggctgctctcctaggagctccacccgagtctccctgcaaggcacggtgagccaggtgcatggctaggctggagcagggtgccccagactgcaccctcacctcctgagcagcagcttagggtggttcttgctctccaggttcttgtcaatgaggtcggccagcagctgcttcagcacatcagtggcgtactccagcttgctctgcagcacggtcatgatgagtgaggccacgttgccacggtcgcgcatggagaagctacgctgggactcaagcgtgcggatgaaggacagcaggaacaccttgttgttgatgagctgggcgaagagcttcaggcctttctccacacgctcctgccggtagcccgggacctgcagagagacctaggagtcgtgatgccattggcaggttggggagctcagtgacctccccacgggatggctgtgcccatatccatgaccctctcatccaccaattaagccacagtccacctggctaatgctgtcaagcccttagcactgagttaagtatctgattaacctccatcgcagcctctagtttagagatgaatcaattgaagcacagagagagcatcacatggttagtaaatggcggggctaggatggcactcacttctgccggactccagagctcttccctgatggtgacgcagagttgatgagggcccctgtgtcatggcagagcacctcacagtccctgtggggaattccaggtgcccagggctgtcgtggtttacaccctgagaatccccatccctgagcctgggactaacctaatgcccacccctctccagccctaggggtgctgttgatacaccagtggcctcggagtcaggacatctgggttccacgtggattctgataccaccttgctgggtaactctgggtaagtctctttccttctctgggggcccaagtttatccacatgataaaaagggaagattgagcccaagagtctctaaagaacttcctaactctagcatttgctgttttcttagggactctctctaagaccctgctctatgcaggggaagaggaagaagatggtcttatctttctgcctccattgtctgttcattgggagatctctgcaagggtgtaccattcactcagcaaacacgagtcaatgactcaggtaggtgtggaaggcccacctctgagatgtccaggggtgtgcattgcaatcctgtcagtcacagctccaaactggaaacactcagatgtccagcaacaagagaacaggtggaggaattgtggtgtattccacccaatggataccacacagcaatgagaatgaatgacctattgctacacacaataacaggatgggtcctgcaaatgtactgaatgaaaaaagccagatgctaaagagggcatagtcttcatagaataccatttaaataaatattttaaaagcagataaaattaatcaatggttgtagagaaatgactgctctaggggatggctgtaactaaaagggggcaccccgggactcctgggggactggccatgttctgcttggtgctggcttgaggggtgctggcttgatgggcatgttcacttggggaaaagtcatcgagctgcacgctgacaatttgtgcgtgatttgtatgcatgcttctgttaaaccaaaagacgtacttaaaaagtcagctataggatctgcccccaagggggagcttctgagaacactgcagggtgtgtctcctgaagtggggcactggaggaggcagggagtgggagggacggcctggggaggtaacttcggagtcacgtcttgagggctctgtctccccaagggggtggataccacagttctttgagaaggagtgtcatgtatacagcagtaacgagcctggtttcagagtcggtcatgcttgggtttaattctgtcacagtcatttcctagggcccttagtgactcagtttcttcaccagcaaaatgaacataatgatagctaatactgatatagatctaagtccatactgccattctgtgtgctttagaaatactgacccacttaatgcacacagcaccaaaaaggtaggtttgttataatccccatgagggaccctgtgaggataaggagcttcacaaagccccaagacacagaagggtggaaggaggtcataaatcccggcacttggcacttctttctgccatctccagggaccatgatgtaaactgaaaggagagggggtatgaaaagctgatgcacatcccagctcctaaacagcagctacatcctcctgctctactcttgaggttttaaactgggaaaaatggagatggccagagaaagccttctttaaccaaagtcgcagagggtggcagaacattcatgatcctcattaccaataccctgtgttccaggctcagggcaaggcactggcaggaggccgggttcagtcagatccaggccctgtcctgagaagttcaaccaggaggccagccccagagagccctgagatcccttccatagcggagctctgtgagccagccctgcaccttgcacagaagggctgtcattgaaacctccaactagcccgtcatcagtagctcctatgggtctggaagctgtaggaaacgtgtgtgtttccaaatcaggtccattttcatttctctcactgtggtgctggtccttggagggccagttctcaggagacaaatgggaacagctagagataaacaggctacagcaggccacagcccctgctggcaaacccctcacctccggaggtgggactagcctctgctttcttcgtgcctgcctcccccagttctccccaccactgggggctgatgagggaaggacaactttaccttgccatcagcccgggcctcaatctgcccatttatctgtcttccaactctgtgaccacccccatcacatacatgccgctgtccttcaaattactcagaagagcagttctatgacttgttctaataatagtagataatgtcatttcttgggcatccaccatgtgcaatgcacagtgcctggcacattacacacattgtttcaatgaggccttctaatgatcttgcaaaactgagttaacaatctctcagagaagctattgcagctattccaaggcagcctatctcatgacaggcagtgctggattatgaaacccaaacttgtttggctcccaagtgcccgttcgtcctccccatctttcaccatatctagccctacccctgggcttgagagttgtctgaaagccaactcggatgtctctctaaagccttcccgtgcagggcctcccaccagctcagactggccggctaagggagggcagtcaccagaaggtttagcactatggcatttagagaggtggaagaggacatgggttggctagatagcacacttggtgtgaggatccactctgggattcttgcgaggctgccccttctctgtgtgcaaaatgcatatgcctcctgggaagcaggtctggggccctgggaaggaagattttagcaaagccacctacagtgaaatagcatcctattcagcagcatgggtcttagaagcagagagaccacagtgactcgtaggtggaggaaaactccatcacctctgggctctattgcctcgtctgtaaaatgagaatatgagtgtctatgtcataatgttttatgaacattaaataagataatgtatgtaaagtgcttggcatgcaccgtgcacacttaaacggcaacagttttattacctgcctttcagactccctggactgctttccagggatccctttcctccaagagtttcccagacatctagtgcatcagggtggtgttttggggtgtgggaggtaggaattttctccccactttatgaaggaaggagatggaagtgaagtgtcttggtcaggagtgtccaaaacagttcctcactgttgcctgccaccctccccagcccaagcaaatgctactctgaaacaagactttctttattcaccagatggttctctaatttagttgaagtctgtgagtataaaactggatagtaaattttaattgtaacccaataggttagagtttaggagccaatgatagactgaaattgggagattgactgctctgtgttttaaaaggttggtacatgaccagtgcctgggaagcacctttcttgaaggcctggacttaacccagagagccccacttgagggggctgggtgacctcccctccaggacagcctgaagcaagaggacacctccttcttcacacttccagaggtaagcaggaaccccagtggctgaaagggctgggaaacactggtttggattaatcaatggcttgtttccatacttagaacaccaagggggagaaactactccaggggcaagaaggggttggaaaaaaagcaaataagaaaaacagtgatccacacacaatccctcgatttcacatagaaggctggatctcacatagcccccggctaatgcgggccagtaaaagttctcagaaaatccaacttaaacatatgtaactaacctgcacattgtgcacatgtaccctaaaacttaaagtataataataataataataataataaagttacatctttaaaggaaacctacttagatttggaattttgaactcatgaagaaaggagaataactttatatactcatcctcattgcattcttatttaaattattctccatcccatccacagagtaatatgggaatgttcagacataatttcccgtcctacaacccccgtttccaccttaattcagccaaacacacagatattcatttattcaatcatttaccacttcccacatgcccattatgtgccaggcactctactctgctggaagttagaactacaaagataaataaggtacatgcacagtctacacatccaatcatacacacacacgtgcacacaatggtcttatcttcttgtccctcttgtgtctcactttaaacaggaatttgtatactctccagggccctaagagaatcctggtaatttgaagcaaacgaaggtgaggctggagaaaaataaaaggaagagaaaaatgagtaggactgggggaggagcaaagaccaggagcaagatcaaggaaatgggtagacaaaagtatcaggatacacgttatgtttttatttatgcacgggctacatctacacatgcatgcacacatacacgcacacaaacacacatatagacagagagaaaaggtgccttgtcgatgaggacatagagaccgtcacctccaacttatgaaagtgtctcttggtatctcttagctgaggagccaaagggagcctcctccagatagaaaagcccatgccctcaatatagaaacacacacaagcctatgcttcatgcaacaagcaagtatggagaaacgtgtgtgccacgaatgcccctctggacttctcacgtttgctacagaggtgcacagcctactacattcccttggacagcccacttagacattccctcaggtgtcggtacctgcaaacccacacagctcccgagtgatgggtctgtttttattttatggacaatgtaaatcttggaattaatcttagtttgcattgttgctttggctgtagatttttgatccatccaagctgtaaggcaggtcactgacatagctccccagaagtccagcacagaggcctgttgttggaagcaaagacactgaagtctaaatgcctgagctcaaatcttcctttggccgccaccagctgtgtggtcccaggcaaccactgaactctggccccttagttttgtcacctgtataatgggcttacttacttcagaggcttcttgggaggtgaaatgaatgaaagcatgcaaagggcttaaactgtgctaagatgttagtaatagtcaactcatagtgattattcctcaggattattattctgtcctggtcttttctcatttatatttttcacttttctctggtatttatctctgtaagccattccaaagccctttcaggacaaagtataatatgaatagacacctaagccagataccatgctagacagtaagtgggataaagtgttcaaaagatgaggtccctgctggtagaagagagggttatgatttctcattcacatttccaccccacttcccaacacatcgtttaccttttccaattaaacactaagtggtaaatcccatatatattgagtaccaactacgtgagtcaaatcccctacttcatggacccttaaccaaaggtccctgaggttccccaatgtatttgccgtgtttcttgtttctgtgcatatgtagttttttctggggagagggtcatcaactacttccattcaattctgaaagggctccatgatcctccaagacctgaagccctactcacatctctgctccaaggttccctggcttggccccacctcttccagagggatggactggtgctgacaatctgggggaccttgggcaagttgtgtcccctccctggccttagttttctcacctccgaaagaaggggctggacttgaagattgccaacacgctcccctgctctaatgccaggatggagcactgcttctcacctcaaggtcccggaggacagggtggtcttcaattcctgggaacagcacccgcatggtgtaagttctatagtccaggaacggaatcccggctccatccaggtcactggtcagctcatggatgtccgtctgcagctcggcaaaggctggcacgaagagaagcctgtgagatggctggatggggaggctccaggagtcacctccatctcagaatgctcagaacccttacccaagcccctaggagacatgagcaatggaccacgatgggcgggaataactggagaggctatgtttacatagctgggattgggatgaatgaatggcattagcatgggagaaagatgtagtgcaagaaaccttgtcttggggctaaaacctttccaaagtgtgatgatgtggggtggtggctgaggctgtccacagatctgtgctgctgcttggccaggagagactccccatctgaagatgaagggctttggtttgcaaaatatgctggggagggggatgtagagggatgggtaagagaagggagaggtgccatgaggaagagtccattcctgatgctgtgttttagaatagatttccttataagatgttaagaaaaactgataaaggaaaacaagtttaaagacacaagtctggaccatgcagctcatcagagccatcaaacttccaaatggggcagagatggaggctcagccacactaatatagtccttctgtataaataggcaaggtatttctttgtccttccttcctcaaggtgatgctacttgatggtgaattatgacctgcatgtgggcactgctgtgtgtggcggcagctcaggcctccagatgaacagagtggcaagaacccccaggaaagtgagcatgcagtagagcctcaggctgttacatagcaccaaagctgtcaccatattccgttctggaaacatcctcccccagggccaccctctgccacaggggtactcaggggtgaggcacccagcccttccctgctccgcctttctctttggtgtgtgcacacacacatatacgtgcatgcatgcacatggaccaccaggatggattaacacatgctggcaaagaagaacagccagtgggcattaactattaaaaaatatttctttctatttacataatctcaaaaatagggagaaaatattttgtgaactcagaagggatgaacaagcccaatgtggctctagagcctcaaaaagcaagcccagcgcccagtgagctgtgatgatcacagaaacacaatgcagccaccctaggaactgtctgcagggaccccagtcctgcccttgcccatgagttgggtggagctccacccagcagagcagacttcaggccctcaaattttggctttctgtgccaggagaatcccaagactgcttgtttgagagagccaaggggatgccacctggagagtcctctgcagcctctcctgctgctcctctctccctgcacccctgcacctctacactggccacacagacacaggggttcctgatatgtaggctgatttcaacagtagagaacccaaatgcatccaagtggagcctgcaccaatgtgtgtgtgcatgtgtttttggcatgtactgtcaccaaaagccctggggaacattcatgtgtgtcctgagtgaggaacatgggtgtgtatgcttataagagagtgtgggaacatgtgcatgagcataggtgtgggtgcatgggcacttgtctgagtgtgtatgtcagggagtgtatgtgagtgtgtgagtgtgacagtgtgtgagcatgtcagggagtgtgtgagtatgacagtgtgtgagcatgtcagggagtgtgtatgactgcatgtgtgtgtgtatgtcagtgagtgtgtaggcatgtgcaagtgtgaatgtcagtgtgtatgcatgtgtgaatgtgagtgcatggatgtgaatgaatgtatgtcaatgagtgtgtatgtgtgtgaatgtgagtgcctgcgtgggtgtgagtgcatgagtgtgtgtgtatgcttgtcagtgtgagtgtgcatatgtgtgttggtgtgtatgcaagtacgaatgtgagtgcatgtgtatgtctgtgtgtatgcatgtgtgagtgcatgcgtctatgtgtgcacgcatgtgtgaatgtgagtgcatgagtatgtgggcatgtgtgtgcacgcctgcaagttgagtgcgtgagtgtatgagtgtgcatgcatgtgtgcatgtgagtgcatgtgtatgcatgtgcaagtgtgagtgtgtaagtatatgtcagtgtgtgtgtacgaatgtgagtacatgagcgtgtgagcacatgagtgtatgtcagtgagtgtatgtatgtgaaagcatgagtgtgtgagcatgtcactatgtgtgggcatgtatgtgtgagtgcacgagtgagtgtatgtgagtgtgcatgcatgtgtgcatgtgagtgtatgtgtgagtccatgagtgtatgtcagtgagggtgtgtgggcctgtgtgggagtgtttgtaaatacacgggtatgtttatatatcagaagcttaggcccatgaagggcccagctgggtgtcttctgagtttgtgtagaggacgtcctggcttgctgtgaagtcttcaaggagaccccttggcttgggccagtgcagccctgtaaacgttcagtggctggctctgggcaagctgcaaagtgcctctgtggctagtctgacaagtcctttgctgtaagaccccttcttcctacgtgcacagcatagctcgcccctaaagtctgaagccaaggtttcctcctggggcctcagctgacaatcctgggtgggagctcccatcggctgctccctcccagttggggtgctcggcccacagggagcagaaggagggtgttggctttttatcagtctgcagctttcctttaagtcaccaagcgcctccaacattcaaagctgcgtgcctgccacacataaaagagattctaatcactacacctaattagaggaaagagtacattgcggagaaaaaaattaagcagcgtaaatataataaaaggcagtaattaacagtcccacaaggcggatgctgtgttgacagctgaaggatgtagagaggggatggaatggatccacttccccatcaaaaagagccgtggctgccctggtgggaatcggtgtgaagtgagagccccaggtatggggccggatttactccatgtacaaatctacagcaaagaaccagctcagatcctcccaggatgagtcacaaaatgatatcctgggggttacaagagtctgactcctaaatttccttcttggatttagtgcagctgatttcactttatggtggtgtttgtaatttttttaatacaagctttgaaacacccttccttctaaatcacagatcagccctacagccttaccttcctgctagaggaagaaagctggagattgctgaaatgcgtcatgttaagacacccccagacctcccctcgagtagagtgcaaaacccactcaaccaggattccaggtatggaggctgctctagtggggtgaaggtgctctagtggggtgaaggtgacaatcctgggtgggagctcccctcggctgccccctcccagttggggtgctcggcccacagggagcagaaggagggagttggctttttatcagtctgcagctttcctttaagtcaccaagcgcctccaacattcaaagctgtgtgcctgccacacataaaagagattctaatcactacaccttcaaggagagggcaaggagaccttggcctctctggtgttgccagggtggggcctgcttgggtatgggtgtggtctgggacacaggcatagggactatagagtgagaggctttgcaggtatgcaggtaggatgcacagcctccagcattgcccacagctgcctggcctgcttgcttgtaaatgaaacacatacacatacacatacacacacacacacacacttgtaaatgaaacacatacacacacacacacacacacacacacagcctccagcactgcccacagctgcctgggctgcttgcttgtaaatgaaacacatacacatacacatatatacacacacacacacacacacacacacacagcctccagcactgcccacagctgcctggcctgcttgcttgtaaatgaaacacatacgcatacacacacgtgcacacacacacagcctccagcactgcccacagctgcctggcctgcttgcttgtaaatgaaacacatacacatatacaggcgcgcgcgcacacacacacacacacacacacacggcctccagcactgctcacagctgcctggcctgcttgcttgtaaatgacacacatacacatacacgtgcgtgctcacacacgtgcgtgctcacacacacacacacacagcctccagcactgctcacagctgcctggcctgcttgcttgtaaatgaaacacatacacatacacacacacacgcgcacacagcctccagcactgctcacagttgcctggcctgcttgcttgtaaatggaacacatacacatacatacacacacatgcacacgcacacacagagcctccagcactgcccactgctgcccggcctgcttgcttgtacatgaaacatatacacatacacagatgcgcacgcacacagacacatatacagcctccagcactgctcactgctgcccggcctgcttgcttgtatatgaaacatatatacatacagatgtgcacacacacacatgcacacacacacattcgcacagacacacacaccgccagcctccagcactgcccactgctgcccagcctgcttgtttgtatatgaaacatatgcatacacatacacagatgtgcatgcacacacatatgcacacacgcacacacacatggcctccagcatggggccactcagtaccttccttgcactccagggccacacgggactccaggttgtccatctgcatctgcagccgcttcagcgtgaggtcactttcgcgggacttgcgtttataggcaatgagcacggccacgatgaaaatgatgaggaggccgccagccactgcgatgctgacgatggcgggcaggctgagcgggctgtccggggcaatgtacaccatccccggggagtactccatgccaccgacacgggcctgggggcacacagggcaagagggagctgggtgtggggacgcagcagctttggcaacagtcccaagttacccatgaactagtgaccagggcaggatgacggaaaggagaccaatcactggtgtcaaaatagacaagagggcatggggggctgggagcggggacaggcacagcttaacagagctcacccccaactggaaaaacctcacctcctcttattcaggagcgagttttgtcatcttcataagaaaacagcacacaactgggacctaaacacagtctgccacaaatgactggctcccctaagatttatgcccaatctaagggtggacaactgaagcacagaacatgatattaagatattacggaattccctgggccagcaacagccttctccttgaaggctttgtttgttgcaggtgatttagcaactatttaatgctgttttgcattttccttattgttgcaccagccagtgtggaaagaatgacaatacagaagagagaagctcaaaagtgaacatgaagaaagaacttggggtgtggggtagctacaggaaaagttctttgtgggacagaatcccctcttggaaagccttggtggcctgagctcacatctgcatccctactgcccgctccatccaggatggggttctgccagcctcaccatcactttgtgcctgccgatgaggttgggggactcgcagagcagctggacatctgacacggtcacggtgcacggcttctccccaaccagcacagtgtagttcagcttcacgttgcccccagccacaggcgggatcaggttcttgccctgtacaaatgggaaagcaccagttcccaccccagagtgaggaccacagctaccagctggctctcatgtcctcccacctggaggtcccatcccgctggtgagctggtgaagaagccacctttggtaataagtgcaaaaaatattcatggcatgactaccaccattgcctcttcctcccagtggctaatcagttatcaaagtactcctttcagcttatcccaaatgcagcctcagaatccttctcaatgcagagttggagtcagtcactaccaattgattcaaattgtcataagctttaattaacctgtaacccatgttccaaaggaagccctatgctgtggttcgcacaaggctgcctcagaggaagcagtgagcctgacctgccagtacttggactttcaggacaataaaagcttgagagtcaaatagccaaggtggatctgccttccctgggtagaaccggcccctaaagagagttttcttcccagtacagactcagagagaacatttatcacactctgggctacactgcaacctctgcaagagatgctggttgagaaatgtggcaggagtctgtgacttgaacacccccttccatgcagcagccccttcttttcccacccccgcctcccaccaccctcactccacctttaggatgatgggcgtgccaggcttgagctccaggattcctgagggaccaaaggcctcaaacaccgggttgggatagtaggtgaagttggtcttgttgaggatgagcagggactggacgttgtccaggatgaagccaaactcctcgggcctctcggtcaggtctgactggtggtcaggacccagagcgagggcgggcgcctgacaggtcatctcagtagcgttcagaacctcacagatctgtgggaggagccacagagtggagtctatgcagtatctccacatacccacagccccagtgcacatagtgggcctccctggatgtcatcgggatagcaaggggttgacaagaggattagagatgagtcagggccacacaattgggcactcaaggaataggctctatagcttgcacccagctccggttttgcccatagtgggtgtggcaatggctaggattggaagaatgcaagagtaaaggtataaaacccagggaaccccaaaagtaattactcctccatgtctataccccaagaagtaaaaatgcccttatgtcttcccccctattccactatcctagtattcaagggtgtcaggctgtgggttatcagtgtatgggcagggagttacctcagtacttgggaagacccacaccctttggggaagcaacgtgttgcatgggcagcctccatgaaccccatcagccctacactcacattgatgtgctccttccctccatgcttggcacggatctgggggttctgtatgaggtccaggtgggtcccccatacggcgatgggtgtgtttccactgagcaggaagaaagaaggagatgtgtaaatgataagttcaggaagagcaatggcactctacaatgatgactgagctatgacaataaggacagtgataactaggcagcagggtaatgttcatggggacaaggatgacaagctgactgcatagtaataaggatgagtatctcggcagccaaggggagggcagtaatgaccagatgtccgtggccatcctttgctgagtttgtttggagtatggacccccgtggaggcccagtcaacagcacagcccccttggctctccaaggcctcttgatttgtgccagctgcttctctgcaaccccttggtgtctcttcctccatccttcccctggtcctcaccaatcttgggactttttaaacattagctttggcctcatgaaagcctcgctccagattgtccccaccacatcctgcaggggctgagcacagtctgctcccccagggcaatcgttctataattttctatcttggaggcttcgatcaggctgagatctgggaaaggcagagggtccatgaatgcaaatgtgaatgcaagtgcgaaatgcttttggactcgggtctcctgtaccctggggtggcacaggaccactgacagggaggacacaggactgctgagagggagggcacaggactgctgacagggagggcctaggagcttcatcttgtgtaacctttcaaaagaaacctggatgccagtgcctatccttagggcagctgagaagtgggcataaaggggtgggcagtactgtagtggactgtgtcctccaggggggctactcaaagaaaaatgagaaatagcctgatccccaatcaaaggagcatcttcgagaagaatcctgctatctaaaacaggctttagcaagttagttagctagaagttgatgagtaaagaatccttgacacacacacccacattcatttccacccatctatccatctgcctgtctttatattgccagttgcttctccctctctccttgctcacatgcgcgcacacacgcatgtgcgtgcacacacagtgtaagattcctgtgaaactcggagaggctcttgcacatgtgacagacagtgctggagatgaccttctggtgtctagccatcttccctgtcctctcaatcaccaattcaacacacatttatcaaatgcccaccatcactgttcacaagtaacccaggtggcttataagagcagagcctcaccccatcctcagactttattaacttaaataaaagccctggagctggctggcagacccagaacatgtctgtctccaacctccctcctagtgggagcatgatgcaggaatggcagctgagtgccagttagggtgacacctctatttctatgaggatgacacaaagaagaactgaattataccaggctgtgaatttcgcagagagttgcaaagtttgttgactaagtcacaaagggctgcatcaacttcctggggccaaatcctggcatggctttctacagacgattttcccctctctgtgccttctggtcttcatctgccttaaggtcatggccaaagctcagaaggtttgggcctgatagagtaactgctgaggacggccaaatctcatctctgcaggcaaagcctgtctttcttttgggtttaagacagggggtggcaaactctttctgtaaagggccagatagtaaatattgtaggctttacaggccatatggtccctgtcgcagttactcaactctgctgttatagtgagaaagcagctatagacaatacatgtacgagtgagcatggctgtgcgccaataaaactttatttacaaaagcaggtggctagccagattcagcccacggactggagtttgccgatccctggattaaaaaaagattgttccctggactggacacatccctgctctctgcctcagcccggggagaccacttctgcatgtacttcctgctcactcccccagccccacacccctgagaactgaagctgacagtgagaagcctggtcccagcagggggcagcgggagggggctgagccaggcagggccctgtgcatgtgcatctcacttcagcctctcagctgcctatgagagtggacaaatgagggactctggccccaggcaggtgagaactgttaaggccactgggctggtaagcagtggagctgggctgagacccttcccacgctgcccctgttacagtgacttcccagtgacctctgtgagctttgctgtggggtgccctctgtagcatcttctcattcccatgtgctagccagggcctggaaaggcagactcatgccgtgtgcctactccatctcccttgatgggagacataccactccagggaccctagagatcctgggatttcaaaatccctgggtgaatcactgaataggcagaggcccaggaagagtaccaatttgcccaaggtaaatgaaggtccccaagtccctgccctagggcctttctataccaacattcaatgcctggtcccctccctctgagacaggtgttcagtgcatctggctgggcactgggaaagggcaggaacaagacctaaactctacccttgaggagtttacagcagaggggaggggaaatataagcaggcagccaggagcaaagaggataggtatttggatggggcctccaggctcagaacacagcttcccccaaggaacctgactacagggagtagtcaggcctgatctaactccttcttccacacccctcagcctgaaggtgggaccaggattagcacctatgtctaccagaagtgagaagagtagcctggcacccccagcagtcactgcagcatagggacatggcctccagcacagtgcctgtccttgaactgggaaaggtgggttcttgttgttaggagcttggcctccaggctgggtttggcacagaggtgctctcagtggaaggagggagccacagtaggaaggtctgatttgggggtgtttggaatcaattccagctcatccatcccccaagcaggactgggcccccagaactctccttggctttcaagagtcagggaagggaaacagaggtgcagaagcattaaggtccgcttgggccagctcctacctgacaatgctccattctggctcaatccgcacgatggtggggtcttccacatactgaaagaccaggtcctggtggatcttggccctgtccacctgcaccgacaccttcatctctagcacctcatctgaggatgtggtgttgcagacaatgtaggatggagatcgcctggagggcaggaagacagagcactgggcgcctggtgttgaggaggacagaggtcctgagtcaaggccctcccacaccgctccctgcatgtcaggatgctcagaggccatgggtgggtgctctcagacagaaaactggagagccagtgacaaagactctccttggccaaactttagacaggttcctctgagccttcttttcaaataggcctcatccctgggtctgtctttggcctgtctagccttgttttttagcaagaatctggctaagtctatttggggagaaccctcccatacttgacatctgatcaccctggcctgcctttgcaagaatcacgttaagttggtttagcaggagtccatctaccttgatgtatcctcttagtgatttttcattcactgagccccttattctgctcattggctataaaccccctgctgtctttgtagtatttggagttgagccccatctgttttccctgatgcagtagtcttgacatcagttgcaatcgtcctgagtcttccttgccattttaacaagtgtcagaataaataattgtttctttaacactactgatgccaggcctggccaggtctgacttgggaattgtcacagctctcagcgtagctccctcaaggaaaaatcctctctctagagaatctcaggccagctgagggagcttctccagccacattgcctagagtccttcactgaatgcacctcctgccttgctcctaccccctaggctccagttcatgacaggtgtgcccttctggggctgcacagtaggaccaggggaggcaaggtcacctggccttgtaggctcaacctcaaccactggattgctgtgcctatcatctctgagcaggtccagctggctctgcagctcccagagtggatctgaccctcgtgaatgggctttagttgtagattccaaattgcattctggggtaacctagggttctgcagagtgggtgctatgggggcaccagggctaactgatgggccatgaagcatatggagcccatccagggaagggagggctgacaggtctccagactgagcccaaatcctctcccaaagagcacgtccactttgttaggcaggaggagtacttccaagccataaggtgattgaaaccacctttgcaaaaattgttgcaaaaaagtgtggcacctgtgcaaaaatttctgacatagaaaaattatcacagtgcaagtctgacctaacggaccctatcttgcttttaacctccaagctacccttgttcattcctgggcacagaccaagctaactataggaggaatttagtttatagtttaattttgtaacaaagatgataacagccttttcctgaaacaaaccccctctttgcctggggaccagagagcctacctttgaaaaactaacaaattcgccacaagatcagaaattatgactcaggaggcacataagcaacaagaggccacaagattccaaatgttcccaattgctcctatggataacatcactattgtaaaacctaagatcactgtttgagatacttttcagatcctgaattctgattgaccagctggtaccacccagaccagtaacgtggctcaactagttctgcgatcccacccaggaactgaagacagcaagaaaaacctatttcaactttatacaatttcatctgcaacccaaccaatcagcattccccactccctaaccccccgcctgccaaattatccttaaaaaaaccctagtctccaaattttcagggagactgatttgaatcatacaactccgatctcccatttagccagctctgtattgattaaattctttctctattgcaataatgctgtctcaggaaattggctctatctgtgcagctggcaagaagaacctgtcaggtggttacaccctcccaactctctgcaataaaaacaaagctaccctgaagtcatttacctgtctaacctttccctctctggtgctgcagaaaggggccctctgagttacctgtggaagagacagggctgctttccaaacatcaccaccacgttgcttccggcattcaggttggtgcctgtgatggtcacttgggtccctccggacatgggcccccggctgggcttcagatctgagagagtcagtgtctgtgtagaaaggatgtggcctgagacacaaccaggaaggggtggaggaggcttctgggcaggcgtgaggcagcaccccactcccccaagctgccttctggaatctttggtaacagtggtctcccagagaaccagggcagttctcttaggcttgcgtggataggcagtgttccagaccctgagagtttgcatgcctatcttagtaatagtaatactaatagctgccatgtacttattttttaagtgtcagattgtacatcttcataattatacatgtatgtgtatatatccctatatacacatacatatatataatttaatcaccaatcaattctttaaagtaggcattattattttacagaagagattcagagatgttaagctagttttccaaggtcacacagctaaaaaaaaaaaatggcataactgagatcttaccccagagctccagttctcaacccctctctgacctacagctctgttcttgggtggtaaactgtctctcccacaggtctctacaaagagctgcccaaagcacccagtggcagagcaatgggaagtgagagccccagggaaactcagagagagaaacagaaaagagtcagttgctttcaagggctgcccccagccctctgccagaatgggaccagtgaggagtccaggttgggggcagggcagaaaaaagctcttgacagctggggatttggagttgcagtttgttctttcattagcattttaatggaaaaactttcctcagtcccaggtgagaagcctgtatctgcatttaaatgaagatttctctctcccttccccagctacctcctccttaaagaattcagcaccaaaagtcgaaccctctcagttccttggagcaggctgacaacctccccttggagatgctttgatagggaagccccagagcttccctatcacctggcacatgcgcctccaggtccaggatcagggcacatgggtgaggagacacgcagaccacagctcctgacctgcctcaccaggtctcagcaccctgtctctggatcccaggtctagtatccctgtaacatgggccaagccaaggaatagcttgtcattttggctcaaccagagaccaggaagagggtggggtgaggctgtggaaagagccctcctttctcagctctgcctggatctcgctgtgtgactctggacaagacatttcacctctctcatcaacaaaatcagggggctgagccaaaaagtggtgatcttcaaggctcctggcagttctcttgttctgtaacttgcagtacctcttcaaatggtacttgtgcccatcttaaagtatccccaccaaccttcccagagaggaaaggaaaggaaaggaaaggaaaggaaaggaaaggaaaggagagagagagagagagagagagagagagagagagaaagagagagagagagagagagagagagagagagagagaagattgtgcacacaggcttcgatgcagggatggtcctaaagagacagagttgaactcagggaagttaaaatagatgggggttggtgctccctggcagcctgtgggtgagggttcttagaaggggtagaagtgagtaatccctgcaggtgttgctggggcactatcaaggggctcactggtggggagaggatgttatggatacatgttttagagttgtgagaagctattaattattcaagccatgcttcataaatatttcacggtgggtttgcacaggaaatcaaattctgcattacttgccacctcttcacttggctccatgaatggaggtagagggaagggggaaagcattccctgcatggagacctttaggaacagctagtgacagcccagggtgttaatctggggcctcttggtcttggcatttggtttttgatgaataaacccacaaattggagtctggcctgattgtgggagaggacaaatcttccctctagccttggtactaaaaagggtctccccaacatgccccaagtcctggggaaagagcttcctggctgtctcagaactccaggggagctaggggcttctgtgtagggcccaaagagtgcacctgcaagctgcctggtagatgagaaggccatgagggctcggagactctggaaagtgtgatagatgggggttctgtcccttctcaaccccctgcggagactcatggggacctctgtccctcactcccacctggaatccctagaaactctgtgtgagggatgggggtgggcctcaatgacacaacccttaaatgcaaggggccagagaaagagactggtgtccctagcactatctccttcctaaagtcttcccaagtgaacatgtggcaccagagccattcctcaaagatgtcccttaagtagaaaaatgacaaatctttgagcttcagggacctaccagatcaatgcatatttgcctgtggcaacctctgtcatctgtcctgacctgcctctgcttcagtctctcctgctcaccacccaccttcttccttctccctcctgttcccatcttttggtgcactagaccttatgctgggaacagcctcccaccacttcagatccacatggaaaattatattctatttgtattatacaaattccatctttgcctccagcttcttctaggaagtctcccttaataccctaaattcaatcacacccctctccagggtaggaacaatcacacagccaagactggacccttcctgagggcagatgagactttccaatgtgtagcacacaggctcattataagaataaaagcagagagctgagtgcattggtacatgggagctactcaggaaacatcctttctcctaggtcagggggcctcagcccagcttgcatctcagaattacccaggatctgtagcattggatttaattagtcctggcaggaggcagggagaggtccagggcattttgtttaatggtcaccccaccccaggagactctcctgtgtccggaggtttagcgctgcctatgcactgtggggatcccaaagaaaagaaagtcctgggcttcagctgatctttgatggagcctcaggggtgggggcctggctgcaaatgcagagcagaggcagagaggcttaaaggaagcatcagcttaatgaggtggcggtgattctagccctgtccactgtgtgctccagggtccctgccaaggaccacaggatggaaaattgctctgggcaggtggcaggccaaggcaagtggctcccaagactgactggtttgacgaggagcagggcacaaagaggagccactgagcggtgtgatgcagtcagatgtctggagtcccagtaaatggggtggggtgcagggcctgtggatatccacagctcaggcctctgcattcgcagactgaggactgggtcccgagcacaactttgacgaataaggaggatatggctcgtgcaaccaagagaaggagatagagaagataaggtggcagatcatgcaaaggctggcaaaataggattgaatggggaagcagacagaggagcctgggcaatgttttacagggagggggagccttggctcttcttgaggtggcggctgacatgatggtagatggattacaacaggttcagagagaaaagcaagggaaagatttaaggaggccgttgtgatggcaaacagaatgggaaaaggaagactctgggacatggtgatggattgatgtcaggaatgaagggatgctgagccacagcccaacaggattgtaggcctaggggatggatcactgatgggaataggcaagagaggaggatgcactctttatgggagctgacagcctgggtgggccaagtggagatgaaagtgaacagccaggtgatggtggccttgattgagccgctggagtgaggggcctgactggggaagcagggcagaggcagctaaggttcaaaagaagcatcagcttagtaagttggaggtggctctagccctgtccactttatcattcaggatcactgccaagaacctcaggatggaaagctgctctgggcagtggctggccaaggaagtccagtgcttgctttggccatgcagcagtttcctcccgttttactttggctgccaggaaatttcaaagccagatttcttgcccaattttagcaaatacctggcgaatgtcatccctcctctctccatctctctctctctctctctctctgtctctatgtctatatcatatactatatatatatatatacacacacacacacacacatatatatgcatgctttatatacaaatatatatacatttctcattagttgtcttaatgtctattgggttcaccttggaaattccctcatgctttcaggagaaggtggtgggtacaaatcctaaacaaataaggaaaatgactcgtccatgaaccccattatatgtgcgtattcttctaattttatgaattcctatgtgcattctgtgacagccaactgcatccagagggggtttggccctcggagagcagaggtggagcagatgcaggcccagtcatggtgtggcacgacactcacgtttctctaaggtttggccctgaccatgttcaagtctgtgtcaagtacttgagctcagttgctttcacctccccttctagactgtaggcctcctgagggaggtgctgtgttgggtcttattcatcatccattaacccccacagccagaaccatcaagtcataaaatccaactcaattaaacaagcactcattaaataatctagtgagaggcattgtgcaaggtgatcaatggctgtcagttgaagaaggaagaaggaggaggaggaaggcagatgagataaaggagggagggaggaaggaaggaagcaaagaaagaggaagaaaggaagggagggagaaaggaagcaaggaaggaaggaagggagagaggaaaggaggagagagagatggaggcgaggggtgggggtgcagaaggaggaaagagggagacagagaggaaggagaatgaaagccaaactccccatgacatatttcagggcacatgatggccaggcataaaatccatcacttcaggcttccagcttccaaaagcagctcagaatcatgaggaaattataccattacagctgtcattaatctgagaggtttagtttttaaaatgatgggtgtgtgcggcagggaatgtgtttatgtctccaccatctccataatcacaaggctgagagattccaaaagcctctgtcccctagaactacttgtcaggcagcctttgaagggatgagaggttccaggcaggaaggaatttaaggactggggagagatcctcagaaaggccatgggatggggaaaggggtggtagggtgagaggtgggggcaattgtgtgggtagagggaaatggattgggtatgcaggtgagaggtgggcaggggttaatgaggtcatgaaatagggataatggtgagtgggtgctatggtttgagtgcatcttccaaagtcatgtcttgaaagcttaatccccaatttaacagtgttgagatgttggacttttaagaggtgattagtttataagggctctgccctcatgaatggattaatgttactatcataggaagatgtttattatcaaagagtgggtttgttatgaaaggcagttccaccctctcccgctcttgctctcttgcacacagtctcctgacttttcgctttctgccacgaggtgacgcagcaagaaggcacttgccagatgtagcccctagatcttggacttcccagcctccagaacaaggagtcaaataaatgactcttctttatcaattacccagtctcaggcattcttctacagcagcagtaaacagactaagacactggggtgaaggagtagtgtgagggagataggatggcataatgggccacaagtgtgcagggacaggccagaaaatggaagcaatggtggcaaccacagaaataataaaacaaatgatactagaagtcataaatacattgatgtaattttccacaagatcatggggttgatactattattatcctcattttataaatgaagaaactgaggcaaaaacaaaatgttgagcaacttgcccacatttacccagttagcaagtggaagagccaggtatcaaatcccaggagttgccttgtgaagtccaagctcttgcctacctaccatgccacactgccatgcacccacctggggactctgggccctgagagctaaagcaacttacctgaaaccacacagccaggcacagaaaagtctggatttgaatccaggtcttccagacttcaaaggctgtgctctcactcactataagacaggagtctcatgaactgagggaggttgcagggcaggcccttgccctgggtttgctcacagagctctagaggggcccagcaatcatggtaatgagctctgtggcctgcacccagccagatcactgctggccaagactcaccatgaagtaatagagctgtgaggaccgggccatgaattcaggccgacacacagccacgcagatctccacgaagcctgcatgctggctgggcttggcctcccccatctcacacacgatcctgcagggaggataggagaaatcccatgggtcacaggacttccagccaagaccctgcaccccacagcacctacccaggtccctttctccacagtaggatctcagggatggccaggtaggggaggaaggggaagatatcctaattcctcctagcaggggcttctccttaattgtcaggcaatgacgaaaactgacctatgggatctcctttgagggagcctagaagagggtccctgtgttctgaccctagatgttcagtccctaattcattattatctactcagttgtcaactagactggagggcatgttctagccaaaacccttagggaatagggctggcagagtccagagaggcaaagccacttacccaagggctgcagcaagtcaaaccagaacttggaacagacctaaggttttctggtccccacctgggagctttctgctcccgatgattgggttgcctcagtgaagtgcttttgcttcccagccagcctccaggctgggtgaggggataattgagtgtgtgtgtgtatgtgtgtgtatgcgtgtgtgaactttttcctttctaaaaatttttattgctttgattacaaaatttgtttataccctttgaaaataatcaaacagtcaaacagtacagagtatggcagtaaaaagtgagtgccccattcttcttaaaacttaaaactatatatacacttaaaagttaagtgtgtgtatatgtatgtatctttgcagacataatatataaatatatatgtgtatatatatctatgtatatatgtatatgtattcttcattttacaaatgaagaaactggggcaaagaaaagttaggcaacttgcccaatacatatatttgcatacatatacacatatatacgtacacacatatgtatatttatatttgtatttcatatgcaggcacacatgaacataaatgtgtttttacatatatacaattacacttataaacatgcatacgtaaggaaagatatatgtgtttttttaaaataaaagcaaaacataacatatccactgctataaacacttctgttttttgctcagcacaatagcatggaccttccttcctgtctctgtagacacggctcgacttttttcttttcagcagcctcacagtatttcatctgatgattgcactatcatttacacaaccatcttcctattgatgaacgtttagttgtcctgatttttctgctactccaaataattctgcaaaatgaaccaactgacacacacatccttaggcattgtatagtaggatagatttctaaggaaggaacctgttgggtcggtttgtgtatttaatatttggtaggtagagccaaataatgttccaagaagtctggaccatgcacttctattgatggcccactcttttgccaacaccagatatgaacaatccttttaaggtttttccaatataatgggggaaaaaatctcatttttatttttattttgcaaattacaggtgaggtttcataaattttcacatgggtgtgtttttaagatctcatatagcctttcctttgacttttctgttgaagccctctttcttgctgatagattgtctgaattaggagtattaattttgtctgttataaatattgcaatgattttctccacgcttgtcatctttcaactgtggttccaatgtcttttgccacactaaagtttaaaagtatctgtgtgtttaagttggttgttctttaactttacggcttctatgttttatgtttctcttagaaacaacttttgagtaaggttcctgaacaaataataactttctatccagatcacataattaatgcatgtttggtgtttgaaacaaaatagaaagtacataaaagcacttgtcatactgaaacccccactagttgcaccattcagaatgtaattttccataagaccatggggtagatgccattattatcctcattttataaatgaagaaactgagacaaataaaatgttgagcaacttgcttacattcacccagtaagtaagtggcagagccagggctctagtcccaggaatctccttgtgaagtccaagctcttgcctacctaccatgccacgctgccttgcacccatgtgtaatatccagtgtcaacattttggtgtttctgtggccagtcttgcttttcttttacaaaactgattcaaaactctatattatgctttgtaacctgtgttccaagaacctgtgttctcacttaatataccttgagtatatgtctggtcatgattcttctataatatcagatttaatggctgtgtagttttctttccagtgcttatacaataatttattgaactgaggaattccctatttttacacatgtaaatcacttctgagtttttactattataaataaggctgaaataaacattcttgaaaataaatatttgtgaattctggttatttagggaaagttctagatgtgtgatggccaggctaaaggcttctaacccacatttccaaatttccttctagaaagtttgtcccaatttccccttacaccatgagtgaaggagtcagctacttctcatgactctctcctgcaccaggcattaactttcacaaaccactccctattgttttaatttgcatttaattgattactactgctgttaaacatttatttttcgtatgactttcggttcttttttatctcataaattgtacgttcatgctctttgatcattttgtgatctttgccttttatttataaaagctctttatatattaagaaaaagtatttattaactgtaatagggtataaccatactcccagtttatcattcacatttttattttgcttgcaatgatttttgatgcacaagttttaaggttttatgtactcaaatcccctaatctttttctttataatttcctctgttgctgttatacttcgcacaagttccccttcttgaaattgaataaatttccacctgcattttcttctaatcctttcacagtttcattttttttaaacttaactctttaatccatctggaatttattttggtgtgtaatgtggaataaggatctgctattgtactttttccagggagttaaccagcatcaattattgaatggtatttccttgggtgatttgaaatatcacctctattacatactaaatttgtatgcattagcattctttttctgggtcctctatcttactttactgatctaactggtatcacaatattttaatcatgtggctttataataatacttttgatatctggctatgtaaatccaaagtaggatattttaaaattctccaaatcacaatatattagcagtggcctagtttggtttcgttctagaaaggtgtcagaaagttgaaagagccatagaaagatcttttggtaactaagtggtgatggaccagagaggtgagtcctaccaagactggatccttaaaccatctgatctgctgtgagcatcttggggagatctcatggaaatcaggaggaattgaggatggctgtactgatggttcagaattagtaaatctaggcaagacccagcaagcagaaatggaaactgcactcacatacctaggggaagacttgcgaagagtcaataacttatgcatacagcacaagtgacaagatttcactccaggaagtgcaacaaagatggtatggaatatagattctatgatgctggtaaacatttcatagttgtgtttgctgggctggaaaatggtgcttacttatttacaaggccatgcatgattcacaaacctcctctactaggtgggttacaggtcaaggtcttttgctgaatgacccattcagtgggccagcagactttcaaagagaaaaataatctaaggcacccacaagcctcagagtgggtgtgaatttcattgtcagtctccacagagagtagcacaggatcagtgctgggggggatgtgagcgggaagttgaggacagcagaaggaattggatttacacttctcttgcagattttcattttgttttgtctcccctccatgcggccttatgccccaagtaggtaacagtcacctttctctctcagctatttctcctttccctctctacactttccccaatatggcagctagctaactgagcaggcggggagttgtgggagtccaccctccaactctaaaatattggggtggttctcctttttcccccacaacaagctctgagagcacctagttgctgaccaggacatccctaatactaacccgtcttccctcccctgttcctcctgtgttgcatgcagcttcacttactgttctgcagggatgtaaccatccactaaagggctgcactccacgccagcaaccttgacatgggaggcgatgtcgcgaaattccaggcccaggttctcccctcggatagtgaccttggtgcccccttcccgggggcctgtcaccgggattatctggagggaggaagagaaataattagacaaacaccaagatactgccactcacttgctgatgaggcaaggagaggctgctggctcttgtctcatctgccccagagtccctgagtggcttgaagtcaccaagggcacccaaagcctgcggtaatcaatgggtagtagcttctaggaaagcagtccatgtttgtgtgtgtcactaggagcagtatgcaaagcccatggtacatctttccatttcatagaagagatgagaggatggaacatgaccagcaatgctaccgggtgattcgtagaaaattgggattcatgccttctagcatttgcttgtgttggttctactctcaaggaaaataaaaacccctcctatccattcagagccccctacacctatgtgaccctacccacctctcaagatccttctcaaatgacactgccccataaccctgtgttcttcttctctctccatttaaattccaaggtaccttctttgtgccacttacatggcaacaattctttgtgcctgttcttcatccttcccactcccagccccctcctcctccgatcctgagtctctgagagcaggtctgtctccctccttgtgggcttttcagtaaccatctttatgtcttgcgttgtcatgtgataaaacctacaactgtccaaacatctttccggaattactatgagcatttgtcacaactcctttgccgttgttgtttggcctggtaccacatagatttaggtttaatttaaattttaccctcgtacacaggtcaaagtgtactggctttccctcctaaatcagtgtcaaaaacccatgattaaaatgtgaggactcagcatccaagtgcctgctttgaggtgagggctgtacagttaacacaatctcatcctggcgtttcatggaccagagaagggcatgcttccattcctggtgcctatgagcaccagcacctggaccttagccaatgtcagcaggattagaatggaaggagcccagagagtccatctctaccccttttcagcatatccaactctcctcaaccctgcagggccacaagtgggaattccatcctggggtaagggtgaaagatgggggaagcagaaggaactaggctgtgctgccctccccaccaagtggcagcttctccaggtgagactgcttacctgccacagtcaagctacctcccacctcctacacatccccgtgagggttggtgtgattgtgagtgagcgtgtgcaggggtgtgagcctgtgcataagtatattcccattgcagtggaaaaacagcttccctggagacacaggcccatttctatgagagggaggtggacagatgtggggaaggtcagagggagagtctgtgttcttcccaaatgcctgcctagccagtccccaaagtgccactggcatctggcagcagtgtctccatgatattctagccctggcttgtcatactgaaaaaggagttttatctctggcccactccttcgtttcccaggttcccctagggccaacaccagtatggaggcagtaaatagcctttgtcacagggagatatgtttaatttgccgtctcctccctgtgattttcttggacataggccaagaagaaagcaagtcccactgatggcaccagacacactgccatgcgcagcagccccctgggttggtttcttgttgagggctctgggaggagccgttccacagagcaggtgtgaaggtgagcggtggggactgggaagggaggacatgggcccaggtatggggtcaggggcagtgaggagagaagaggtccacctgtcctcctattccagatcattctgtaggttaattctgcaaatatttcctccaagtctgagaatcactgtttagattcctaccatgcaaaagactgaagtggggactgagagaaactctcagagcctgtatagccaggaatgtggaagataaagggtctgaagcatggggcacatgttgagggccaccccaaggggctgctttgctgggtgaggcccacaaaagcccacacacaaatgtgtaggaggcccacaaaagccaagaatcttcttgctttcacacatccctggtgcacgtgcacaatttgtgagtgggggtatgaagtctcaccattgtagtggaggagaacaataacctaggagaacattactcaggagatctgggattcaggaccatgttactgacactttggttagagtatgtgtgcctctctgagcattagcctctgtctggaagagaataataacctgatgataaccctggccttgggagacattatgggtttgaattgtgtttccatcaaagtcacagggtgaagttctaaccccagtgtctcagaatgtgtccttatttgaagacagggtctttggagaggcaatcaaatttgaaggagaccattaggatgggctttggtacaatatgatctaatgaaaaagaaatttggccacagaggaatgcacaaagagaagatgatgggaagctacacagggagaagatggccatctccgagtcaaggagagggatggggaacagatgcttccctcacagccctcaggaggaaccgaccctgccaacaccttgatcttgaccgtctacctcctgaacggcaggacgatccatttctgtcgtgcaagctgcctagtctgcagtaccttgtgacggcagccctgggaccctaatagaacaggtagttgtttggactgacaaggtaaggggtgtaaaggtgtggtgcaactattaggcatcacacaaatatatggcctatgactgtgcctgccactgttaagtgatcatatactgtgtgcatttgtgaaactgtgcacaaagcccggtaccagttcgtcctcactgttcactgaggcagagactgagtctctgtcttctctccttctccctcttcctgctgcttcataatcctgaccagcatccgcagtggtaaagaggtattgagcacctactgtgtgctcagccctgagctggaggcacagatgccatggtgccacagatgacatggtgccatgggggaggagcatgtggagagagagatgcagccctcttttttattttaagagggagcaagggactccagccttgctggaagagtgcaggagtgggaggagaagagacaggactacttaaatgaactccaggggcagtgatttccttggcttagacatccctgggaatgattttaccaatgatgatgagtgaggaggctggtgagatccccatgagctgggcccagagcaaggtaccttgcctgtaggtgcgtgtgaaatccttccagctcccatgtgagagggacgctcaggcccaccgcacatgtgaggaaggtgaggtgtggagatactggtgatttagccccaaggtactcagcaaacagctggtggagcctggattcaaaccctattctctgggacccagtgtctgcgtgtttggctcttcaccgtgttcctcccccaggtctttgctccatggcctgtgtccctttggtccccctaaactgtgctccatcttacagctcagggcttgctttgggggagttcaaagacctctctgttgtgaccttcttcacctccccagagccaggctgtgccccaacacccatgccacctccaatcacgggttgacacttggtgaggatgccaaaggtggaacttcaggccttgccaccgaggctcttagagacaaaggaaggggctggcgaggactgagtcctttttgacacagctcctcagagactccaacaggacagttgggcccctcattgaggatagtcgagccccaaaaagagtctctgatccaagcctaagcttctggggaagccgtgaagaaaaactagggtgccatccagccaggcagagcaaccaagtccacccagtgactactgggtgaccgacaccacggctgggcagagtttccacagggtgtggcacagcagcctggagcctgcccatttggagcaggaggcccgaccccggcttacctctgtgatgcgggggtttgtgcacttgcttttggcaccagacagctccagccactggctctcctgggcagggcagtgctggcgcagggtgcactggcctgggccctggcaccagccacatgcgaagtctgggtcagccttgaggcacagcccgcagctctcacgcatggctccacacttgtagaggtgaactgcagaggggaagggcaaggacaaggggtgcttgggaatggcagtggggacagaaggggcccagagagagacaaagagtgcagtgccagcctggggtgatggggcacaaaggcagttttgcccccttagccattctgatgcaaaaaagaacctgaaagaaagtccaggcctgagcagagggactgaaatgggaagctctggggttctccgttcactcagcactcagcagcccttcccaggaagtcctctgcacaccacctcctaccagaagccctcagcccaggtcaagctctacagagcccatgctcaagaagtaacctagaagcacagatggtggagaggctgtgaaggaggggctcagagggagagggacagccactaggaggcgggggcagaatgactcccgcgagaatgcaggacggctccttccctctctaccccatcccttcccctccctcccctgctaggccccagcccttccacacctttattctgagctgggttgtcaatgttgaagtgcccattccacacgactgtcaactccacgggcaggttgttgatctccatcccttcataggaatactgcagccaggtcggggaggaggaaagaagaaagtggggtcacagagagttctagagagggcccaaatgatcagcctacggccgttaagagctcacaggctaaagactggccaagactgtgcttgtgtgcatgtgtctacctgtgtgcatacaagtatgcacatgcacatgtgtgtacaggcagggaagtgcatatcagagggggtggaagataacacaggggtgggccaggcctccaagcatgcccctgtggatgccagctcaaggagcagatgggagcaagccactaggtcatctcctgtgggtctcaggcaggaggcctgctcccatcccctggaatttcctgagaggtaaaaccgagggaggagtccacttcctctctggctgcccagggaaaccctggtccctaggccctcccaagtctgcaattagattggggaactctaatttccaggaaatgtccagggtaggtggatgctttaccaaagacctggggaggggtgatcacttcccaggcagggcggtggttgcagagactaagaaatgaaggagctacaccctagggggatgagaggctgggggttaagagagaagaggactagatgggagcttgttggtgacgggggaaatcctgaggaccttggaggacaaatctggaaatctgggcctggatgctgcagacagtcaccagctcaaagccaggctcacgcccagattcctgttgtgctcctgtcctcggagggctcctcagggtcctgctcccctacctggctgagagataggaggtggagggtggagagaagagggaggtgctggcttgaagatgatggtggagggggcagtccccaggcatgatggcccctagtctgccttcccatagcagacccctctcagtctccagagaaagagggttagcagagggaacttagagcccaccctgggcagcaatttccaacccctacctggtgattttctcattattccagccgactctgctcgccacaaggggcaggatggaagaatggaattgagacagattttctgcatgggaggggctgaggcctggcaatttgttgaacgaagttagtccagaggaccaggtttgaagctgtgtttgcaggacctacaggctgttttaattcaaatttaatttgaattaaaaatttggagggctgggctagggggatgttgatggatatcacaggaggccactgaggctccgtcctccaagttggccatggcaccttcatggacagggagggtggccacaggacatgggaaaacacatctgggaagaatctcagagggctactgcctctgggcagggacaggtctgcaccctatttgtaggagcttctaaaggagatgttctaatcttcgatgcagaaaattgccctaaattcctgagttacggaatgtgctcccatgagaacagactgtgacttgacattgccctcatacagcaaccacggggggatgtacctccagccactcctggctctgccctagcatccagagttctaacttcctccctggcaacgcgtgccagggccagagagctaggttcggtgtttgtcccacaacggaggagtttgcaacgtacccccgtcgttgaatctctcgtttgaccaatggcacccgggccaaggccagggtccgagctcacagagtaaagcaaagtttcctagccctgcagaaaccacagtggaaactttgatcatcatagaactcaatcatcacctccccagaggttgtctctgcagctgggtcaggctgggtggtcctaagttgtcctgaaaacctcttccactttagactggtggctcttagagtggtctatggattccttcagcagaatcacccggggggcctactaaaatgcagattccagggcccatcccagatctgccggactggaatctctaaagatgaggagcattttgagagctactctgtgattccggtgctggttaaagttagagaatccctgcagtctattagaagtagggaggcagatgactgccccagtggagggagaagggtataagagagggatgccctccttccttgtgtgtgtttgtgtgtttgtgtgtgtgtgagagagagagagagagagaacttccaggcttccagttccctcctccagccacattcaatttcttcccatccttcccatctctctccttgaaagtcccagtggggaaaggtgatctcaccaggcttcaagctgctgcctggatggctctgagcagggctggctgtttcaccccaagctgagcaccatctgatcacctagaggcagtgctggggcaggctgagctctgacctgtaggagggatgctgacagtggctatgtcaagatgggagcctggcttctgctctcaggcctaggtctggccaagacacaaagtagaagcagcaggtggtgaccaggagtgttagtcaaaaatcaataaatcctcatgccccctctcaggaaggacctgacatcccacagaaaggaaggcaaagaatcctacatacatatgcatgtgagcatctgtgtactcaaacgtgtttatgtgcatgctgacttgaggagacgttagcacacatctccatgttatctgtatgtccataagtgcacacacacgcatagacacacagacacacacagttccacaaagtggttctgccagtgaccagctgtgtgaaatgagcagataatccaagtcttagtttccccattggtaaagtgggaattcaaagcagtacacatctccttggattggcataaggattcaagatcatgcacagcatgctccgagcatagtatctgtcatatagtctaagcgctcaaatgtgattgcgtattttagtctatgtgcatgcagttggggatgctatgcaaaactatattcgtgttgcctatgtttatgtttgtgcagaaaaataatagcagccatgcattgagtgtttctgtgccagacccttaatatgtatggggatgtatacatatgagaacgcttatgttttctggtgtgtgtgtgtgtgtgtgtgtgtgtgtgtgtgtgcgcatgtgtgcaagcataaattttctctttgaagaaattgaaaataaaaaagacattaggatcacatgtgctgggcatttctttctctttctctcccccaatcctgggatctaatgactattagagaaatcgttaaccccatgtgctccccctcagccccgctctgtctctagggaagtttccattgttcctggaggctctctctcctgtggatgacctgcaacgtgcctggggcagggtaggggaaaggggtgggcatggcagatggagcctctctgcctctgcagacagctgggagcctggaccacgggctcccgtcccccaggatcgccctatctccactccacttagcatttatatagctctctgtaatcagcaggcagttaatctgcacaaagctcagagcccagggaggacaggctccaggctcctggaggccgggaggttaagtgtctcaatcaaggtctggcacaccatgcggggctaatggatgactttccccattaccttgggaaagtgtgaacctcagcttctacttctaaagcaaaaatgagacctcgatataactgagacattctttcctccagccagtcccttgtcccaagatctgagatattttgccggaaagttctgccatttgggcaaacaaatctcaacaacctaatgccacacaagaagctggtatgtacactgtgtccatctctagtccagagggctctgctgaccccttttcagccatgtcccagtaaagtagaaaggggacaagttctcttcctattgcttccctatccctgttttgcacgtggtaaatgacggtgccaagagaaaaccagaggccagcatgagtccgcggaagctgggcctggccccggccctcacgaccagcacttcagccagccagatgccctttgcagccccctcactggcatgattggcagcctccgagagctggtggccacgcactattattagcagcacttgacattttcctagagcattggtctaaagtaggccatgaatacccacagttgcttcccctccactgctgcctgtgagtctgccctgtcctcctcccaccagctcctgggggctgcagccattggctcaaggcctgtccccgcataatggggttggaaatggctccaccaccccaacccagtgtcactcccacactgaattttcttcttttttctctgctctcctttgagaccaatttatcacccacctccttctgccatcacaaactcatggatttctttgttagatcccttgtccaaggctgtttccaattgttcatggatttaggaaatgaaaaaatttgtccttccacacaatcctctttgaggctgatcagactgtactcccaggaataacaccaaagctggggtagaaagtgcccttcgctgctgttctttgctcaacctttgattaggggatgtgttatgaaactggattcaagttctgaatttgtgccttacttgctgtgtgatctggagatggtcacttgccctctctgggccttggagacctcatctgtaacaggattaagtagataccctctcaggtctattcttgtctgatggtaccctgttttctgtaactatggtgggggtgggttgccccgatcatgaccccaaagatatttgatggaaattgcttgatggtaagaagcaacctgacccagaccagcatttaaactgggattccactgccccccatgaaaagagaggctcccaggaaatgtcagagctgagccctcctgaaccatgtgattccagtgtgtcctagtaagcaaagggctgcattctactgtctgaggggcacaccttctgttgcctcagtttctttcttagactttaaaatggtagagaaatcacctctcctacaactaatggtgtcaaaattaaaaagtcatggaggcaaagtcagctgagctgctttggaagcagtgacctggggggcacccagacctggcccatggtggatggagaggctgcagctctgaactccagagggccagagcgcagcaggagccctcctcaggtcctgagttgggggcagggcatgagccaggagcttcaacatcaggttctcttcttggtgaagggagccgcagcttccaggcctccagctccaatgccaacaggggctggaagtagaaatgaccactgtgtcctgggacatcaggcttccagatgtgaaattcccaggggaggagctatgtcacttgctgatttcttgaggtccaaggattcaacacccgacagacagactgtgcgcacactggagcccagccgttcccttccttttcccatgggtgccgaccatggtgccagctccaggtaccccatggggacaccatgaaggaggagacagcacccacctgcctggtgctgcggagaccctgtttgtgctcttgttcccaggaggctctgatttcacacccacgttcggggagttccctgtgatggctaaggactcatttggtcaggcagctctcggcctgggaaatgctgaggacatttcaacacaatctacttccaattctggcagtcaatagaatggcagagggtcccagcgagcttcttggaagctaaagttagtccccagggcacaagggatcttctgaccaagaggtttagaagactaactcatgctgttgtctggagtatctttgtctattaacggagtcaaccaaaggccaggccatggggcccagttttatgacactagtgtccctctcttgggcacagccatctgaggcccacaggctctatccaccctcctgacatccccagatccttgggtcagcttctctcaagaaacaaggctgttttccccacagcttcagatcctcaccagccttctgcagagtcaaatgtgagacccagatgcaggtctctttctatagggagggtcttgttttggagagaatgacttgagccaaacccttggggctgatctgcttgaactcagaatttatggggaaacaggaggtgtttcatatctcctttgcttgcaggtttaatctggagtgctgcagaaatctgagaaatagcctggcagccaggggaggagggggatgggcacacaggatgccatggggacaacttctggggtttcagaggttgtgagagcagtgaccagttctatccctgtaatgctgagtgacctagggcaagtgtgtgggcctctctgagctccatttccccctggactacttcctgcaggaagagtagagtgtcccacgaaatcctttgtctgggactctcctggtcgcacatcacatctccaaatacagacattgcacataagtgcccaggtgcaactagaagaatacataggaagcagtgtgacataggaggggtcctcaaatccagaccacctctgccactcactagttgtgtgaccttgagcaagtcacttaccttctggcacattttggggtgcattacaccaaagtgaatagagctcagcttctgggcctacacttgcacactcagccccttctaaggcctatgtatctaagttgtacttattatattttggtcttaaagaaggtctccaaatggtatgtctcaccccacaaatctagatctgcccctgcttccaggcctctactttctcttttgtgcagtgaagaaaaactttaaagttcctatgacttgaaaatgttctgaatctatgtgtctagtgtttgtctctgagcatctgggcacaaagaagggagcccagaaagaaagagagagaccagagcagtagctggaaaggcaacatggcaggtgcgaagggaagtcaggaaaggtgatacacaggtggggttcactgtggggtacctaggaattaggtagacagctgtcggcagcctgggggctgctgactactcattgatagggcttgggcttaatgtggatttgccacacattgggcagggtttgcgctgatctaagcagcgctctcctagccagctccttcccatttgttatttcctcctgccaatgcttggtctgtctcagaagccttctctgctgagaaacagcctctatgtaggtgtgaaggtggtgggatgtctttggggcttgttgagaaggcagggcgcagggctttcagagcttctcaggaaagaggatggacatgaaggtacctggagcccagcgtctgcccataaacagggctcacagctccacggctggtccaatatcccttctaatcctgtcttacacggacaaccttcatcacaaaacatttacaactagggccaggccctgggtgacctcagaacccagcacgctgctggggcaggtgttgtggggctgggatgtgccagcaggcatgggggaagcaggtaggcagttttgtgcgtgttgaggaaacgactgcagggctgagctgatttggctcctagaagacaacagtgatgtgggtgggactggggcctggtttggcagtgggcagggttgggcgactcacagaggtgttctggcactgtacgctggagctgttgaagcgcagggcgggcactcgctgctcgctgccctgaatgttgaggatgcattcgtagccacgctgcccagactggggctgggggaggttcttggccttcagcgtgataggcttgatcacctccacgggcaccaggatcttgtccactcgcagcagctgggggcagtcctggggacagagggcatggctcaggctgggcagccaggaaaccaaatgagcaaggacctctgcagacataacccggatgttccctgtctccacccttccatggacacacccacaggcgacccctgaggtgctcgtgcccacccagtgggcaatgcactgaggacagaaatgaaactgaggaatccgaagtcctagtgtcatatcttgaggtggtccccaccctctttgggttccatgaaaaccttccctatgcaatctggattctctgacactcctgtagcctcctcctggcacccttctaccctagtagagactgcctctgcgggctaggcctcccctcccactggggactgatgatttctttgcctgctaagttccaggctgtcaagaattgggatgcacagaccatgtgagaagctccgcagagaggcaaagccctgggccctgttctgcccctggaatgtgagtcttgactgccgcagggaggctgggagggccttccctaaatgggctgaatctgatgtttgagaatgttctggaatgggccccagaggcctcataaatccagaaagcttctgaccaagctctaggatgtcctggccccaaagaaatgcctctcagagtagaaacactctgagctctttctggatgctagcaatgggcacacttagccctggagccacaggagcccagatggcctttgggatggagacagtgaatcactgggcccctttttcctggggctatcagctttgtccagggagggctggggacataaggaggtcagaagaaggagggtgggtgctctgcccagttgagtggtaggagctggtgtgttgctgtattctcaggagctgtgtggaggagagtcagtattctagctcttgctgatggatgtgggcaggcgtgaagccttccataacacaagcatggcctgggcatcccctgtgccaggcaggtcccaccatcccccagattcctccatctgtggcactgtctggggcatgccaagacagatggctcctgggcaggttgatcatcaaaagcatgacgcacgtgttctttctgatggtgctttgtcatgggctcaccaccaactctcagcagaggcttctcaccccgcaccttaacacttgtcctcagcagagtaaggcagaaaggaagccactgggaaatggtggaagggaggggttctaggcagttaggcaactggcagctgtccctcccaggtcccagagcaaacatgagccaaatatctccctgtgccattgcgagttacaccataacaagacttaggctcagagggagaaggcttgaactaactctagtacccgtgagctgctgatgagctctggaactctgagcacatcacagcccatttgaaactcaatttccttatctatcagttgagtgggactccaaggccctaaccatcttaactcatcatgattccatgatttggagtggttgttctctccatcctttctgatcatccaaccagaaaagaggagggaaagagaggcaggggaaatggaagcaagaaagggagagagaaagctataagggaagctaggagacagagaggaagctggaggagcaagaccatggtccacagatggaccagcagtggagccttgtttcatgggagtgccccaggcccattaaactaatccctcctcccacacccctacaggctgctcacacctttatcctgaagggcagctgaaagaggagccgcagatccagaaattccactcctgggtttacgtgcccagaggaactgaaaacaaggactcagaaatctgcacacccatgttcacaacagcatcattcacaacagccaaaaggtagaagcaacccaggtgttcactgaggaatgaatgggtaaacaaaatgtggcctattcatacaatggaatattactcagccttaaaaagggaggaaactctgctataacatggatgaaccttggggacattatgctcagtgaaataagccagccacaaaatggcaaatactgcagggttccacttgtgggaggtcccttgagcagtcaaattcatagagacagaaagtagaatggtgatgtctaaggggaggcaggatgggtagttgtttgatgggaacagagcctcagttggggatggtggtgacagctgtacaacaatgtgaaatgtacttaacgccactgaactatatccttaaaaccggttcagatggtaaatgttatgatatgtgtattttgccacaattataaaacaatgaagaggagcagcaggcaggcgggccagcaggaagagaacaggggccttggtcttggccttcaccttgcatgtggtctgaggctctacagtgtgtgggtctctggagacgccagtagccacttggggagagtcttagcagctccatcctgtgccccccaccacagccgctactctagcaaggtgggaatgtggcacacagaggaaagaagcgatttgtgaaaatgatggagctcagaactggggcgggaggagagtgatgttggcagctcgaggagagcagatccttgagaatggggttgctgtgagtccaggctccactagactccaccctccctctgcctgagccctgggcagctttccctcccctgaagcagcaaggagcctgactgtctctcctgccacagtccctggagggaatcagatctggtcgcactgggagtgagagccaggaggccctggaatctcttcccaccacctcccgccatccacatgttgccactgagaaatgaggccctgagggtatgggaatctcagaatcctctgactaccctcatggaccccatctattttgcaaaggagaaactgaggcaaggagagcagaaagaagggctcagtatcagcagatgagctggtagctgaagaactcagatgccaactgcctgagtcaccaagtttctgcccttcatgaaacaggagagttcccaccagtgggcaggaccacctcaggatgggctggtcagtcagcaggggtccccctgaagtccaggggactcggagctgtgaaaccctccggagctgggctggaaccctgcctgggggctggactgttcttgtccaagacatggggagcagcaaaacctgtctcccacgtcccctgtaagattcttagtgaggcttgtgatgagttctctaatgagtcctgattatcggtagccccataaaggcctagtttgcatataaaaaggttggcagctctgagagtaagttcattaataataactggagaggcccagggctgggctgggcacattttcctctagtggcgctgctgattgaccccagtgtccctcctaattgaaatgtaaaacggcaatttctccctaggcaccaaggcatgaagggaccacttccaccaccctgccccttcctcccaccccagcatcccagatcctgacctgccccgcgctgagattccagatgcaaaatcacctacagatctgacactccagggcaacttcggataaactttcatgttcctccaggatgtgagcccgaggccctgtttcatggcccagggactcagggcacccagacctttatcttcaccttgaaggcttctcacccagcaggagtctggctgggaatcctgtaactgtgagaacaagtctgtctccccactcctcggctagtttcagagtcttgaacaagtgctctcaccattgcttggcttaaccatgactagggactgaaaattcctctcccaaatgaccattttggggattccataaactaacacatataaagcgtctggtccggggtgagtggacattcagcaaatgtttgttctttcctcctctttcctcccaacccaggttgcgtcttgtccctcatctgctccctttttccacctcatttccaaaagacccatctcccttgctcctgcctccatgtaattttctgcaaataccccagcagttcccacccagcttattccactcctctgggcttcacatcttaggataactctgcctaacttaaatagctctaagtgtcccaaacacaagggggactggcagggaggtcccagttctggccactgctccctgaacagcagcctccacttctgggaagtgacattgtaaagttgcatgctccatgtgctatgagacaggagatctgccagccatttggccttgggcaagcccctcaaaccctctgagtctctttattcataaaatgaagggattggtttggattcgatgaattgtgtagtccctggaatattgtgacatcagaaatatatattgggtcttttcctctggctgctggcacggtgcttctaaaacctttggagttttctgaatgattggtggaaaaggagcatcttttgttattcacagcaagcccttttccactatacctgagtttatgttcatgaggtgactcctggaggatgggggtatgttgccagaggatccacacatgtaattagaggatggcacttcagccctctcctctggggaagggagaggggctggtgattgagttcaaccatcagtgggcaatggtttaatcaatcatgcctatgtaaatcagcctccatcaacaccctaagtgaaggggttgggagagcttccctggtggtgaacaggtggcgatgctgacagggtggtgtccagagaggacaaggaagttctatgccccttcccataccttgctgtaggcactgctgcatctggctgtttatctgtatcctttgcaacacccttttaaagaaactagtaaacgtaagtaaatgtttccccgagttttgtgagctgttataacaaattatccaatctgaggaggggattgtgggagcccctgacttataactggtgggtcagaactgcaggtgacaacctcagatttgcaattggcatctgaagtggagacagtcttttgggactcagccctttaacttgtgagatccaatgctcactctgggcaggtagtgtcagaaatgaattgagttctaggctacccaagtggtttctgcagaggattggagaattgcttggtgtagaaaaaagccccacgcatttgctattgtgttaagcatagagaagaacggtttgttttccttttagtcccagttctatccactattaatagctgataatctggaatatataattgtatgatctttttgaagctcagttttcccacctctaaaatggggataataatacctgcaaaactagctcaaaatgtggcattcagcaaaccagtgaatgaatactgaaggcatgggggaggtgggcctccaaggggcggctcttcacctatcagcagggacatgttttaatattttaataattggtacgttgcaacctggtatggttgtccagttgagcaactggctctgataggcagcatgggatactgctgtgattctaattaacatggttaacttggtacaagcattcaattcagtgtccattccactacctccatccccttccacatattttccatgtgctatattgtttcagacacacacacagacacacatgcacaaacacatataagatcactcctatgttctagataaagacactaaggacaccgtttacgtcactctgcccatggcaatgatgagcacagtattttcacccaatcaccgtactgacctttatccacagatgatgatccagcttccacccaaaactcctcaaaaacatactgcccttctcttttgaggcaagccgtatctctgaactatgatttgaaagggccagcttttggaggatggaaaacacctgtatttaataagattctttggagacacatgcatgccaaaagaacccaactccctcggaggctgttttgcctgtggctacattctgcagttctaagaatgcaggggggtgagaagtggcagcagctcgaggcacaagcacacctttaaaggcctggcattcaggaggtgactccagcgagctccaggtcaactgtccagccccatgcacattttggtctccactgaaatgcacacaaaatacaaatcgcactgctaattgcagagggcaggaacacgaagccaaagtataaaagcgagaatgatgactttctatccaccatgtccagcacgttagtgactgctttatacagaggcttcattgcatatttaaataattgaacaaggacataaagaatgcagcctagctgggagagaaaaggctgccttcagggctggtgctgcctacagactggggggataggcccttgaatttatagcccctagtgtgtttacaaaatgagggctttaattctcctattgttacagcaagattggggaaaacagagctctagggaagaacagggacctggggaagctaaggaagaaatgatttgcaggtcacctctcctctgtccaagtcacctcagccttcatcagtcccaaagacaagccagccctaaccccaaccaaccctccaaatttatactcaccttctcagaaccacagtgcccaatacaaaaatgtaacgcatcatatattttcttgctgttccccaagtttataatgtcattagtgtgatctatgacaggctggttcatagagagagcaaagtaataatataaaaaggaaatacccataacctgaagtggggaggggcaggcaagattgatggaaagtgcagttgtctggaggaatggcaacccagtaattgaatacctggagtgggggtggtgcatgggtggggagcgtgttctgtagctggatttgcttttttttttttttttttttttttttttttcacagcagggtgaaaggcatggcaggggtggtttggttcccttgggttggatcccaggaatgccttccctgcaagaagggaagcagaattgctgacaaagtaggttggtgatttccctccagagtccagtcggtgggtcaatgcccttggtctgctcctgtctcagggcatggggcttatttcagcaccaggggcaagcggcagcccatgagctaggactttctcggccttgccggctcttcagtcctggagaggacttgatccttttgataacggatttcatcctggctctgaatttcttttcaggggtgttggggtattaggggatgttgggagaagctttcaaacacagctttgcaaatcaaatagaattcattttgcctcctctgatcttacaactattctctggagtaggcaggctggttgaacttcaagagaagaggcgttcctgagagcctccttggtgagcttgcacacctgggggccagatgtgctttgccctccttgcaaagcctctctagtctggtgcccagagaatacagcttcagcagcagctcactttgcttttcagtttagatgagaaaaaacagcaaaatagtccatcaaggacaaattcttgccaatggatttgcttttgcaaggaagttcacctttgttcctcaagcatcatctttaagtgtgaatgcctgatgggaggtccaggttggcctgtggaggagctggggatggattccaaaaccacctggggaccagtggctgctcctgctcagtagaggggtgggcatggctttgttaatggctacccaaggctctggcagctgatctgaaggcccagggctgttatcataatgccatcattagttgaaacaaaatcattctttgtaactggaatatagttactataaacaacatatgttattgggcattctatttctaataattgtaattatggtagaatacttgccattaatataataacaacaatgattgaccagttctctgttccagtccaataacttcacctgaacgcattctttgttcaggaaaaaaaaaaggtaattcaatatccctgatagtcaacaaagctactgttgaaatggaagacgcacagatgaaagcattcctgagatgcaagatggtgccgggtagatgaaaagccacctgtcagcctcactgttagctaacaaaaggacactgtctgcatcccctcactcaaagggtaaaaggaaatgaaaaccccagagatttgcagaagagtcaccagggcctgggtataccttcattccaagagagtgggccttgggctggacgttcagtggaactgcaggccctgagggtatgggtcaccctgttaggtaaaggtggtcgacctaagccttgacttgacactcactctataatcgccagcccccctgaccactttttgggcatggatttatcttgggggctttccagctgctttctacttacaatgacagaactttagagatgatgtagaccaaaggcctcattttacagatctctaaacacagatctccatagatcttcttcacctttaaacctctcacaatgccttgagtatggttgaaatgcttagggtaatgaagaatgaagagttaaatcataacaaaacttcagattatcgtgctgtgagtaagctcttcccctagagtggtgacaggacataggtgtctgggggcttccacaaaatcaccttttaattgggtagtttttttttaccccctactcctgctactatatcttcccagaaaaatatacagtaatgttccacagagggatgtttcagtcaatgacaaactatatatatagagcagaagtctcataagattataatattgtgtttttaccatgctttttctatgttcagatgtgtttagatacccaaatacttcccatcgtgttataattggctgcagtattcagtacagttacctgctgtacaggtgtgtagcctaggggcaataggctatgccatatagcctaggtgtgcagtaagctacagcacataggtctgcataagtacaccctatgatgttcgcacaatgacaaaattgcctaatgacacatttctcagagggcatccccaacaataagcagcccatgactgtatattgctaaaataagtacatatagaatgtaaaaatatagcaagcaaaacaaaacaacaacataaaaaaatcctcatatttacactagcagccaggaactgtcttttgagttctgaggacaatgacctcctttcactgaccccaaatggctggagtcagtcagtagtccacacatacttctttacttgtttcctctttgccacattcactaggaagatgctacaacaaccatcgccaggtggccaactctggttcacctctatgctcacattcaaaatggccctgggattgagctgggtagaatgcagcctccaaacctagaccagaagctccccattagagcttccttttcttagaataaataaacatccaaggtaaagaggagccaaaatgtattccatgtgataagggaggcatgggcgattccaaactaccccagagcccctccctgccatggcctgccaggctcaccatactatggctcatgggaaatggagaggatttcagtatggcagcaagagcttagtacatacagctccatatccttctctcggccatttcctccagactaattcctttctccggggccctggcatcccatcctctgagatgctgtgaatccccagcagtctttgcttgtgtcaggtatagaggggtttcccacctggcttggagtctgggtgcttgaagccatcattcttctaaagggatctctgcattgccctgggacacatggtgggctcttattttattcttttttttttttttttttttgagacaggatcttgctctgttgcccaggctagagtgtagtggcttgctcatggctcactgcagcctcaatctcccaggctcaagcaatcctcccatctcagcctctcaagtagctgggactacagacaggcatcgccatgcccagcttacttacttacttacttacttttattttttgtagaaaaataaaaatatttttctattggggagagtttactatgttgtcctgactggtcttgaactcctggactcaagtgatcctcccaccttggcctgccaaagtgctggtactaccacgcctggccttattttattcccttctggttctttttccctctttctgagcaacagaaggaggctcctcttctatacttaaaagaaagaaatttggtacaagaagagcaaacaagaaagaaaaagcagaaatgcaaaagcttcttgcaaggtaattaaatgattagaggccttcaaaatccaccagctagctcaattgtttttgctttcagtttactcttgggcctctccgcacatagaacctctgccagatatggcagtctggaaagctggagagaagctgaggaccactttgtctcaactcccatcaagttatttgcaggtttcagaccagaacaagaaaaggattcttctcacatccctgtccccagccttggtaggtcaaccagtccttctgctcctgaaaccacaccctgagacaggcctggccaggctgatgagactgtgcagccttttatcaaggacatgcccttgctgtctgactcacctcattcttattacctttatatccatgttgtctttgttaaagtagagaactgacacataagtatgagattcacactcttacataaaatccaagatgcaaccactctcctccctttccctataaagggacaatctcagccagggtctcttttcctgactgtgaatccatagtagctatttccaggcatgaacagattcccacagagagggagttggttttgtgtctgaggcttccataatctcttcttttttctgtctgaaacttgcaaggaacttcatgggagctgagacaaaggttttcagcctctctccagctttccagactagtgtatctagcaaaggttttatctagcaaggaggtccaagaataaaatgcaatcaaaacatttgagctatgtggaggcttccaaaggccccaagtcatttcattatcttaatgaaggttttcaaatttctactctttctttcttgtttgctccccttgtctgttactcaatcaggatcatcctctctccagacaacatctccactccttgcttttacttctaaaatcaatcaccctgcttactgtccacctgtagaactcctgctcagccatcaggattcgggcaaaacgggatttgggccgggattttctgatggctaagcacagtgcagtcactacccaccgtgctatgggagcccccatgcagcaggtgttagtgtggggtgtacattgaccttccctttcagcctcatataataaacagcttctctcctcccatgagggtttggccaaaggtaggattcttagtggggtatgagtctgggatggggagggcacttgatgggcctgtgtgttctctcaatgcccctcctgcccccctccccccaccaaatcccctatgcttcctgcacctggacaggtcccttctctcacagctgtggggctggccacatggtcatgacacctgtgtggtgtgttaaaggggtctgaaagatacacgcaagactaggggttgcaggtgaaggtgctggagcctgctgagtccaatattggctgagagagtgcaagaaacactgtcatgtttgaacaacagaattttccagaggtatacctgttatcccagaagtccttgcccacactctgacattccaagacaggtaacagcataggcagaaagtatttttggtacagtgaggatgagtgttcaagaagaataaaaattcagagggaatagaaaagtcacattttagccttagagccaaacagtatctcagcgattcttcaacctggaccgagcatcagagccactgggagggcctgtttaagcccaagttgctgcaccctgcccccggagcttctcattcagttggcctagggtggaacagaagacttcgtgtttctagcaagttctcagctgatgcagattctgctagtcttggaaccacgctttgaaaaccaccgctctagctcacaagctgaccattctttcattctcatctctctcccttttactcagcttgccctctttgggggtctcacttctcctctgtgaacagtgccctgaggaacagctgaggagtctggacacagtcctgctgtgtacttacaattatttctaggacacaccaacacacccatctctttggaatctttctaggacccacctggtgtgtggaggatccttctggttggagtgacctggaatacacctttgtctgtaacagaacctccagggctgatccagaacccacagtcccagcacagagcttggcatatttcctgtttttataaagtggacccttaagagccaggaagaagggggtggtcctgcacagttttcctttggtttctcctcttaagggaatgcctctcttctgtgtcccatgctcacaacaagagacactcaccactctggctgccagggacctacctcgggcagcttcactcggccttcctggaaggagcaggtcttggggtcatgggtgcagacatgccggtatttacaccagtggcagcggtatggactctccacgcaggacaggcacctgggcacaggggaagggaggcacaaatctaagaacctggatgagcccaaagcagagggcttgagtctctatggtctagcaaaacatttttagtattaagagaaaccaccgttgaatgtgcaggaagggcagatcttatgcacatctatccctttactccccaagacctcaggaagctaatggtctctggtttcctccctttcccatatgtagctgacaaccccgttcccccaaggccaaattagccctcctccatctccatgggataacatcctccttttcaaaagagggaatgataaggtctggagcagagggcttgtgtagacagacctaagagttggggcaaacaaaagattaggtttgtatgcaaattgactccgggtctctgctgctgagaagccacctgcaccttgcctcaggaggaagtgactgaggctgctgtctcactacgatggctcctccatggttggcaaccccacctttcccctttaccccaggaaaccaagacaattttataagagctcctgactccttaaaagcccaacatggttcccttttccaaaaactcaaatgcctctccatacaggctatgcccttcacggtatagatgaccactgcccccaacgcaggtttgttgctttggccacgaataggccacactctccccacaagccattcctccctccagagcaccatttcttctgtcctccacctgactacctgcttgaccaaggaagagctggtcaccctgggcccttctcccgtgaatctcttggctgacatctctcggacagtcctggccatcttgtgtcatatctcaccattacctgtccagctcctctactagtctgtaggccatcaactcctggagggtaaggattgagtctttgtgttgcattgatttttgactccactgtgtctaatgagcaacacattcccttgcacatgggagatgcttaaaatcattttatgggcttaatgaaagcttcacacatgatttcacctatttactctgcttccccagaggggaaagtggagggagggattaggccaccgagtggtaaagacagggacagctttgccgcaagaggcaagaggagagtcccagggctagagtaactcatttttggctgggagggccggatgccttcttacttggggccccaaagagagctaagctctagactcacagctgccataagcagatcaatagaccctaaaattccaccagcctagatctctggtcatgtcagctacctatcatgcatggagggcaaaacaggagtatgttaaaacaagcagggttttttgaggtcaggtcccacggtttgctctgtggaactctggggatcccatggagttcctttggagaatgtgtagttttgtggggcttctgtggagaggggttccaggccccccaacctttaatcagaggagctcctgcttccatctattctgtatattgggcatccacacctactttcagtttaagatttctatggtgagaagaaaaaaaaggctggcccattcacaacctggtccaaccccattatttgataaagaaaagataatataataatggcaagaacacatgtggtgcctaaacactgggccagacatggctgtaaatgcttctccttagcatggcccttttaccccttgtggctgtcctgcagggtaggcagagccgatattcagagctagcagccagcacagggtgccagccagtgactgctcagatgggacagtgctcctgccacgtcagttggtaaatatttgtgtgacgcccttggaaggagcactgtgatttccctgttgatagaggacactggggcacagaagggttgagcttctcagctggtccggctacagagccagagcctcggccctccccacctgccactggaagttggatacttaagtcaaacaaagctcgagttggagtcaggcttcctgacccctaagccagagtccgcccccccccacagctttctgcctccctctggcccttaccagcctgtctgcactcagcctgggcagcctgtggggagctgagcatgcaattgagtggttagaccacttgccccaatcctggacacacactggggcttctctccctcctcagttcccttctctgcccatggagcttgctctctgttcttcatgtgggatgcaccaccccacaacagatggtggagatggaattgagttagaaggattgatgtcagggaagatgtatgcgctagggatgtggagagccccactccataagttctcattttctgctcttctagtctctttccattaaccctgtgggtaccagaggagagggagtgagggaggcctcctctggggcttctaaatggtgactccctgtgggtaccagaggagagggagtgaaggaggcctcctctggggcttctaaatggtgactccctgggaatagtgatggggttttctgatctttggatgaaacttgaccccaggaacgggaagtgggtaaggctggggccacttacgaattgtggacgctgcaattgtagaagacaaagctggtgctggcgaaggtcatgccggtctcctttgatttgagctgaagctgtacgacatggtggtcccctacaaggagagatggctgaggggtcagggaatgctgaggccccaagccagggattccctgaccagtgacacctgctggaaaagggagcctgctccccaggcggctgttggcttaacagggctctgactcagcagacccagtcccaggacaaccctgagagcagctgcagagggcagttcttgtctattctccctgcccaccgtatcacttccactcttccatgtgtacacacacagatgcacactgccagggattcaaatgtgcatttgcatgcatgatgtcctgcccagactcacaaaattgattcataaccaggagaaacacatatgtagacttctaggaatctaggaatgctgccacaaactgcgcaagaagttttgcatgtatgtgtgtgtatgcatgagctcattccctgtctctgtaaagagagcccctgttctgacaccacttcctctggggggctcagggctccaccggggcgggagaccctggaatcctcatctggtgccagggaggagctgcagcccatgtttaattcacagccctgaccctaggcccccacttcaagccttgttctttgccttccctgagagcctcattaatcaatcagctctgaacaaatgtgacaagcacaaatgggagggacaacatggaatcaatctgcccaggctgggcctgtccctcaccagcatggagcctctgcccactcctgtctttcccagggcagcttgcccccaacaacaggcagctctggggagacccggtagggcagagttggggaggcagtggtccagggtcagagatcggccatgtgagcatccctgctccagctcagtggcctcctccactgacccgccaagccagtggtgcaggctgaacttaaccacatgttctgctgctgtcctggcctgcccctccccaccctctctgcagctgttccttgcccaggatgagggtgactcttgggggctaacctggggctgagacagaagggctgtaacagtcaatgccaagggcaatggagggagatcccatccccctcttcccataacacacccaccatcccatgccccttcctctgactctctcctgcctgcaggttgctttgatccccccacatctgtcctgagttctccttatctagccaggaggaagaagtgccactcagctgtgcctccgggatgctcaccattctctgtgatgatccggggcacctccttggctgcaggggagtagcactggatctgattgcccacgaccagcccatccatctctgacaggtcctcaaaggtgcagttgacgccagctgacagctccgggacattgtacgtctccaggaccagctgtgaacagccaggcggggggagagaaggaggagggtgaaatgggaaaaggacaggtatggaataaaaaaagaaagtgggagagtgagagagatcacagggaaagcaaagacaagcaagaggcaatattaacatggagaagagactcaggttattaggagagtggcacagaggccgtggtgagatgcaaagagacagagacaaaagaaacctcattaggatggaaatggatttggccccaggaaacaagaatgcttaagggatttgcgtggtgccattttgatcaggactgaggcatggctgatggagcacctcttccattaggcccaattttggaaaaatagaaacaccaaccaccaagtgctcagtgctggaacttggaagtcacctgtgcccctttctctctctgtacatgcatctttcccattttatagttgaagatatcattcccaacaccctttgtcattctttgtcaccctttggtcatttttggtgatggtgctccctgtctttctactctttatgaatagagcctcttccccaatagtcctgtccctgtctccttcttgcatccccccgtagacacttaattctttgatatcctgcacccttctcttgagctgcttctgctggccgggcttggcccagtcctccagaggggccttgggctaaggcactttttagtgaggggagagttttccttgcatccctggaccccaccccaacccccacgacccttaccagcacgttgtactgagagacggagatattgttgggatggaccgtcagccggacacactgcttcatctccgaggcaaacctgcggggctccttggaccgctcacaccgctccttccgggtgcaactgggaaggacataccctcgagttactcaggagatggccgcttggtccagggaggggcggatgctgaggtcaggtgtttccagcagctcccaggatgtgtccaaactcaatgcgcccagagctaacctttttgtgtccttcctcaagcctggtcctcctccatcattcccaaatttagaaaagatggcaatttcaatcacctcttgccaaaggcagaaacttgagagtcatcctaactcccctcatcctctccaaactcacataaggtgttgcacagttctgtctattcaccctctctgcacatccttagcccttgccattctcttctcctccttaggcaaccagagatttgttttcttcatatagaaaatatacctccttggctttgaacatgccagttcttctgctggacttccttttcctcacttctccacctgtccagttcctactttttcttccagccatggctcaagatgcacctgcaatctctcctgcccaccctaggcaaagtgaagagcttcctcctatgatctcatagcacctcggagtctcctactttaataagtctggaatttcttagattgtatgacaattattgggctaagtgcagtcctctcctgccaagtaggagcttttcaaaaaaagcagctatgttccatttattttagaatcccctcatgtaggcaggtgggagagagggaaggaaggatcaaaggagctaagaactgtagttaaaagcttgctctggatcagaatcctggctctaaggtttgctgttactcttcagtgctctgtgctgtgtaaagtgtatggtgtcacaagtggaccatgtccagtgtgacctgggatcttgcagtcctagctgatgaaggtttgtgaaagatgcatgtaaaaaacatggaactctcctgaaatgcaggcatcacttgaggtcactgcatggaggcatctgaatttcagggagcagtatttaatccaagtcaggtgaactttgtggacatggggcttcaccaagtggtcatgatttggaaactctggactacagattctgttgtggggtgggggcaagcagggtcctcaggagggacaagacaagaggagatgagacagcagggaaatcactccagagttgctgatctcttttgattaaagagaaaagattttgcagaggaaggaagatgtcaggagctgttgcagggcaggagagagccccaggcaaggagtttattaggacacagaacagccagggatagggaatctacatggggagggagccttggggagggagccttggagagggaacgactgtctcaggaagcagacaggtgtggtgtggggcaaggagatgagggaagggggtacctggacaccctgagctgctattggggtaactcaggcttagggaaagctatgggggtttctcctcctaacctttggccacagcaagaggggcagcctgggtggagagcctgagaggagaatctagcaaatgaaggagaaatcattgaaggccatggactgaagctgtccctctaaggatgggataaatggaggaacacagggacagaacaaaggacttcagagtagattggatgtgcaatgcgaaagtaaaaaacacccctgaacagtacattcatggctgcgaggtacaagtgcttattaataggcacatgatatggagtttacattgtctagcgtttaagtctcataacaatgctgcaacaaaccccaccttgtcaggatgtgttgggacaaagacgcaccctgcggcctgtagagcctacggagctctacctcctgaagcttccagactgaggagtaaggggcagaccccttgctgcagactaagctggttcttctcgccatcctgatgcccccttcatatccttagggcaattcaaacattttcccctcaatctttctgtctaggctaatcgctatttttgcctggcactgggaagcactttgagtgttattgcaacttgttggacgaagataaattctccagggtgcttctagaaaaccccctcccaggagtgaaggatcaggcatgagtgtggtcacccccgtggcacttccttgctgctccagctgaccgatggcaacaagagcgtctgcctaaaagacttggaagttaatttaccaggccagctcctctgcgaggactccattaccttcagccattaagctaatgttatggacttttccagagtgtctgcactgacatcgctattaatagtgttattactcccattaacagcagacccagagagctggtacgggcttaaattattcactgactccccaactttgaagttcctatttctaagagcaatcagtaggtctgaaaaatgtctttgattaaattatgaagagagcgaaaagcagagctgtttccaggccaaacatcacctggagttaccaaatagagattcagatagaaaagacaggactctatctctcttccaggggtagggaggaagaggtggcacacaggtgtttgctcgggggatctcaggacaaattctacctgcattgcttgctgcttccaaagttcatggggttgcatcttgccactgctcctgaaagccccaaagaaactactcatcatcttcccccaattttaggttttatagggaagccacctgtaatttacaattttaaacatcactgtataatcttgggcaaattacttaacttcttggtgcctcagctttctcatctatacattggggacaaaacagtacctacctaatacggttattatgaggattaaatgagattatgtgagtaaagcattaaggacaggacatagctcatagtaagccctcataaatgttagctagtattatcatcttatcctttctctgacatcctcatttgacctctccaaactgtagctgatgcagaaccacagatttattttattttttatcttatttttagaatgagtgttttttatttttattttttgagacagagtctggctctgtagcccaggctggaatgcagtggcgtaatctcagctctctgcaacctccacctcctgggctcaagccatcctcccacctcagcctcccaagtagctgggactacaggcacacaccgccatgcccaactaacttgtatttttttggtagagatggggtttcaccatgttgcccaggctagtctcaaactcctaagctaaagcaatccactcatctcggcctcctagagtgctgggattacaggcgtgagccaccatgcccagcccagaaccacacatcttctccatgactggcccttggggcaaatcaaagacaaaagaaaggcacggctgcagcagttttcctcctaataaaggagaaggacaacccagaggccaggagggagaaaagagcgaaagaatggtctggatcatagctctgttttcttactagttgtcaaagggtattgagaactcagctatcttagtggaaagtcaagtgtaaggtcagagccagggatgttttgacatttctactatcctccaggattcatgagggtggaggctacaaatgtccaaaagcacagacaattgaccttaaatgtgataggataatggaaggcgaggcacgaattcctgctggtttcttgtggggtctgtcaagggaatggtcttctgcttttctaggactgcaattcccaacagcccagactagatctgggaaccagagcaaaatgttaattcacgacctgagaggcaggggtagtggcttagatgtttcattccaagaggcctcaggtactcctaaagcatgtccctcagctccactgtacaggccccttgacatgaaggaatcccctgcttcatccatttcccaggtaggaaaactagagctgaaaacggattcagacagtgcatatactgtgtgacttggagttttctgacattcttctctgcatgccagtgtcacccccgccccaaatgcaaaccttcagatggccagcaggaagccgaccccaagaggacacaccagacccctagagctggagtccctccctgctaacctcttctgacctctcttcctcattccacttctctgcatttcatcttctccagcctcagatcaaaggtgcaaaaagcccttggggagaaaggctctagggcccctggaaggggttattattcaagccagtggttccaatgagattatcctctctaatgaagcagctacctccgccctcccctaagcctgaactttcactgctggagaattcccagccaagtggaaaattagaagggagaggaatgaaggaaggaagggggtgagggagagggagagaggtggtgattaagtcctctagaaattaattcccaaatacagcgatagaaatattaactcccggtgccgctggccaggcaaacaaatttcaatttggaaacagggctatctgtgagtccagcctgagtgaaccgccaagcttggaggggctgttgctgatccatctccctgggctctctagcatgtgtttaccaggcttaggcatcagaacttgctccctacttctccctgcagatgatccccaatccttaacatttcacatttgccatgacctatgcttaaggtgcaccatctgtgcttagaattgagaagattgaaaaagaaagggggtaaggatgagggccttccccagcagacctaatagaaaagttaagataatttagaatgcctactcacctaggagattattggaagctttggtcattgtcatcacatctggggaccctgacaagggaagagactagaattcctaattcattatccttgtcctccttaagaatgaccacagtaatggatagatgcatatgtgtggcttggaggaagtggagtagctagtataggatccttcctaggcaggtgggtgtgtaagaggtttcttatatgtaggggtagatcagatgagtcctttcaatgttacaattctaggatccaatgactgataccatggtctcaaggaagttgaagtatttgggttgtgccatgtaatacttaggatgaatcccaagataggaagcccaaggttctactgtaattttccctctgccatcagttgctggcaactgggcccatggtcctttgccatctctaaagatccaaaattaacctaagaagcagctgaatcagatttacccatgcatcccctacagaaggagggcataggacttagcagaaaccagcaggttcaggggttgagtggagacccaagaacctttctgggcttatatagcaaccaaggcaacctgtcccaccataatcagctcagatgctgggcttgcagccttcattgagaagccatgttctgccctgggtccctgactggattctgaccttggtagccatgctttgaatgaacaatctattgaacaaaaccttaggtgagaggtaaaaaggacctgtaaatgttcgtttttttccagatgatcccaaaccaaaccaaattacatgtagcagctgccaaaagagaaagtgaagtgggcttgtctttctcttttcttcatcagtggctagctctattagggcctattaattttctactaaggttgaggagaggttaggaaagaacaggtgtggagcagagcaggagtggagggagggagagggagggaacggcaggagaagggaaaaaggaggaggagacagcaaaggcatcgccacaggtgaatccattctctttctaatccagtcggtaacaaggagaatgctgcctattacctgagacacattccaacaatgactccagttgattctcatcaactttacactatactttatccaacagcctggtgtcttcatgtccattaacgtcaccaagtccagtaggcttggtgcaggggagcactttgctctgtgcaggctgggctgctccatcctatgtggcccagtgcagcatgattgaatgaagtgtgtgaatgctggaatatgggtgtgtatgtctggagtgaagcctcagaggtaggccagctcctctggttgtccacaggtatccaagtcaatagactgggagggacattgagagcttgagcagaccacagggcttttctaatttatatgggaagatggcatttttgacttaccattctctggtcatgaagcatgtgttttgtgtgtgtgtgtgtgtgtgtgtgtgtgtgtgtatgtgtattgggggcttggcggggggcagggttaaaaaagaaaaggcccatttccttaagtcatactatgtctctgctaagccattggagaggaaaattccaatgtactagtatctgatctagtctgggactcatttctttggaacagaggctgatagctttttggcaaagagtcaaggaaaatctccttgcacagactgcaaagagtttgctgggtggaagtggacaccaaccattcctcatgactgtgtaggccttgtgcaagcagccctaggagagatcagtgaccagcagattagtgttaagtagcccttgaatataggtttaaaaaatgagatagcaaggctgtgggatgtgcctcagtgaagcaaggcagggcttgcattttgcaatcagcttgtgtgtcattaagtggacattggcatggctggttgaagccttccaaggggaggaagacttcccaacagtgggctggctccagcaccagccacagccctccagtcctggggaggagaggaatggaaggggagggggaccaggaggaggcactgggatccaactccagcctctgctcccacagtcgaggccctttgggccacttcaggcatgaggacctgctgcattgtaggcccagcgaggggcttcatgcaggtcccctcccttaattttcatagcatggctatgaaattagagctgaagaaactaaacccagactgggtctgttcttagacaggtcctcagttgtaactaagttgtaactcatctcttctgctctgaaaagcagtgtctttcttgtctttccacttgccatcttggaagaaaccatatagaaaagaataggagtgactcttgaaaagtaacccctgccaacctatccagaggagggcattcttccaacagaagaaatctgggaagaggcagggtcgtgagggggtgaaagggagactttatgaaagctgatcttatccttcccctgtgatgtcttgggttacatgagcctcccaggagtgatgctgatgacttttcttaagaaaggtaacgcctgggccaatcgatgcggctgggtctgctgggcaggatcccattacctgctgagactgagacaggcttctttgcctgggcacgaagccatgggaggggaagatggagagggggctggggacctgccaagcctggtcactggagaaaatgtttctggcccaggacaggagatagctgtgatagggcgaaggcagggtgggcttgtacgctttcctttaccttcacccaagtcagaatgagtcagctcaggaacaaggaataaaggctcaaaactcagggccacctcaatacttagcattgctgaagctgtcattgccatcagagatgggcaagcctgtgggccagggtcaggggctgcaaaagagagcaactgagtgaccctgtgtgctaccaggttggcaggcgagtgcttcatgacaattgagagtagcaggagagaggatttaaattacacgagcctttcttaagcatgttttgtgcaacccacctgggactttgctgctacaaacagcccattcagccacatgagccacctgtttacagaggccctgaccttgcactgctcaatcacatgtgctgactctcaacccctctctctgccttttccttcttcctctcttgctgtctctgtctgtctctgtctctcatacacccatctgctgcccttctcttccacaatgctaccaccacctcactccctccaaccatggggaaagttggcaaaagtgactgagaaaatggacttctcttgacacctcaaggaactcttttcctgccgtcctggtcttcctgagtgaagatcaggcttgttgaggccacttagcaagcaaccgagtcacttggcacagggtcttgcccatggtgggggcctaacaaatgcattgattctagtaaactcccactgtgaatccaaggcctggttccccaaaatctttagggcagagatgacctaacagagtcgccttcatatcactgagcctggcacactgctgggcacgaagggagaagggcaggtctgagagatctacggacaaatttgtgagtgtggacacagcactccttggaagcaattaaacctcccactcttgccacctgtctcccttcctagaaaatggatgcccttcagagcaagcatccataggctctctctggctgccgtcaacctcctgtactgaactgccagcccccagccttctcctttctctcctgctgagcccacttcctcatgtgtctctccaagccatggatgtccagtttactcttaagaaaagtgaaagggagggcagatcaggaggagcaatatctggctttgacctgaacctgaggaactagggaagaaaggcccactgggaagaaggagagagctctctggataaagaaagtgttctatatcttgatagacatgtggattacaagcgtgtttgtctttgtcaaagctttcaagctgtacacttaagatctgtgcatctcattccatctacatttaaaattgtacctttattaaaaatatcttagaaatccagggacctactctacttatccaggaccggattttagaacctggatttcaggacctcagaaatccatacctgagggatttcagactttcccttaaggaactcaaggactcattatgcctcagactgccactcagagatggggagggtgcctgctcttgtatcaaggatgtattcgagtttaagagggtatttttagcttttagaggcactcttcgcaagggagtgggggaagacaagattttacccccaccttcttatagttgccagggggctctccttggtcataactctgagagggagggaggatggatttactgagtgcctcagcgggcaggcagccttggcctatgggggctcttgagctttgtcctggaagagttgggctttaccagacacattggcacaaatttatacctgtgtctgccttcctcaggtcacggacataaccaggaggctcaaggttacgaatgacagcaccttgccctgacagagcatcttggaattctgtaacatcctatatcaatcacctctttttatcctcgtgccatcactgtgagaaggtaccgttctccctctttgaaacaaggatgccaagtttctgacatacggagttatcgtggaatctatttgcaaattcaagtaactgctaacgtttatttgtgacaaaaatcggtacccgtggacacgtacagggcagtgaaaaatttgagtgatctggcacgcacactcccagctgaggtgggataaggcagcctcagcttcttgttttagctctcgctctatgaacaagtgtcctcttcaagccctatttcatgccacatttttctcattttgcaggtgattttgccgcttaaaatagtccccgaatgtagtgctgaaggtctgtctagtgatcctgagtgcaagaaggccatggtgtgccttatggagaaaatagctgtgttggataagccttgttcaggtatgtgttatagtgctgttggcagtgaggtcaagcttaatgaatctattatatatattaagtaaaatgtctttaaacagaaacacacacaaaacaaggttatagatggatttgttgatgaaaatgtgaccagaggctcccaggaacctaaccctgtatttctcctaggagcaatggcttggtattcactaactccgtgttccagcgactttatggaacatatctaccatgtgcaatgagaactgactgcacttgtttaaagccccacaacaagtttccaaggcatgtgaacttgagtccactgatttccactccagtaatcttcccagtgtcccccagtgcttcaatgcgctggctccactgtggctccttgagcaacgaggtgccagcagcagcagcagacaatgatgaccacaaagacaacaacacttgcacagcccctgccttctgagagcctgtgcttaacaagggctggtgctacatggaaacacgaataagatatacaagtgtcagaataaaacatggtgccagactaaaggggtgaggaggatctagcaggagtacctgccacttagacaaaggctgggaaccccccaggaagagaagcatgcagttacagtagagccatctggaaaatcaccagggatcaacagagtcacaagaggggggggggcacccatgagctcacagtccttccccagccttgtcaacattcctgccccaccctacactacatttcccagtgatccacagctcaccagtcattggtcctcataccatctcatttgattccccagtgactcagtgaggcaggggagacaggcatcaccatgtccaattcacagaggaagagctgggatgaggagtctgcacttgggggcaggcgcccaaaattcatgtccatggctgtttttatgccatgctgagactggagcagctggcttccccgtgcaggctgagggcccccttcatgaactgcccagacttcaccttggcctccatccacccctgttttcttccacttgacaggaggcaggtatgatgttacagaagggtaaactgaggccataaaggaagtactgtcttgtgcctcctcctctcatgtctgcttaccttgcagccctgggggtgggaggtgggggttctcacagtctctctggtgccttctccaagccttggagcccctctgttcacagggctccgtgctctgtggggctgggacagcattgtgggcagagaccaaagctgacatggaaattgccactgggcatggagtgtcagggagggaccagattttccgattgcctttgaattatgccaggtaggaaagccccatgccaggatcgcagagctatcctcagccaagcagaaaacagggtagtcaaggcccccaagtaaggcaatgagtttagagtacagtcccttcctcagaggcctcactgggtgacacaaagaaaactgccccctgtctgcctggcaaggtatcattcagggaacaattctggcctgatctgagccaatctgcattctgaatgcaacctctgccatcctcttctatgctggccactcctaggctcccctgctctgttagcatgcaacctttctatacacttgagtgcacagtttctgatctgtctgtgagttatgtatgtttcagacaagactgggcacgttcagggtggcacggccatagactgagttatgtatacttcagtgtagctcagtggttcttgacttttttccactgtaacctacctgaggaatttcagaccttcccctaaggaactcaaggactcactatgcctgagactgccacccagagatgtattcgagtttaagagggtgtttccgaattttaagggcactctttgcaaaggggaggggagaagacaagatcctgccccaccttcttatacttgaaaattattggtaaatgtcattggtcacatgtagttcaggttcttagtaggaagactaaggtttttcttcttaatttataatgtctggatccagctcacaaagtggcacatttcaattgttggccagaaacaacaatagctggactggaatcaaatttcatcagagtgaggtccaaccattcgttggcttctccaggtattgatggcaagggtcttcggatccccaaagaaaagccttcagctttctggttgtctgagccctattcctgccctttggtttatttactgtttacctccactataatgccattgccttcttccctcttctgaataataaaatggagccacacaaaaggaggcacattggcaagaggccagcactcaggccgggctttattggcccagtgactccagcccaagtgcactcacagccagctaatgggtgtttggcagcagtgggagggtcctcaggtgctacacacttcaactgcagacccaaaccagaaaatcctttggagctgttgaagtagatgttaaggagatgtggaatcactaaagggacagcatatatcttgtttatgatttcggggccagtaagaagctacagaaaaaaagatccaatgcctttttcctggtgttcagtcctggaaagtcagtctctagcccagtaagccacagtcaggaaagtccaggaatcctgcttcctccagccctccaatgtatgattgcccagcatgacaactatatcctgacctgtcatgattcccatgccaccgttgccatatatttcttaagggaatttggcaaatttaaagggaagtcagaaagaacaaaggaagggagataacatttggaaaggatgcaaggaaggaagagcaagaatagctgaggagaaaagacagatcaaagggaagggcagtgatgacagagaagcagaggaagggaattaccaggaggaagtgggaggcacgaggcagcctccccatggtactcacgtgttgtgcagcacacaccagccacagtgggggtcgcctgagccaaggcactcgccgcagctctgatactgaccacaggactccacagggactctggtgagctaggacagcaggatagggagaaggtggtcaagattttgcagaacacccagcagtgtaccagaagagatgttgctctaaatatcaagtgtatcacctgaaatgttgcaggagcatgaaggtgcttggagcccagtgtgggaagggaacttgagtgattatgtttgagtaggtggccacatatgcatccagggagacaagcagccatattattttcttagcagtctccatgaatacagactccatacagtccatactaagttgtcagaaaagatatttacacagtgttcatttcaagttttctacctctgaaaccaccaaatatctctacaaatggccaattcatcatgtatttgtttcctatcaatgtaacaagtgcaaatggtcattctcactctctcatggtttctctttttctgtagtgtttccccttctttccagtcctccttcaagtttcgtcatttttgctgctccagagagcatttagtctgagaccaagacccttctctttctcttcctccttgccatttaccaagatatcataagctcactctgtagctgttacttgcccgctctttctttctcataatgttggccaactggctctaaaagctttcactatggtgctttcaaagagcatctgctgctatttctcctcctacccacactcttttcatgactagaggcttcctctccaacccaaaactttatattagctttcaccagccgcctgctaatgtaaaatgttccacatgacatttttgcttagcccaaatgcttccatttcctacatgctcttaaatatcttttgaatttctttgttctccaatgtagctttgccttgatgtctctttacataacttgccagcacttgctacatagtaggtatttaataatgatacactggatcaaacggagtttttattttctttttataaccttggtctttattctccgttttgccggtttttttctttacaaaaagtatttttttttttttaattttacatcatcctcttccagttgggatacctttttatctcaatggagaatcctgcctgatgtttcagcttgagctaagagaatttgatgtggccatccttttaaatttcttgccatcatacaacaggcacagaaaactataaactgtgctgacctggctgaaccctctctgttacatgagcaaatgcagaggcagtgtttcccctgctgttttatggggcatgtgcctctgtaaaatgatgtctgcttggcaggggctacttgtaactcacgcacaggcaaactggcaccagagcttctcaattagtctccaactctcttttggaattaattaataattaattccaaatcccacatgatctcttttcccttaactttcttattccctttatgcatctttttgttctccaaagtacacactgagcgttcttaatgaccacactgcgctttcacttctttcaagcaaccttttagcttacctctcccattctgacggcagtgaccttgaccttggtggcccttcctccaccttctcagatgtcttttttgcacatttggaattttatcttttcttttattactgctcatgtaatctgcatgagccgtgcctggagtctgcctacatatgaccttcctatcctactaattaaccttaacaattagttccttacaaattacccacactggctccacaccagccaagaatttgccctctttctgttgcgtctttaatttctcttcctactccttaagtgagcatagacatgctagtcatgtaagcatataaatagtggctcctaacccaaagtacctggactcctagtaattcatgagtggtaatgaggtccacacgctattttcaatatttcccaaagcctaatggcaattgaactgttgctgttttatgttttttattcatactcagtgatgtatgtctcatattaaaaataggaaatatgttattacttaataaatgcagtttgtttagtagacagaatctttcaaaacataatgcacagagggaaaaaataataaaaggggccataaatggtgaaagttgggaaacataagtacacaataatgttttcatatgttccagctgcttgtctagcactccatattttgcataggcttaaacagaaaatcatgccttgctcaatcaaaagcattttctcgctctaaacttaattaccatcctcctcagtttctcctattgacaagttctataatccaccttggatggaatgtggctgcatgttctggaatgttccacatcaagtcaagagccagctgcttggtgaatctgaaattctcaaaaacctttgcattcagattcttaaaatattttgaaactggtgtttaataatgtccataccctggaattgtcaagtccctcctcctgattttaaacatgagtcattttttgttgggttggaaagaatgcaagagccctcagagctaggttcaaattctggcttaacatggagataaaaatccctcctccccacccccaccccaattcacagtttcccaaagcacagatgatgcaatggttttgtaaatggtctggcactttataagtgacggctatgatggatcgctgctatccttttcattaatatcccaatcctccttgtactgtcacttacctctccccgacatcccagaaaactcctctgacagtcttccaaggcttcaggaactctgtcaggagttcaacagacctgggagaactttttttttttagtaccttgatagtgtcatttcctccttgagctatgatatttgcccctaagccattcattgctccacactttggatgaaacctggagttatctcatttccaggacttattcactatctttattagcttctggaacagctatctgcttttcttagcttttcatttaggtgggtccatgtgagacagggacacaagtcctgcacaggtattatgagtcctgggttccagccacagctctgccccccagtttcctgggtaaacttggacaagtctctcctgggcttctttgtgatgatctgaaaaatgaggaactgggcgcgttaggtctgaattccctctcagtcctaacatcctaagctccttgttaatgctctgacaaagtctctcaggtcagcctcatctcacttgtttggttttcatggacatgtataacaatggcaccaggtctaccttcaagaaaactttctcttgaagacaatcatctgggcagctagagctttctcatcttaaaggtaaacaacccaactgcctgtagtctttccttacggaatatttctatttatgatttaaccattttttatgactctcttctgaacttgatctaggttctctccactctttttaaagtgtggacattcaaattggggagccaacaggattctgacagtccaagtagaaaggttaccattatttgagagctaggtgccacctccttcaccttgccaggaccttcccaaggaaggacagaaccagggaaatctcccaggccccaccatcaggcaatagtctccagcatggccaaggcctcccagactggctgcacagctctccatctctatcattgctttgcctcactctgtaccccatggttaattctgcaaagcatcagaagtttttctaatactttaaatcacttttgaaaactggatttagtccaaccatttagcttagtataaatgtattcccttatgtccccagttactatccacaccttgctagtatgttgcacaggtggccagatggcctctgagccaccttgtctctatgattctctttccccaaatacctagacttgccactcacagccttacaccatacaaagctgcctctcccatcccccaactccagctcctctcctgaccctggaacacaaaccactccagatgcagagccacacgattaattaaaaccaccccacgctgattaaagtcttaagctgcagtgccaggcatgctaattaactgagtgagggaattcagaccacaggaagaggtgaaaaaagaaagtaagaggggcgggggagggacttctgtttggagaacaaatcagatggtgacgtgacctaagctgccataatgatagattgtctcagagaccacaaaatattgaggtctgtcccctggccaccagactctagcaaaggtgttgattgatgtggctgcaacttcaccttcgctgcttctagagatgggagccccatcacctctggggacctccatgtgtgcataaactgtgcttggggagaaggattgtgtgcagggttagggtagggtctgcacaacattgtcttgggacatcgtcctggctttgtgcaaaaacctattaggcagtttagcagttcctcaaaaaattaaacagaattactatacgatctggcagttttgcttctgggtacacctgcaaaacaaccaaaagcaggatctcaaagagacatttgcacactcaggttcatagtggaactactcacaatagccaaaagatggaagcaacccaaatatccatcaacagatgaatggacaaacaatatgtggtatatccatacaatggaatattattcagccttaaaaaggaaggaaattctgacacatgctacaacatggatgaacctcgaggacatgatgctaagtgaaataagccagacataaaaggacaaatactgcatgattctgcttatgtgaggtgcctagagtagtcagattcatagtgacagaaagtagtacggtggttgccagggactagggaagggaggaataaggagttactctttaatgggcaaagactttctgtttgagcaaatgaaaatgttcagaagatggagggtggtgatgcttgcaccacaatgtgagtgtacttacaaatgcacacttagaaataattaacactgtgaatttttttatgtgtattttaccacaataaaagagttgaaataatccttttgagtggacttgacaaattatttcatcttcggcatggcagcatggatatgaaaacacctgttctctgcttagctccttgggtcaaaggggaacggcttttgctggtagactaatacaatcatctttatgaaatattctgatatctttcagtcaaaagataggtatcactattcttttcaacgtaatctcaaatgggttttggataaatgtctcctatcatgtatcattacataactggctctgttgttctcaaggtctggatacctgtttcctgatttggaaaaataatgccatagccttgttcttcctggaaattttccttacctctcacccattccaaaaggcctagacgaggagctctcaattcaaataactcacaagaggtcaaatggcccctgattttagaaaatcctcctgctgttgctcaagctctcctttggtatttttcattcacagttatggccagaaatcactcatgtgcccttccccatttacacttcctttccccctagatcacctttctgggaatctgggtggttttatccttttgccaccaaggtaagcttccttaaataatataatgtagtttggtctggttttaaatgattgtaaatagaattatcatttgctgttgtacatgcaatcatcatcatcatcatcatcatcatcatcatcatcatcctcatcatcatcctcatcaccatcttcctaacctgtccagttccaaaggccacaaatttacaaaacaatggcctagcacagcaaggcaatgaatgactgaaaagagagcaaagggtcccaaatcagattttaagtcatggccttggtcttcataagtttctccatctgatgagctgagcccattgcttggggacctgggagcctgggggtcctccatggcagctggaggaatttttacagcttctgagtcctggcccccattgcccaactcccacctggtttctctgatatttcgaaagatgctttcctctggcaatagggtctcactctgcctgttgctgctcacattctgaagggtgcctgctgttctgctgattacattcagaaatgttccacagatatagcatgcagtctctgtgtgtatctctaatttgtttaagcatttgacattatggtcaaaatgtgagttattactccatttctactcttataattggatgctaatgcaacgatggctacactgagcctgatggttggaattaatttaaatgtccaaaaggtttcttaagtacccaatttccttcaaaattgtcaaaaaagaaagaaaaaaagaggcaagatgacccattaagaaactccaagaggctgctggaggaactgtcaagctgtgcagacgctgcacttggtgctgtacctcatgctgtccttccttgtcactgtccccgagcagaggaagtagagttgagaaaagtaagtccttttctggcaaattcttagctcagtaatacacatgggtcttagtggcatggtcttggggagctcctcaaagcatctccacccgccttcatctcctttggtcaccactggctgcctttccaagctttatttctgctggccagggaccacataaaggttttgtggagtctccctgtgatggctccaaggccctcactgccagggctgcaatttgtggttgagcagtggctcaagaagctgtgcttatttcaagtcactccacatgcctggaaccctgtcactcctattctctttgctcaaagggggcaggtatttctgaacctggctaacaggtaagaaaggcagatgccagaaggctggtcccaggctgtggcagattgtattatgagtcccaattcttcactccctaaaaagaagacttttatgtctccacccctatggcctcatggtgaatagacaagtggtgtgtacttccccacttcttggctttgggcatggcctcagaactcgattggccaatgaatggtaggaaacacgaggcaaatgaatgcttccgaagtgcttatgtgctcatctttgccttctgtgcttctgtcattgccatgagaagagcttcccgaaatagctgtttcctcttcagcctgggccccaaatgaacccacatggagagagacctgagcccaaaccacagccaggagacaaccctggctgatgcagcagcttgaagcagaactgcccagctgagttgagcttagggagctgacatgcaattgctttgcagagccatgggtgtgaggattcatgtctattgtatgcaagtgagttttgggctggtttgttacaaagctttattgtggcaatagctagctgatacacaggtgctggacagaaagttacaccaggatgcaaaggtcccgtgaaaggtagaggggagaggtcagtcaaatggaggagggggaaggttgcagtgtggtagcttcttaccaccctgtgcttcaaataggtcatgcaaacattgatggcgtatgtaacttgtacaagttcagaaattattgaaagccagatctaacgtgataaatggcccttctcagtacctcccacgctggccatgctcttttaattctatggtcatagatctacagatctcaggaaggtctagcccctcagcaaagtactaaagaagactctggaaagagaatgcagccctccagatgtggtcagctgtccagaagcaaagatgtgcttcagaccccttgtactgaccatctggccaccccagtgtcagaaaatgatttttttttttctacttggcagcagtaaaaactccttgggaatgatttgccttgagctttgcaattcctcctgctggtgcttgggccatggggctaatccagctgggcctcacttgacggcagacagaggcacagggtcaagggcagcagccttggctaccaccactgtccctacctgcctctaggcaggacctctggggtcaaggttgatgatatttagaatagcaaaggcaaccgccccagggcatgaggcttggggagctgaggttccaagctgtaatctaatctgtgtgtctgggtgaccttgaacaaaatattcccatttttcatgcctcactggattcattttcagattagggggatccagtcctgctctgccttaaagaattggtcacaaaatactaccaatacaaatgatttgggaagcttcttgtaaatgaaaagtagcagatgttgtggagggctgcaatttgttgctattaataagaataaatgcctaataggaagccagtttgctctgggaactcggacagccaaggagcgagtgccgacgccggaatcatcaacatatgttggtcctcattagcaaacggcagtagctgggaagctgggcaaggagctctcagcgtgctttctgcagagcgtcgagaaatcaccccatcctcaggcttcccagtgtgggctgcgctaaaatggcacgtgatcgttattagccagaccccttgccaagcgggagagcgatccccttccctgatgcacagatggaaaagccatagcccagaggggctgagcagcttgcccaaggtcacgcagcagggcggtggcaaaggtggaaattgaaatgaagttgggggctggagcctgccctcgggcctgccagacaccactggctcccggaacatagtacaggggattgagaaacctctggtccctctgctgaacacaggtcctgtgttgaaaacttcacagcattgcaggctacttactatactgccaggaaggtgtggctgagttcaggggctgaggagccccacctacgggcagatcaccaagtagcagccctgaagagagaatgacaattggtctcagcacagcctcctcctccaggaggttttcttactccttcaaatgtggttagggagaaaaatagagtttgaaatagttttatctcagggacaagtgagaagcagagatctgagagaaaaacagacctgggtttggatcctggatctgccaccactgtgtgacttggacaacttatttaacttcatcaagcctctttttcctcatctaagtaccctgatgggttgttttgaagaataattgggatgacacatatgaatgtattagtgttatgctaatggcaactctgttgttccagcctctgcctccgataaaatgcccctgtgatgggtggtgcgaagtcatctctcttcactccactatacctagtactcagctcatgcgcagtaaatgagaaaagtgaatgaatgcttgcatgcacgcataaataaataagtgaatgaatgaatgtggttcctattacacttgtacgtgttccaagaatcccctggagatcatttatttggcaaccttggctctactctaaaacctatcatttctggattattgccacagattaatctcttagtgtaaaggttaaatcctctcctttctctgagctctcatgctcacattcacacacaggctcaggaggcccgacttcctgacttccagggctgcggggttgcaatgtgtgagattctctagctaggcagatcctatgcatttgacagaggagactgcagccagagcaacccctccaacatggaggcccaaaggaatgggggatgagaggagtgttctggcattcacacagttaacaagctgagagggaccttggaaacattctagctgccaatcctcttatttttcagatgaagctcagttgctgcagggatttgtccaaggctacatggctaccaacactcctcatttgatacccagtccctagatactgactcctggccaaaatgctcattcttgaccccatcttaaggtcagggctgaagcaggggcagagcctcagggccccacatcctggagaaaaatgaaagtttccctccccatccccaagcccagcaggtgggaaggggctgttgtcctggggatcaaagtgctgctcctgttccagcctttttttttttttttttgactctgtgtacattgggtattttattagaaactttcatgttactgctacgtaaacactgcttcaaaataatacataagttaaaaacttgtcaagcaagttcttcatcagctgtactcctagaattaaacacacatcacacacatacaagtcaccaacccccacaaaatgtttaatttaactgaccttaaaatttggagaaaagtatcggttggcttatcttttagcaaatgacacagacaaagactatggccccttctgaactgggaccgggaacctactgttgtgtgtttcccaagcacagcctgctcaatgggagcctttgtttctgcagccaagaagaaggcggggaggggctggcacggtgacacctaactcctggcccaggcagcggagccaagctagtccccaggcatatgctgaggctccctagctggctggcactggctccttgtgggaagtggcagggcaggctgggcaggcactcccttctccatctagcacctgacccttctctctgacttccttctagcaagggctctgctgaccagcgttcccagcaatgctctggctgttcaaaccacaaaaaaacagtgtgtgtaaatgatacattttgtgaatgagtgcacagcagcccaagggggtgtgcccagatgtgcatgtctcagcacaggagtagcatttgcacacacctatggggggcagaagtgttctggaccacaggagactgtgtgcaaataaacacatctttcctcgcaggcaaccaaggctgggtatgaggcttctctggctaggaaacaaacatcttttttcaaaaagggatttgactctgggaaaagttatggtgctcaaatgattggaaactgatattcctgaaggagaaccttctaggtttatcaacatagggccccactctcagaagaccaggtgctgctggcttagaaaggaggcagagacgacagatgacccaaggaattctaaatcatcttcgtttcaccctatctcctgtctcaaggtacccacctaactctactgaacttatatgagcttccattgcaggatcagggccaagcctgctgctggggaaagacaaagagggccctctggtgtctgggtcatcctggacacaggcaaaatgtatcttcttcagtaagagatacagctttgagggcatcttccagtaattcttcaaatatgaaaggacaattgttaaaatgacagcattctaaaagttttttttttttttttttttttttttttttgagatggagtctcactctgttgcccaggctggagtgcagtggtgtgattgtggctcactgcagcctctgcctcctgggttcaagcgattctcctgcctcagcctactgagtagctgggactacaggtgcacgccaccacacccagctaatttttgtatttttaatagagacagggtttcaccaggatggtctcaatcttctgacctcgtgatccacctgcctcagcctcccaaagtgctgggattataggcgtgagtcaccatgcctggcctctaaaagggttttatgccttatgcactgtcggtgagtgtttagattagcacaaccattttgaggagtaatttggcagttattactaaaacctaaaatgacccagaaagtcttcctcttggaatctttcctgcagaaataccagcacctagacaccggtggttggctgtggatattcactgtggctttgtatgtagtaatgtctgtttggaaacaacctaaatatccatccacagggggctggctaaaaaaatcgtggcacatctacactctaagataatagtctgtatgtactaagatggatgaatgtctatgattcatatttgagttaaaaaaacaaattttataaaaagggtatattaagactcaatgtttgttttcaaaagacaactgtgcagctgtgtatacatatatatgcaaacctcgtgcaaagaataacttctagagagagagttacatatttgctaacagtggttaactttggagagtttgaatttttcacagacagggtattattgacttgggaaattaaaataatattttaaagatgctttaacctttagtcttttaaactaaattaactgtgcagctcaaaatttattttagggtgacagcttgaatttttcttttttctttttttttttttttttttttgagatagagtctcactctgtcacccaggctggagtgcagtggcgcgatctcagctcactgcaacttctgcctcctaagttcaagcaattatcccacctcagcctcctgagtagctgagactacagacacacaccaccatgccaagctaatttcttttttgtacttcttttttgtagagataggagttcaccatgttggccaagctgatcttgaactcctgacctcaagggatctgactgtcttgaccttccacagtgctgggattacagtcatgagccaccatgcccagcccaacttttctttatacccacaagatttctaatattctggaactatggaaagggctcttgtctgcttggtctctccctcttggttcaccttctgaccagtagcaccctagaagtgagccctgggccatgggggagttttctccttataaaattaactatcccatattgggtgggaaagtcattgtttggcaatgccttattcagtgatgtcacctgtccgcccagaagcttcctgcagaaaacccacaccaattccacccaacatggagaagactccatctctccacagaaattactgggcaaggaccagggcacctctgcctacagcccccatatgtgcagacgctatcacgcactatgtgtgcatcagtttagtttccatgtggaggagtcatggtgtgctgggacatcactgggctgggggtcctaggacctgggctgtaatcctagacccgttccttacttctgcaagcccttagcaattgtcttcatctgtctagctttcagtgttcaacataaattgatctctattgtcctttcaagccagaagattccatcataactaactatcttaaggctggaaaaatctccaggagtgtcactccaggatctccctcaattttattctcatcttggttacttcatctatctgtatgatagggaccctcagctctgccctttccctagctcttgtgatctcaaaaaagtacagtgatatcaatctgaaatatactttgaattctaagaaaggaaattgtcgcaacttctaatgatgaattatgaaaccactagagtttactgtggccatttctatctatcattaacataaacaattgtgagggtgagtaaagggttgtgtgcacatcctttctgagagaatggagagagcacaggcttctgaagtcctagattcaactcctggctcagccacttatcaaaaatgtgtctttgagcctcggtttcctcctatgcataaagggagcagtattaggtgacgattaaatcctgttgtcagtgctcagcaacgtcccttcttgcctttctctgtgtgggactgggaggacagtcaggggacccagcggcgctgtgccagccttcatgctttctaggctgcagacgtaatgcagagcttcccgcttccatctgccaggagctgaccccaccggactgtagtagtaggccagttgctttccattaggaagttcgttttcaaggggtgagtggtggtggtggtacggataatgcatccatttcacattttgcgcatctggggagtctgatctatatccgactaaggctcagaatagattccccattccaaaatgagaaatggctattagagctatatttagactaggggttcagtgagctcagaaataattgctggccctggggtggagatggggtaggaggaggctaattccaggctaatttgggcccattctcagggggggtggcctgggggaaggccgggagtctcagccaccctatttctgtccattcaggcctctgctacagcaacagacaacccccaataccaaaatgccattgcctatgacagacaagctcagtagatggagaacctgggagaaggatctaaaagtgtagcagcccacagggaggggcagcagataggtggaggcttttaataactgaatgttagtcaggagtctgtgggtcacaggggacctgggacctgctgctgctgggacctgggctgtgcagtctgagagctgatgcttagatcttaactctgccacttaagagcttggtcaggcgcactcaacattctcaagcctctgaaagctatgcagattaaatgacataatacatgtaaaacactcaacacagtcctagaccatccaaacctaacacccagcatctgtccttataggcacgaccaccatggccaactcatcttttgggtttgcttttcctgggacagacaacattcacgttaatgcaaagttcaattttaaaattcaactttaaaggtttccagatgtgtccctgtgattgctgaatacttcagccctcagttaccatatatgtaagtgctggaaaaggagtcagaactgaagagaacttgtgatgggatctcacagtcttattcctaacctgaccactgactccactgggtgatgccctgtgatccccaggcctaaagaacccctccctatcaatagggctttggccacacagcacagccccagaactttccaaccagttccctgtctctttctctcctctcttcagctattctgagagcttttgctctgctcttgaattgcataggaaggaaaagaggaaaaccccagcaagtaagttttattgccccagcacctggaaaagttaagaaaagacagggaacacttccaactatctgatgaaatgaggtcaaggttatctgtgttctttatttaatcagggtctcccctgacctctgtgaacaagcataaccaaaagcgtgccctgggtctgggataggaaatcatgctggctcctagccaagtacaagaggccgtgctgtgtgccggcatgttgggacatgagttggcacggcacgtctggaaggccagggtcaggcagtgaggcccagcatggtggtatttggcacagaatccagcagcccctgctgtgacagggacatgaggatgcagcctccagacacaattaaacatggggcatttgctgagtttgcaaacaaacctgcaggatacagggctgaggcagcagcaagaaaacggatgtgacaattcagggcaggtagcatgccatacgtggaattcattttcgaatgcttttctcctccattaagcctgcttcggatgttgctgggaatatagcttaacctggaccagggtctggggcagagtggggctggtttgggttgtgtgcctccccaggcaagttcaccatgccaccgtttgctgagttgtgggccacccctcagggatgctcacagtttaaggggagaatcaaggcacttacaaggtgctaaggaggagggaaaggcaggaatttggggtctaggttaattggctccaaacttcactgagcaacagaatcaacagtagattctgttttgctggatttaagatgctggtgcctgggccaagctctgagcagcaaaatcaaaattcccaggagctgggcatctgtattttctcaaggccctgtactcctccactcattccccaacccatgaccctgttaatgggctgggtttgggacaactggccttgaccatagggagcagaggagttagtgatttgaggattatgcattttgccctggaatctgagtgatacggcaggtggaaggctatgggggcacagggacagggtgggggtgagcatagagataacactggacagctgtacatggcttccccattcataagcaatttcacagccatggttgcctatgaccacattctggtgaggtagccagctcagggaggacagcctccagtttacagatgaagacacaggttgggaggggttaagcgacttgctcaaggtcacgcagcctgtgaatggcagtgccaggtccctaacacaaggtgtctgtgaccaacggctgctctatgacatggcgcagcctcctttctccactccagtcccctctcttgcaggggccaggtggctgtaactctctcgtgatgagctgcagctgcctaattggttgcagaggcaagttgtcccaaacatcatggacaatgatgaaggcagagttggcttggagaatttccattcaaatatatcttataatcactctttggccaacatgtttccctcacaaggtctgtctccttctacatgacacacatctccaaataaggctctctatcatctggggcctggcaagattctagacaatcgctcagtgtggtggtgcaatgtcaccctggccaaacccagcaggggctggtatgtctgacttcatgagactttaccaattatggaattgtttcactggatccaggggctgcagacttcagggctggccatatcctgaggcaactgctgcctggagcttggtagggaatctacatcctgtcttggggccaagggtatggtctggggacacagagcagcaggagcccacaggtgggccaattctttaggacaacctgaccttcacagggctcccaggctgctagaactgagtgggccattagttctgacacagatgctcagttgtggccctgtagatttgaagggaaggccgtgggctggtttactaggccatgttttccgaggcgtctttccagctatgctgaagaatcagtctgaccttgcagaatgtctgtagatggaggaattggaagggtccctctcagctttctgtgccattcaccctggtccagccaagggagaatccagcaaaatcattgacatgcaaaggcatctttggctagcatgggccttaataaagccagctctctgagatggagggtgtagctggaaaagggtcattgaaggcagaaaagttggacagaaagctccaccccgtagggcccatctaatctctgcaagactcctggcctggaaggccaccctggtctgccctcatgtcgggtcactgagactcagcaaagcctggagagggtctccccacccctggtgcttctctggccaatgcttcttcaaggagtgaagggaatctgaaaacagtgcagaccaaatagctgctgtgtcgacgaaaggcggccgggggctgagcaaagggtggcattggtgacaccacagggtatgaaaggttagctttgcatgcctcagctccctattagattttcccttttcttcttcctgctttcattctttatcagaaattgcctagtgggctctctctcactcatacttcagcacgaatgggctggcgtcaggccgttgctggcagtggctgctgcaggcttgtttttgggagcagagtcaaggagcagaagtgaaagtcctgtgttctcaatgactccaggagcaggagaccctgcctgaccatagcccctgcctttggggctggccttttctcttttctcaccactctcctccttcctgtcccctgtgatcagtgaccctgtgacactcatgtgcacaattctgtaggagctatgcttagaccttttgtgatgcttggagaaaccacccacacccatccagaccccagatccaggaaaacacctgggaagaagacaaaaataactatgaaagcgtaggttggctgcactaacctaattctaggaccaaagaatcccagagttgggtaaaaacttagttgcctaatccaaacttttattggatataaccactcaatgcagatatttatgctatgtgtttgccagttacatccaatttgaagaaaaataataagaataacatcattaaatataatcagacatgacttatgaaagggtttgatgcaacattaaactgtgtttactggtactgttgccctaatttattgcttgtgtgccacggtaatctaatcataattacaaaaacaaatagctaggagcattctttacatctcttggtgacttagcttctaaagaggtccctcctccatccctagcagacagtattgagccacttcagggtttagagttcttaggataccctaaatgaatagcacagaaagcttggatggaccctccatctacagagagtctgcaggctcagacttatttctcagtacagctgggaatatcactcagagatcatggcttagaaaaccagcccatctagctgggtgtggtggcacgcacctgtaatcccagctacttgggaggctgaggcaggataatcacttgaacccaggagacagaggttgcagtgagccaagatggtgtcactgcactccagcctgggcaacaagagcaaaactccaactcaaaaaaaaaaaaaaaaaaaaaaaaaaaaaaaaaaaaagaaaaaaggaaaaaagaaaagcaaaagaaaaccagcccatggtattcccttcaaacctccagggctcggtacctgtgggataaggtgtgcattcccaaggccctccagccagactggactcactgaagcctttgtgcatcttggttcttctatagtgaggggcggtccatccactacccaccaaatgagacctgcacacagatgtttatagcaatgttattcataattgccaacacttggaagcgaacaaggtgcccttcagtaggcgatggataaataaatggtgtggtacatccagacaatggaatattattcagttctaagaaggaatgagctatcaagccatgaggagatatggaggaacctaaaatgcatattattaaatgaaagaagccaatctgaaaagcctacattgtgtgattccaactatatgacctggaaaaggcaaaaactatggagacactagaaagacctgtggttcaatgagatataatctcatacctgtcagaaaggctattattaaaaagacaaaaaataacagatggagaggttgtggaggaaaaaggacactgatgcactatcggtgggagtgtaaattagttcagcccctgtggaaaccagtttggagagttctcaaagaacttaaaacagaactgccattcaacctagcaatcccattactaggtatcaacccaaagaaaaataaattgttctaccaaaaagacctgcactcgtatgtttatcgaagtactgctcacaatagcaaagacatggagtcaacctggatgcccatcaatggaagactggataaagaaaatgtggtatatagataccgtggagtactatgtactcataataaagaatgagatcatgctttttacagccacgtggatgcaactggaggccgttatcctaagcaaattaatgcaggaacagagaatgaaatactgtatgttcccactaataggtgagaactaaacagtgagtacacatgggaacataaagataaagacgggaacaacagacgccagggagtactagagtggggaggatgaaagggggctgagggttgaaaaactgtctatctggtactatgctcactacctgggtggtgggatcatttgtacaccaaacttcagcgacacgcgatttacccatgcaacaaacttgcacatacatgtgttgaacctaaaataaaaattaaaaaaaaaaaaaggatctgtggttttcaggggttggacggggttgtgggagtggagagggatgaatgggcagagcacagagaatttttagggcagtgaaactcctctgtatgatatcataatggtggatacctgtcattacacatttgtccaaacccataggatgtacaaccccagagtgagccctaccaaagactgtggactctggatgataatgatatgtcaatgtaggttcattgattgtaacaaagggaccactctggttgggaatgttgatagtggtggacagtgggaggaggcagggggtttataggacctctttctgctcaaatttgctgtgaacctaaaactgctctaaaaaatagtctattcaaaaatagtaagttagaaaacaggcagtatactactgttttatcattcctttaatgaatacacctacattcaaatgtccttccttgctctcacacggccaaatctgacatgcccaggggacatggaagaaggggaaggagcagaactgccaccagtactggggctgctgcaaaggctgagggacccaatgtggagagccaaggttgggaaggatgcagagtcctgcggctgcgatgcctgcagtgggctggaacagaaaaaggctactcagtaaaatttggcaacggacacgaactcactttctctctcctagctgtgcttttcctgcagggactgaacaagggcagtgtgtgcacatgtgggagtgccagaagcaccagcgcaatccagatgtgcccaggcccatctgtgcgtgaaaatgcagacacaccacactatttatcaattagtgtctgctgctgccagtgtcaccagttctctgcctgatgaatgatgctaggctggacaagccacaccccaaggtatttccactgtctgcagcaaagcccaccaggggctgtcaataaacatccccagcatagcccccaggcactgaatgatgggagtgggtcagatgggcacagcccttcaggacccgggcagctgccggccagcctcgagcagtccactaaaagaaacagttccagatggtgcctccgagcacatcctctgggtagcagccactctgccctagtgcacaagacatggctagatttcagcccctactcagccccttggtgaggagtccttgtgcagtgaccaacctacacaacagtatactgtggctctgtgagcacctacacacacagtcccagggaaatgagtgtatctcagagatccaggagacccaaaaccaatctcagctctgccttacttcaccagcagaggttgaccaaatagatcaacctctcagggctgccgttttctcagctgtaaaatgagaggctccttcctgctctaacaatccaagatatatgggaaattgagagtacatttcccttcctttccccgggttgcccccctttcccttcttgaacttgacccagcccttccagaccaggctaaaactgaaaatcaattttaattataaaaatccgtttactgtatcaataaatcattctggctcggcttggtggtggggagaaggttacacctggaaccaagctcataagtcactctctccctctgccttgccgctcgggggctgccacccctctgctccctgctccaatattcatctccgtcattaggctgtggattattaatgatgtcctgggctgatggatcggagcccagatgctctgaaacacattgtgctggttgtaacttgattttcagtggaccccttgacagcaaaccttgatgggctttttcccctttccatggagggggtaaagaggggagtaggactgtccttcaaggtggtcccatggctgcaggtaggaaagagttggtggcacagacaaatggggtgagcctgcctctcccagcccacttactaggagacagcacagtgttatgtacatgtcaggttcccatggcaatgagacttttaaattaattaactgatcaattaatattgttgttaggcttattccttgcgtgcactaaggagagaggcaccatctgctttggatggcatttcgggggaagggggagctcctctgctggcttaagctcagtggggaggctggggaggaaggcagagatgctgggtctaaggggtcaaaacatcagcggactgccagtccctagagaccacttgtcgttcatgactccctaaggtcagtggttcaagttcacacaactctgcgtaacaccacaacccaaggtttggatggagctgggggcgggaagccacaaatagtgggtggctcagtggaaccaattcctcttactaggggggttgaagtctcacttcctttatggcatgtgacccctcgtaagcttccagtgctttatgttgtctgggcccctgagccttacatccaggcagcctgcacaggaccactgaggaaagcacaagtccatatgagagagggaggctgagcttctcccctgggtatccacagctttcctgttctccctcacatccatctagttggcagagatgcaaaatgggaacttctgtggaaaggaacctggcatggctggcccaccaccagtggggtggggactgcaggactggccatgccaaatgtgttctggccatgccatccacactcaccaccaccctgcacaggcttaccaagaggcaggcatctgcagcacttcgaccctgcaagccagcagccccgtggcaccccatcagagcaggctggggcagcagcctactgtttactagagacatgcctgggctgagttatgagtgcctccgagcctcagcttctttacggtaaaataggggtaagaaaccctacctgggttgttctgagagcttgtcacactctagttctggtttggaagctttacccatagttagaagacagagcggagctgacacttacaacctagcaaattgtccactgcatgcattgattttgtgggagagaaaactaaaagtaacactccagatgagattttaggattgtttatggagcactggactcaaaatcaaaagacctggatttgagagctgactgccacatatcggctgggtgatttttgagaagtcatttaacctttctcatctgtcacatgagataatggtgccaacttcaaggagttgctgggtaggttcaatgagagattgtgtggaaaatcgcttgggaaatagcaagtactaaacagatccatggcatcatttcatttgctaccactgtaccgttagcaaagataatttagagttcgcctgtatcaagctttctagggtgcataaatgatagtaactattaacttcttgattcagttctttcactgccttccattaaggcaccagaagagaaatcatttttccttttttgttcatctgctcgtcattatttcagatatcccgctgcactcagatacaagactgaagaagcaagaacgttataaaaaagaaagaatgaaaagaaagaagaaaagcaactaagcccagagatggatcccaaaactgaagaattggtttaattaaattgaaagctctggtgcttgtggtaattgctatgaaggaatccatatcccatcagaaccctctcccctggagtttgctccctctactttctctgcagcaggtactaaaattgcttttatctttagggagatgcagcccacagggcccagaaattattgtggggtcaactgtctggagtggggcttagggagtagtagcaaataattcggtccaaacctggctttgaccttgaatttccccaacttagacctcactctttttttttctgcaaatgaggcctcatatgccctggtttgcagagacacttaaaagtaggcagtgcttgcttttgtggcccctctgctacttctgctatacacagggcgagctgggtttataacaccacctaaaccacaggccacgctgggctcctcatgccctgagctacctcatctactctttgggcatcatttggctctgggaaatactgtcggtcctccccgcttttttttttttttttttctttttctttttgtagacagagtctcactgtgttgctcagcctggagtgcaatggcgccatctcggctcactgcaaccgccgcctcctgggctcaagtgatcctcctgcctcagcctcccaagtagctgggattacaggcgcctgccacctcacccagctaattcttgtatttttagtagagatggggtttcaccatgttggccaggctggtctcagattcctgacctcaagtgatctgccttggcttcccaaagggctgggattacaggcatgagccactgcacccagccctgtctgtcccttttaatgctaatagagaaacttgatcccagaagtagataaaatcagcttttaaacaacgacaaatgcaacaagcaatggcaggccacaggaagcaattaggaatagtgagcgggaagagccctgaagagacctgggtttgagtcccaaccacaccatataccaggttcataactttgagaaactctgggtgttgagtttgaattgtgctttggggtcagctgggtcctgcctgattgtccaggtttcaaaaccattctaagcatctagatcaaaacaggttgtttccatactttcaaaaacactattttgtttaccaattatcaagcatttgttaagtgtctatcccaagctaagtactgtgctatattggtcaggtcaggcaacgcagcaccttaaaagttgaagagaagcctttggaaccattattcattcattcaattgaatatggtcaattggcatcatgaatctaacaattaggaattgggtagcaatatgaagggtgtgtatgggaaggatcaggtggcaggagaacagcaagaagacaggattggggtcattttcagtcctgggcaaagaattgagcatgcagacaagatcagtggggtccttcctaggtatttatgaatccctgaatctcaaactgaataccttgtgtagcagaagcgagcgtacacagaccctagcagatacacatgtgaatctgggtagtccctgaagaacaggacagggctcagctgcaggtaccgtgcactatgaccctgccagccacacacatgggcactaacattctgagcagtcatctagaagccagcagccagtgcaggatgggggtcccaaagggcttggggaatccacaaaccacatggtcacacccttaatgccgaagagcaggggaaatggaggtgcacacaggtcctaactataacatgaaaagggatgggtgggaataagaaaaagtcattagaaaagaggagctctaaaatggctcagaatcaagaagaagttgactcagtatcaatgtgtggctcagcagacatcaaatcccatgataaagccttgtttccctatgttcactgggctggaacccaaactgaatccagctctagggaaaaagagaaggtttggggtaagagtgtgtgtatatgtgtggtgtatgtgtctgtgtttgggtgtgggtgtgggggggagggtaaggagctgaattttaaaaatccatcacaatcaattatcacaagtatgtccatttttccagcctgctagccagagtcaaagactgtgtgcatttgaaatctccaaccttttaaaacattactgtgaagttgaaagttcctggtgtcttttgattaaacatcgtgctaggtaatgactgttttacttcttattcttttttgcccccttcaaattactgattgttgtctgacattaaggccccatttgctcttaggaaattaacaagcctacgaaactcttaatgaattgaaactcatcaaatgtttggaaactatggcagtcttaagattcttttccttttaatctatctctctgtgaaatgtctcattttttccacatattcacttggattcagacagctgcactttaggaattaggttttgagtcttgcttatctgaagtagcagggagtcacctgcccacagaggtgcaagggcttgagaacttgggtggtttctccaaccagcaacgtgcttactgtctttctgcataagcatcgacctggctgcaccaagtgatttctactttccatccaagggtgccttagagctttaatacatttgaaaagacatttctagggtacagtctggtcatcaaacagaactacttccattttggaataaagtgactgggcttcaaagggattaatcttgtgtatgggccatgccacctgctagggagttgtgagctaatggtgggcatccttgaatcccatcttatctggatagtttctccttttctaatgccatcatcatctagcagcagaccatatacagaggttccagttgagaccttcagctttgtgaagggcgggaattcctgaaactgtcgcaaggcttggggtctgaggaatacataaccacccaagtaaggagcatccaggagcaaattccacactatctcttgcctcagaagtcaggaaaaataatcaggtaactaggaaaccctgaggaaatttcagtcatcagttcaccttgggaagtggagttgttatgtgagtgtttatgttcaggtgtgtcagtaggaggagcctgatgaggatgaagaataatgagcatagcccaaggggaacactttcctctctagtcaacaaccatttccaatccttggacaaccaaccacacagtcgcaaagccaggtgtccttggacacatgtgaatggggagaggggtgtgcccagctcacagagccctcagccctagagcagttctgaccttgacttagtatatcttccagctaatcatgagtctagacacacatgccccaaatagtcttggtagaggcttcccagggtgatccactgctgttaagctacatggtggagctgggaaccacatggcaatccttggaaacatcatgccatcatctcatggtatttagattctcagctcaaaacttagagctctgccattggcttcttatatgatatggaatctcagctcttcaatcctcagaatgcaggaaatggtttcttacatgtattcggaaaacaagcatactatgtagaacaaataacacctcaaaccaaatggaggctgttgcgagtcctcaccataataaagcaaaggaaagaacccgtggggtttctgcccatgtctgagagctgaattctggcttccttgctcctgcttacttcttagcagcaggaccttggccatcaagagttaactccatctgactctaatgcacgcactgccacccagaacaataagccaggcaatggagaatcctgccaggaccagtattgattggcttgcttgattagttggttaattgaatatcactgctttctaatataattaaaacaagataaatactggggctttgtcccgtaagcaagtgccattagtgatcatggtacacaccgtgattaaaaatgcaatcgactgggagggttatttatgaacttgccagcctctagtgccactccatggtttgcagggccttgagatacaacgtggctggcatagagctccctaacctgtcatgactgtgctggtctcttaagaaaggaacttatttcacaggggaatgcatgcaggtaaaactattttatgcttgcccctagctcccttgctttaaagtatcagacagtgaaactacagcaccatggaaataccatgcatgacagtttcctcctttgcctcactttcctcattcccaaatataagactggctttctgcccactctgtgcaattctttattttaccctcatccagtttcaccatgagtttgaaattttgtttggatcactggtctgctcatgagacacttatgaaaaattacctgaagcaaggctagttggagtgtggctggcgggagggtcatgggtcttatttacataggagcagaggggatcaccccacaggctgctaagagagagagctaaatgcttcatgtgaacagcgtaggtgcctatggactaatctactcccacatgacatctcagactgctggtgcctccaggaggaggaaggctgccaggcttcctggatgacagatctcagcccccttttcttggatagcatctgttgcttcctcagttgaccaaggaatgtttgtggcatgtcaactgctggccttcctggtgaatgtgtggtgtggggaaggagtatcatgtcaccttttcctgagtcccacttattgatgtttcagctgtccctgttttgagcaaggggacacggtagcacttcatttagggctggtgaaagtctcagttggcaaggcacttggaatacctccaaaagtgggggctatgtaaaaacaaagtattattattctattagcttgtggtcttaatatttggaatgtgtccacatgacactggacacatgcgtcctcccccacctctggctctccacattgggtccctcaacctttgcagctgccccagtacttgtggcagctctgctccttccccttcttccgtgtccgtgggacatgtcagatttgggtgtatgagagcaaggaaggccatttgaatgtaggtgtattcattaagggaatgataaaataatagtacactgcctgttttctagcttactatttttgaatagactattttttagagcagttttaggttcacagcaaatttgagcagaaagaggtcctatagaccccctgcctcccccgcccccaccatctgccctcccatgacgacagccttctccacagctccaccagaccggtgagcaaacattacagaccagatgagagtgaaaggatgctgctcatgatgcctagagtggcatgggacaccacatcagctctcttcagaactgggtagtgttttgatgacaggttaggcatgtctgaaagagccagcaggatctgaaggtgcagatgcaatcctactgtagaaataacaaaaagctgacccactggtgggactctgacacattaattttttttctgccaaaaaaagatctttttttttttctgccaactgttgcccttccaaaaacatatccctctgcaggttttattttatttttgtctttttctgggaatgtggcttcattttgttgtccttttccctgagtggctgccaggtttggatgaacaggaacacgctgctgggatgtctgatattgctattgctagagagaagagaaaggaatgaggcaaatagggagtcctgcagaggggagagggagctgtccctagtacattatgggaagtcagtgctgaggcccctacttttaatgggaaatcacaaagaaacgtgcttgagggattgacaggaataataaaaaacaccagcatgctcagaatccattcggttcaccctcaggtttctaagaactaaactcatcgtcctaaatgcttacttggagagaaaccactatacgtaaagagacatgtatatatgaagaaacaaggacatagccctacctacagttttatttttattttgccataaaataaatgcttattaatttccataccacgtatggagagagctgccacatgtgaatttcttttagcaataattgccgtgcctgggactccttaagttatatataccgcgggaatagtttccaaataagaacccagagagagggagagattcacagacaatagcttaaaaagtctagaaattatagaccgattgaggtcagcaagaaacaaattattcaatatatcccctgagggctagagccagactttcccctatgattccaaaattacttcgcagtttcattagggtgaaaggcagtgcagtctcatgagttcagaaagtaaaggttgttccttaaaatttagatagacttgacaaccacttaggatggcattttggcattctgtccctgctcatcaaagaagttgctcaaatttgtgggatagaggaatgagagcaagaagtattttaattgcaataccttgtgttgtatatatgtaatacctctatgaaaattcaggaaatcagtactgctaataaacctgatgtacaggcagaatcatttacaatgcggaggagctgtcctcaagttctggtgctgaaatacagaaccaaagaattttatcatttaaagtgcctacacaatatgaatgaatgttttctcctggctcgagtagagttgctgctcaaccatctatgaccaatataaagctaaaagagtacttgttccatcaatagagaattatagaaaaatgttttttgaaacttttcaatgcagtggagatgagtagtactcacttacatctggttcttatttttttctgagacacatagaaatggagcttccctacccccttgcagttatgtgaggccatatgactatctagtggaatgtaagtgaaagtgaaatgtataactgctgcaccaaaagactgaagtcactgtgtgaccattcagctcttttccccccacagcaacaataatattgaccacgtttgagacagaagagccacaagagggaattagcctaaattcctaagcgcccacctggaaaggatcctccttggaagatctgtcagatccatagtaaactttgaatgaaagagaaataaaatgttatgtgttaaagttcctgaatttttgaagcttatcctattctatcctatctcatcttaatatactaagttattcatctggatgtctaaaaaccatgaccatcacaataaaaccttacactgctatcaaagtaatcaaataaatagatagggaaacaaggaactttagtcacttaggaaaaaaaaaaaaaaaagaaacatacctgacaatgtcccctccctccaccccagtggttactggtacctagctttatttgggaaagcaacaaaggaaatatttccagaggctgaggcacctctttggtatagaagtccatttctgcactgccttttaaaatggtcaaataatccatgttgaatttctgataatcagagttctatgtataaagaagccaaggtcaacaccactgccatgaaatgatggatgtaactatcaagcagaggtcaaagaggatcagaattcaacagagaccatgggatgtggtcaacaggaggtcacaggctacctttttaaaagagtagcttcattggaaaaaccagattacagagggttggggaaagagttagaggtgaaaaaatgaaagtagaaactctaaactacaggctcaaattacgtggtggtaaaaggaaagaaagaaaactgtagtttaaaagagaaaaataaaacttgagtttgaaggtagaggtgaaaaaacagatgataggaagaaatgcaagattttgaaaatttggacagaaagtcccatgtatgattgaaggaaggagggatcagagcacagggggaagacacttgttaccaggaggagaaacacatgagggtttaggtaggtttttcttctgcatttctcacttgagtcagtgcatcaacatacaactaacttctaatggccaagaactccaggaatcatcgcaaacatgttttatgtccttcagtcttccctgcattctgttatcatcagtgctatttaacctcctcaatatctcttaacctatacctttgtctgcatttctacagccttaaatcaggacattaattttgatggagctattcaaatcatagctttacaagtacattacaaacttctcagtttctcatctgtaaaatggaaacaaaaacaactaatttttttaagcactgctgtgaagattaaattaaataagcccctggcagtggatcacaaaaacttcttgcttggtatccctagccctggatttcctagtttttatttattcactattttgtcaccagaatgatctgtttgatctgtttgacaatcaagtcttgcatagtttcattcctgcctaaatcaagtcagttggtctctttcatttatagagtaaaatccaggggttcttttagtatgatactaggatacagtatgatacaattgttgcccaactcttcagtcttcaccaatctctcatcttaacttatgtcccagcaacattacacttcttatagcttcccttaagacacagtaatgtttcaaagtttcctatgactttgtaatgctgttccttctgctgaaatgtccattttctctctggttttctcagcaaaatcctattcatccttgaaacccagctcatatttggcctccttaagaacgttcttcatcgctcgttctccatgttacctctccataatgtattcacttcggttgtcacacttaactcattatattgtcatttatgtctttgcatgtcagctttcaataatcatgaatgctttgaagggcaggctgtgttttatttaactctgtaactctctttcctaaagccatatctactacctggtaggtattcatcaaatgtttgacaaatgaataattgaacaaatgcatttgcctgtatggagcaatcataaaacggtcatgaagatgatccctacatagccctcatcttcatggagcagatgtcatccactctgagtgatgtctgtgtttctggaattgttgaaagtggaagcattggaacctaatgttgggggaaaatataatacactaagctcacactggaaactctttgtttggaactgaaaccctttaattcatgcctcattggttttcaacacacacacacacacacgcacacacacacacacgcacgcacacgcacacacctcccatcactttgtctccagaatcatattataggctatctcaaccttgagaattgcacccagctttgctgactgacctcaactatgtactgctcaacttttcttctgaccttgattctagaatataagggaagctatattgatgaacagcaagatcctcacttagttatctgctggggtagtattatgctgcatggtaattccgcttagaggcaaagaggagaggggaggtagatcagggaagctgatggccatagtgttgactgagaacctaggactccctacttgagtttcctctccatagccacaacttgctatgagacttcagcttgtttccccccatttataaaatggagagaactctgtaacaccagctctcatctatctacaaaaataaaaaatggaaagagacagcctccagcttttaaagtactgaaggggcgttaagcagcaactaaagtccagaagtctcacttgaggaaatgagaacttatgctcatgtaaaaacctgggtgagagtgtttataggagctttatttataatttgaactggaaacagctcaaatgtcattcagttggtgaatgggtacactgaggttcacccatgccatagaatactattcagcagtaaaaaaaaaagggggcaacaacatggataaaggttaaaagcaccgtgttgagtgaaagaagccaatacaaaagagtatgtattgtataattccatttctaggaaattctagaaaaggcaaaaatatggtgacagaatacaggtcagtgatttccaggtgctggagacagggagagaagactgacagcaaagggtcataaaagaattgtggagagtgatggcaatgtttatatcataagtgtagtggtaattacgctaatatgtatatatatatatatatgtatatatttctattttaagacctattgattttgaaataattttggacttacaaaaaagttacccaaatagtagaaagagcttctatatccccttcccccagcttttcctaatgttaagagcatatataaccatgtcctatgctcaaaaccaggacattaacactggtacaataccacgacctaagctctaggccttattctgatttcgccagttcttctatttaatttctaattcttttccagggtcccccattccatttacttgttataactcctttgtaacctcatcatctctcatttctaccaagtcctcaatccttcattgtctttatgactttgacacttttgatgagtactagttggtaattttgtagaatgtctgtcaatttgggattgtctgaggttttcacatgattagaatgagttatatatttttggcacgaataccacagaaatgatattgtgcccttctcagtgcatcctttttttttttttttttttttttaagagacagggtctcactatgtcacccaggctggtcttgaactcctggcctcaactaatcctcctactttagcctcccaaattgttgggattacaggtgagagctatagcacccagcctcagtgcatcatatcaaattgtcatgatgttgtcaagtcttgttactgatgatattaactttgatcatttggttaagatggtttctgctaggtttctacactataaagttattattttccctttgtagttaataaatattcagggtcaatactttgagactatgcaaatatccagtttctcctcaaactgttgcccacaattttgtatccagtagtgactcttctctataattattattgtaacataattaaagatttttcctcttttcttccacatttaaaaatcttgattttgtcttctaattgtttaaaatctttttattttgaagcagttatagaaccacaggaagttgtaaagatagtaaagagatgttccatgtaccctatacccagcttcccccaatggttatattttacaaaatcatagtgtactatcaaatcaagaaattgacatttctttaaaatgcgggtatagttctatgtcattttattacatgtctagtttcatgaaaccaccaccacaatcaacatccagaactatttcatcacgaccataaaaccagacacttaaaattggtgatcagaggcacattatacctcagtaaagctggcaaaagactgaaaccaaaaaccacccaaacattgccaggatcatgttacactaagcactctataactattagctctcatactgttgctgttttatcacagagaaatgccagtcccagaaagaaacaaaggggcaagggacctctccttttgcatgcctccctgattgctgctattgtggatggattcgatggaaatgagtcgccagcacctgggtctagcactcctctagctctactggagtgattccagggttgtcacccccatgcatgtgacatgtgactctcatgcacatcagcatgggctttcttttgctcccattttccctctctgcagtgactatattttgttatttgcatataccaagtgcatcttgcttccgagtcttttccattgctgttccctctgtctagagtgttctccttgaagacatctggtggccagctctcatttcatttatgcagaaagagcttcctgggccacctagtgtgaactggcccctccctgcaacccttagtcccagtttctctctatcatgtgactgtgttattccattatagcacttattgctggaagaagctgtcttggttatttattctctgctgtgtttattgtctatccctggtcccctccagaatgtaagctacataaatgcatgagcatagcctgtttggtccactgctgcctctccactctgtcaaaggaatatgagtggggactttctaaaattgttcacacccccagaagagtttttctaccaccttccttctcattctctctcctcttttcttctctttcagctctctgtctcctcctgcttccaacacacacccattgagatggaaaataaagtatagcatatcattagtggaatcacaagcaaacccagagacttcctcctactcccacccttttctgcaatgaccccccctttcccaccctttcccttggcgccctgcctgttgttgatgggtgcctgcaggaggagtgcccagaaagcagggctctccctgagtcgtccctaagcagcttattcatgaactgcatgtaagttaatagaaaaggtttccccagaaatctgcaggtttcttgccgttcccactcttcccctttgccctgttacaatctggttagccctgttattattatttctgtggaatggcatatatccgtgccattaactctacatatttctaggggaaaaaggatggagaggaagaaaagactgattatttatcaaagaaaagacattttttcctctctctagacagccaggtagattttctgaactcatatctgccatggaaatggggctgctgcttctgaaatgagtcctctgtgttgggggtgggctctgtttttacggccagtgggtaatagcattttctgatttatgaattggcatctgggggaggtgctgagcccctagatggattcatcgtggggagaacagccatataaatactcctgtcacataaaattattgttctcattttgatttttaaagaattttttcttttgcaagatggtgggattgagaagatattagtgaggaagcaggagaggaaggagtcacttggcccctttttcttagaaggcaaacatttttgtctggacattctccagaaacacggggttgcttagaagtcaattactagaatggtttacttattcagggaatacttggcactgtggcttaagtgggggaagctggatctcaggagtttgacccaggctccaattgggaattttttttaactggtgaagaaagggtcatttcatgtaagttcctcccaccttccctaaatcagtgtgaagatgcatttaaatgcaccagatgcttatgggtagctgcacagtaccaaccaccatgcaggtcctgtgagggctgcaagccaattataagccctggtgtctgccctgcaggagagtgcagtctggaggatgagtgtgaggatgactcagtataggacacaggctttgaatcacgcacaggattcccctggggagatgagtcctacggtgtcctgaacagatggcaggaggaaagcagaggctcaggagggaggacacacaccatgtggctgcctagaaaatgagaaactgttggcggtttatgctttgtgtttcagacacttctctccaataaacctgtaaactttctgaggacgaggaccttgccatagacttgtttggttcttaccccttttcttccctgaccttgaggcttaacacctagcagggcaggagaaaccacactgttttctaagaaaggccagatagcatatatattttagactttgcagaggccatatggtctctgtctcaactatgcaactctgctgttgtggccaaagcaaccgtagaccacacatgtaaatgaatgggtgtgaccaagttccaatacaactttatttccaaaaccaggtggttgatcagattgggaatgtcgcttgccagcctctctactgggtgaacaataagtgcctgctgaattgagttaaaatgatgtcaattaataataagtgtacctcactttttaaaaatgtcaaatatgacctgacaaagtatgcaaatgcagaacatgtgaaaagagttattttctatgcagaaagttcctgtggccaaataacatacaatctgttctatgaacacatgtcaagaaatggtcccttacatacaacctgaatctcagaattttctccagtgtgcaagatatggcacagacactatctttttgcacggcgccaggcttcagagggcagtaaaagggaaagaatctcccttctcatttcataggcctgaggaggagctgtgccagagtctgagactgggaggcagactcttctggatgggggcagcccaggctgttgggctgtctctaaccagtatgtctaactatgggaggcttctgttcatttctttatttctttgttttcaaggcagaataaactccaaattccaagggtcaactaagcgcctaccaccagcccatgcatggccacaaaaagccttcgtgtcatcagtcaatgccaactagttaataatgaccagcctcttcactaatggcccgaggcaggggttctcagggcagcgaaggccctgggacagagacttgccagcggctgcatggggagaatggtttgcaagaagcatatctgctggccactatcaagggcatatccacccatgctcagctctttagaaagatagtaattagttttttccccttcggtgcacacagtgaatgcagcagaatctggtatttggagaaccattggagtctgtccctctcatcttgatttgcctgaggtttatgtctataactaagaaatatcaagattgcaaggcagttcaggggatgtgtttagctcccaaggagagaaaagaaactttcacacgtcagggcttcaggcaaggagaggccactgcaaagggaggttgatcgtgactcggctggctctgtaccacattgtgtctcttgcaaactgcaggtggtgataacaatgactgaatagtaagctcccagagggtatagagcttgtcttgtgctctctggatgttccagcatgaagacatatgcacaaagttacagggaaaagatttctagacctacagagtccattgtggtcatctggaaagtgcttcctgactggtgagtggtgcacactgtgatgggccaaggtgtgccattggggcagctggaagataccttgttccctctggtcattagaggacttccatcacttgggctagacacacaaatacattcattttccatgtgtgccttaacatagtgacaggttggaaagcattgatctgctctacacatgagaaaattaaggctgggcatggtggctcacacactttgggatgccaaggtggaaggatcacttgagttcaggagtttgagaccagcctgggcaacatagtgagaccctatttctaccaaaaatttaaaacaaaaaatagccaggcatggtggtatgcacctgtagttctcagctacttggcaggctgaggtgggagggttgcttgagcccggtggggttaaggctgcagtgggccatgatcataccatcgcactcagtctgggagacagagtgagactctgtctcagcgaagaaaaaaaagagagaaaattgagacttggaagtcaaggtctcacaagtcaagaacttgaatccagttagctttactctatgtttaatacttcacctgctactccactgccacccacagtaaactgtcaacaaataactgtagaaggcaagttgttgagatagagaaatcactttaaaactagtggacggagagatgatgacattagcatgacttgagatgggagccggacgcccaaagctgaagtcaacatattgccagtttacacaaggcattcttccctaggttagtgactttcattttgaccatgactcatggcaagagatatgttttacattgcaactcagggcatacatacatgcccatatatagtttcacaaatagtagttatccttactatgtttgatggccactattctattcgactttattctattccattaaaaacaaattctggtcatgaccctttaaattgatttcatgacccactaaattgatttctcgacccactaatgtgtcatgaccagcagtttgaaaaacactggcttgacccttttccagctccccctccctcctcagaggctgggagaatggaaggtaaatgtggagaaaaagaatgagacaagagatcgagagattgagataaaaataaggaagaaggtgggagaaacacaaaaaatagtggaagggataaaggaaagaatggaaattaaatgagaagaagggagaaatgaatgaaaaatgggagacataatgagaaaaggcaaaccctacactgacagattcatatccgtgaaaactgctctcaagctccatagtcattctggccatatttatacaagaatcttccctgccagcattaatggccatagccttgataatgctgtctgcctgtctggggatttcttatctgtcagcaccatctcaaattcctatagtgactctcagagagaatcttccatctgttcttcaggaaaagaacagaaaagactagaaggcattgggtaaattaccaaggaatagaaagtgaccacacccactttacccactcctttgcaccgtgggttctatagactttgagctgagtctacacaacaaactcttggtacaaaggaaattgttttagaaggtaacagaaaagtgaaattcagagattgaggtaaagttaatttataaagaagctgcaagtttacatactccaatagccagaggtctctaactgattttgactgcacacttcatagtaaaaagttctttgagcatgcacctacaatgcacatatatttatttataaaaaatttattaataaataatatatatgttctgctcattagcatcatagcactatcaaacctttagaaaattaggaaatgaagtgagataaagataaaatagcatcttgtatttgattttacaaatgagtgatacaaaacattttactatcaccaagaaaattattataatggtaagagtgatgtgctagaattggttttattattgtttaatacatttgtttagcacttagtgatacaaggctctaaggtctaaggttcaatttatttccatactttgttttaatggctgtcataactgaaaaggacacctcacatagacgcagagatgcaaaaaagtgcattgttggctgtgctgaataaatcaagattttttttttcagtctcatgcaccaattatgtgaagactgttgttgaaattcagctagtagatttccatcttctctgatgtcaatcagctcttggaactaatcggagggtgctgaatttttatattttttaacaaaggggtcaaaattctctgaaactcttcatttggaagatttttaagcaggtagaagattctgtttccaagttttaaaagttttaagatatgaatttttaaagtgtcacatttactcattattggcaacaaaatcacataatgatgaaaatatttccaaacatcttttctctccccaaatgatctcctcatgccataaatccttctgaaagtacttactttcttacccattgtgaatgtattacttttatattggagggaaagattaagtgtttattttttcaaagttaccagcaaagtggcatactctgacagctgcttgtcagaactgaaaaggtcagcaaatgtggaacattttggttcttttaaaagaaaaatgattaattatgtttccataagcagcagacctctgtgttgtacaaaaaatttccgtggtcacttgtacatcattgcaaagtattataaagattttatttaaaggattgtttttataacattgataatatctgtcacacataaattgcaaatttgttgtagtatgttgaaactgactcagccagtgaggatgccagtgtcaagccctccaagatgttgggttcccagcatctctgtgcctctctaatgcatgaatgactgatgcatagaccaagggaggcagacactagctagtatcaacactatattaaacacaagtaaaaccagatttcttgttttaaataaattttttttattattatactttaagttttagggtacatgtgcacaatgtgcaggttagttacatatgtatacatgtgacatgctggtgtgctgcacccactaactcgtcatctagcattaggtatatctcccaatataggccaggtgcaatggctcacgcctgcaatcccagcactttgggagaccaaggcaggtggatcgcttgagctcacgagtttgagaccagcctgggcaacatggagaaaccccatctctacaaaaaatacaaaaattaattgggcatggtgatgccctgagactaccctgcatgccctgatgcacacctgcagtctcagctacttgggtggctgaggtggaaggatggcttgaacctgggaggcagaagttgcagtgagccacgattgcaccactgcactccaggcttatagcctgggtgatagagccagaccttgtctcagaaaaaaaaaaaaaaaaaaaaaaaaaaaaaaaaaaaaaaaaaaaaaaaaaaagaagcagtagttctaatagtttctcccctttcttcatcggagagtgttccttcttagcagcccttggcatcaaaatgcataacactaaagaggcaaaagggagctcagtgttttagagtttggtctctggtattctggagcaaaacagtaaataagtagcctcccctagattattgtgaagttggggatattgggtcatcagcattcaactttattttatttatttattttttgagatagggttttgctctgttacctaggctggagtgcagtggcaccatcacagctcactgcagcctcgatctcctgggctcaagtgatcctcccacctcagccccccccaagtaactgggacctacaggcgctcaccaccatacccagctaatttttgtagagacaggatttcaccacgttgcccaggctggccttgaactcttgggttcaagcaattcactggcctcggcctccgagaatgctaggattacaggcatgagccaccgtgcccagctagcatccaactttaattgtggaagacagagtaataaatatttgacaataaacaatggctcctaaattaagaacatctgagaagatgcaaagtgatacatgaattcctgttgagaactatgtaactggcagcagtaggaggcagacttttaataatagtaataaaatgtgtgccttttggaaaagaacagtgaattagagactgagagcatggactaagctcagaggtgaggaaagcttcgcagacctaggatagagagatacgatcctgggcatttgtgtgagcatgagcaagccaaacatcagttagtctcaaaggcaacagctgcccggacttcaaggggtaaccctgagaatctgattgatgaagagaacactcctttccccaaatcgcaagaagaactcagcctgtgctcatgacagaacagcacacacaaaaaaagagaaacttgggtcaggcctacagccagagagactagccaaggaaaaggtagaggaaaccaggagagctgggaaaagatagttaagtctttcccagtgaaggttccacaatgcaccaatcactctaggtgctcctggtaacatgagttctgtggccaaatgactttgagagatactacttcctacatttgtcatctcactcatagctcagagattcataatacccattagtatattaaatgcactatcaaatgctatagtcaagatatccacttaactcaagggctggatagagtggctcatgcctgtaatcccagtgctgtgggaggccaaggcaggaggatcacttaagcccaggaggagcccagcgtgtacaacacagcaagacctcatctctacacaaaatttttaaaaatttagcttagagagaaagggcacctgtagccccagcgactccagaggctgaggtgggaggatcatctgagcttaggacttcaaggttacagtgagctatgatggcaccagtgcactccagcctgggtggcagagtgagaccctatctctaaaaatcttaatctctacatatctatacatctgctcaactcagatttgctcaaacatatttgactaaagaaagcttttgttttaaaaaaaagtcctgcagaatttttgttctaagaaataaagtttgggaaatactggactaactaactgatgcttaaatctgtaccaaggcaaggaccagcaagaggtctcctacacgtgtcatgcttcatgtgaatatcatttgtctcttgagacccccacactttaatgagagtgaacatttatttcccagcctgtggattaaaaggggttttgagggaatagaactttctccagagggccttcctctcctgctgaaggtgatctcaggtgtgagtagtggccctagccaaaggccacgtctcagggaagggggttgggcacctctgtccactagaacacccaaggggccttggaacctgtggactcagactatgaggccagagccaaccaggagtggggccgatggaggcctcctggtctgctctcggtcactcttggcaccaaaaacacctaatacgctccagaggatacatgagtgagtttatgaatgatggaagaaaaatattacaggtggatttctttcttttcttttctgaaacctcccccttccaggttcaagcaattctcctgcctcagcctcccaagcagctgggactacaggcatacaccaccacgcctggctaatttttgaatttttagtagagatggagtttcaccatgttggccaggctagtctcaaactcctgacctcagatgatctgcccacctcagcctcccaaagtgctgggattataggtgtgagccaccacacctggcataggtggattttttttcaataaaacatagacattcttataacaatcaccagcatactgaaaatcatagagatgaaagctaagcctcattgagttgtcattatgtgccaggcaatgagctaagaattttatgtgcactttcttatttattcattataaccacccagccaatgggcactaggatattcccattttgtcgatgaagaaacggaaatacgcagagattaaataacttgtccaaagtcaagtggcagagccagaatccggaagcagagctgtgattctagccctgaaccaccttcaagccacccagcttgcaactggatagccttctgcaccagctggaatccttttggagaaggatatattctctacctgttcctccacctcttcattgtttttctggactttgtctaaataagtattcagataatctccccttagccattgtgcatcccttcaaaaccatcgcatacgtctctgagtcagtttcaaattgatgtctccattgtctgcttgtaatatctgaaatgcacttgaaagactcatatgagatatgtaaataaatgccatttgtaatttacccttttatacctatattgcatttagtaaagtcacatgacatcattaatgctaactagtcatcgtgaacaagggcataaattaatgtgcatcaatttacttttgaaaacgtcccattgatattcaaacggagtgtaaaatgtacttaagtatcaacatttctggtctgttttccacagaactcaagagcaagtcaatcagtgctcatggaatttaactatttccattaggataccatccctaggggacaggggagtgggttggaacagtgtgagtcaacttctaccaacacctggcctgttgagaggggtgaggtggtcaaggcccacccaccacccccacccacaaatgaggatcagtggtagtcttaagaaagagcccaaagactccagcctccagaccagagtccttgtaatgacctcactcaaaagcgtaaggagaatgtgcccttcaaactgacatctttttcttccctgatccctaactccatgagaaagttgggtttctggagcaattcccacagcaggaccacactcttttcaacacccttcaagctggagtttgctctcactttaccactgcagagcttccagaacaaggccttccctcggcccttctctgattgtgtacagggactggctctgtgtggggcatgcagtgggcgcttactaaacagacatggtgggacaggagctggaagctagcagagaagcagccctggccctgtctgtccaccctgtggagtctcctcatgtgctgctaagtggatgattataggtggttgtctttaaaaatggcacttagagtgccccgaaagtaacaggacaccggcgctaagttaggagaaggcgcaataattgtcaggacaattgccagagacagatgcttaatggagttcaggattagagacctgccagcgctttccttaactactggcccttgggtttcctcagcttttctcctgctccacatcctccctcacccacccctgctctacctccacatcatagctcttcttctctattctggggcagagagaaggaaaatgagccagttttccctctgctctagaagtcctggaagatgagggaccaaaagtttcttcagctacccaatctgtgataacttcatatatccaatgaggttggactcaaatggattcagactccttccctggagtggaagcagagttacagagaaaaatccagagacaacatagctctctctgattagggtgggagaccacagcctcctgggccctccatcccctggaaggcagtgctccttactatgaagggagtctctgcctgagtactttctagaggctttgagatgatagataggggaagcacagaatcctgggtagctggtgcctggagctcaactggcctttagccaccaagcagtggtttgtccaggcttccctgcccctaacaacgtttttgtttgtttgttttggacatagagtctcactctgtcacctaagccggggtgaagtggcatgatctcggctcactgcaacctctgccgcctgggttcaagtgatgctcatgcctcagccttccaggtagctgagactataggcacgcacaataaggcctggctaactttttgtatttttagtaaagatggggtttcaccgtgttgtccaggctgttctcgaactcctgagctcaggcaatctgcccgccttggtctcccaaagtgctaggattaacaatacattttctaattgtaataagaataatgataatgatgacagcaaccacaacttactaaaagcctactacgtgctaggcactttacatatattaacttcaatcctaaaagtgctgaaagagagttatcatcactttaattttctacataaaaaaccaaagcatgaactgcttgagtgagttgctccaggtggcacagctggtgagtactaaggacgggtatgaaaagccaagtccgtgatctgttcatgaccccccccggagcctccatcctgcacatgcttatactttctggtcacccccatggtctgtctgagagatgccaggccactgtggtgatcatactcagatgtcagagacttttgcctacaccagtgaccatgtagaaacacgtcagtcagaaaaaaacagtgggggtggtgggctgctaccctgcctactccctctgtgaggtgaggctggtgccacccagggctccatgtaccccgggatgccctagaggttgcaaaggggcacttgtcccaccttgtgtcaggctacaacaaaggagaagtaaaccaagggacctccttcatggggccgaggctggttctgagttctgatcacatctgcactgctccaccaccccatccccagagactccttctgccttctatggctggttctgacacccaagagtggggcgtaccactttttactggaaagtcaagatgatggatagtatctcttgctctcacagagggctccccattcctcgttggaggagggggctgggaaaggcattgcagaaggagctgagccctatattcaagctcagctcctcccccaaactgctggtgactctggatgacctgctccctcctctgtgcttcagtttccacactgatcacaaagtgcagtaggagcgtgttgcgccagataagccagtagcgttttccaggcctaaggttttagggtacagtggacaattcagcacctactgactgtaggaaactagggagggaagtcacttcccctctggttcctccagttctgccgtggtaaaatgcagacatcctgccttgattgagaatgaagtgggaagtgggaatatctcagtaatgacattctggaaccttcagaatctgttccagacaaatgggaaggctcccacctgagtgaaattgggtgaaacattgagacagcttttctgtttttgtgaatgtctgaggtggctccatttcctgtcactcattcctcagccctgtgcttcaagtttgctctcccaggagctatcagacataggccagcctgggtgccaggagcaaacatccacgtgggcttgtcaccgtgtcagccatccaaacactaactggagtgtacagctcggcccccacaggggcagagaggatggcagagagacggttgcatcaccatccagtgcaccttacatgagacatgcccacagacacagtgctgagggcaggactcattttcacaggagcccagcacctttggctgcagacagtatctccacaacagcctcttctatcaaatcaatgtctatagacctccaagactgtcagacttcacatcaccttcctcagaacatcctgggaggcagggtggagacagggacagacactgaggtgcaaagaaatggtaatgactccttcatcacacagggggtccctggtggaggcaacatccacttaggggtcccaagcctcaagcgatgctgccttcttagaccatgatactacctccccgttgaactatagctccttctgaagctctcagcatggtaaaaaacaatcacgatgcctcctctcacctcttccctccagagaggctggcttcactatctttcaatttcacaaccccaaacaaagaacttgcaaataaatagaagaaggaaagggacaggacaacatggacaggcctccccttctcctcttgtatgcccatctgaccactctcttttaaaatgcaaccctttcaccctcacaaggatcctgactccacttaatccacttgatttcctttttctggagtgtttatcacctgctaacctagtctctgatttatttcttaggttggttccttctttgctgcttccttttgctaaaagcatagggatatgtcactgtttcttcatggttgtattcccaatgccttgactggtgcttggcacatagtaggagggagcttagggaatgcatcttttaaaaaaatttatttttatttattttttttttagagaagtcatctccctctgttgcccaggctggagtacagtggcatgaccacggctcattgcagcctcaacctcctagattcaaataatccctctgcctcagcctcctgagtagctgggactacaggtgcacaccaccacacctggataatttttaaattttttgtagagatgggattttgccatattgcccaggctggtctcaaactcctgccctcaaccaattcttctaccttggcctctcaaagtgctgggattataggtatgagccacagtgcccagctaattaattttttttttttttagagatagggtctctctatgttgcccaggttgatctctgtttcctaaacgaatgaatgaatcaggcctgagtaatatgctataaagcaaggtggccctcgccacttcactactggtttacgctggaaggagccaggcaaggctgctatcctgggcaatgcctatgggcagggaactcacctccaggcccacctcctcaggccccacaggcgtccgcatcctgctttatagcaaggacttgagcaccggcagctcagaaggacaggctgcaggagtcccccagcacctggaagcagacccactgtgaacaggagtcagtaaaacaaaggacaccataaaagatggctttggtccaaacatcgctgaaacagatccccaaagcagaaatgtgtgtttgaggcttctggcttccaggaaggaaagggctggtgtgtggagaggcagatacattgaaattcactgagaaatctgccacttcctctgggtctatcaaagaagatactcgccttgtctgggggacagctgcttctcccctggtaggggtcactccagggcacccaagaacaaggatggtcccagctctgccacctcatcttctcatttatctgcctcactgacatttcccctcacctccttcccattggcttggcaggtttttatcacactggtttcagtgtgtatagacattcccttggggttactggaattttagtaaatacacaccacactcatatacatgcatacacatacaaagcaagaaggaggctaacagagacacacagacagggatagacacaggggaaggggtgggtgtgcatgtgcacacacagctgagagatatccagaatcatgcagaagaaagaaaagagacagagagaaacgtaacacggctctgaaagagacagttaaatcatgacaaaatgacactgacacttaacagtgcacactcgtacactccaagcagaagtgtacccggaacatggcatttgctgcaagagctcacagagggacccacacgtccatgataagagaaaccatatccaggctacagaactacgtaatttgcaaataatctaatagctaacgtttgctgaatgttctttctgagctaagctcttttacatggaatatctcattgaatcctcactcactccaggagatcaatactgtttactaaatccccatttcacaggtgcacacggaggctggggtgatctgagctggcctctgtcttcagctgtctcactcaccactttcccccttctcccctcctggcagcccgtccggtgtcctcaaaaacacatgtcacatgccgtctctggcctctgtgcttgctgttccctccacctggaccacttctccccagacggtcctctcgcaccacttcactctcttctgctttttgctcaaaagttccctccttggagaatttcccttgcaaccatctttaaaagagcactcccctccactcttctggccatcaccttatttctcctgagtcggtttaatttttcactctgttcactattacctgatctaagccattcactcattctctcattcgctgtctctctgcccagaatgtaaggcctataaggataaggactttgcttgtattgttccccatggaattcctggtatcctagaagaatgcttggctcagagcaggtgctcagtaaacatttgttgaatattgaatgaataaggtgctgagggaatgggtgacagagccagaaaatatgtagcatttgtgtgcagatatgcacatgtgtacacacacacacactccattctctacctccattagtcatataatccttaccctgcatgtcgagagctggccatccattcatcctctctaccatgcattcatcctaccacatgccaagagctggcctatttcagcatatggaatgaggaacactggaacccaaggagagtttatttatttatttattttttgagtcagagtctcactagtcacataggctggagtgcagtggcatgatctaagttcactgcaacctccgcctcccaggttgaagcgattctcctgcctcagcctcccgagtggttgggattacaggtgcatgccaccaggctcagctaatgttttgtctttttagtagagatgggtttctccatgttggccaggctggtctcgaactcctgacctcaggtgacctgccctcctcagcctcccaaaatgctgggattgcaggcgtgagcccccacactcagcccccaggaaagtttcaaacagcagtggggagtcaaagttagttgatctctctggatacttctttaactatggattcattaactgtttcacgactactaaaatatgacgcaaaatatttcccctgactgtcaaatgcctctttcctgcactctgtgtcccccagtgtggtatcaggtaaatcagagggaggctggaggtggcagagagcagcatctccatccacaaagaaactagggacaagaagggatgaaagagtgtttagaagagagagcagcccctgcccaccaaatggtaaagaggaacattcctcaggggcagaggtaacaccctagatagagcttgccgggttgctgacgaatcaaagttatctggttcttaataaaactcagaatcctgccatctctatttaagtcttcaggcgtcatctccaggcaggaggtcccagtctcaccaaaatcagagtgctctcaaagaagggctgctcttcatcacaaacagatgaagtccaaagctcattcactcatattaactctataagaatatacctggccctttctctgggtgaggtcttcctctacctgctagacacaagagagacaaggtccctgccctccaggaacttatatgctaattcatagggatgggaaataaacaggtaattttcatactgtggtgggcagcagaagggagtaaacaaaaagacttaataggaagaagtcaagattccagggtgagggatatttatgtagggtggccagcggaggcctctctgaggacacgatatttgagcaaaaaccacaggcatgaggagggaccagccacaggaaaagccagagagttttcacagcagaggaaacagtaagcgtgcaagttctgcagcaggaaggagctgggctcagggacagaacaaaggcctgtttgctggtacacggagagccagggtccagggtcacaaaatgagcttgcagaggtggagatgagtcacaggatggggccaagggaccatgccaggagcttgggccttatgccaagaatgatgagatgcccctgatggtaggaggggtccatgaacacccattctgttaacttggaaagtgctcacaagcctcccgattcagttgctcatctcttcgcctgttgtattagcttgttttcatgctgctgaaaaaaacatacctgagactgggtaatttacaaagaaaaagaggtttaatggactcagagtttcatgtggctggggaggcctcacaatcacatcttacatggcggcagggaagacagaatgagagccaagcaaatataaaaccaccggatcttgtgagacttattcactacatgagaacagcatgggggaaaccacccccaggattcaattatctttcaccaggtcccttccacaacacatgggaattatgggagctacaatgcaagatgagatttaggtggggacacagccaaaccatatcacctgtcattgtattgaacacaacaccaggacaaaaaggttgtttaggccactgccctgctgcagataccaaacagatcagagaagagagaggctggtatgtaagaatggacagcataaagcacacattttctaccaccagtttttttacacagtgatccctgttagaaaatgtgtccttcaatcccatataagcctcctggattatcatccagattgccactctcacatatgtttaggatgcccttccactaagatctgggaatacaggtgctagtatgtttcatgttagattttagtcttcagttataggagcaaccagagcaccaaaattgaaaccacagctctcttgagcccagatccatttagtcacccattccacaaatgtgatttgagtgtttattaggtgtcagtgctgttctaggggtaacacacaagtaaactaaagagactaaaaaacaaaaaatcatattcttatggagtttacattttaaatgaggaagacatataatacagaacaattattaagaatcatatagcaaataagaagagactaagtgctatggataaaaatagagccaggagaggagattgggagtttatgagtctgagtggaaggcaatctagagttttacctgtggtactcaggggacgcagatacctggatagaattccaggcaaaggggaacaaccaggacaaagatcctgaagcaggagcctgccatattgcaggagcatcacagaggacatttctgtgtccagagcactctctcccgccctggccctgcagactaggggagcagggagagcggggagagcggcaggtgatgagcttggacatctcatgaggacagagcatataaggccctgtgggtcttcataggcactttggtcattgaaaggatttaaacggaggaatgacactatctaactcaaacttttgaagattaactgctgcatggagaaaagactggaaagacaaaggtggaaacagagagagtagttggagggctattgcaaatattcaggcaagagaccatgggggttcaatccaggtgggtaacaatgaagtggtgggaaatagccatattctggaaacattttgtagagtccgtagaattatgggagctacaactcaagatgagatttgggtgggacacagcaaaaccatatcaaggtgtttatgttaaaatgaggctgatagagagaggccctaatccaatttgactggtgctcttagaagaagaggcgagtaggacacatagagaaacaccagggctgtgcacacagaggaaaggctatgtgaggacacagtgagaaggtggccatctgcaagccagggagagaggcctcagaaaaaaccagccctgctgacactgtgatcctggacttccaacatccaaagctatgagaaaacaaatttctgttgtttaagctccccagtctgtgctattttgttatggcagccctagccaatgaatataagtggtagattactgacatgcaggaagtgcttcccttatctgacttaagtttgaactttgtaataaactgaagcaataggttatttgtgttggtacctctcttttccaattctggttcaatgagggcactggggactcattcattaaaaaattaagaggggcctattaggtgaagtttaggctggcaaggcatcggatgctctcaagctgctggcagcaagagagacaaggaagtcataatcacagcctggtctgacaagagctactatagacatgtctaactgcaggccaggaatagtccaatgaagaatgtgacagccgagctaagttttgaaggacaaggaaaaattagtcacataagaaaggaaagtgctttccaggctgcactgacatcatggctaagctatgcccttagcctgcagacacagtgtgcaacgtgttctgacccatcatggctgagggagacccaccacctgaaggaggctggaattagtcttgataccctgggtctggaaaatacccaggtatatttatcaagctgctttgccctgagctctattccgcatgcccaacctgtcaagcaggcctgggttcctgatgcgctctcccccgggactggatttttgctccctgcctcccttggcctcacctgggctgctgtgctccaacccagatggaccatctagaatctcaataccagcccctgcctgactctaagcacggccagtgtctggaaactcctgtcacagagtcataaaaaacaagagtctctccatttaacaagcacttactctgtgccagccatggttctaagcttattatatgcctatctcattcaattcttggaaaaaaactatctgatattattgtcaccaacataggacagtaaagaatgctgaatcttaaggttaggaacttaccagagactacatttagtaaatgagatttaagattcccactcagacatttcaatggcaacacctgtggacttaatcattgcactgttctacaaatctccaccaagaatccacaagcccagtggagaccagtgtcggcccaggtgttaggcctttgagatggtcatttgggtggcaggccagtctccacatctgtgtggagcagccctggaatggatgaacaccctggctctattcattcctgccttcctttccaatgtgcccataatatggagttctcaggatgcctcattgccaagcctgaatggacagtgaccacattacccatccaaggggaaacagctgaggacaaagaggtgaacaaggattcagatgggcacctccagggaaggagtaatgctcagaatgctgactcagttctcaaagggggctgataactcatattaccagcttatactttgtttttttgtttttaatttctctttttttttttttagagacaaagtcttgctatgttgcccaggctggccttgaactcctggcctttcggtaatcctcctgccttggcctcccgagcagctgggattataggtgcaagaccctgcacctggctccgtttatattttccgtctttgaaagtcctcttatgttttaagtcccaggttcagaaatgctggctttcagatcaggcaagaaatcttgaatattcaatgccttgtgaagatcttctccagatgattcatgccaccaaggaaagctgcttcccctcagctcctagggcctcagaggtgggcttggagtggggagtgtggaagctgttataaaagcaaggaatgcagacaaatgggaagcctcgtgcccagctgcaggctccatctcggtagtctcccctcccaggaaaaaatactccattttccaccctaccttgggaatgagaccattcccaagccatggcagcctcatccagggcacagtgggtcccagtatggctgaagtcgggagaacggggagtctgacaacaggagaagatgtcatcgagctcttggggagggcagagctcctgtgactgttaaggcataatgcacaagccccgtgggtggcataatgtggaattcatctcccccacaatgccaagagggtccaggcagaacaatccagactctgtcagcagggtcctccagagagttcaggccacgctgacgaggatgaaaaagaggggagatctgcccctcatggccgctgctgccactcagagctaacgcatacatattcatgggatagaggggcagctcccgagaatgacccatcctccacagaggccacagggcagaggtacagcagtgctgcacctcacttggggtgggctgtgtgttgtggggtggaggactccaggaaatacccttaaatacatggatgtccaaggtgaaaccccttcctttgcctgctgcagacatatgactcctggcctgagctcagggactccagaaaaactcacttcgttctcagctcagtttgagaaccaagcccaggttttctacttcctactcagcatcagcaaacctgcaccatatctgttcttctcgggtgggctccatggcatttgctggagtttccacaaagagttgtatgtacacacaaaagttcaggccgtgccctaccccatcacatctcatcacacagactgttttctgagtcctgaccatggtgttcccttaactacactcttttggcaataaattcttgatcccacaggcttctgggggccaggaaggtgactttggtatgaggtagcattttgtatagggaaatctggacccacaatttgggcatctgtacgacgttccttcagaagaaagcaaatgttggccccgaacatatatgcatgattttgaaattagtggatttgttttagactctccaatattttgatattttaaatgtttctttcctgtttcagaacaccaagcctcagtccccaggcagcataactgaaaagtataactgaaaagatacatactacgccaaataaatcaaatcacctctctgcagctggcctcctaaggtttgtactgagccacaggctagtatttaactgcaagacaaatgtctagcggagcccgaagagccttacctgcctctctgacatgatgtagagttgctcgtggtccttggagaaggccatatcccggaggactgggccggggtccaccacctgcaccgtctcatactggagggcgttgcccctgggtccatccacccggatctgtggagaagaagaggagagccaaagtgagttcagatcctgcactgcccacagccaaacttcagccaaagaccctgtcaacagccaagggagagggcatgagttctgtctccacagtgctcacaggctaaagccaaggagtggagtgacataagctcaccaagggcctcaggatgggagtggcagagagggaagtgggggaccaagctgggcttcaccaagaatccagtcttaatctccctggttccctatgcctcaggctcaagcatttgatgcctttcttgctggtctttggagaaaaagatgaggctctgaggcttggaggaacaacatgtaattgaaactgcctcagatcagagcgtcaccctgcattggaaaggcaatattatttgctgcatttgttagcagaaaaacatgtcagtgtaaggatgggaactgctacctggatgtcattgctgttccttgaaggtgaaccaggcagggggccaaccccaaaggtttcacactaagggtctctttttttgccattgaaatagtggcttatacttataccattaggtcctgaaaccttctagaggttttgttcacgtccccagcaaaagggatgtgggaattacaggaaaatgtgcttcaggcatgagtcatccacaaccttctgcaaacactcagctgaatagatcatccccggccatccataagtccttcctagaaatgctgggacagcatagagacaatggaaagaagacttctgcccacatgccccatgaatgagaactaacctagaaaagacatgagctttccaaccctacatgatgctcatctggcctctggatgttggccaaggtctctggaaacatcctgtgtttgagtgcatagatccaacatgaccgctgcgcagtcagtgctaaaaacaccactcccataaatcaggaacaaatattactgagagtgtggctaggcaagaactaggggatcaccacacttccctaccacatgcacaactgtaagctacacataacgtaattttagagatttcaacaataaaactaaagaaaaaaattatattccaaatattcccattaggcactcttatttttaatttttaatgtataatttttaacctctcacaagatcaaggagaataaaagagtcattctgaggaactaaattacagaaagaacaccatgttaatgacaactgaccacaccaggtcccccagaaggctcccacctttcatttctcttgagtccatgaactctgatatcaggttattttgtggtttatttgcttgattttgggtttgttctggactctgatttttaaaatttccttttaagcattattttcaagcttcatggacatcaggtactgggagatggttttgcacataattccttattgatataatcctctcaatcctgtgggtttaatgttcattcatcacggctcatgtgtccctccagcatccattccaccttctcccaccttttgggtgggattgaacccactccttgcttcccaggttgtccgtgatgagcataaacaaaccagcttgatcttactctctgccacagtgattaagagaaaataggctcaagccaatcaacgtgaatcagagcaaagcagggactcatggtagaaagaagaggccatctttcttcactctcaaaggggtagaatgaacttgcggctcaaagatctgtgggcagccctctcctaacaaggaagggaactggaaccagggcaggtcaaacacagagatgggaaaatattggtctttggtgacatcgctgagccactgaatcaaagtaaccccaaagcctgcctgacattgggacttcctagttactgcagatattttctttaggttaaagtaatacaaaggttttttgcaacatcaaaagtcctagtggatgcactgataatagacaagaaaaatgatacccaggtacattaaacaagtggcctgtgggataaaatctggggacagaattagaattcagtttgactctggaagtccatgcttttcctaccaccagttacatgagagtccttgctcccagagggtttcctgtatgtctcccggtggtggccacctaaaggcagggagctgaggtcagggtctgtctctagtctgtacaattcctgagactttctctagtcattcttgattttggtgctcaaacacttgaacctgacaaatatttattttaaaaatgaataaattaatgaatgtagttcagattcctctttgatggtttcccattaagcccatgaaaacaacagttaaaggatttaaggagtcgtggttagtgtcaaaaatggaaatgcctctgattcccagagccttccttcttctgtgcccaccccaagccaccagatgtccatgctggccaggtcctttcctaatctagatgaaacaggagttcatgcaaaaccaattgggattaccacccaagtctgaccgtgcaatgatggccttggcccctggcccagccaagcttcatccccagctgggaggtgcccctggagcaggagcagagagtgatactgaatgccctggctggtctccagccccctcaggccaccgtcggccagagcagggtccccaggggagtgctggcggaactaagctccatccagtgccccttggcctgatccccaaatgaaattacattcagtgcctgagcagtctcctttatctttcgactccaacttcactgctccttaggatgaggggtttgctgggtgtggctggacatcaaaggaagccagttgacttgggggatggacagaggggtggatgaggaagcaccaactggacaaggttccataggcctggccttctgcaaggaggctggatgcagattagtccccaccctctgcactctgccagcgagaaatatgtaactggaaaggctccttctctcttttcccaccccaccctccaacaaattttcagaaaaccaaagaaaagcattatttattcatctgttgaaaaaattcacacaagacatggataaaggagtttatggtggaatttactgaatgtttgatgagcaatacaaaaatttaggtagaatggaccagctgccggctcttggacccttaacatagacaaatagaacaagagctgttatttattgagtggccactatgggtctgggacaatgataggcattttatatatatttattttcttatttaaatctcagaactcagtaaagtaagcattaatattgtccccctttataggtgtggcacaaaaaaggttaaataacttggttaaggtcacacatctggcggatggcacaggctgcacccttaccagggtctgattgtttccagtggtcatgcttctatgagttcacactctacaccaaaggctcacactgaatccggcactattgtttatgtaaacctgcattccttcaagacgtcaaaggagttgattttaaacaagcatcaccccaggggtgctggaggagccatgtctttatctactgcagttctgggagagaaacgtgcatatgaatgaagatgctgttgtaaattttctaaataatgatcccttatatttttgctttataccttgcaaagcattcttaaataacactgtctcagctgatggttgtaaaatttttatgatgttgattgccagaataatcattctcatcttcctgatgaagcagccaagatggaggctgttctgtgccttgccccaagttcaatgataaaccaatggcatataagactagaacccaggtctcctgattcctagctcagtgcttgtctcttagctatttagattttccagaagcctttgacaaggttccacatgaaaagttatttaaaaataatgagtctccatgggacttcgggcagtttggccatggagagagagaattgactaagagacaggaaaagacagatttctgcatggagaagtaactagtgttacgactagtctcatttaatattttttataaatggtctggaggagggagcaggaaaatgtgcaaatgattctaaactctttgggacagcaagaaggccaataacaaaggtgaactacaaaaaaaaatggtccaccctctgcaggggctgacagttgccacgtggcaaatagccctgggaccatgagtctcccaaggaagaggtcatgcctgctgtactcagtgcaatccccaatacatggttggtgcttagtaagtaattactgaataaatgtaaaacaaccacagtctctaatatctgagctgctagttataatcgaggtaagagtcaggatcgaggaagggatcagagccaccatttactactcccaatactcgggcagccaaaaaggcccacaaaatgttaggcagcatttaagtaagatttcatagaaaaacagacaagcagaagccatcatcttggtcaagttcacctgaacatacgagatcacattcagttcaccgctcataaggtaggaacacaatccagatgcctgcaactcaagaacagcctaggaaagacagcccatgccagaaagaaatagttgagatgaaagaagacacactgaccagtggccatggttcagtcaccaatacagaggccaccccaacacttgtaacatgacaacttgaacaaattagatttcttttttgtttgtttgtttgtttttgttttcagacagattcttgctcttgttgcccaggctggagtgcaatggcacgatctcagctcactgtaacctctgcctcctgggttcaagcgattctcctgcctcagcctcctgagtagctgggattacagtcacctaccaccacgcccagctaatttttgtattgttagtagagacggggtttcaccatatttgccaggctggtctcaaactcgacctcgtgatctgcccgcctcggcctcccaaagtgctgggattacaggcgtgagccaccaggcccagcctagatttcttatttttacatagtatagatacttgtggatcacctaaacaatgagaaaggatgaaaacagaagttgatttttttttttttttttttggtagaaaatgtaaagaaattggccgggtgctgttgcttaagcctgtaatcccaacactttgggaagccgaggtgggcggatcacgaggtcaagagatcaagactatcctggccaatatggtgaaaccctgtctctactaaaaacacaaaaattagctgggcgtggcggtgggcgcctgtagtcccagctactcgggatgctaaggcaggagaatagcttaaacctgggaggcggaggttgcagtcagccaagatggtgctactgcactccagcctgggcgacagagcaagactccgtctcaaaaaagaaaatgtaaagaaaccaatcacaggtcacgaaggtactttggttgtttggaagatgttaatctctgaggatgacaccaaggaggaaaccacatcccaatcctgtgtgtcccttgacggagcgacacatcccacacccaccatgtgtctgttgaatgcccactgttccagagcctctcctagagagaagaggtggtaagtgccagccccgccttccaggaggcctgtctcctggagggctcagatttcacacaaataatgccaggtggcaaatgctatggcagaggagtgttctaaggcctctctttgttcttctcaggagatctagccaactggagtttaaccagggatgatcagcccagctccaggcgaggctagtgggcagggagcatcatgaccaagagctaccaatatggcatgccagtgatgagagcttgactaatacaacacatagcaggtaacgtcagatttactcaaagccaccttaggggacaaaatcttttagatcagtaggaaggctgatctgaagtagcaaaattagcaggactaatagatttcataaagacgtaacatactgagagaagggttagagtaaaacttggaaaaagggcgtctgaggggaagaatttgatcatcttcctgcagcatcatcttgaggagagagagagactagagaagatcagagagccactgtgtcctctgtagtagggaggggtgcccctgcaggcctcacctcagcccccgtagatagttccagaacagcactggacaatggaagatagtacaagccacaaatgtgggtcacatacgttatttaaaattttctagtagtggccaaattttacaaaacaagtaaaattaattttcataatatgtttaatctgacccaatataccccaaatatgacattagcatgtctacaagtataaaaattttattgagatattttacattcttttcctcatactaactaaacctttgccacctgaggtgcatgttaaacttacagcacagctcagtttggagcagccacgtttcaggtgctcactatgtggccagaggctaccatattggacagcacaattctagactattctctttcctgtgtattgattctgcattcaccaagtgaccttgctaataatttggtttggtgactatcccccggaggcatgctccattgagattttgcaaccacccccaaccccaaccggccctccctcccccctgtcctctgctgcaacccctttgtgtctcccagggaccttcaagctacagcacagtgcagtgtgccccattgcccttactttttgggcattcttgggctgtatgatccagccagctgtatggtccccatcaagtcagaatgctgctgcatgggcctcattctaatccaggctcatttgatgcacccatgccttctcttcccacactctgggcaaacctcctgcgcagcaggacccctggtacccctgctcgtgggaggggaccaaccagtcagccagaatcgttgctgtgggaggggattcttggagactcttacctgcaccaagtaatactgccttgggagagagtggtgataagtgggacacctagacggtggtgggcatctggggctgggggcagcaactgactaacaattgcatagatgcatttcaatattaacgactggtgaggccacatgagcacttaaggactgagcatcatcttgcctgtgccacacagaaacctccactacagtgttcagtgtgcactgcactactccacactacatgcagcttaccaagaacacacacacacacacacacacacacacacacacacacacacacactctactctgggtatccaggcatctgcatccccagccactcagtccctggcccgggatcttccaaggcagccagcccctttcctccagccctgctggccccctgccgatccaccagtgggcaccgccacctatctccatccctggcacggtgagtctccgcactgccagacagactgctattgaaacatcagcagcgtggcctccgcaaaggtcagccatccggggagctcctggcagctgcttgtttgtttattggaacattatctgggccgggctgtttatttacatccattgaaggattgaacaataaatatagtctcccagtagcaggcagatgcttgcactagagcattctggctgccgtcttgcttggactaatctccctaatgagcaaacagtgctattcatctctaaagatgcaggccacctctgcactctccctttcctctctcccttcacatcctccccaaacttcctaatggaggtctacaccttcgagatttgggagctgggcccaggtataagaatgcaagggtgggctcttatccaacaggcagggaaatagagctggaactgtagatggagaggggaacagagcaaacctggaggcatatgtcccagggcaaatctgaattccccacctagaccctcaaacctcaaacacagaggcacgtggcaaaccagctggtggtcaggacagaaggaggtcaggccttgctcacagggccagaggtggaggggcttgtgcggaggcgccccatattccagccatgccagagccagagttaggccttgaagtgcccagaattggaaggagatcccttgcaacaaaatgcaaaccagtcagtttgcaaaagggagacttcattggggcaggcagggataggtgaggagccgaaggagggaagtaagggggccaggtttggctcctctcagaagccttgagcacatgacttcagctctcctagctgtcctgagtctctctcctggctctgacctggctctcaaggaggcagcaacaaagatccttggcaagcaatgagtgaccagccgtatctctggcacacaacagcagtatgatctctctcaggagggagcaaactgtgagccatttggatcatagatatgcagcctactcagttggacccacaggttctaaatgatgtagccctcatcactgtcacttggcacctgaaaggaagaattagcacaccaaagagtgccagaatcaggcacagggtaagtactcgttgaatgaatgaatgaatggcctgagaagctgattctgggtctgagttgccacagctggaaccaggagacacaaatgcacactcacagacatgtgtgcacacacatgtatacacatgtgcactctctggctctgaagatggggccacatctcagctcaaacacaatctctagaattttccctttctcattctgcagaaagggagagaggacaggtgatacaaccgtgtctggggcaaagaagagctgggaagggtgcagcaggttggcagcaagacagatgcgaatacgggcatgaggtctgagtaacttggcaactggctcgttgtgggttaaacgtcttcagaaaggggaccttccttgtggaagagctgcctagtttgcaggctggtagactggaggatttctcagttcccatcagactctgatgggctgcaagtccatctccccaccagaggagctccctcacaccccaggccctcactgccaatatccctacaaccccacaccaagggcatctgagaataagactgcactcatagaagcacctcacatcttccccagggcttttgttttttaaaagtattccctcctgcctctcccctggatttccaatcccctctccccattctgcttttgctttttttcacagcgcttgtccccttctgacatactgtgtcctgcgttcatttatgatggttattgtttacacccttgctagatcatacacaccacgggagcagaaatctttatcaagggatatatctcagacccttgaactgtgccacagagtaggtgctcaataaacatttgttgaataaatgaatgaatgaaaacactcaaagtaatcatcttcgtgtttcttcatcctcatggtgtagatctcccctattttacagtgagggaaccagttaggggctttccctcactgtaactgggagatgttacagcaaaagtgaaatggaaactgcccagccaggcccgcgtggccggtaggtgccctgtttcgccagcagggtggactgtttgatgccacatccgtgccttcctgcctttagtctcagggcttggaaggtgggcgtaaaccctgcttctgtgttcatgctgcttaagctgccccagaatagctccatgaggtactttgttttgatttcctgattccagccaggagaaaggggatgcaaagggaactgcaagagtgtaaacaataattaattagacaggcagtgtgtgtgcacaaatcgtgtgccgtgttaccaaacactgccaggacaatcggtccctttgggtctcccattacacacattctcagagccaaataatgatttctatgctgccattaggaacttcttgccctgcgatgtccaaaccaaaaagaaaccagtgataatggcctccaaaccttccccacctgcttgagtggtgacacaaagaacaagctacaactccagaagagaaagatgctgaagaaataagaagggaagtcaatagggctgatataaagaacataccaggaaaaggttcaaaccagcaaatttcacatgtggaatattttgaaacagcttcactgagtgcaccattcccagagactcaccagagagcactgtgtgctaaagttacaggtttgaaaccttggtaggtcagccaccccgtgaccccagagccacaacttctttggatagcctgcatcctaaaatcttggttggccatttcccatgtgcctctggttagaaaggagcctgggccactcccactcctaggaaaacaagttcccatgaataggtggttaattcaccacctgccatgcgccacacaccatgccatgcactttacacgcatcagctccttctgacacctggcagatggaccatgctcatccatgctgcaaaagaccagaatcctgagctggggtgcactggcagcgcaggatttttgaagtccaggggcaaacagcgtgactcccaactctgacacttaggaactgtgcagcctcagacaatctactaaactttcctatcactttcctcatatgaaaaacagaaataataacaatacctcattgttatcattattgtgcaagtatgataatgtcccaagcatggataatacttggcagagtgagggggttttgataaatactagcaatgattaatgtgcaatgattactattcaaatgaatggatctctatgattttcatccaagcccactgagagcacaaccctgatataaagaggttagaaggtttctatatgtgccgtagataaagaggctagaagatgtggcctgcagattggactcccaacatctgacaagttcacctaagggcaggagagggagaagaggacccacagcttagctctgggctgtctgaagacaatagagggcagggaaccaggactaaagagtctgtgctctttagcatgaattgtacagaacaaaatggacccagagaacttcccgtggctgccctgaagctacaggaattgtctaggaaaccctgagtctgctttaactcaggagagactcagaaagccaacgactttatggaggaagaacaaagcagtttcatgcccatggtctgaccaagctgcaggaggggaagtggagaaccacagcctggcctcgctgagagatgcggcatctctgaggacccagggaggatggagggcagaggtggggctggcaggatgctggggagatgcagagccagtcttcaaaagcagagtcagtggctctgcatggtgtcaggcacagagacgcaggccagaaccaggaccgtcagctcctcatccacacgcctctattgcctcatcctacagcttggacaagccatgttcatctctgcccccacacatggggaggctacctcctctcctctctgcccacacaactgttgcagtgacaaaggggttaatgcctgcgagacaatgaggactgggaacaggtgtgcaaggatgctggggctggcacagtccatgttcctctcctgctggaaatctggcctcctctggagtgggatccagcaggtgcttcatgctgttacaccagaaccaggagaaaactcctgtctagctggaggcccaaagaaaacagaagtagagagaaacccgggaatccagggactcctgtgtgagctgctaccacaccttcaggagtcgtccaggtactaactcagaggaaggatgctgctagcacagagctcggcacagggcagagactcaataaatcaactgcactagcaaagggggacttcattgcagcctcagaagcagcttcacctccctctcccttcacatcccagatttaccagtaggcaccgccaccctagagtggctcccttataagctatagggtgtgacagccatgagtgtgtcaacatcttgagggcaggtcagtggtgtagagcttaagcctggggctgtgcaggcaaccaagctcgactgctgattctgtctattatagatgtcgtaacctcaggcaggacttttcagacttgcttagcatcctcagctgaaacacaggtctcagaatttggagctcagagctgccgtgaggatctcatcaggtgaattgtgaaatgctctcagttcagcacctgatacatgcaatatacatacgtgcctgtgagctgtggctagttaatacgtagccgtgcctggttagccaatgtgaagatgaagaggagataatgtgatgctgatgatggtgtagcagagcacagcttcccctagcaaggctccctggcagctctgggaacaccagttgcttaatagatgtgtagtaaattgacaaatgaacacatgagtcccattaacattggaaaaagatcagaagggtcccagcatcctcagagactatcttccaagcttacatttctttgatgttctgtccttacaggaccaccaaacctctttctagcactaagggcacccgcagcagccagccctatatggctcccatcatcatcctgtctgcaggaagccccgtgggtctgttgctcagcccccaggcactgttctgcaatttccttgacaaataaataacccagggagtgtcagacaagtgcgtattacctcaacatctgctctccctactgggctctgccctaggttcttcccctgcagcctcatcaagctactggggcaccagcactttcaaggggcactgaggctgccatccaaggacagctgtgtgtgtgtgagagaggctaagaacagcccatgttcacctatgacaaggggcagaggtgcaacttcccagaaggtggaggatgcaacttcaacaaggctggggtgcctttctccattcactcctcatccccttgggaagcacgctggtcagagtggtgctgcctgacttctggcagaaatgatggagtttcattttgcaatgtcagtgcatttgcaaagccctagaacaggaggggattccagatttgctcagttgggatctataccaggatttcaaagtagccccagttcctgggctatctaggataattgtgtgtgtgtgtgtgtgtgtgtgtgtgtgtgtgtgtgcgcgtgtggcctaaaggagggtcagaaggaagtgagggatgcatgtgacgttacccaagatccggctcatggaaaactgagaatctcagaactctccccagagtctcccggtatgattcggtgcctcctgtgggctccagcggcacttcctgcacaccttgcttgtgtcacttatatgcattgctacatggggtcatgagcgctcactgtcttccccactccctaggagcttcttgagtgcaggggctacatgttattcatcttacccaagctcactagccagtaagtggagcaccacactgaagtttacattttctggcttcaaacctgtactcagcaacaattcttctaaaagtaggcactgtaatgttcagtgtcaccagcaaaaacaattactagagcttctttgaagagtgggcctcactcagggctatctcatagatcaccaccccttattgaatccttcccctccccgtcccacacatctctccagcacagacactgcccacatcttactttttaaaaacagcagctactctgggaaagaaatacttggaactatcacaaatgaggacccagaaattcatgagtcctggggtgaggcatgtgaatagtttacagtcagaaaatctgttcccaaagagactgtggggacagccttccctgggcttagaatgctggagctgagaagggcatccctgtctggggatgacatcaccagacagagctggaatgcacagatgcagaaagctgggggccctggggccaggagagagcttggctggaagatcacaaaggggcttttgaccaccctcatcccaggaaaaaccacagagacccagctttaagccacccccgccctcagttgaggggcctaaagacatcctcctccaatcagacgggtgacctttgatcccagtgagggaggcaccagagccaaagtgccttgaaggaaaataataataataataataataataagtgcctgtatgggttactccttctgccagaagcctgtggagttagttgcagagaaatccattttaaaataagatattggaaaaccattctctccgtcactggccacagttattacaattatttatgtggcatcatcaaggcccatgtgtttcacagcaattaaactattgatctcccagctctgaggcactgagcaaaaacctacagccactggttctggtgctctgggagttgcctctccccatgtttcagatgtgaaaactgagcccggtggggaagtcaccaagaacaagagagtcaggggatggcacattaatattaatgatcaatatgttaatataatatgctaatggtatattgacatatcaataataatatatccatttatccatttggccagcacttactctgtcaaagtgttagtttttaggtttgcccaagaaattaataatgcagtgattgaaagcatgggttccagaggccattaacaagggcttctacgcagctctgccaggacctagctacatgacctttgggaaatgagtcaatttctctaacccctggtttcctcatctggaagatgcagataataacagtacctaccacaatcagttgacgtgaagatttaatgagttagtagatgaaaagcatttagcacactgcccagcacataatcacagctaaactacagttagcacttatttacatgaggggtccatggctactcactgacccatgacacacctctggcaactcatgttgcacagctacgtcattggcaaaggagagagggaaggcttaccctcctgtgagtcgctgcactgagatttgaggggcactgcattcttttttgatggtcttgaggcaggagctgcacctggacctctgtttgcagctgccccctggatgcacatgggggtggtcctgagctccaacctccctctctgcctacctcactatacctatgtccccatcacttttcctcaagcctagagtcaatattaagctagtaatggttacacaaagtcttatttatgaaatgcatttaaagtaatattatttaatgtgtttcaaggacatgttaagggataaaatgtattggatggtgggagtctgagactggttttgaaataattctccttcctgaacttttttgctacaggaagttgcatgtgcctggaacatacactcttatattgcatggtgtggacagggagagactaaaagtagggtgacagtaaaggactatgattcttatcttggtctagccaaaaggcagttggaatagagggtaaggacagagggagaaggagatggggcttgaagaatgaaggacaaactctggattgtcacacctgggtggccaagggaatggtgggcccaaggagcaagttgaagggaatgccgtgtgggtggaaagaagaagtgcgggtctgagatctgctgaatgtcactggtgggagtgtggccgattgactgtctcattgttttggacattcaggactgaatgtctgctggatgtctgactgaatgactttctgcttaggcagaaagtcattgcttaggacaattgagtcactgtcattttagaggtggattgtgatatcatgatatcaaatcatttcccggagccagaatttagacgaccaccatggcaggctggccctcctaccctgtctctaagggtcacatcagacacattccatagattacagaatacagattggaaaagtgccggggaaagggaagaacacaaatcactatttcctacttcccttcacgttgcccccagacactacagagggctcactaagttgaggaatagaatgttctcccacttctcatcccagaagctgaaataggctccatgcatgacccaacataaacttgcaaatgaataggcagtcactttgaggagcacaggaaagacacaccgatttaattaccttctctgcaccatcaccagggtccttcaattttagtatctgaggaacttttctttggattaaacagtttcacagaaccaaacaaaagtctcattttgcaccaaaattttcacaatttttgcttagggctggttcaggaacttctttccaaagtctatgtcaaattaaaaatccagaaatacctaccattatttaaaaaatagtagggtttatttcccacactgacctaagacttaaaacaaaacgaagccctctaagggttgagtgtgtggtgtggccccttctccccacagaccttccccttgggtcagagcgtttagtcggcctcatgccaatgcccatgaccgggggtgctggttcccttctgcttcttggggccttccatggttcacccccatcagagtctggaaagggaggccacgggaagtagggaagggaggaagaggaaggaaagggtgggagagctgagggttggagaatatcaagaaaaactgagattttacaggttgttactctggggttccaaaagaggtcctcacggaggttccacatcaccagaccctgggtcctgtatcagaactgtcctgggtctgcacgctggagttcactaactggacttccagccactttacttcccatcctcaacgtagaccaggaaaagtcatgatggaaagacttctttgttcctcctcagcccagcagggctctgatcatgccagcttgttgtgttgcaagacacgaaaagaagccagcaacaaaattgtcttgcgtcacttaacttcctctcagatttctaagcaggtaattatttcctctcctccaatggactgcaagcattttggagggtttttatcagagacactccataaataaaagtgtcaggttattaaggataatcttatccactctcctgagcaagttatccagtggaatattgtgctcttcctctgtggcactttcttccttgacttttccatttggcacctaagtgagccaggggaggatgtgtgagcaagggagacatttctgctactggggcctgggaaacaggaccagaggggctttcactccggtctgttctgtgtgacctctgggaggcttgttttctctagttcattccattgctgaacatgagttgagcatgtactgtgtaaaatcccacccagaaatgcacacatttcaaataagatttggctggtttctaccctcaaagacttcttgtccaaaacaagattcacagcacaatttaaaaagcagtttcacattgactttctaaatttaattcacaccacacatagtaaggacacaataaactttattgaattaataaatgaaccatgattccagtgagggaaggaggatgattatttgtactcatgttgtatctatgaacaaactaagactcagatgggctacatgatgctcaaagttagattatagctaacaagtgctggatctcattttcgatcagatattctggttaaaacccaatacaccttggcccacatctcacgcccctcccgagtgaagcacattcaaatgattgacttctgttctggtggccatggagaggaagcagtggtcaattctgaggagtgtgcttcccagaagagtggcaatgtgagctgattgttaggaggaatatgattcaaatagcaggagccatgaggaagaatatgtcctaggcaggctggcatgagcaaaggcagagatggaggaaagtgccacgtgtgtgcagtgtagggtagtcagctgtggtcagggcatatgacttttgggggcatggtgggagggaagcccagagtggtaggttggatgcaggtgcaaaagacccttgaatgtctttcaaagtgctgggctttaacctgtacacagaggggaagtgttgtatgtttccaggatgggggaactgatatgatctgactttcataaactggagataataagcaaagcatatcctactttttcaacttggaaaaactgctatgcccttgaagaggggcactgtcattcctttaacaaagtgaacgcccacttattgcctcaaatgactaaactaaaaaatgcgactctatcaccataagcctccctatgttgtgttgggaggtggattttattgaatcgtccacattctcccagttctcttctagtcaactttttgggtttaggttaagggaacaatacatttctttgcagcaagctctctaaccagagtttgggaaaaccttgatgttcttaacataaactcaatcaactgacttaaacgcatggaaaatggtggacttaggaggaacatttcattttagcactttacggatcaagtcactatgggatagagaccctaaactctcacaaacttccaggctaagattttaaaacatagatttaaccctagcctataaagtacttaatcaataatagcttggtgcctcaaattttgaaaaggatttttatgtacatcatttcagtgtgtcctcccagcagtattgtgagctgggtttgggaagtgtccttaggccatagctccccagcagatgaagaactaaagcctggatgggaaatgactctccaaattcatgacaccactgtagcttcattaggtctcttaacttctgaacctgttgttcttaccatgctatcttggcacccacttctttttaaataagggactggggtctcacaagaaaagtacacaatttagtcccccaccctccagtttcatcaatgcagagtgagatgagtaaaacagggtgctataagactgcctgttgcttgagcctagctgtgttgtgctggggttgggttggattggattgagttgtattgtgctgcattgggttaggttgggctgtgttgtgttgtattggattggattaggttgggttttgttaaattgggttgtgtgtgttgtgttgtgttagactggatttattggattaggttgggttgaattggattggattgtgttgtgttgaattagatttagttgggttgtgctggattagattgagttgtgttgtgttgaattgaattgggctgggttcagttaagtttgtgttggattaaatgtaattggattgggttgtgttgggttgtgtgtgctgtgctatatcatgttagattggactgggttgggttgggttgggttggattggattggattgaattgggttgagttaggttgtgctgaattggattgagttgggttgggttgggttggactggattgggttgggttgtgttgggttgtattggattgagttgggttggattgggttgggttgggttgaatttgattggattgggttgtgttggattgtattgaattggattgagttgagttggattgggttgaatttgattggattgggttgtgttgtgttcagttggattgaattggattgggttgcattggatggggttggattgggttgtgttatgttgaattggaataaattggttgacttgagttggactgaactgggttggatttactggtctgggattcactagcataggatccaaagtcttccctgattacttttattctgtggcattcagtgaccatttgcctatccttgcaaagctaccatgagtttaccatgaccaggttgtgtgcaacaagagcaaaatggagcagcacaagcaaaagtcagcacagcattgtggaacaccagttgtagggagcctctcagcctgctccctccctcagctggctcaggttacacctggccaggcaatttcagaaatgggtagggaagaaatccaagagcagggagtggagaacaagagccaggcagagcaagggtcggggccaggcaggcacagtttgcaggccagagaacattctctgagagcgcaagaatctgtgcctcctgggaaaggctgtaatccattttccctgaagacccgagtaacccggtcaaagaaactcaatcccaagtggttttgacataaggtcatgaaccgagacaaggcaatctcagcagttcatcccacacaacaagcaggcctgcaggcagggggactggagcggagagggcaggggtagcatctcagggccctggttgcagggggagggagttggagcccttcctagccagacaggtgattcatgtggacactctcacccttctgagcaccagagatcacaccagggtctgaccctctggcagccccatctgctcactaaaggggaaactgaggcagaaaagagcgcaatactgcccagaacccagagtgtcgaggaaaggaggtgatatcagtatgtgctcacttgctttggacacttgagagcgctaagctgggggagggtcagcttctccagcctcctggcttcctccctccctgctttccctctccttccccagggctgggagccaagggatgcctcagctgcaggactctccctccccaccccctgcagaatgagcgtttccacaacttgcacatctttacctcctgtgtttaccggaaaacaggaaggaaggagggaagaggaagtcttttcagagcctctggtgatcatcacgcactttgctttttttttttttttttttttttaattcttctcccccactccaatctcatctgtcccctgaagggagaaatcgaacccatctgtagttgttacacaggcaaaatcacagatgctgctgtggtctagccagggtcggaggggctctgttctgtggtgtatatgtaggtatgtgtgtgcgcgggtctctgcctgtgtgtttctgaagctggtctttaacaagtgtggactctctgttgaattctgcattttctcctgcagccagcaggtggcagtgctgcgacagtcgggtgactccagtcctgtgacgcctggccccgcagcgcttgtcaggactggtccaaccgtggaagggaaggcatgtccacacgcaccccaaggtggcccacatagaggtcctgggcaaggcgatatggaggagagccatccaaaggcccttctgaaacctcctctcctctcttccattcttctctatttcccctaatctaatctagaaagggggaaacctactaacgtttcctaagcacatgcagcatggttttcagacttagcataaaacccctgcagagcttgtgaaaatgcagcttcccaggccctgtccactgagactctcacgcagcatggctgaggtggagcccaggaacgtgcattttgagtaagtgctactggtgattcccatgcagtccccagggaactccaaattgagaaatagaaaactagcatattccaggtgctgtgatgagggcttcatcctagatctgttctcagggttccttgtaaattataattctctccacctgtttcctactctaggtctgttctcagggttccttgtaaattataattctctccacctgtttcctactctagatctgttctcagggttccttgtaatttataattctctccacctgtttcctactctccaaacacattgccgctgcactcctctaccatgaagttttggctctgcattcttaacggacaattttgctgtttccttatgctaatttcctggtgctctgagatcaccggacttcctgctccagaagcaggttttctcacactgcctccctgtcatcctaacctttcttttattccgtgtaagttcctgaaatgcacagtgccttaccctgccttcccagccatggggctttgctggagccgtgcacggcagtaccatgcttccccacctctcctatgctctccacttgcttccttcccagtcaaagggctctgctggagttctgcagggcagtgccatgcttccccacctctcccatgttctccacccctgccttctcagacacctgagttggactgccctggtgaacatctccacagtcaagcaacctggagctgcacctacagacatgtgcagaggacaggcatctcccttgaaagtcagcatgacacaagacctacccacagtggtcatactgggcgcttttaagatggcaacacaaacaaactctgaaaacccagtgtattcatttgccgggggtgccataacaggtgaccacaaactgggtgtcataaaacaacagaaatgtattctgtcacagctctggagattagaagtctggaatcaaggggccggtagggctgaatccttcattgcctcttcccacctccagtgactgctggcagtgcttgctgttccttggcttgtggcagcatcactccaatctctgcctttgtcttcacatggcccgggtctctctgtctaaatttcccattcttttctctcatgaagtcaccagtcactggattaaagcccatccttcatcctaacttgattagatctccaaagaccctatttacaaaaaggtcacatgcacaagtatcagaagttgggacttcagctttccctttggggagatacagttcaacctgcaacaccccacgaaccaaagattctgctttcacttcttacctcctgcctggagagaggagagcagagtctccgtgcttctccaagcactgaatgacctttcccatgaataaagcttttgctcttggtggatgccatattggaagaggttaaagcaagtcagctttgggcttccctgagtgcagtggttctcagagtttgggctcctgaccagcagcatccgggaacttgttagaaatgccaaatctctagccttgcgcagacctacagaatcagaaactccagggctgaagccagcaatctgtatttaataagttctacaggtggtctggatgcatcctaaattttgagaatgactgctcccgcggcagggctcacaagggcatccccagcaagttccagccactgactatgtcgtttgttgccccaaatctccctgtttttctgccctccggttcctggcaatcccttgccagctgcccttccttgacggctgtcagatgcctggcacatcacctggctccacactcaccggccagcttcccagcactgtttttctccggctgcctctcctcacctggctctccgtccgccaccccctcgcgcttacttgcatgccctcacttccctctgactctttctcctgacaaagagaagagcttggcaggggttggttaagttaactctgatcacacagaaaacaaactgttatttttctgtctgccaagctgctgaaggcaaggatgtcaagcccaggatgtgtgtgaatgtaagatctacagttaccctagcgtgtctgtgttctaggcaagctttttttttttttttaaatcgtggtccagttcccagggagataccagtgacaacctcttggatgctcattgcgctggctgtgacagtctctgtacacattccctgacccagggaatgagcaactcccataaacagcagacggtgggtcacctctgacatctgctgtccacatttctgatcccctggaaggccttgttcaaagcaacactgggctgaaatgttggtgcaccatgtgtgtttgccgtgtcggtgcacataagcagacagacctgcaggaggcagacagccaggcaggagggagccccgggggacacgtggacacatgttagagtctggtgaacattcaagacaaggttttaaagatgtgtctgtggttgagggtggggaggggcaaaaaggaggccctttggagagggccaaggtgcatatattggggagcctgtatgcgggtggccaccctcccaggagagtttcaagtttctggggaggagggaagcctgggtggggcggagggggcataggaagtcctaaactccacccccagaagaaggtagaaattagcagagtatctgggcaagctacaacccagtttccgtgccttttttgtcccaatcaccaaattgggcacaattatagtagaatagcagtgagaaaaaaacaaacagtaaaaataaacatggtaagtgaaaaggttggaaaaggaatgtgccagagaaatctggaaatctttgcatgcaggcactcgggtctgagacacactttccattgggtctggaaaccaggtagaccaaggctagagttcaatttccctaaaagggcttttttttttttttttttaacagagtctcactctgtcactcaggctggagtgcaatggtgcaaactcggctcactgcagtctctgctcttgggttcaagcgattcttgtgcctctgcctcccaagtagctgagattacaggcatgtgccaccatgtctggctaattttttgtatttttggtagagacagggtttcaccatgctagccaggctggtcttgaactcctggcctcaagtgatccacccgcctcggcctcccaaagtgctgggattacaggcgtgagccaccgtgcctggccagaagggttgcctttttcatttctgtctcctagatgtcacatcaggttttaagaggctgtggctccattctttatcccacacagcaagaaggtagcatggctaaacatcctggtgcaatttcaacctctcaggaccattctctagtttcaaaccccaaaaagcacctggccacataggtgagttgctccgtcactatcactcatttagttggagacactcatctcctcttaagcacctcccgtgctgtatgtatttttaaactattgtgacttattttgctttggaaatttaggagatcattgggtcactctttgaaacaaccagagatgctcaggaagaaagggatgtcacaaaaccaggtttggataccactgttctggggttcggcttcctgtgacttaagagatctgttcagattttaaacaggacagctgatccactatctcactgggtcccctctaggcaatataagccagagaggccttaacatcagaaatacaagggttggggaggggtggtgcacatttgtatcagtgtattctcctttagcacagatgaaatacactgggtgacataatggaaattcacagagggaaaagatccgttgggggagagactcataactcaggtgaccactgaactgtgatccccacgagttcaccttgtccagcctgtcttcccttttgccctctccccaccaccaggccttaaatcacctgtacatgtgcattgctgggtgccagcagatgattcatgaaactcaacagacagatgccctggtgggcacaggaaaccgaaggattgagagacatgggtgtgttgaagtgctagcagtaacagccatgaggctacacagtccattaggttttcattttacaaagtagagtgtacttgcatcatctcatctaatccttcgagtgatctgaggagttaggcattattacctccaaagcctaagagaaagtggtaaaagcaaagccttcaacaacaaaaccccaacccaggaggcctgacctgggtccacctaaaatctctcaggacaattctaggcactctccctccaaaataggtctgctagatcttcctcctgctccacggctctgctgtgcaaggtgtcaccatgccagggagtcttctgacacgactctcccaggccatgggtgaatgttccacttccaggccactataatgtcgactgtccttagactatagccatgcttctgggttctgcaaaacaatctgaacccaagattgagaaacctgtgatataatatacagatctgtcatgtggaggagacttgcaggtttgatttttctcactgtttaaatatctgggtggctgcaggaaagatacaccaccctctgtgcctcagcttcctcgtctggaagtgagggcctcatatctctgtggtttctccaagcagaaatgatgcaattctacatgaggtgcaaactaatttggctacaaatcatcacaaaataggcctaaggatggagatggtcctggaccataccgagctaggcagggatcatcagagacaggcgaacaatgggtaaggagggccctggagcaatttatcctatttacaaaaattaggctctatctaaaaacttagcagagaactgcagacaaggatgttgaccagtgaacccaaaaccggatgccaagatccttccaagaaagtgaagggaatgaatgagaagggaagaggaagagaaagcagacaggagtgaagggagaatgggagaggaaaaaagagaaaaatttaaaagatctgccggtttgacactcacatgaaaatgtcccagcagatttgcatttcctagtaataaatattttgtgtttacttattgtgacagagtttgcatgtcatgtaatcactgtttcagttcattttccccccaatgatagattgtgataagttggttgttaataatgctacaatttacctaacaaattttgagcttgtaatacagcttcattaatatgtttaatttatcgttacagttccttcaggttaatggtttgagagtatgttggagtttaatctgaatggctattataaagtgcttgtttctcgttaaaatgtaaaactgagatacccaagatttatttgggataaaccagccagaataaatctccctcttctttgcattgggaagggaatgagggtcggctattaaaaaggctaagcattggagagccccttcaggtaagtttaaagtaattttgcagattaaacatcctttccctagggtgaatgggagcgatgcctgaggccagagtttagcctagaaggattctctggatgctgcagaaaggtagggacatcagaaatggggtgataactgaatttcgacaaaatacagtataagcattgcaggtgactggaaaggtatctgagtgttgggtgatgggttatagaaagcagaatccacaaagattaaaatcaagaacacaagccccctgaaaagcacaaaacagaggagagcagcctcctcttctccagatggaattttggcagcatcctctggctgacaaactttcacaacactcctgtaacgcatcagacacctgcccccacctgccttcacctccgggctcctcatactggtttattcttctgggtaacttttagcttagttcagaaaaagaaagaaaccctcattctgtggctcaaattttaccacccaactgttcaagtggcttctagggtgcctaacagtttctctggacctggggtgtgaacgaggttgcctcagagcattgaagaagcttctggatacggggccatctacatttagtgagtttgttgatagctgaaaagcaagagtagaattcttgccatttgaataatcagggcccctctggacaagtctctagcacccaagggcatctcagaaaaacagttgttatgggttgaactgtgtcccctgaatagatatgctgagatcctaagccccagtacctgtgaatgtgactttacttggaaatagaatatttgcagaaataatcaagataagaggaattgattagggtggagtctacaccatattactggtgtccttaaaagaagaggaaaatgccatgtggccgatggaggcagacactggagcaatgaagctgccaggcaaggatggctggccactaccagcacaaaggagaggcaaggaagggttctacacagagcctcaaggagtgtggccctgctgacaccttaatttcagacttctagcctccaggactgtgagagaataaactcctaatgccccaggccacccagtttacagtgttttattacagcagccctaggaaactgacacacgtaagcccagtgggtcactcttggcactacagggagacgtgtaaaggcaagggtgggcatggatcttacagcaggcagcggattccaacacagctgaaagccaggacacagtagcccttcctacccactgtccagaccttgtatgatccttaatcctacgtgtcaacctgactgggctgcagggtgcccagacagctggctaaactttattctgagtgcacctgtgaaggtctttcagatgaaatgcatgtttgagtggttggagtagtgcatcagactgccttcccagtgagggggggtctctaccaatctactgagggcccgaatagaacaaaaaggtggaggaagggagaattccctgtctctgcctgcctgtcttccagtagggacattggtcttcttctgcctttgaacttggactcaggctggaactcacaccattgacctccctggctcctcaccttgccaactccagatgagggaacttcccagcctccatagtcctatgagacaattctttacaacaaacctctttatgtatgtaaataaatgaacacacacatacacaccatcctactgttcctgggttttggtagaatccatgtggaatcagatgctctgatgccctcgaatggtggcccttggtgctcccgtggcctgcatggtctggccccctctctgtcctactcttgcccctgctcatttcccgtccttccccttgccttcccactgtgcctcctctgccagcccctgcatcagggctgctctgcccgcttggatgctctctcggagaacctcacaaggctggccctcgcttcccgcggccttgcacccccatggcatcttggagaggcttccctgactccgagtgctgatggttcccattcctctaacacatctctgtgccctcacccagtgttatctttttttatataacacaacctgaagttatagctgtttatttagtgtgtgtttcccccatagaaactagaaactccctaaaggcaggaatcatgtctgtttcactccccacagtgtctgtgcccagtgcctggctcagagctggtactcagtaagtgttgtggcaggaagggaatggggaaaggaagagggagggagggagggaagaaagggagagagggaagaaggaaaggagaaacagtgagaaaggaaggaagcgaaggagggagggaaggaagaaaaagagggaagagaggaaggaagaaaagagggagggagagaagaaaggagggagggagagaagaaaggagggagggtaggaagaaaggagggagaaagaaatgtggaaggaaaaggagagagtgagagatgggaaaggaaagagggagaaaaggaaggcaaaaaaaaaagaaaaaagaaagggagggagggaaggtgggcagctttgcaaccccaggctctaagtgcaccattcaaagatggtcccttgggtctgctcatgcctggagcatcccataatttgacatttccaggggtaggttgcaatctaagggtcagaagtactgagaaataagttagtcatgaaaattaagattaaatatatagattttttaagataaacttttacttgaaggttcagggaaggtcataattgcttattataaaatcatataacatatggagtctcccattctcacccctacccacaaaccttctgaagtggcaggttcttccagaataagatccatatataacttgtctgcctggaaagctaggtcctctctgactgaatttcatttgtcacccttataacaccaaggtcggacacccatgcaaaatatgcatcaaggttctgctatgccctgggttctcggacacagaggtgaacactgtgtgaggaaggtcacatctggatcccgcatgatttattcatcaaagtataccaaattgaaatcctctcataaaattattcatatgtgagttaacaaatctctaaaacagagcagagcacacggtccattgtgccctgtgtatgaagaagggacacaaagccagtctcagcagcagagagattttcagcaagtcctccctccaccagcctcctcccccatcactggatgaggagaaggttccagtccttcccactggtccctgagaacagggagagccgccctgtgtggggacacaggtgagctcctctgcatatctagaaggaaaccagcggcagggtgcaaagagaacttccagtccccatggaaagggtggccggatggacagagcgctgcctttgaactctcttcctcgttccgctctggcagcccattttcctttaggcgtctgaccctgctaatggggactgagtttccacgttaagtgaaggggtcactgggtcgggcgggcgctggcttctcttcctcctgacagatccataattagaaggagacagagcattcaaagaggagtgttggctccaggcacatcctcgtcagcctgtcaagcagaagcctgttctccatgagctattttgagccaccttctcagctgcatttctgatcttctcggcctgtgtcaccctcccccaccccatggtcttcctcccaccatgtctctgctgtgacatcactgaggcacatgggcttggcggagggctggacaaaaagggcattctgtgcaagatgcctggggctaataggagcgggggggcctcctgcccctgccccacacctccaccacctctgttccagtggaatcagatgtaagaatcagagggcctgggctgttgactctgggagcaattatgaccagggccatgaggttcaacagattcctcgccttggagaaataaagggtaatcactccttagagaggacgtcatggtggcgaaactggaatgcagagcaggagagcatgggcttggtctctgcccaggagctgccctgtaggatttccaggcccgggcaaaccaggtgggatcataaggacctatgcacactccaggagtccccagtgctctactgatcactccctctgcaccgcaggtgctctacaagcatgatttcctgtcctgctcatggcaactctgagagggagagaccattgcatatgaggagggggtgtcttctcaagactcagccaccaaggatgtcccatctggcctcaggttcacaaggtctgggttcctggggaagctgggtttgcttgatctgaggctgtggttctcaaagcgtggttctggcacatcgacatcactttttcaaaatccagattctcggactccctccagacctactggatcagaccctctaagggtggagctcaaccgtctgtgcttcaaggagcactgcaggtgatgtggatgcacccctaagtttgggaactgctgcccaaaggacacctttttgtcggcccataacataaatctctaggacaagtccaaatgcccccactccatgccttcctgtaggtggaatctgtctcttgaatccagctccagccttacccttttagcactcaccccaggctgttctggggtctccccatcatttttgggaatgctcgccctctccctgtctctggttcttggaatgaatttttatatctttatgtgtgtgtttccctcattttacaagaagagagtgagtgcctcctgtttgtgccccccaggactctgcccaagggtgctcagccctgtgcctgccagggccccaggggtccagtggttgtcacacactgcctgtgcagaaaccagggagaattgattaagcaccagccttaattgtggctgcactgcctgagagctggcagccaattccagctgcttttcctcatctgcatcatgggcctccagctcctttggatttttttaaattatcaaaataataactcacaagtcctttgcaccagccattctgaagggatagaagaacaaagaggaaacaaacgggttgactccttgtctctgggggccctcaggaaatctggtgatactgatgattcgtggggccccaaaaagaaatgaaggctcccaggttcttgtcctgctgccactgaatctttatctggtgacctaggcctggtcattctgagtcccatgatgaagatcttctggttacataatagggaggattctacattaggcaacaggtattttttgagcttagagaagccaggtgctgtcctgagcaccacgtaccctgtctaagagaccttaactctttagaagcgtgctctccgttgtgtgttgagagctggctgaaatccagaaagtgccacggacatgcaggaggcaaggggaggagcacagggcagatttccctgggctgatttttagggaatgagtgggcattgtgaagacggaagagagagggaacagactagtataaggcacagccagtgcagagccaccgaggtgggaaggacctggattgtttgggggcagtgaggtgctcaatttggctggagctgagtagggacatggtgggaagaaggtgaagctggagggagagtccctcgcagtgctggccaccttacatcaggagacctctgggacaccagcagtgacctaatcaattgctcacagtggcagagtaaccatcagaatcaggatttcaagcctttccagtaatcactgagtaaaatataacccgctcaccagtgagtgatccagaagggacagaaacagagaaagggcggaaaaggtcctcaagccttaaaaataaaacttgtcttctgtcctgtaggagtcctgagtacttctttaccgcacactttaaaatgtgaaaatgtaaagaagttggctaagccagggcattgcactggggatcctgcccaggccccaactgtgtctgcatctggctgtaggaggggagtggcccaaatgggaactcttagggaaatgacatggctggtcaatggctgagtgtcccagctgtgctatgggtctgatcttgaatctactggaatcacaaggatggacatgtccaaggtcacagacagcaccactgaccctggcagccacctggtgaatgtgaccctgtgcaccatgtatccctacttatcacaaaagcaacatctgtcataaggggttacaggtgctgcttacaaacataataaatatgtttttctaaataaagaaggctgaccaagggcaggaacaaagcaaagttactccttttactataacctccctggtcacctttgacttccaagcctgccagtcatttttcaaggttcaaggctccattcgtgtcaagacagagtagagagtgagggtgggatgggacagtggggaggggccgctcaaccctggcagtagcaacaactccttggccatgttaatgagcagctttgttctgcatcacctagctgtataataacagcaggaattaatacaaccacaaattaatagcacagaagagcaatcaggaggcagagatacattcctaatgggctcagctgagagcaggaggaagatggatatgggagcatctccctgccttggcccctgaaccttgccagctggggctggcagaggggctgaaacaccgctgcacacagcctcacctttgccaaggacagagggtttggctctgccaagggtaatcagggcctgcagcctgtgctgcaacctccacctgctcttcccagtcagagccactggcccaggaaggagcaagacacacagctctgctgctcagggacctggggcatcaggtctgagtcttgcccatgtcactccccagggaaggtgacagcatctctctcaattgctttcctccagatcctgtggttatagggagtggtcaggagcaattttctattaggtccaagtgaacagctcactcagccattgcatgtaataataacctcaaagtgcacagtatttttcttataataattataatggtggctattgctctcgggctttccttccaggccacctctccaggggtcccaaagcaccagccctctgtctcacctgtcccaagcactatggttgaaagaggtgataggcagaaccagtgtgccctgtgaggtacagggcgggttctataggatggggattcttggtcccatcctccccatcctacagccactgctgtggctagagacattaatgcatctgtgagaaagtggaaggggcccttgagtgttgagatctgggtcctagaccctgctcagataaggcatctggacaaccttggacaaggcactgaactttcatggacaatgtgtatatcatctatgtaaaatgcaagctctgaatacacgacttctaaactcccttcaaacactcacatttcattaacaataaagtcattgttcactaagagaacattctgaagccatctggaattctgcctctttcctctgccttcttgtacctgtgaagggagtggaaggaacccatggtgcccacgtcgagtgtggaaagaagcctgagatgtttaggccacggaatggacatcatttcagttgaaactttgggcaatgcactaccagggtcacagccttttcctatagtgtttctgggacctgtccgctctgaaatcagtgtgcttcttctcccccactgtccttttgtgactactggtcttcatggctatgtttggaagcaagaacatctctatcaggtcttgtttaacttgagccttgtcccggctggctgagatggtgcgagctagggaagccagtgggaagggcgggaatcatctatgggaagttggccaaaatcttactaaggaactgggattcctaaatccctcactgggagaatttattccagtattattccatgggctgggcgtggtggctcatgcctataatctcagcattttgggaggccaaggcgggaggactgcttgaggccagcagttcaagaccagcctgggcaacatagtgagaccccatttctaaaaaaaaaaaaatacaaaactaaacttagctgggtgtggtgggcgagggcctgtagtcccagctactcaggaggctgcagtagaaggatcatttgagcccaggagttggaggctgcagtgagctgtgatcatgccactgtactccaacatgggtgacagagtaagcccctgtctcaaaaaaagaaaaaaaaaaaaaaggacaggacatccatgtttatagacaacagaagtaaaagttccacttatctatgacatgaattctgatattttcccttctttctcactctctctcttactctttcttgctctctctcactcactcactctaaaataaaatgctgtttacaacccactaaactgctttcatgacacattaatgggtctcaccctgcaatttaaaagtcactgggtgagatgcactccaaaggacattcctggtttctgatgctgtggtcggaaactaggatagcagctctctgactccctgactcctccccatcaacttgttgccctgcagcggccatccctgtgtgtggctagtggggaatttgtgggaaggggtctccacaactggggcttgttgagggactcccacccaatgacaatttggcacaggtatgcagagtaataatgggctctcccagctcccctccatgctgcacctactcccagctctgagctggagctcccgtgcatcttcagccaggaagaggaagagggaggtggggaggtgggaaggtagcaacaagcaccaggcaaccatgagtaatctaggccagtgccagtgccaggggaggtgtgatgggaggcacctgggcctcctcccctgactcctgctgctgctgacagccccactgggagctgcaatggtgctcttaattgtgcctgctcctcagctgctggagggacacggccactgtggggtgcaatccaggaggtgtctgggtttggaggggtgcttctaccagagggcagggctgccaaaagatgagaggcaaggcttggggcaccccaagagacagtcctgagaaagagacatcattccccttcagtgaggaaaatcagctccgggccccacttcccaagggtcctgtggggataagacacttccaaagctttgtcataggccttgtcttataaacactgccagcaacgcttttgagcgggagggactcattccaaccaccagccctgctgattttttctctctcttctttctacacaggaaaacttaccttcctctccggggtcctggaagacctacttctccatgtttataaggtcctttgaacaaagcagcattttgtacacatatttagctgctgttgttatgcttattaaatgtgtttaataattgtgatgattttataacatctgtaacttctttgttttacattatatgtaatctccttaatggaactctgtagcccagtgtaaaacacggaagctgtagggagggggaaatagtcatatttttgcacagagaagtctcatgattatattcaaacagaggtgtctcctggtgctttataagatttcagatttcttttcttttctttctttctttctttttttttttttttttttttttgagatagggtctcactttgtttcctaggctggagtgcagtggcccagtcgcagctcactgcagcctcaacctcccaggctcagatgatcctcctgccatagcctcccaagtagctgggaccacaggcatgcaccaccacacccagctaatttttttattttttgtagagacggtgtctcactatgttgcccaggctggtctcaaactcctggccccaagagaccttccctcctcatcctcccaaagtgctggaattacaggtgcccagcttacaggtgcccagctgagacatttttcttactctagagagagacactgcagattctgtggtgattgcaaacaatgaggaagtcacaattcagggcctgcaaatgatatctgggccagaatcaggacggaacttcatgggttaaacaacaagggggaatggcggcccctaaagcccttctcccattcatgtggataatagttgtactagacatgaaacgctcttccttatatttctaccaacctgccctcaggcaccacaccacctagtgcccagaacatcggcattgaatggcgccataacaaaagactctccccagggtctaatcataagatgatcaaacactttcattcaaaatgcaggactgtaagttgcttttgctgttctttcaattacccagaatgtcagcatatctacattgacaggttaatatttggatgatgactctaagctctgtgaaaatcctgactgctttcaaataattttttaaaaatttatatttggcataactgtattgtgaagtcaaacttgatactccttaatcttttgactatttatcacccttgtacaaaatatattgtttgtgtttcaccaaaatctattgtttagtgactcccaagactttattctctaagcacagtcttcatagctgagcagttttgtacagcaaccttcacagggctcgtgagccatatcagaaattaggattctagggaggatgaacaatatgaacattttgattctggagggaggacactaaataaacagcatctcttttctgtaataaggggcatgatttaatgactgctaaaatctattctataatgctatgactcagaagcctctgttctctgccagaggttgtttgttcccaagtcctacctcctcttcccactgccccaaatcactagagttcattctccttcaatgagttagccttgtttgctaattttcaagtattttcattctggggctccctgggccaaaatagaacacccccacccccggcaccggcctttttagctttaaagctcaaggtcatcctatattaaattgatgcgttctgacattatccatgaaatgacgagtttctactcaggaaacaaagacatcattgtttgttcttattcaaaccatcaacgaatatgagttcatggcatctccatgctcctagagctcttcgaagacaggaaaaggcaaggagacttccagaaaacacattaccaaagatgagagactggctcaatgaagaactaaagctaacccatgcacctggatctgcaggtctgtcctctgtgttgccaccttgtctcaagacctttttcccattctaggagggaagtgggggcctgctggtggtctcccccaaccagcatgtgccatttggcaagaccaccagagttgctgggctactgtctgctgagaatgaaggaaccatcagtagagagatgaacagcctcccagtctgggaaagaagttgccagaacttagaggaatgatagcagagctgacatattctctgtcatctgcttgccctaccatggatggcaagattcaaggccccagctgagaagaataacaaggaaagccatgttcttatggaaatagcttctgctctctaagtattctagtccacaccaactctgtttctggagttaagatttaattagcttcattagtagtataaataagaatgttaatggctctgcttcattcacagtgactgatggcttaactcccattgagctaatgggttttagtcacatcccgaatcaaggtgctgagcatctgatccaggcaacacacatctttgtcctggtttttccagagtagtctttccaaagttttcacattgtatatcctgatatgggggttcagaaattatgggtactattatgtgcatccataacctcttcctacttggtacttagcctgatctcaaaaccccacctgctttgcctttctctctcctctagagatattccagaacagaagagttttcctaggcaacaaaagagatggggaaggagcacttattgagcatctactatgtgctaggtgcttggttccagaacctcagagggtggccaccaccaccccccactctatacacaaagaagctaaggtcagagacaagggagcgaatcactagcaaagctgggatttgaacacagaacattcaggctgcaaagctctcttcaccaaaacatcttgcttttcagcaaaaacacttgagcaactggttgctttctcattgttctgtgaatgttcctctgatgcccttgaccaaaatacacactccatgagggtagcagccaagcctctgctgactaattaactcctatagttaaaagccaattcaaacagccactctgcttctgcgtggactttgtttcctaccacttctagcttcctgctctgttcactcccatcacacccaggaaatctggaacttggagccaacaaaagctgcctctctcaatccactttgctgttgtaataacaaaccataaaattaactaaatttcaccgcggtgtaatgtgctgcataaaagcggtggcaatgtgtccgcagggcaaaggaacattccactgaaatcagtttctctttattgcattgccaacattcaataatttctcccccataaaggcagggagaatggcatgagccaaaatagaatggacacttgcaaacgtgctgtagatacctgtgcatgtgtgcagctatgtgcaaataaaaactggcaagtcacatgcacatgcatgttcatacacacttcccatgtccacacatgtcccctggctgtggaagcacatcaaattgtgcacatgaatactcagatgcatgcacagaaatacatggctaaaacagcgcacatatacctgtgttgtgcacattcatacttgttcaacacaggtgtgcaaatgggaagtcatatggagaaggttgtgctttattgtctttcgtataaatgccaccagtaaagccctcctggaattccgcagtcaactacaccctagttgcagcacattaagcccatttctaagaaacaacgtttacaaactagatgttaaatgctggaacattctcttcctattgctgagaaaagacagccaaggtagcttcagtagttttggcaggcttggctttgtccaaaatgacacaaccagaccatgttcaaaaaaagagcagggcataatgagcttaagggagtatgaggctctccttgtaacatatttccaggctgggtaaaatgtgccttgctcactcaagggtcttttcttgaacttttggagaaaacagaaagccactcccagtagctgggtgagtcacagactaatgggatttgcctttgcccagcccagttatggaagaacaaggaagttctgctgactgtctgctctaagtttttcctggggcaaatttaggttcatcttctcttgtggtggggaaggcagttgctgtcacactctcatatctacactgtagagcgctgttatatactcactctcaacttgggcaaggtcctctctgaaattcactatgactttcatcctctatgaaactcatattctcagatgcatactgtgctgagggtatgctcttaaaatttccaatttctgaaaggaccgcaggatggaaggctattttgtgtcttgtaaaaagcactggatcaggaatcaggagaactgggtccacactagttctgccaccggcacaggagccgtgaacagactcaaattcctctcggcctctaaatgcgtagatgaaactttagtgtgtcagtgagctcccccaaacttatgactccaaaatgttttaaaatccactgatgaaaggcaaatgccaatcttgcttttatgaaaaacagcacacaaaaaagaatacctctgacgttgtcaaagccagccaactattaagtctagatgtaatatgatgtcagtaaaaatgagttgttccacactttcaggacaaattgtctcaaaaatgctgccagtgcagtaattactcagatatttacacagtgattaacattttcacccttcaaatcatatgaggatgttctatagacagccagatatcttctaatctagcctggaatgtcttgtagaagagtcacaatgctcaacattcaataaataattacttagtgaccacattataaatatcaggaggtggatggtggtctgtggggatgcagcactgaataaaagacaggacctgccctcaaataataactgtgggaactgacaaccccaaccacccacttccctcgtcaggtacccatcctctggacaggaaaatggttcttgtcttctccaggaagacaaatttctgggctgcagcagtatcctaaagttatggaggaagtatggctcaactcactgctggcgagatgacacagaccacctagcactgttttccatgacaattcctttcaggaaactgtgatgactgaagaggaggaatggaagcccatggacccatccaagatgagatgcagcttcttccagaatggcaaggagtctgagaaagagaaggtccccacaaggtctcttctggctcaagtgattattccgctagtaaattacagggtaaatggcattcttgccatttcacagaccacacaaactgagactccgcaaaacataatgattaacatctgcaatcacagaacctttgagccaggctaaatgttagagatttttctacctacctctcattttgtaagtaacaacacctatgccagagatgtgacttggcctatactgcctcatcccccatctaatgtttcttaccacaccaggccagtaaagactacatgaaagtttatctctggaaataaatcttgcaacttaaatttaacaccagttctcagtcacatattctacagagcagttttccaaattttatcacatgaaaagatttgttttaataaaatcattgaactagagattccttccatttctccttgccaagatatttactgtgtacctaccatatgcaaggcatcaataaaaaagggaaaagagtgttccattttgtgaaaagtagcaattatgaatgcattttctcctatgtaaatacatgaataaaccttaatataacctctctccccctgttctctccttgccccaccctggatacaataattgtaaatgtttaggcctgaattttccatctttttaggttaggatggaatattcaggggcccccacacttagtttaggtgccgagtgacctagcatgcctgtattcaggacttattatgattagattatagaatatttgattttaactggaagtttctttataaaaaggcctctaagggttcttatgtaaaaggacctagcacagaagctgaacctaataatgaagatatttttaaccaaagacactgtaatctacacacacagcatataaaacaatatagatccagactgaaaatactcactcagcatccctgcctagctagccatagcagggaaatgggtatattgtagaattatgggcccaacagatctcattattttttacattctctaggtctcattcacaatctttgcttttgaccagtccctgagggagtctgtggcagttgagacagagactcagtggat[450 bp omitted]aaagagcacaagagaattgggaaattggaaacaataaagaacctctctctgcagcattatccatcctgcaagtccagttttctgcctaggttgtttctcatgcccaggctagagtgcagtgatgtgatctcagctcactgcaacctctgcctcctaggttcaagagattcttgtgcctcagtctcctgagtagctgggattacagacatgtgccaccacgcctggctaatttttgtatttttattagagacggggtttcaccatgttggccaggctggtcttgaactcaacatcctcaggtgatctgcctgcctcagcctcccaaagtgctatgattacaggcatgagtcaccacacttggcctcttcctaggttcttaactcatcctgcagaacccatagcagctatgcacagacagaaccagtcttggaggaagctgtagaacatttcgaggggcatgaggtttagaactgacccctatccaggccctacccctgaatgactgctaagagttggggagactcataacctccatcagaactgaattctatctgaggataattgggcatttacttactaacactgaacaagttactagaatggcacagaaacaatagcaacatgaagggttttctccaacccttgggttttgcagcctttaacacaccatattttatctaatctaaggcaccaattgtacagcacactataattttatgtactactaagaaagaaaaaaaggccggcaattaactatgacaatacattgattgtaagaagcattcaatttcagagatgttagattgtgagggaaaaatgtgtcttagaattgctaatatatagtaaaatctcaatcccttacaatggcattaaagcccttcccagaatggccccaaccaatgtttccagccccatatcctgccttcctgcatggaccagagcttcagcctgattctccttggtcagcacactcacaccttctaattctgggcctgggctgatgtggtctctcttgcctgggaggtagctatttggccccagcccccctagcctgcctgggctggtcctcacattccatttcttcctcatcatggcccttaccctgtccctttacagcacagttctgagtattttagggttgagttctttctctagattataaattccctgaggaagataaaacaatagttaacatgtgttgagtatttactgaatgacagttacataagtgtaaaccacatagatttcatatgcaagagggtgctattatctaatgagaaaaataagatatagacagcaactttaccaaattcatacaggctagtgacttagtcaaaatgggattccaacatgcttttgggtgacaccactgccccatttttaaccatttaaaatgatcttaatggtctaagcactggcatcaagggaggcagggggtgacattaaccaagcaatccatcatggattttcctctggcatcaatctggcttcaaggagaccacctaagccagctctgtctcttactattcttccttcccacaacatcagaaaaagcatttcctgctgttagggaatttatgattataaataaaaataaagcctgtaagacattactaaaaagtaaagaaaaaggcaactagataaaaaaaataaagttggataaaggtatgaataacaatgctgataataacaagagaattcactaaccatagtaatatgcttagtccaataaaggttctgtgaatataatgagttacaaacagattcatcttggctataaaataagaagcttctgtgattgttattgttgttattataaattaagctgggcttaaaatatcacgctgtagacaagggtgtgttttaataaacctgaaagcacaaccccaagcaagaattctgcctcttgtttctctatctcaaagatgtttctaggcacaggtgagaggccagcaatcctctgaccactgcaagctggcttaaggagaagggagctgactaagactccctgggccactatatgttttccctcagaagatatttacacgaggccaggcatggtggctcacgcctataatcccagcacttagggaggctgaggtgggtagatcacctgaggtcaggagttcgagaccaacctggccaacatggcgaaatcccatctctactaaaactacaaaaattagccaggcatggtgctgggcacctgtaatcccagctactcaggtggctgaggagggagaatcgtttgaatccgggaggtggaggttgcagtgagccaagattgcaccactgtactccagtctgggcaacagagtgagactctgcctcaaaaaaaaaaaaaaagaaaaaaaaaattaaaaaagaagatatttacacaagggatgggggatactggcatctggcagaagtccctttccaagatcaaaccctaggaaaaagtaagaagtgtctaaagttctagtactgaagatcaattcaacagttaagattttttttttttaaggttaggaaaacccactacaaaaggaagaaggaagctactttgaaataatacaaattagactgggtgagatccttccatggaaaatcttcttttaacaattttaaattgcagtaaaatattcctaacataaaattgaccatcttaatcatttttaaatgtgtggccgagcagtgttaagaacattcacattgttgtgcaaccatcaccaccatccattcatccatggaactcatttcatcttgcaaaactgaaactctacactcattaaataactgctcccctttcccctcccacaaggtcctggcaatcaccattctagtttctgtctggaaagtctttttccaatggagcatttcataatcagtgttgcactgttctttcaggaggccttctgaaatttgtgtcctttgaaaagagaagaaccatccttccagagccccctggcttaaagtcacaagtgggaaactgaggctcagaagagagtaagatttggcttcccttagaacactcaatgtggctgggcacagtgcctcacgcctgtaaatccagcactttgagaggccaaggcgggcagatcacttgaggtcaggagtttgagaccagcctggccaacatggtgaaatcccatctctacagaatacaaaacttagctgggcatggtggtgcacacctataatcccagctacttgggaggctgaggcatgagaattgcttgaacccggaaggtggaggtttcagtgagctgagatcatgttacttcactccagcctaggtgacagagtgaggctgtctcaaaaaaaataagtaaataattaagtgcacaagcaggtactacctctctgagagcaaacacttagtttagagcaaacacttagtttagacacatcattgccaccccacactcaccacgcctgcccataatgcccctagtacccaatggccaacttgaattactgtgtcttatcaggatgacaccagtgcagttgtttcctgcatgtagaacaggttaaatgccttctggaaagcaccagtcctttcattaatgagctcaccttgactgtccacagcacagaaggggtgccatgacagccctatgtcaagacatggattttttttttctttcccttagcccttggggtggcagtcgcctgccactgtgtgcaacctcaatgtgccccacagatattatcattttctacatgtgctacgatatgattaaggactactgaaatttggattttcttttttcacaagacaaaaaaacagaaaaactttgagctccccagaggcaagggagggaccagtgcaatggagggctaccttagggtctttacccctgcagagcaggtgtggggtctcgtggagcaactgcatgtgccttgcctacttcctgcacccagaaatagtcactaccagcccctgtccaatgagggccagcatccacatccctcccctttccctctggcagtcctcctttaaacctcctggaggtttagcttcctccttcctcttctcttctttaagttgttccattatctacatgcagggtttgatgcagatttccaatagctgttaatcaaaacatcttctatttctacctttgtcctcgaagtgttgtcatgtcacttctgtactacaatttaattaagtgtcaagcaagagatcagttgagaaggtcttgcctctcagtggaactagggaataataacatctgcaaggcttgcaggcatcctgtgtctaaacccaaagcaacacatatcatagcaggaaggacctttccccaccccagtaagaggaatgagggttgctgtggactagcagtgcccttgagagcatcttagctcagttttctcaccagaaagtggtaaataatacatattttccccaacagcctaggtgccagcattggtagatgtcggtgaaatgaatgaatgcatacatacattttagatcatagatctttagttctttgggggatggatgtaggtgtgaaagtaggaaatccattgataagcagagtgttaaataataaaatacaggcaaaaattctagactcttaacacattacggctggttactttggcaaacattagaaccgccaaagcacacacaactgcacaaagttggttggcaaacttttctgttaaatcgacactccaaagatcgtcattaatctcagtaagttattaactccaagaaatcatctgaacaatggtgaactataataatctgtacataccatatgtgcattaagcattaacacttcattcttgcctatttcctaatgtcaagaaagctcaaatgtacccagcacattgatctctcctgcagaaaaacatgttacatctcatccacaattacaacaactacctagcttgctatgttattgtcatcccaactactgggaaaggaaatgttataatccatggttctaacacacatgaggtcaggtcattcggttgctctgggaactctatagagttgtgctccctaaatcttctgggctgtgccagccaacactagttgggaactcccctccaataaccagactacattatgctcctggcagggccccaggggctccagtgtctcaccccaagagtaactcttctggcactggcagaacagtcccagcctcacgaaagagcccagctggaccataaattgtacagacaaagataaagacacacattttctcttggctcaaaggaccgcagcatggcacattacccacccctctcccaggccagcacagccgttcacatgactcccccttctcctctactgtttctcctctcccactctatcctgttctcctctttccccatctgctgcgtgagctacaaggctcctatcagccctggtcaccagagcagcatatcatcccagagctggtacagcaggctgtttgttgggatgaacttcaaatgaccttctctctgggtctttctcagcactgacttaaccttgttcccgcagacagctgtgggctaaagacaagtataccctggtccagataccactgcttgctatctgtgtgactttgggcacttgtttgatgtctccgagcctcataaaataatgctaacttcatgggatggttgcaaggactaaatgagatatgtcatagctttaatgaaacttagcatgccttacgagtacaaaggctcttcacatctttggtccactatcaggaaggcagttagatgttttaactcagtgttttaacaaaacaaaataaaaacaaagttcaaaaatattaagtgacctactcaagtcagtaatggaggaagcaaaaataaaacccaggtttagcaggttccttatccactgctaattacactcttctctctataaagcaaatgctatggcagaatttttgtgctagccctgccttccaaacatgctggaaaggccacagagcagcaggaaacctacattgttttccctactagatttaaacctgtttaatttgttggattccacaaaagaacacaccatccttcatttatactttatacttcagttttccccatctgcccactgtagcaggaggaggtcttctcctagtgaaaatggttagaattatgtaaggtacaatgtaaactcttttgagatacttagagatgagttctggagaatttacacatacacacacactttactagacatttggatgagtccaggctcctagagaaagtatatttgcagaagttcaggtagatattattgatgagctgtctattcagagccttgaatgaaaaggtgaggtatttttgatgttgatatcaataggcagtgagatttgatcagtagtgagaggatgacattaaatgaagggtcagagaaataaagaaaactgcatccctttgctaagcttggcaaagatgataaaatataaataacatggatgttcctctgattccattttttttcttctttctctgattgccacttgagataattagctaatacaataaggcaaatagaaaaactgcctggatttttgctagcccatttccctctccccagtggaataacttggattaaatagcatcaaagcactctcagctgaatcccttccccccaaaaaaggagacacagagggcaaagccagacctttcttccttttctagcccagaaaggttgctgggaagagctcaagggcccatatgaggcgggaagcagcaatgcgtctccatgacaaccacccaggccaaggccactttcatcacctgaaaactaagcaagacacgaaaggagggtgcatctgtaggaagtttggattcccacaagggcgagcctgttcaaaagccggcatgtgttgcagctgatgtgggatgggtaaaagggaacaaaaggatcgggaaccaaccaagaaactgaccaaatcaacgccagctcaatgaagaggtattggagaatagtattggctgcccaaaaagccgtccaaaatcgtttggtaggaaatggcagctgggtcacaaaaggagaggcagtctgagggtctagtgttgagtaggtcacagagggggacaagcagttgtgtgctccgagaagagtctgcaagccaccttggaggtctggggagggaaggcaggtgcccatgatcacggagatagtggtagagcccagatctacgcctatgctttctaactcagtccagggctatctttatatcttccactggcttcactttctccttctccccttttatacagtgtttcctgcagcagttgctctttcgggcactttcatgctaccagcgtgttcattgtaaccagattttccctgcagagaggcatgggcactatggtttgagcacctttccagggatggctctcctgggacagctgtgggagaaaggatgaaaggaaaggaggaaaacattccatttgcctcccagttgctccttaggctggtgctggagaagtgataaatggggcaggaggtgtcagatatcaacctggccttccttctccctacccgcccattactcaattggaaagattagggtaatgaatgaagctgaactgcctgggttaaacctctggcccttctgctcactcactgaataaccttgcccaaatcccttaacttctttgcctcctaatcttctatacagagatcataacaatcttttccaatcttctatacagagatcataacaatacctacctcctagggtttgccttagaaagaggaacccacagacctaagacctaagatgtcactagcatttctcctgtatgcttgagggaagtccagcccaaggacacaaccgacaaatccaacagtttgtgagtgaatgcatgaaggaaggttagtccgtcctcactccaaacctgttctcttcagacccagtgtttcctaacctttccacatcatgacacagaaagatcaccgtatttgtacaacaggctgaggtcaatggagaggttgttcccagctgcaagcacatggccctgaggctctggctgccccacatccctcctagcatctcccagggctgtagggatcaatatttaggttcctggtaatcaataggaagcaaagtaagcatagcccgaaattagggtgggggcaaccccagtccctggggccaggggacatctggacactaattggtttagaagtatttgggctaaaccctggagtgcagagaatcactctggttagctcaggccaatgggagcccacctcaggtcctaggggtagaggcaattcttattatgcttcctgttactatgctatgggagaaaggtggaaaaaattttttttgaggaaactaccaccatccccactgcacactgaatggacagaggcagaactcctaatgggggcagcgtcccaagtctgaggcgcccctccgtgttcccctttatacgcctccccaccatgtgtacttctgtttgctcctctgtaagacactggtagccatccaacgccgaaagatgggtcaaggaccataatggtctcagtgagcaattgaagtaaaggaccacatgtttgagcttttcttgaaagattttttttaaataaataaaagggttattgagctcttttttcccctccctttcttttaacagcacctttcaacccaggagctgccaaagaagttataagccgtgctatgtatagaagccacgtcactccctactgaaatagagaagagcagcatctcccccacagcattgagggaaagaagagggagcaactgggtccagccaaaacagggtgtgggggtagggggctggtggggtcggaggagtggctgcaaccctgcctggtgtgtgcagggagccaacacagggagggctaccaaggggggccactgccaggaattgcagcatttttgtgctggacagagctgcctcagggcatctcattcccactcctagatgtaattgatcatatttggaaaggccctcagggacaggaaacttgataaattcccattccaatgtttcacgaccctgacagtaaaggagctcatcctaataatgaagctacaggctgcttcccacagtttaaatgcatttccccttctgatgtccttcgtggagatcaggaacagctggtcactctcctccccatgataacccctcttatattgaggatgggtatcctgttgcttttcaccccttgctgcttcttattaataaaaaaaaataaaactccaatttctgtatcttgccatcaaatgcccttttcctttgtcccaactcaacccatcatcaccgtccttttttttaagtatattttttcttctgaccttgttgcaaaattgatggctcaggagtaaatatcattcccattgtaccatcccaaaaatggaggcatacacattaggaccaggtgaagggaaggaaatgaatgtgtgctgcagccctcccctttgtaagctgttccccacattctctgagtgaatcttcaaaatcccaacctcctgttcacaaatccagaagttaagattcagataagtaaggggttcaagatgatctggttaatcatcaccacagctgaggtttaaattctgttcacaagttaattgtttattaacttgcagaccagttcagatcaagaatacattaactcagggccaggtgcggtggctcacacctgtaatcccagcactttgggatgctgaggcaggcagatcacttgaggtcaggagtttgagaccagcctggccaacatggtgaaaccctcatctctactaaaaaatacaaaagttagctgagcatggtggtgcgcacctgtagtcccagctacttgggaggctgaggcatgagaattgcttgaaccagaggtggagactgcattgagccaagattgtgccactgcactccagcctgggcaacagactgggagtctgtctcaaaaaataaaaataaaaaataaaaaaataaaagaatacattaactccattcagagaaatgcaaatcatagcgtcaatgagcaggagatgccatttcccacccgctgggatggctagagtaaaggatagaaaatgacaagtgttggtgagggtgtgcagcaattggaaccctcacacattgctggtgggaatggaagtgaggtggctgctttggaaaacagcctggcaccttctcaagtggtgaaatagatttactatatgatcccaaaattccactccttgaaatatatgcaagacaaatgaaaacatatatccagacaaaaatgtatacacaaatgttcatagcagcattattcagaatagccaaaaaaggaaacaatgcaaaagtccatcagataaagaatgggtgaataaaatgtggtatatccatacaatggaatattagtggcaaggaaaaggaatgaagtactgatccatgctacaatgtggctaaaccttgaaagcattatgctgagtaagaaagaagccagacacaaaaggctacatataagattccttttatacacaatgtccagaatagacaaatgtacagagaaagatagattagtggctacctagggctgggggccatgtggagctggagagggtgatggctaagggatttgagctgtctttttgcagcaataagaatgttctaaaattgattgtggtgatggttgtgcaactctgtaattatagtaaaagctactgaattgcaaaagccattgacttgtactctttaaataggtgaattataccaaatgtgaatatatctcattaaagctgttttttaagagtactttaaattcaaaaactctgctttttaaatgtttgagaatcctttgtccttataaagaattgattcaaagttccataaagcggattcagtttccagattgtgttgataagacttgcccatggctggccaccccgtcatctctagcagagggtgtgtgagaatggccgttggctccagcttcctgggaggggagacccaaggcccaggaagaaagcgatgagtcctttctcatccaaaggtgcatgcccaagatacctgctttgaggtacttcccatccaccttctccattacaatggaaggcaacaaagccaacaggaagcaccttgtccatgtgcaccatgagtcaagtcacatgtaggacccagccaaggacctagagtccctgccacatcccagaaccacacttaggtagcaggtaccaggcctctgagctggaagcaatgtgggggaagatgcgcccacctcctgctcactcctgcctctcttggtcattccacagagttccagagaaagagataaaggagacaaagaaagaaaagaagaaaagagcatgcagagaccagttggaaaataaaagggggccaattccctcttattaagcctgttattaggctgcgaatcaaattaaaccacagggctttccacttacagagtgctattttaaggcttattagactatattaggattggcatacatttccactgacataatatcggcctttaattggatttaagggcgaggaggctgcattcagctggaatagggtccctgcaaggagaaacttgctattctcctcacagcttccccacttcccctgctggctgccatcccaggggctgggcagaccctgtaaccctttcagatccaaaacacagcttttttcctcctcctcctcctctgataagtgcccagaggccgaagcaggcccccctctcgcctacgtgtgcccatccctgactggccagcttccggtactcggtggctgtaggaggtgcagagctgtgcgtgcctgccgaggctgggcagcagacttcagactgtgagtagagccccagggagggaggccagcctccccctcctgcttccaagctgccgtgggcgagattggcagtgggaggtgcaggagtttttcatgggacagtgatgaaaagggggacttggggttggaagcagagtttaccttgacctttgaatctcctcccatcccctgcctggtcaatccttgaaagaccctcaggggcacgtggtagaacctgaatacaggagggatatgggaaaaagttcacacactatggggaagcgaacactctccgggctggtggcagtttccagacacttgtgaccaacttctcaaagctgcagcatcctcctacgtaaaataggaacacgctttccttccactcgggattgctttgagaattaattgagataatacagctaaagtggtgagtaggaggcttaataacgtttagtgccttctcccctttgctgtacaaatttcagatctttctaccaaaaggcatcataaaagtaacagacctcaccagtcaagtacgttgcaaaataatcttgggaggggaaatatcttggtacagagacaagtatgtatgaaatatcacttcccaaaatattgctcaaacatgaaaaaaaaatcccaaattccttaacattttccactaatatatgtgaacgtcgcctgctcccacttgccaagatgtttcttggctatactttgatgtcttcaatttccacgcttgtttttagctcttctgccagagccatgtgcttgtttatttttactacatttttatgacgtttctgctattgcaataagttttgcattattagttttatcaaataacagaatgtctggttggctggctgagatttattggcccagtttttatggctccatcccagaacactttttgtgattactttctaagttgttcttagatccattcttaaatatgtgcttattcctttattaaatcacatctgaggactaattgttatggtataaacttagcatcagtgcaatgccaattgctataatcttaccattattacttaatcacaggtttgtgtactcggttctatgcaacatatatatatatatatgttggaaaagttgcttggaaagctgaaatttacaaactgcatttcttcctatattcactaggaagtttctcctcctaatacatattatctcaccttgaaatatctgtttggcaagttctgtttatttgggatgttgactttcctgaagctcgaggaaaaccttattacaaaacaaaacaaaaaaacacaagcatgatttatttcatccctgcattagcttcctctgctgttcttatttgacccaataagtctatgaatgacttggttctatggttgagaggcagagaaaggatgaatttcctccatttattatggggagaacttgaggtggggggcaagcagtatcttgctcagccctgcaatgaggtgtcagttgtcctgttttctgcaaggaaggtcctcatagcctggcaataatgaagtctgttgtgcttcttgaaagctttgcaacccctgaaagtctgaattcttttcaagtcagatctgttttcctcatggagcctgagcccagggttttcttctcccgtccaacccccaacacatgtcctcattgctcactgacccccagagagttccacatcagtaagagtgggacctcctggaatgttcccccaaggggacatcaaaggagcaactgtcctggcgggtttggattaatggcatctgaatcattacagccagaaatgtgtatgcctgtaagcctggggcaccaacagtgtgtgcgtgtgtgtgtgtgtgtgtgagtgcactgcacactgagcctgtgcatattaaggggtttaaatcaggaatgagcgcaaatccacaaacatgtatccctgtgaactcacggtactcacaatttagccaggaggagtttttatttgaaacccactggggtctaaaatctttttagggctcagttttctggagttgaagtgttttacattcccacttctgctcctattctactacagttcttctttccccatcagggaatagactattctgatggcagagggtggtaggcaggagcctttcataaaaataacttttgatcataatgcatcatcattatcatcagcgctatttagctctaacgcaggtaggtcactggagtaggggcaggcttcttggtgaatggctcttggatgtgcttttttgtccacatgtgtgtgtcctaatgtacccctgctctgcagatggctctaattaatcaggacagtgaaagctcttggagagggattctttttcttcaaaaaggaagatgctctagctcctccctccacttagcaaccagcacgtacagatgtggcaaaggcagagaaatagagaagtggtaggaagtttcacaagggccctttgggaggcaacttgctgacagccacaggaaaatgtggagaaggtgcctgagccccttttcagcatgagcataaatgagtctagtggttgtggaacacaattcgtaaaagatgacacaaatgcctgctttcttctactggtcttattttaggggtgttcaggatccaagtactccttccttaggtgaaactctccacgatgggaggtcttggtttcaggcaggaccaagagcccccactttggaagttcaaagagccagatgccccctcttcctgcctctagtggtcagggccctgggctggttcatgaagccttgctcccaagcctttggatctccagcaggtaatgcactggtaaggaaggctgcttagacacttttcaggatgtcagtggtgagttaccgcagggatgacgcttcctgctaagagatggctatcacccttccagcttcccgtgtcccaattcctgaacttcgtccaagtctgttcctccagctagccatcaattctgggagggcttgatatccttcttcataaattccctttttgatttaaaataacctgagtcagtctctgttagttgcaagtgaaacatcctaactgataaatcccccaggacagctgacgtcagatttcattagctgaaaggggtgagccccactggctgtgagcaaaaagtgcaccccactttcatcacaagtctggacaaatgagactgttgggtgctcggcagactctcccattcagccgattaatatttccctggtactaaccatgtgcctggcactgccctaggaatgagagatgcagccacaaataggagaaaatcccttttctcatgtagtttgtatcctagtgtgggatgagacaagcaattacaaataggcatataaatccctctgcctatgcctaggaagagagggaggaggggtagagggcaagggggaagggggaaaaatcaagaggctttggggagggagagagaaggagaaaaatggagatcatatgatgccaacagagaaaagtgtttccagaaggagggagtattcattttgtaaagtgtacgaggaggtaggaaggtaccattttgttaaatgatagagggtagatttctatagtaggacaaggctgagaaatgaccccaacatatcagtgggcagctgatgcaggtttaaggggaagagcgaggagggggtttaggataggagagcaagaggggagatatttaatgctccttttgaacgtgcattaatggacttgggatatccagtttcgaagaactgctttagaaagggaaaccactttactcatacaaggtgaagacatcttaagccagatcttcctagaagctctacctggcagatcggtgagaagctggggttctatttttttcccaactgggccctccagtgggtctgtttttctatccaggtgctcaaatgggaaagcctgaagctcagatacagctgtttgtgtaaatggcaaagttgggtttatagcaatttaatcagcagcattaataatgtcacctaagcttaatgataccaattataaccacagtaaacattgctgagccgtttataaacagtgatgttcaagatgaacttcctgcatttggtcaatgctgttgttaaaaaacaagactagaaggttcatgttttgaagattcccatattctcactcctgtgctgaaaaaacagcgccacataagggcaaacccctgcaaggatgtcatcctcttcctctcttcactacctgctttggtcatttcccaaggccagatctgcatccaccgctgttgtccaccaaaacagagtaaggctacggcaggagtattatggacctaaccatgccagaacaaggacacagttggataattattctagcccaggcaatattggttccctctattaagcaagttctgagaagtccaggggaaaacaaaagggattgttaaaggtcagatagagcccatcaaaattctaatcaaaacagaagttggaggcaggacttcgtaagagctattcctctccatgggtggctctcatatgagaaatggaagctagccttccttttctgaggaaggaacatgtattagagagtcaaaagtactccctgagggattctaattagaggatgaggaagacagaggggcctggggaaggattcctaaggaaggttgtgaaaccacctgtttccaaagggcttcaacgttaaaggcaacatctctgcctatgagaggtgtggtgtccaaatggagagatgggtgttggctaaggaatgtcgaccagccagagtctcttccagacccaaaagcctggaaaaaatgtacatgtggctagagacaccatcttcatctaaaaacagcagaactttccaacctttttcatggcagccacaggaaatgataatctttgcagggcacatggagtaaacagaggggaggctggagagccagcctgctcagctgagagcgtggaacactgagtgccaagctctgtgccctgcatttcacatgccctccctctttcctttgcatccttcttgccttcctaatccgcctcagcaaagggcttcttgcacggttttctcgtcatcaggagtgcatgtctcaaggaaaactgctcttgtccacattctcagccaaatgagagtatcaattcatttgttcattgtaaatagagtagtgcaatagtttggtcctgaatccgtgttcagtttggaatcttaagagaccaagatgccaaaatacctgcatggcagcgtgttgtctttcccctggttgccatgaagataggatccgctggagcctctgacatcccatctcaagcatgtgaggggctcagaacttttcctaagaggaattaaggtctgtcctcattcaatttgtagaaagccactcagccttctctttgctgccaacacaaaccttcttttcagtctaacctccctgaagatagcagactcttcaggggattttactgcagtgtttggaaattgcattgtgtttttatagatttgtgcgtacacctggtggtcttagaactccacaggcaactctagtaaataaataccagctctgggccgagcccaagttaaagtgaaggattttgttaggccaaagtcagcgaaaggaattacagagaaatccatgccagaaagcaggagattgttagacacagagcactccattcaggggaaaggacaacaatatatttttttcccagccagtgtgtctcaatggagatgaggatttgtgaacaagattcaaattccactgccaccactaacttgctttttagaatccaaaatgaagtcttcctgtgactgcgtctatgtggcatcaactatttggaagggaattgagacgtttatttaattatccagatattttgaaatatacaaatcctttttgttccccacttccaattcagatgtttgtcatctgtagcaagcatgtgtgactcaggtttctcatctgaaaccggggttgggtggaggttcaagttcacttgtctacaagggatgccctttctactaacaagtgagcctgaagcaatatacccacagtcttttgggggagagcaaagttttaagaaaagatattgcctgccagtgtagctagagagcagtagctctcaaatggcctagtaatttggaggagagggttggtggagaagaaaacggaaggaggatatgactgtgttttattagattacttggaagtaattagccatatagaatctttgggtatggccgtttagaggttccaggccattatttactcacagttaattccttaatgcatgtgttcattcaacaaatattaagttgatgcctactctatgacagtgacttgggtaggtgctaggaataaagggataaaaacaagctttttaaaacaacttctacaagtgagtatataattacatctatgtcaagttctgtgaagaaaagatgaatgcagttatgagcgagtatcactgggcacaatctcataggcagggctagggtgggcttgctcaggacagagcagggtgattgagacttgaaggttgaagacaggcagggccagacaaggcaaggactgggaaggtcagggtcttgcaggctacataaggggcacttgattttatcatggatgcaaggagaatccactgaagggcttaaaatcatttagaagaaaaagcaccagaatcagaccacctgggctctagacccagaccaatggcttgactagtgaggtggccctgagaaagccattcgaccttcctgtctcagttttctcctctgcaaatgggtactacaaagagactcaaagttagacctggaaggcacctgagagttttgttttgtttttttatgttcagccccctcctatttcagaaggaaaaagtcaaggctgcttttttttttttttttttttttttattcctgagacagagtcttgctttgtcacgcaggctggagtacagtggctcaatctcagctcactgcaacccgtaccttcagagtcaagcagttctcctgcctcagcctcctaaggagctggaaccacaggtgcataccaccatgccggatttttgtatttttagtagagacggagtttcaccatgttggccaggcaggtctctaactcctgacctcaagtgatctgcctgccacggtctcccaaagtgctgggattacaggcatgagctaccgtgcctggctgtcaaggctcctaatacctgttctgttcacttcatttgactgtggcagtaatcaaaagaaataatacatgtaaacatattttgtaaaataaagaaaaatgtatacctaaggtcttaaattattatttctgatctctcccaccctggccacaaagactcacacatctcaatgttcctaagtattaagacaagagagataaaaatagagatttgcctgcatgtgtctacgtgtgtatgtctgtgtctttgtatctaagtttttacttcattatctatatctagagagaaaaaagaaaaaagatatttgagagactggatgtagttctagggcattatttacagggagcggggaagtcctgaaaaataccttatccccttgggagcagtgacctaatcaagatggcataattgcctgtcttatctaaatgaaagcatcatttgagaaacagtaatgggcctcagtgtggtttcaattgctatatagttctcaattgctattgagttctcatttgccatggagttcagcggctgaagggtaattataatgtttaacaaatatattccctttagggacctgatgttaaagacacaacatcccttttcttatcctaccagattacacagctcccgggaccattgctatgtaccttaaaagcatgggcactttctctccctaagcttacctttctgccaggcagtcactaagaaacacggtctcagagggtgggagagaccaagaagtcaggacctccaggtgggcctgtccctcatccacatgaagctgccatgagagttcttgttgtccctcaggccttgctaatgaaccccaagacagcttaggagaatatgctctgtcaattattcatccccgccaggtcccaggcatcatctttgcctatcccattgcacgaagacaggagattataaggatcagagcaaaggtggtgctcactaaaaatacagatcagatactcagtttctctttaggactatggggttaccaaaaaataagggtcccgttctatcctttccttagcaagcatatagcatactcatgacaggtcttgcagtgacatctgagctgaatgatgtttcgacaacaacaaaaagataaaaatggaccaatttggaagaagaggccccaaaccccccatagagttgttgcaggtggccagtgcctctgtccacctcggagctcagaagatggcacagaggcctgcgtgcttgtagagagagagacagtgggtgctgccctctgcattgggctggctttagcatgcccagtcctgcacagcaccctggatagcccctgtcttgttcttcttccacctcaagtctaccgagtgcattctgcttggagatgggggccacatctgctgaatgcacattttatccctggtggtggctttgttcttaacctggcataggagctcactaaatgtttgcagaatgcatggtaaatggagcaaagagatgagtaaaattgattgtattacttccagctgcctgacagtctgcttgaagatactggccttaacatggatcgtcctccatgccatccacttccccaaggactcagctgtaatgagcgctagggggtgggttgctgctctgctccagatgtgaactcatggggtactttccagggaaaactaggaagaggtaggagagagagaagtgtcgcaggttggcagatgacaatcatgagggctgtccactgtgccagcccagtgacagaaaccagcctcttcaaaggcccctgcaggcccacgatgccttgtgtgtgcactcactgcttggagaacagagccaacacgtgttgtgctgtaggtacctcgtgggctacagaaaatgatgcgttgattgatttgcttattgggccttttatttattgtgcccagagtgatgggtgaatttagtaaaggaaggaggaaagggacaatcaagtttgagaatggtctgtcagctgcagagaggctgcaccacaaccagttattagcttagaaaataagatttctccccaatcctcactttctcttttgctaagagaatattttttccaacctacattaatataagaaaaataaaaaatgtggagagtggggcagaaggaggaaaggttagagcaggaacagggagtgaggccagaaatttgtttaacagaatcatttctgtgcctccttgaacactttgattaaagccaggggactaaatcaaagccactgaaaggaagaataaaaagatgtctgaaaacaattttgtttgctggaattttccctcctgtgttctattatggtgggggtgtggctgtgtgtgtgtgtgtgcacgcgtgcgtgaaaaaaagttctattttgtcctcctttgatctttcaaagaaaagaacatttaaaaaaggaaaagaagaagagaaattgatatcaatattgttccttttctttccttcacttccatcaataactcaactggatctaaagtgaggtatgaataccaattaagcccaggcaatccacaaatgaaaacctgcagcatgtaataagagagggtttccaaggccactacagccaccaggggttctcttaatcataggtcctctcccctcccctgggcccacttaagtcataagaccatttagaggactttatacatcatcaagtaaggccaagatgggaagagcaagatggagaggcctccagttcatacttccgtcttcaatgggtttgctgtagagccacctgcagggagggatcctattgatgtggtagagctgctacaatctcagagaagtggcttgagatagcaatattcaaataagacaagaccataagcactcatttctgggttgggaattggtgtaactagcccccttgctctccaaagaggaacacacgctttctatgcatcttcaaaacttcacataaaatagtgataaatcaggggcacccagactaagaaactgatgcaaatgctagaagtgcagagatgggagtaagctgcaacttgcacgctaactctgactgactgatagtgacttcctatagtgctgtgttaagaatgactatggggttgaattttcacttagtcagaaagtatagtgacccgttaactgatgtctgccataagggttagaagaaagtcctggtatcacatgctatgtgtatgccaacctggtacacttaaaagaacacttgacttgaagtcaaaagactataaaccatgactttgggaaagacacatagcttttctgagtcacaggccctatcattaaaaataataataacaacaggaaaactaatgtacatatatgaattttgtaatttgtgaaatatgcatgcatgctacctcttttattgtagtaaagtatacatagcataaaacttgccattttagctatttttaagtgtaaagttcagtgtcattaagtacattcacactgctatgtaactattaccaccatctatcttcaaaactattttatttatttatttttgaaacggagtctcactctgtcgcccaggctggagtgcaatggtgtgatcttggctcactgaaacctctgcctcccatgttcaagtgattctcttacctcagcctcccaagtagctgggactacaggcatgcgccaccatgcctggctaatttttgtgtttttagtagagatgggatttcatcatgttggccaggctggtctcgaactcctgacctcaagtgatccacccatctcggcctcccaaagtgttgtgattacaggcatgagccaccgcacccagtccccagaactattttatcttcccaaactgcaactctgaatccattaaacaacaactccccattcttcccttcccctagcctctggctaccatcattatgcttcctatctctaggagtttgacaactctaggaacctcatatgagtggaatcacacagtatttgtccttctgtatctgacttatttcacttagcatatgtcttcaaggttcatccatgttgtagcacgtatcggcatttcctttctttttaagactgaatattattccattatattatatggatagaccacatttatttatccattcatctgttgatggacatttgggttgcttccatcttttggcttttgcgagtaattctactatgaatatggttgtacatctgtttgagctcctgctttcaattcttttgggcattacccagaagtgtaaccgctggatcatatagtaattctatgtttaattttttgaggaaccatcatactgccaccatctgttcttacatttcaattagtaatgcctgtttgaaaaactttatagagaagttgaagggtcacaaagagataaaggttgaagaaattcaagttgaagtcatccaggtatggcctgggcctggccaggggcacatggcaaattgccctcacctcctgctgcccaggctgtggctggcaggctgtcttgctcagcagagcaccagggtggaggagcaatagcttgaatccatcccctttgccactcgtctggtgtggtccctgggccaggaccagtgctctagtggggaagaacattctcactcatcagcagcaatgtttacctgggcagggcgatggctcagatgccaccctccagaatgcagaccccttcgtgggaaaggcggggctgggtatggggagggaacaatggggaggaatgggcagacatggtgggaggaagccattcacattttggttatgacatactggtgtctagactttgtcatatggagcaaatgacaggatatttggatagaaactcagctttcaaataatgcgctaacaagaaagaaacgcattgcctttctttgttccccaaagctctggcagctggcgagatcagagctagcctgccagagcacaaagctttagactccttgtcctctctgcactggggcagtggtttcatgtcagctcacagacattaagaggttgcgctgcctggatgcagcccagcccagggcattgttgacatctgagagtggcagccagctcgacaggctcttcctttctccataaagtcattgagaagtcactggacttaaaagggcccacagagggtcatttagccccctttctgcctggactggacattagcaaaaccatccaaaactatcaggaattttccttatcaccaaacatacccattccgtggtcttgctcaggggatgtggagaatgacggttcctttttctcactatgttcgtagtttcatcctgtggttgagctaagtgggctctaggatgggaaaaacccagtttgactcctagggctgatacttctagtgtgtgaatttaggaaaattattacaataactacatcgcttaatcctcatattcttcatctgttaactggagaaaacaggaatgcatgccttatctcagttaataatatcaggagcctggcacctaaaagcacaatgtaagctctcagggttattgtcccatgccaatggagatgtccccctccctggggaagactgcaccaaactctccctgacagacgtccatcctcgtgaatgcccttcctaccagggctcctgagagctggatttgggcatttctgggatagcaatggcttctcaccaaatttgaaggtttaggaaacaaacttaagggctcatctcattgaagtctatgtctggttcatttaactgctccttcaataagctgagagagctcagcagtgagtccataaaaagcactagtgaataatggtcccttgagtacactgcagaaggtgtcccttcaggggtttccatgccctgctcccccggtctttcctacggcccgcgtgtgtgtgtgtgtgtgtgtgtgtgtgtgtgtgcgtgcgcgcgcatgcatggggcaagagtgtgatggtgagtggggttaggctgaaagtcagaaaactggattctatgctcacctctgtcttcagcaagaccctccccctttgggggctcagtttcctcatctctaaaataaaagttgtacagtttcatttctggaatgacttgtggttcaatggatccatcattccggaactgtggctgatgaataggaaaaccggaaaagaaaaggaaggcatttttacatgaggcagaggggagaagtgaagtgcaaatccagggctcctgatacccagggcacacaagaggagattcagagagagaagacaggcatcagcaagtaaatctttcctctgccaagtgctcttagatagaaacccagatccctgaggaaattattgaaactcaattcctttgagaacgttaaaaagtgagctagcaaagcacattgtgaagaggaaatctgggtgtcctgccccctctgctttcatgtcgctaaccacaggagatggggctccttcaccttcacagtccctggggtgccttcctatctttcagggagcttggggactcctccagagaaacagtaagatgagttacaagccgtgaacctgtctcagtaggactgtctagttacagggagctccatattaagagaaattggaagaaacctgtaatccaatcatgaagccggggatggtggtgagttacctcctgaaacacacacagtacattcagagctccaaaaacattgtgcaggagccagaggtgagagcctcagttctttcctcacttccaggaccaagagggtctgtctttagggtaatagaccctgtgctttctgagtcttgattttcctaccattaaaaaaagagagaggctaggcatggtggctcccacctataatcccaacgctttgggaggctgaggcaggcggatcacaaggtcaggagtttgagaccagcctggccaacatggtgaaaccccatctctactaaaaatacaaaaattagctgagtgtggtggcgggtgcctgtaaccccagctactcaggaggctgaggcaggggaattgcttgaactcaggatgcggaggctgcagtgagccgagattgtgtgactgcactccagcctgggcaacagagcaagattctgtctcaattaaaaaaaaaagagagagagaattaaataagaagtatttctttctcttggctacctcaaagtaggggcttttgggaaatcaaaagtaactatttgggaagaagaggaatgactgatgttgcagaaaagacattccagcaaagggccatttaaattttccttggaaatattagttgaaagaataattgacatctgctgttggaatatgatgatgagagctttaatcttttttaattatttaaaaaaacttttttgagacagtgccttgctctgttgtccaggctggagtgcagtagtgcaatcatagctcattgcagcttcaaactcttgggattaagtgatcctcccacctcagcctcctgagtagctggaaccacagacacttgccaccatccctagctaatttttttgttgttgttatttttgtagagacaggttctcgctatgttgtccaggctagtctcaaactcctgtggcttaagtgatcctccagcctcagtctcccaaagtgcttggattacaggcatgagccactgtacctagctggtgagagcttcaaataagctaagaaagagatatctaagattacctggaaatgaaactcttgctaaacatgggctctacatgtggatatagagcaagtgcaagttgcaaatcattaactacattggctatgttcaaggaatagaagtgaaaatgctcagctgagtagccctgggctgggctgtggtggccacacagatcccttgcctagatccagagcctgctaaggatggtggcctagcagctctgtcatggactatgaccaaagaagtatttccaaaggatcaccatacactgaactcttcaggcatgacagcaagtgggcagcgtaccaccctcaaaaaggatacacactcgggagtgaggtggcagggaaggagggagatacagaaggaactgccatggagcctggaagaagaaagggggggtgaaggtattgggaagaaaggatgaaggatgcaggtgaggggtggggtggggagcgggggatgaacgcaacacacaggaagaccaagaaacccggaagaatcacgagtacagaataaaaccaataataagtccccctctcatgcaggggacatcattagagatgccacggtccagaggaaggacacatcggctgatacagctgaccacaggttggagcagtgcatctctggggaacatccatgaagaccaacagagaatgagaaggacagagcagcaaagggcacctgcagggatggaacagccaccaggagccagatgctttaactgaactgacttgagttgaaccctcacaacagacccgccatgcaggtacttattagataagagagccgaggaccaggaaggccaaatagctggcccaggttcccccaggtgccagcggtaggactgcaattctgctcgtcgaagccctctctcttccaactgtgacacttttctcttaatgctccaggcctgacggagggcagagatcacagggggtgtagaaaggagctttttgtgatgacatagaaaatacccacgcaccatgggggcagttggcaagagaggagaatgtcttggaaatgggctggacagcagggtgttgattggggccaatgtcaatgctgggcgtgatcaaaggaggggcagtgtcgcctccataagaagggagaacgaagggcatttagagggagtggaacagcagcttatttgagtattctattctgcttagtgtttttcctttaggttaactatttgatcaactactaaggtatgagagaaaagaaaagcaacaaggagacatgggggaagagagctggatggggagggacgcggctgcacccacacagatcctggctccctgtcgctctccttcctgccagcagctcctgggcctgccaggcatccagggaagcagctgtctgagcctaagcccagctggcaggaacccccactgacctggggaccagaggaggaggtgggctgtggtctctcctgtcaccctctgtctgcccaggctgacacctggagtgtctagagtggggccctcagctgcctgcgctgcggctcacagcacctgatggacacacaggtgtggcgcgtcctgctgggctcaaagacacctgctctgggcaccatgcccgtccccatcaacagttgtagatgaggctggagctgagaagaactgacaagcagacgtctgctgaggagctgggccccgccctgaaggaagacagcccagccctcccaaagcacatggttgccaggtgaaatttgcagtcaccagccgccagccatgtggtgacattggatttcaggcaatgaccttgggaacccacattgcatctgcagcaggtgtctgcattcacctcacatagcactctgaaaatgtttgccgctgtcagcaccacctgaaggggcttcccctgcagtcctcttttccatccaccctcccctaattcagaccatgccatttctctatcctgccgcacacctccacatttgagttttcctgcttggatctgcctggcctgatgtgtctggctgctcagagcccagagcctctcccagccctttcacagaagatgagagaatccctaacgcctctgccatttgaccaagacagctcctttcaacttcctcttcccctcgggcaaaatcagcagcagagacaggactaagctgagtggcctaagcccctcctttgattctcaggcccccagagccacccaggtgccagaaacctgctaagacgtatcaccagaccccttgctgatatcataagcattttttccccttctcagcaaaactgacaggacatggcttcctggaaaggaggtgaggggaggagtccccaagcctggtgagaacagagggagtgctggtcgatggcccctgtttctccactgccacctcaagaagccttccaaggagggcagactaatgcttgcactggcttggctaatggaagaagccaggggggctgtgtggaaagaatggaagagcccccagtgggcataacatacaccaaaaagagagggcaccgaccatctgtgttgacagagaaggacatccctcagtagccatcaccgaaaagcaggcacttcatgtctgccctgaaaccatcactatgaacaaagagctcatcaaagaaagggaatttttatagacaccctatagaggagtgattttgattcctaatctgtccattacggccccccgagaagtaggtataaaaagatgatatgcggccgggcgcggtgcctcctgcctgtaatcccagcactttgggaggctgaggcgggcggatcacaaggtcaggagattgagaccatcctggttaacacggtgaaaccccttctctactaaaaatacaaaaaattagccgggtgtggtgccaggtgcctgcagtcccagctactcgggaggctgaggcaggagcatggcatgaacctgggaggcagagattgcagtgagccaagatcgcaccactgcactccagcctgagcgacagagtgagactctgactcaaaaaaaaaaaaaaaaaaggtatgcagtgtggtccctgacagcaggtttgagctcccttgcaaggagaactccagcatttaatgcagaagaggcaagagtcaacttgggtgttcttccttcccagtcttagctctgagtgtagaaaatccaggtacattcctcccgaaatgctgttctggtgagtggatgcagagaggctgcccaccactgtgttatcacagatgccaccctggcatgagatgcaagggaagtagaggcagccatctggggatgggattactgggaagcccacaggcctcacaagccagaggcaccatggtttcttgacttggacgtggcctctcaaatgctggaggatgtccagcccacagcctttggtgatgctctcctggccttatttagaattcttaatgctggcaaacaacttttataaaattatccatttgtatttggatgcatacataaaaatatcctttatctgtatttggttaataaaactagtcttgctctgcctgtatttagcggtgccagctatcctggactctgtttgtgtgcctgtgtatgtgtgtgtgtgtttcattgtttctattccaatcatatcactaataaatgtctatgtataacaaactcatgcagaggagcagtgagcagattattatcctgcattctattgactccttatcacccctttccctgccctgctcaagcccctagatattgatgggtgtgactgagctaggccatcctctgctgttaggcaaaactgtgttcctgtgtgggcataccacgtcccaggagtcgacgactcacttttgccctgagggtccccagtgaggatgcacgtatgcctatggcaggcagggagagctgatgcctggttggcatgagcacctgaattagtgttggccacatatggatggccatgctggtgggcagaggcagaggtcagggggcacaagaagagtggaaaggagatcccagagaagaagcacatggagtgggaaaggcacgcttccaggttagggctggtctgcagacacacatgccccgtggttgggctggggagacgggttggggtggagagggaaatgggggtggggagtaacacgtgcaaaggtggaaatcatgaaccaggttttaagtcctttggctccgtgttatgtatacagaaggcacagagaaaagaatatgggaagttaagactgggctgtttgggtgggcaaggaaggagcttaccaaaaactgtcccaggagaccctctgagatggcccaagaccctcaaagaaagtggcccaccatcctcagctacctcttctctaactttcggtatcttacagctattcctgtatctccctaatctcaaatcacttcttgtgagagtttcctgccaatgatgtcagtaccgcttagatgtaggagcatatttctggacacagttccctgaataaagacttgggatagaaaattaatcctccccctaggagttcataaaactggggcaccgaggggactgatggctaaaaccaaagttgcagtgagcctggaagggaagcagccacttgggagggagccttaaactcgagtggggacggagacagtggccaaagatgttcacagccgtccttgaaagggatgaattaaagagaaggcatcaaggacagtaactcctttatcaaagcccatggctgggcctctctgatcagcccctgcctcctgacacacaaacacacacacatacacacactcacacacacagtctagaccacacctagccactgaagagtgctttaatccatgaaaacacactgagaaataactctggggaaacttgattgggaaggtaagcctgatgtgaaaaactgcaatcatgcatccaaagccaaaaagacatgatcttttgattatctgtgccactactctgattaatgattgttggccatcgcctctagattgacacctgcattatttttgtcccagcctggcttatctcctatcagtcaacgcatcacccacactcccaccagctgtactcaaggtggtcaggcacatgagaatgctttgggaaagatttacatcacgtgacctgtcatgtggcactacattagggctgcaggaccagctattgagcaaaggtatcaccccttccagcaatgagcttcaattttccaatccaaaagaagcagaaacaaatggctaaaaccaagtcagagatgataaccttgagtggctctgctgttttgatgtttacattttcccagaataaactgtataccattcagtatcaccacacagatcacacacgtggcgtggcctgggccctgtttactcaagcagtttcttcttcattgaaggagtccctcctgttcctttaggatttgtggatgacagtcctctgaaggaggtcaggtagatctatgcagatccttcctcccagtggcatcagctcagctactgcaccacagccttcaggcaggagtggaagcccccacaccaagcaacgtgtcctctctatcttcattacctccaaggtctgatgttactcaccctctcccacacctcacacactggaaaccagcatgatgcattagagagatgaagccttttagaatcaaacaaaatagaacaaaggttcaattctccagcacctagtagtgtctgacataaaataggtactgcataaacatcaatacaagatattctggctctgtcactcaccaacagtataattttgtgcaacatctggaagcctcaactttctcacctataaataaggaaagttgagaggcttaaagaagataatctttgtccgtgggttcagcagagggcctggcgtggagagcatggaagtgccttgaaaattggcatttctccagcatttattaacaaaaccataaaataatttaatgctatgccaactatataatgccaaacatttattacttactatgtgccaggcacttttctgagggcttaccatccattatcccttttaatcttcaaaatactatgtcgttggtaaatatcattattcccattttgcacgggcactaattccaagctttgagatggccagggcatgatgtggtcaggcagtagaagtaatgataaaaccagtagagcaggcaagacaagccctggctgcccatgagtctctagctgaacttcattgctaagttcacctttagccccagcaaccagggatgccaagtacacctttccccagaggactcagtcttgcaatgttctctccaaggtctggagaagtcaagaggaagggaaggaaaggaagaggcttccaggtcttagtgcctcatgccctaagattctatgattggtgccaggcctccgtagctctggatgtgcataggttagtgaaaccagcagagtggcagctggaaaggttcgattttgtgtgtctggccatcagctcctcctggactaagggctgtagatgtacacatttttctggcttgtcttattttccactggaaatccagatcccatcaatgctctaaagctggggagtctactgaagttactatgttcaaactttaaaacaaatacacttgaaacccctgggccttcactgtgaggaaacagctcttggatggtttggctactaatttttggctttttagcagtggctttaaataatgaggtgcccatggaaatgcaggggtggaggaggagcaatacagtgacaacaaaagagagaaatctgggaaaatgggaaactttcatgggagataagaaatcttaccgcccttattaggttttctgttctatcagggaggtctcctggctttaataaaatctcattttccctttaaactctcccatgtggtagggccttgtatttaatagggatatataagagaggattccaacctgaggctcaggtggccgggggctccccacactccagtccagcagctgggattgattgcagagctgccagtccagcaacacacaagttgctgcacatcagagagtaatcatgagccatttgatgctgacctgcacgaagtgaagatggcagcttggctcccgttcattcccatttggacagagaagctcatcctggtctttattaaaagtggaccaaaggagtaagtgatgagtcacaatatgtgattgattaggggcatctgcatttgaaagcctccgtggccttcatccatgcctaactccttaaggttcccattagcactgggagattgtgttcattaggagccgctgatgttgataaattcatctttcctgtcacatgcaattctatccagggtctggctctcagttctgaggggctgatccaccttgccttaataccacacgacaggctccttcacaaaacaagcagggtgtcaaaggctagctgttgggagatgccaggcctacaccagcaaaggctggagggaaggaaagggtgagcagctggtaattagaagctactggtgggtatcagaacgcatccatcagatgtctgcagagaggaacacacccagagtatctgtgggtcccaggagctggtgtaggttctgggctattctttcacgattgccaaagagtcaccacttgttgaaccctcgaatgctaacaacagtttctagctctaccaaactcctgttttgccagctttgcccccaagaaaacagaaaagtcatgactagcaaaatgaatcagtgtgaggcacttgcaccaacagagagcatataatttttatctagcaatttcactatcaactccaacaaattcactcttaaagccagaaaagcattccagctttctgcagggaaaatgtatgtgaggggtaagccacccagagtcagttacaactaccctgtctgctgtgggacaagctctctgtgtgttcttttcaaggtgtcagagaggtctgatggacaatgtgcacaagtctgtgtgtgagaagaccaagaaaggcgaggctgtccccgccctctgcattctcatcctggataacccaagctcatgttagtaaggcctctgaggctgatgtccccatttcatctatgtgcctttttccaagacagacactttagctgggattttgagtcctactagtagaggcttgggcaaggccagagtaggaaagaaacctggtggggcagagactgatcgggctttccaggcccacatggccagtgcttacacatcttccatgtcatcttggtccttccccttaactccatcccgcccccccccacgccccagccctcaaaacaatttgggacaacatcattaaattcacacaaacttcttccttaggatccagaaacccggttgtcccccaagaggtagaaaaggctcaagaataatgccacatggacttggctccccagccccagttccactcatcaaaagcaaataccatgtgcatgttctgtgtgtggcactggagacccaaagacaaactgttgatgttcctgccctaaagggtctcatgcagcactcagtaagaaagacaggcagttgattaaataaccacagcacagtgtgatccatgccaacatggacatgctagaggacccagtagcagtccaggaaagggagtgattctgtctacttggggaagaggaggacaggaaggacagatcaaaaaaggcttactgaaacaggtgacatctgatctgagaaagagctcctagagcagtcaaaatggtggggaagacactgtaggcagagctacatgtgttcagtcagcagggtgggaaacagcatggcatgtgggggaacaaagcacaagtggggactgccagcatgaagaactaagtgagggagagcttatgtggaatttagaaaggaaaaaggcaaataggagccaaggagagcaagaagcaatatttccttccactccagccagtcccttatgtgaacagaaaagagcagacagtagagtttgagtcccaacgccactggcatgaccttagaccaatgccttcacttcaagggtctcagcttccccatctgcaaatttggaacagccccacctgtagcatctgccccatggtgttgttgtgagaatcaaattttgataaggttcttgaagtgttgctactctgaagactgtggagagctttggcgatgtgaaaaggtctcatcaatcatcaccagggatcccagcattggccgagggactgtaccaactttgccgaaagtccttggagttcacatgctaaggggaaagcctctattgctccgcaaggcaaaggacccccagccgaggatacagggaagggaagaagaaatccatgtctctgctgctgctccatggaggagcaggatgctggggttcctgtgcccactgcatcccaattaagtatctgtttctcctcatttacacttggctcagctctccaaataccttcctttaaaggattgttttttaaaggcccttcaaactcagcaactataaacactgatgttaggcaaggcactttcagcaagaagcaaccataaggaaataaaattgctgctgttaaatctccactcccaggaagcgatttgctcagcaataaccatttctcaggagccctgatcaatcactgtttgggcaggagagaaggccttcccaggcctcctgatttctccaccctgcagtggaggcagcgcccaccacctttaattttatccagcaggccctgatggtggctttggcctggatttggaaccagaagaaattgtccctgtgactgtcctagaacggacacggggcagccatcactcctgcctggccccacctgcacccagtcctccttgatcctctctgtcttcccaggtcaaccttcggtgccaggcagggttaatcctctctctgcttttagcaggaggagccaaatcccacctatggcaatgtttgcttctggagaaacttatcttcctgcattgctctctcttcatcaaacatgaatgccagcaaaaactcctttcccaggctcacgaaatgtgtaaaaacaaagtacagaaaaagaaatcctacactagattccccagatgttttctatgaggcaattggatctctctttctctctgctagaaaaggctatttaggaaaagccagagaatacgagatgcttatgttatgaaatatcagcccagcagccttgtttactgggacccagttggaaaaaacccagattcccaagtaaataacttctctccttttcctagcaaaaattgctttaaatgatttcaatcctaaagataattttttccaagccaagtgacctttgcctcctttttatagcctcccctagaatggcctgtacagaatgtgtttccctgataagcccagagcttttccagacacagtcttctacaaactcaaatgaaaaagaaaaaaaaaaaaaaaagaaaacaaaacaaaacaaaagggagagctggaaggatcaactcctctgttcccctgtgcaggtaggaaaactgaggtgcaagatgtgacatcctctcccatctctgtggcacccacacatctgattgggcagcacagaagatggggtaccacagcctccccttctacaacatccctcatgggtccacaggagcccctctccccaccttgctgcttggagagaccatttgatttccttgtgcccctcagtggccaccagcaccaactcagtagataggttctgctgcctacttgcaaatccctttgctctccagaagatatctgtgagcaggaaggtatggccaggggtaacgagtgaaatgcagagacctggggctgaggagagaaaagagccaggatggatggcaggggagagtgctgtttctcacagcacagcctggcacaaaagaaaagaacagaaacacacacccacgttctactggaggccgcgagctgaaactgtggtatgggagaggcaatggatagggctttcaggagcaatcctccaacttctgctgacatagcactgttcccccaaatattggaagtgagggtaggaagagcaccctagaagttccatcacccaccccacccaaccatcacactctcctggtgaaaccatctatgctattccccaattatcttgtttctgtgagaaacacatatgttattctcaagagtcatgacggtacctggaagggagcactagctgtggcagcttggtgtttcatgctgcagaggtgattgttgctctgtgggccagaggtctagtgttctcaagtcgtggaaatagtgattcttcccgttgaaaacttaacacgtgctttagagaaaagagtaggagtatttaactcagagctccagcttctcaccacccctggcacatggctggcacatggtatgtcctgggtgattatttcttgagtcattggttgatgccaaagttctctactaggcaacaatccctagagattagaaaggcctaaagcaggctgtgtcctgggttgtcacctctcccctagcatgtcatagttctgaggattgtgcccatccctgaggtgttcttatgagctccttattccctaaaaactaccagacattccaagaagtttcatggatagcaggcatggcagatgattaacttcctcctgtcatttcacctaggtctgtgatctctcctgcgcaaaatgaggttcaaagaaagagaatgagaatgataatgattattgaaaagtccctcccacctctgatattctttgagctgctaagatttgaaatttcactcaatggtatcaggaggttctgctagttgagatttagtctacttcaaaccagtgacagccaagacaattctgaaatgggcactggatcttttttttttttttttttttgaaatggagtctcactctttgttgcccaggctggagtgcaatggcgcgatcttggctcactacaacctccgcctcccaggctcaagcattctcctgcctcagcctcctgagtagctgggattataggtgcacactaccacacccagctaatttttatattttttatggagatggggtttcaccatgttggccaaactggtctcgaactcctgacttcagatgatccgtccacctcagcctcccaaagtgctgggattacaggcatgagcaaccgtgctcggccagatcttttatttataacagatgccataacatttcatacaaaattccccatgattggagatattcaagtggaggcaggacaagtggctgggttgttgtgtgtgggcaagggtggctgtgtactatgggaatgggtacattagcatccaaagggtgattacaccaggcagtgtctcatgtccctcctcatgtgggagcctaccacgcaagggagaaccaggactaggttgatatgacctggcttttacaaaacccctggaggagggaaagaaatggaggcagcatgtcaaagccttgtctgagaagcattcctttctccaaagcatctgaggctctgccttacagatccccatggaccttgcattcctccatggaagcctttgttctctgtattgtgatctatttacaaataccttcctcctcagactgtgggctacttaagaacagggctgtgcttctactctttgattataatgtactctgagcaaccagcatagtggcaagagcatcatcaacatcagtcaaatgttgaaggaaagagtaaaagaatgaagaaataatcttgttcaaggttgcaaaccaccagggaagagccaatcttaaaacccaggattcccgaatctcacactatagctcttcacagtcactctgcaaatttcaaaaacaatgaaagataacatccaaactattaccctttttggtgtacacactgtctccagatttcaaggcttttgcagtagggaccagttatttaattatggtctggcctttactagtcaaaggtatgttcttgggcttcatatgttcttggacttgccaccaccgtcacccctcactgcccctgtacctcataatataacagtggcttaatataacagaggcagggctcaccacattttatatcagtgttggcttatttatggcttgagaattgcttgagatgctgaaactggccccatatgggattccaggagtagcagcagcccctccccttggggcttccgggaactacagataacttttttaatgaatcaaaataccaaagaactaaccctcccaacagttgttatccattgctcaactccctgtagagagcagcctgtggaatttgcagcattgtgatcgtgtgcaaagggcagcaccaggccctggtggtgataacaaggaggcatatttacccaacacttctcccccagggagactgtttttcctccactgcaatactgtggccctcttggctcaccctgcctggtccctgacatggctgtggaagcagatggatggaatcagagaacccgcccagacagaaggaccaaggcaccgagggagaagataatataatgtggcccttcatctcctggtgtgttcctaaagtatggatgattgccattctcaaagaatttcatgatcctgatttaaagaaacttgccaacattccaggaacccagaaaacagacagcagtcctccacagagaggcagaaaaagagacaggacgatttaaagtatcaggagcagggcctcacgggagtgagttcagattgtgcatggcaaagtcaaaacagatgatgctttagagcagtagtttccaaaccctatcacccaaagaacttgctaaagcaccgattgctggtccccaaaacagagcacctgcctcagtaactctgggtctatgtctatcaaattctcaggtgatactggtccaagagccacgccttagggggaaatggcattaatgccaactccagtaaattaggcaggataccaggaagaacttcccactgccaaggttaaacatgagaataagatcaggttactaaggacagttgtggaaatctcctgagctagagactcacgtttctgaaacggatctgaatctgttctgcttagctacaaggtaattttatctaccatggactataatcagtttcaatacaagattatggagtatctccaggattccaagcactctgctgggcactgttactggcaacaggtagcacttgcaaattgaggactggttggtttggttgtatccttgttatagatggggaaactgaggctcagagattcctgcaaggtctcacagctggcgtgaggcagagacaggactcaaactcacatctgcaatctgatcttgtcccttctagatatgaggtagggagcagaggtgcatagaacaatattttcctaaattgtacacttgagacagtgtcctacaagatataagataaaaaagaagtgattcaaaatgtcaaatggccaaataagtttgaagaaaacaaatgcaactgaagaatctgctagacttctcaggtattttaatatacttaagtgtgtagtgcatctctaagaggaggctatgtagtatttcttaaatttgaccagataatcttttatttaaaaacatctatttaaatttcaagtgacattccagttgcaaggaacacagtctggaaacatctggcatggatattaataaggcaaagaatttacacccctagcccgtgttctacttcacatacactcacacatttgggatgaatgcggagtgaatatcaggtgtgattcaaatcagattggaaaagaggattttccaagattctgcagcctttgcccagggctgaggctttaatggagagcgccaggagccccgagcagggtccagacaaagccaggtgccacagggcttggtgggcatcccctgcagcccacaatccctccagggcaggagccagaggcgtctggtcgtcatctgtgcacccccgcaggcttcctgatgtgagagacgattcccaccagaactgttagtcattccagtttctctcaatcaattattcacactcctgtttgcttgctttgagagagaggaggggggaaaacacagaaaaagccacagggcatgataaaatacaagggagaggggagaaaagaaagctggggacttttctgggctgagtatagggtagaccactagatgtgctttctaataggtcacctgcatttgtcctcttggacaaagcacacaggctgaggaggtctccttctttccctgaagcccagagaagaggaagcaggaagagggttaagagcacagccaattgcaggagtcagaaagacgcattccaggctccagcatgagcccttcatggttgtttgccttgcctgcttggataatatttgaccagctgaggggtgcagtgtagacacaaaaatcacagcccctgctgctgctgccttcaggctgtcatgcagcctactgaagtctcagtttctgccatggtaaaatgaggatggctgttcaagctcgcccggagggattcaagtgagatccaaatatgaggtccccgtggcagggacctcaaacctccaccagcctttcaccctaagcatgcacagtcaattttagtgaaaggatcaagatttttaaattgtcatgtgtagtattttgcaaatggctgctacatcatcagctcgttaataacagagagtactggcactggcatggtctgcaataattgttatcgctatcaaaatgatcagcaatgatacgctgccctttgtattcaaagacaatgctactaacacagtataacaagtgcttattttgcattgcacaattatatattgtctgagctaccaatatatttgagagagtatttgcagtatgtgtatgtgagtgcatatatatgtgtgggtgtgcatgtgtatatttatatatacatatataaacacacacaagtatatgcatacacaaatgtagttatatattatgttcatgaacttttttgcgtgtctatgtcttagtgtcttatccttatataggaatacaagttcttatgggcaacgattttcctttgtacttcttctgtatcatctttagttcaaagcagggtgcatcctttgtaggaaacccttaatacattcctgttggcagtcaggtttatcccagcagtggggaaaggctcatattgatccctccatccatgctccctctctctgaagcccactcatggcatgtgttgtgagatggccaagccaccaagcaaaccatacagcccacttgaaaaaagaccccctcgagaaaagaccccctcactgctgagttaattagctggctggctgcacacaccaggattggacatggatatttcaaagcatcttcaccctcagacttaaatgctacctaaagcattccctgggattctatttttcaaaatttattttttccaaagtaaaagtaataaatgctcattaaagaaaattaagaaaaaatgtaaataaatagaaaacaataaataaaccacacctcatcccattttccaagcacaactactgttagcattttgatggttctctttccagtttttattttattcattgtatcatgctttctaattgtctcatgctttttcactgaatgttatcacacaagaatcagttacaagattggcctttataaactaagttttcaatgactacataaatataccaaatctacctaaccattctcctataaatgagtgtatatatcaattccaatttttgatagactaaataaatgctgaaatgtgtatcttggtgattattacccttgaaacaaattagaattgattctttaaaaaattgtcaccagttcaaaggatttgactattttcaagtttcttcctaaatatttacacattgttttgcaggagtgttggaccagttagaattcccaacagccatgcttcaatgcacacagagccagtttcacatggaactcctgggacgtatttctgaacaactgtttataatgcttttcaactctttcaaagtccttgctttacccatccctatgcaggtgcacatggcctgttacaaacctctgcctccagaatatggacagtgagacacagaggggttgcctgctctcactaaatctccagctttgggactcactttcagtgcaagcacacagatgaaggttctcaagagccctcctgattcattccctcccacaggccaggaacctgtggcacaccctaaagagaattacactgttgtgtatcctccaggaactatacgaggtttagtgtggtggttcttagcaacagaacaaatctacagcactttcacttgttttcaagtaaccagattagcaccagtcgctaattttacatcttgccttcatacactcttgactacactttatttcccagtaagctagtagaaatgataggagcacatgacaccaagtgtttccacttccttcgccactcacctcctcctccccaccggctctatgggggaattatggaattgtgctggatagtggccatgcaggagacactgctcacgctttgttgtaaccatagtcttaaggaaaggagactggacaacaccaattaactttttttgggtgctctcctggaccagatgccaacagagcttttgcacatatgatcagctcatcaggcactgttggcttccttttctctttcccgcagaggctgggatggttctgagcactgagttaattacatgatgctgcagtacggtgggctccatcctctctgccctgtgtatgcacacacacctttaaacacagataagcatacacacacacacacacacacacacacacacacacacacacacacactggccaggcgacttggctgcagaagtggacagatgagcataaggttatcctaccatatatcaggcccaagagataactatattccgatgggagaatcagttagtttcactgacatatacaagtgataacaccacaagagtcaaacatgcctacactccattgtccaaaattacccatgggacgcttggggcagagaaaagagaccaactacctagccaagctaagcagagacacattctccaaagtcttttttccctaaggacttggggtggcaggacatgagctatgatgtatggctggggtcacagggaggtagatgtgtctcatctgtttccattttccaatatccaaggctgacaacacactaaataagcctacacagctctgaagtttttctcagtttgatgaacagctggagaacaggagttccagagtcactgttgctctgtgggatcggggtcccgtctgtagctcaagggtagggcagaggctggtaccaggcatctggaaaagatgaaaccttagcagacttagaccatggtgcacaagatatgcccataagcctccttattcccctcctcctttctgtttacagtaaatatgtattacagttctgaaatacagtaaatatgtattacaaaatgtattaagagcctcaatatctatggagcagaactaacaaggccacagttgaagtccaaatcctgggtcaaccaaacaactttacttttgttccctggccacggatgttacacccggccccaggcacctgactcagcaagctgtatgatggcacgtgtcttagacagcaaggggaatgatcaggacaggatgcctcacctatgtccctgaaagaacaacctcaaagccccatcttaccaagtatcactttttatccaaaggtgagcatgcaagtgcatgcgcgcacacacacgcgtgcgcatgcacacatggatgcacacacacacacacattctcagtgacaagtcctcctgtggccaaccttgcccctcactaataatttgcacaaattaaaagataaagcagcttagggtcattcaataaatcataagcacaaatcaaaatctatccactcaattaaatctgaacctagctggaatcacatcgtttttgaacgctgaagtggctaatttccgaaggatgtaagaagatcattcaacacatggttattcaatatcagccccttttctctgtgatttttaaacttaattagcatttagtaaagatggcatgatgttccatagagcagcgatctttgagggattacctccagctcagaaggggggaatataaaaccaatcagtccattgatagaggggccccgtgagctgcccagcattgaaacaagcaccagaggtgggaaatggaagaaaaagaatgagtttgaaaggaatcctgccagccctgtgtccccagagtcatccccaccagtcctggcccacagtggtccaagaacaacaaagacagcctctgcagggagaacaccgggctgtgtttgcatctctgaccactcccccagcagtctggatcctgccaaatgaccgctggtcaaacacgggcgggctccagctggtctcattcctgttatgactgcacttgggttcattaacacccagccctcccctgtgggcatgcaaggcaggaagccttctcactggcttgttttgcagcctagctttttctttctcagaagtggggcaggtggtactacattcgagtaaaatcatgcttagtggggaagggaacaggctgcccaggcttggggtggacacctctggggccacatgctcagaggctctctggctgcctctctcgttagtcagcctttcctggcatacccccggtacgttaaaccgtcgtctgaaatacccagcattctgccgtggaaagaaaacattgagctcggaaaacaggtgggatgaggatattccagggacctggctcgagagcctcagcagggatcatgttccccagggttgtccccaaagacgggacacttttgtgcacaagctgcagagcatcagaaaatcttggggactgcaaagcacatcacatgtcttataggccagagcttctcaaattgttttgaagggccattctgtaaaatttcccatctactgtagatggatacttttgtcaaatactagaagaacaaattactagaagagtgaaacttgaagctgcaaaatacaaatgcattgagtatgtgctgggatgttgcatcaatatcaagttgctgtatacatttctaaatgctcactctcaatgtctgtacctatctcagcacaggccactaacaactcgttcacagagtatatgctgaattgcgctggtctagatccttgccactcaatgtgtggttcaaggaccaagatcatcatcattacctgtgaacttgcaagaaatgcagaatctcaggctccacctcacacctattgaataagaatctgcctttgcataaaattcccaggcaatttgtatgcatgtgaaagtttgagatgtgctagaatagaccaggcttctgagctaatagattataaatgttttctttccactcaaccttcacgatgtctttgagtaaaggagatactcaacgttgaagtgccttaactaagttggagagcagagggggatgtaaaaattggcagggtctgcaggctgaaatgttttatgggagttgagtaactggcaagaatgaagaagaaaagctgagaaaactgaatagcccatctgtcgccaggtaactctatggttcagaagccaccagagaattacggcactcacttgccagatccaaaggaagcccaggagagtgagcacaaagggtgagagacatttatgaatccagtattgggaaatgggcattgcaccaggatgaagcagagagcccaaggtcagggtgctggaggagacaacttgattctgtaatggagattgtgggcggcccacgcagagacagcaggatgtttatttagatcttgtctacttagctggttgactggctgcaagtttgattatcattcaccaggtctctatgccctcagccggaaccatgttcctaatctgcttggccattaagggctctctgaaccctgctctgtctccagcatagagccagagaggctggaagctccccggggtctctttctgcacctccctcccgcggcatgtctctgcttctgtctgggactgcaggccagcttcaatcaattcccaccgaccagcagcccagatcttaattaaaacattcaacctgcacacaagtgaggagagtagtcacagccccctcagtccagctgaaaggaaatcacaaggaatatgtacagattcataagagacttctatctcagggtgcaggtggggtacagccaatccctggttcccttttcggagcactcccatacacctgtcctccctattcctgtctcacctgcactgtgactgtcacttcgatccgacttccataggagttctctccccttctgccccaaatcactaaaacacagagctggggagaccctggaaactgaggacccccaatgttaagtatcttgcccaaagtcacccagccacattgtgtccctgcctgagagtaacaagaaaatgcatgatttgtaagtcaatcattcatattagtcccagtcaccagatattccaccacgatgataattttgtacttattattgtattgtaatagtctaccctaactaacaattttggttcagaaaaaaaaaggtctccttattaatgtcttttctgtgtcctgaccatgtatttttagcaatccaactaaggggttccagctgttaaactctttgaaggataagtacgtatgaagagtttcacccaattacttctcccaggggtcctaagaggctttggggccttaagttgggactacattggcttcaagggtggataagacagaaactgtctcaacctttgggttgtagaattcagggtgggatgagctcaagcctggggctcatgccagccctcccttccaattctacaagattctaggaagcattagccttcattattctattcctcaaagcagggcttctttctggcaagtcccataacatgagaggagcctgaatcccacaagccatgactggcagctcagagcagaggcgtgtccttcacacagctctggctggaagagacaacattctcaaaagaaaagggccccactgatgaccagtgatgatgagctttttttcatatgtttgttggatgcataaatgttttcttttgagaagtatctgttcatatcctttgcccactttttgattgggttgttttttttcttgtaaatctgtgtaagttcttgtagattctggatactagccctttgtcagatggatagattgcaaatattttctcccattctgtaggttcctgttcactctgatgatagtttcctttgctgtgcagaagctctttggtttaatcagatcctatttgttgtctattttggcttttgttgccattgcttttggtgttttagtcatgaagtctttgcccatgccaatgtcctgaatggtattgcctaggttttcttctagggttttcatggttttaggtcttacatttaagtcttgaatccatcttgagttaatttttgtataaggtgtaaggaagggatctagtttcagctttctgcatatggctagccagttttcccaacaccatttattaaatggggaatcctttccctattgcttgtttttgtcaggtttgtcaaagatcagatggttgtagatgtgtggaattgtttctgaggcttctgttctgttccattggtctagatatctgttttggtactggtacgatgctgtttttgttactatagccttgtagtatagtttgaagtcaggtagtgtgatgcctccagctttgttctttctgcttaggattgtcttggctatgtgggctcttttttgattccataagaaatttgaagtagttttttttccaattctgtgaagaaagtcaatggcagcctgatcaggatagcattaaatctataacttactttgggcagtaagataccatctcacaccagttagattggtgataattaaaaagtcaggacacaacagatgccagagaggatgtggagaaataggaatgcttttacactgttggtgggagtgtaaattagttcaaccattgtgaaagacagtgtggagattcctcaaggttctagaactagaaataccatttgacccagcaatcccatcactgggtatatacccaaagtattataaataattctactataaagacacatgcatatgtatgtttactgtggcactgtccacaatagcaaagacttggaactaacccaaatgcccatcaatgatagactggacaaagaaaatgtggcccatacataccatggaatactatgcagccataaaaaaggatgagttcctatccattgcagggacatggatgatgctggaaaccatcattctcagcaaactaacacaggaacagaaaaccaaacactgcacgttctcactcctaagtgggagttgaacaatgagaacacatggacacagggagggtaacatcacacactggggcctgtcggggggtcgggggctagggaagggatagcgttaggggaaaacctaatgtagatgaccggttgatgagtgcagcaaaccaccatggcacatgtatacctatgtaacaaacctgcacgttctgcatatataccccagaacttaaagtataaaaaataaaaaataataacaataaaaaagaaaaggcccccactgaaaacacagccatcattaacttctctgtctggcaaagcaagccccaggatgtgccacatcatggcccccgcttcttctctgccccatgagtcccagcccccttctgcccaccaaccactctccttcttgtttcctgagacacacccagccccaccctgcctttcagcaggcacttgcactccttgaaagtcccaaggagcttgtacttcctcacattggttgggcatgagctgggctaaggcctttctgttctccttttgtgcttctaatgttgaaaaatgatgtctgtaataagacagtaaattctttgctggtgactcaaaagccggtaagcagagaaggcagtggatgggaaggaacgcagagggcaaactctagttacttctccccataccacagcatcacagtcttagggagtttcccttttgccccatccctttcgagtaaagcaaagggatgatggaatctagtttctgcttcccctcaatgccagttagcattagtggaaaggagagtctgtgcccagccaggaggacggaagggtaccagcagctggcaggagcaggtatgtgcacgtgtgtgcatgagtgtgtgtggccatgctgcaaggtggcatcaggtaggtgacatgggaaatgcaatgcccagcatcagtctcagggcaggagaactggggctaggggaatccacttcccttcccttactcgatctcccccatagtgactggcaaagcatgttgaagaagaagtagaaactccttgcatttgtcttctgttactggggacagcttgtgctgatatgttctaattacttctctggttcacccatgtgaactaatgggcaacctcaagggatagtgcaggatcctggggctagccaaagtaaagcacccttacaaccctttagcctgagggagcaaagaatggggatgtttattggaagctgaaaggagaatcgtgtagggcagatgactttgagaagtgatcttaggtaaaggatgcagccaaccccaggctacccagcaggggtggacagtgggttaggggggcagtgctaaaagtggggaaccagtgtgaattaatctccaacctctatcctttccatcccaccagtctcctgccggggtcctcactgtcctgttcatccagtagtcagaggccagggaggccaccgaggcagactccacaatctttggagggcacaaggctctggagcatgaataaaagattcctggaatggctgggcccggtggctcacgcttgtaatcccagcactttgggaggctgaggcaggtggatcacctgaggtcaggagtttaagaccagcctggccaacatggtgaaaccccatctctactaaaaatatgaagcattagccaggcacggtggcaggtacctgtaatgcaagctacttgggaggctgaggcaggagaatcactcgaccctgggaggcagaggttgcagtgagctgagatcacaccattgcactccagcctgggcaacaagagtgaaacttggtctcaaaaaaaaaaaagaaaagattcctggaagaagcacacattggtgtgcatgggaattactcattgatatttctgtcctactagaacataagttcctggagggcagcatctatgtgccaagggcatgatgggccctcgataaatatttattacattaacaagagtatatatgaagaaatgaaggaatggaagggcatcatggagggaacaaagctaactaaccttcttgtagtctgtaaatgtgcacctgctatcaggaggccccagcctgtctttcagactcactctctgaaaagtgcggacactgtttctcccaatctgtcctcacaatctttccagggctgccactccctgagtttcccaggtctcctgggttcacagtcatgatactccaagctggcaggaggctcacccctggcaggtgatgctccaggcaggtagccgagtgccccagaggctctggcagtcactgtctggcctcagtgctcttctacagtgaggtgtggcgcagagctgagcatcgcgcattgctgtatgccctgtttcacagttactgtggcaacagccaggcttcagcctcgcctaggttgtcctggggaggatgggccgctgttggaggctacagcaatcctgtgagccacagccatcctggtcattgtgcaggtccaggcatctcaaaccagggagtagacacagacactggagtcctgctgagccccaggctggccaggagacaaaacaggcgtgatcattcacaaaacccaggagccctaggagatgccgcctccctgtgtccatctgagcacccaggccctgcagcagaggacctcctccggttggcacgaaggcgcttcacagcttcctctgcagccacgccttaccccatcccaccctaccccatgccccagccaaataaaactattacagttttattataccaattgtcagtttcctcctccgaattttctcatgctgttcctcatccttttcgctggaaatgttcacttatcctccaaggcctagctcatgcttaccttctctatcagcaacattgacccccaacacccccccccaccaccaccaccactgaccccagccccacccacccaagaagactctcccactccccattctaggctcctacagagggtgataaatcccactcccctgccagactgtgtctctcatctgattatcagcccagcacctaaggcagtgaatgggtaccttgatcatggtaccctcaagaacccatgatccagagaggctgtattggctttaacctgggtgtcaaactaaggagtcaagagcaaacagccccacatatgaacctggatttgggcatggctgattatcatgggagcacccttcctcccaacaagctcatcactcaagtcctacttttgttagctaaacattcattcattcattcatctgagaaatatttagtaagcatgacactacacaacactgtgctaagcactgagaatgcagagtgcagcaagacatagtcccggctctctagaaactcctaggctaggaggagagacaaaagagtaagtagacatggcaagggaagtggagaggatggtgggaatccacagaagaggcccctgattccatgtaagagagaaactggacatttagaggcttgaagttcagcctggatgaaactagcagagcggggcggcaccaggacactaagccatcttcagaccatggcagcagagcccaggcttgactcagaagcggggctgtgtaacaatccaggcttttctgccaacttacgacaagacttattagagattccaggcacagtggtattgagacacagaccactaatttgcaccccaccctctttttttttttttttttcgtattaactggcatctctgcctgaccttccccaatcctctgacagcctgggagtttgcctggctagcagccatccagatttctttttttctccaagccctggccaagacccaggatacatgggagagggggaagggaacagtttgtgctcatgcaaagcttgctcttgcatacagcccctgggccgggatggagccgagtttcctctgaagcggggcccagccagtagagctgcctctgtcctaccccctcgagacacccaagccgatttggtgcagatggcaccagcagatgccagtccctaggagggtccctcctccctagctaatgaggggagcaggtgaagggaccagagaatgtgatcaggagtgagaagtgaaacaaacactagattaagagttaggaacctgggttctagtcccagctctgccacaaataggctatatgactttgggcaagtcacttcacctctctgaccctaggtgtccctgttgtctgagtctgtgattctagctgtcagaagtgcaaatactgctttaaaagaaaggaaaactgggttttcacttctgctctgttgttaacctactgtgtgatgttgggtaaattccttcacctctctgggctaagattagccatcttttagaagtcacatcgcacgcaacatgcaattaaaactgagttaatgtgaggccagggccatgaatgacccaggaagaaatcatgagaatctatgaagaacctttccccactttttcccactgtccttgccctgggattctagtcatgaggaagctgctggtccacccactgcatgtgcagtcctgctctgagctcctgcccttcctcccgcactaaaaaaatctctctgcttcgccagaattctctgaggccatctgtggctctgatccaccagtcaggtgagccgtgggaccagccctggggattctcagccttcagggatcctgggcctcatcacatgcagatgtagtcctgcctttccggggcaggtgtggctgcacactccagcgaaagtgaagctgcatctctctgcagccttacagcaaatgggtagccaccacagctgctgataaacagctaggggagccattggccaaataacccacttttcacacctggaaataatgggggaaacactcaattaggcattcaggtgtaggtctggactggagtggaagtcacagcctgccctccaggctcctagaaatcactggtttgaggctgttgcaggatgacaggaccatgggttttatgggggctagttggcatggctgaggacaaggggctggctggtgaccattcaggcagaaaggaagatgaggagtggggacaagatgaataagcactttctttagagtctgaggccctgtgagaggaagaaatcaatggaaaccttgggagggaccccagagagagtcctgctgagagagggtgtcggccagataaatttgatgatgcagcactgagtgggggcacaaagtcctatttgaagtattgcaggcaggctggcacgtgcgtcccacctgtgcatctcatgtctggccatgtggcccctgacatgctgctgggcagaaccagggggaagcagcagccagttaaaccctggcacccatgcaggcagcctctgataggcaaacagcctggaagctgggagcctcaattagcctcttggagagaggggagagtattacttgattttctttgccgcccagaaaaagcaagaagtccagatgcaagtgcaatccatgaccacttgctctagaaggaatgaccaggatccccatggccgggaaacaaatgatgaagccagttagcagcctgattccaaattagagtttctcccattatacctatgcctgtacacatgttcaagacacagaaagctttcactgtttgggggtattttgttttctcacaaaatatgggcaactggtatcccaagagctgccatagtttggtgagatataaatttctggtcctttaagcctcactggagatagacagtgatgttgcctggggacttcctgggacacacagctgaacaaaagtaggggtaaggcaaatgtaccctagagatgaggagctgtggtcaaagtgatcacatcaagagaaagccttcagccagccccctgggatatccccacaatggatgggcagaaaggactctggagactcagtacagatactgaagagtatgccatgctttgaaaattggggagttcataaagggaatggggagagctgcaggttccctaggtatctatggaagtttcggaaagagatgaagaatagccaacacatatgtagcactcatataaattaactctaattttcacaacagcactgtaagataagcactatttttatccacacttgatagataaggaagctaagccacagagaggttaagtagcatgtccaaggtcgaacaactgattagtggcagggctggacttgggttttgggttttttattttttttgtttgtttttgagacagtcaacccctatcaccaagtatggagtgcagtggcacaatctcagtttgctacaacctccgcctcccaggttcaagcaattctcatgcctcagcctcctgagtagctgggattacaggtgtgtgcaaccatggccgactaattttttgtatttttggtagaggacggggcttcaccatgagatgaggctggtttcaaactcttggcctcaagtgatccacctgcctcagtctcccagtgtgctgggattacaggtgtgagccaccgcgcctggccagcagggccagactttgaacctcaggaggcttctcccaaagcctgtgcactcttaaccacggtgcagtgcaccctctccagagtgaagcaggatgctcgtttctttagggaaagaccctgccttggtgtgggaaatagagcctccaggggcggccctgccccacacctgcctggggcctagggaaatcctgccccaagatccagacccagacacctgccactctgacagctggcacagggatgggggctggggacatcacaccacccgcattctctgcagggatacccagccatccattttaggctaaaagccttctccgcatctcagccttccccaaaattttacaaatactagaagataaaagcgcaggaaccagcatgaatgaagttggtttttaagagacagtgtttaacatcaagatccttctgatgtgagtaatttggattctgatgcaattctggattgtttgttgaattatgcatcagcagcttctgttgctgtaaaaagcaccaccgtcactcgagctaatctgaaacctgcagcaatgaagacagttgggttcacagtttggatactgagatgcgtctttgatgatagtgaaccagcagaaggagagaaacagacacaagggcaagtggagagcaggtagtaggaagaattgggggaatgaggtaggattaggtgctttatttaccacacactcatgagagccccatgctgggagaaagaaaagacccaaagaggtgagcagatatcagcttcccccaaatccaggaaattccacaggatacagaaagacaagaacagagagaaccagggattcattctggcaaaggatgaagcagctcctagactgtcaaatgcccactgtctctaccacctgaaatatgatgctctccttcaagctcttgacctatgctgggggccttcctactgggccaaaggccatcatggtcatcattattaattattttctcagtgttttaatatgtatttcaggttgatatccttatttaaaagcaatagctaaggacagtatgcctatttgacgaagggcacaggggagaaaggtgatatacctaaagtcacacagctgcttagcaaccggaaggaaattggaattccagtctcctgactgccagtcaccttctcttccatcaccccaggctttgccatctcactatggaggctcccaggatctctgacaacccatcagacccactgcttaggctgggaatgccaagtcccatgcctggagcagtagaaagcaaaggcaccaaagccccaagctaagccacctagtccaaagccacgctgtgcctctagcatggtgtgtccctgagcaagttatggaacccttggtgtctcagtttccttatctgccatagacgcctgataatagttcttgcttcatggaatgagatgatccatttgaaacctttggatcaatgctaagcagaaaataaatataacctgccattttcattattgatattctcctgtgaaactgttgtgacttcagaggactgatcccaaagcctgccaggaagaccctgctgagtgtcccgctctcctgaatagcccatgtcctcactatcacaggttctattcgtgtcgcaacaaggaaccacacatccaaggcagccaagccaggagggccctgggtgtgcgggagtcagctctgtggagatgccgtccatgcccggtctgacgggaaccccagctctgcgtttctccttttcatgaagccagtgagccaaaaccaccctcctgggctggcccagtttaagagcctgggctccagggacgcagggaggcccctcagcccaattataaatcaatctagcagcactcactgaggccattgccataaatggctctaaaagctcagcctctttcggcccaataggctcagggctccaggattaatgagcatcagctgccggcaggctggtggggacagatgccgacctaatgagcacagtggcccagccctcgccagctcgaggtggacagggctgatgagcaggtgtcattgtcatgatgcccctttgccaagtgtcactttgaaagggagggctgttgtcatcaagtggcatcttattaccccacctcaggacacccacaggagattctaaaggctgtccacaaagatggcctttgtggctgccacctccactcctcagctggccctggcaccaggtttttctcaaggcctctcaaccacagggctggataagggttttagaatcctgggcatcccctcccatcccatgccatctgattggtgctgcattaaagtacagaggtccctgctagaatttccctcagtcacgtctctattacacccacgggcttcaagtttgcctggagtatttacacacagttctgcagattcaaatggattcaaatgggcgcaagggctcagcatcacactggtcaccaaagggacacaacccagtccctgcaagacatatcagcttgtatgtcagtcaaagacacaggccttagagggactgatcataagcataaaacatagcaacaacaaaaatagtcatgatcacttcttcagcatttattttgtgccaagcactgttccacgctctttatatgtgctggcttatttagtaaatgtgaatgaaagactctgaataataagagtcacgttatattaaggcagtcaatgcaggtgaaacaaaaaaaggaaagatcacttcggctgactggagaaatcaagagaggcttcatgggggaggcgggaccacactggtcctagtgcagtctgggaagagtgttccagaagcagaagcaggcacacctgggcagggctacagtgagtttgctgaaggtcacacatctgtgctttggagggcagagctgcagggccacaggtatattcaatgtagtgggttctggcatctgaaaatgttgttaggatgaaatttcaaaatcaggttttattcctgatgaaagtagactgctcttaactggggcttcactgcttcttttccatttctgtttggagtgtgatttttttaaggtaagatgtacacgcaatgaaatgtgcagatcttcagtgcacactttgatgagtttttgacaaatgccttcacctgtgtaactaacaatccaatcgagatctagaatactttcatgggcatgaaaggggaggaatgtgacctttgtgatcagatggtcccatacctacatcttctgggcatttgtaagttggaataaatcaaaataatcaacttcctcccttaccccacgccagtccacctcctacccccggagaaaaaataaaataaaattcatccacatctaaacagacaaatgcctacctagtctgtctgtgtatttgttacctttgtgccccagaaccaagcttcataccaggcacagagtgaatgatccatacgtgtttcttaaaaaaaggaattaacatcctcagattaaggtctcccaggaagtaaaggactccactttctctaagttcccatgtgacactgacaattatattttcctgtcctctctgttgagattaggaaggagtccctaggaggatgcagaagagtatccttttgtcctgtctcctacctgtcacccagactcttgtgttctctacagccagtccatcttaggcctcaaattccatatgtttgacaaaatcaagcaggtagttcaaggtgctcgtctctcctcccagctattcagcagacaaaatctgtgacataatgtaccccagcctcagacacgctcacccttctttcccaggccctgtgtgaatgggccaggccactccttgatagttttcaggcaaaacacatgagaacactcccaggaaagagaagcctccaggggtaccatccgtatgcataccacgcatttacttcctagcctcaccagcgttttgggtgtggccacagctactccccaaacctttcatcttgcaagtccctagatgtcctcctcgggaaagctccctgcgcacagcttgtgggagactgcaggctcataaacagcataagccagcattccaatcagattatttctcacttgcaatattgcacaaagagaaaaaaataatgctgaacattctgttcgtggaagaaaaaatagcaggagaaaactgtcacattgtttggtctattttcaatttcattcccgagccctgcaaatagctatctgtgcaagcaggccagaagaggactccagcgacctgacatgcacgatctcagatcaggtctctagggcctgtgaaaaagggagagacctttggctggcacatatctacacatgtgataaaattgcacaagactaaatacacactcgccaatgcaaaaaactggtgaaatctgaatggataagcttggtgggttgtaccagtcaattttccatttgtgatattgtactatagttatgcaaaatgatgccacgtggaggggagaactgagtgaagggtacaggaacccctctgtacaatttattgcaattgcatgcaaattcacgattatctcaaaaggcaaagttaaaaaaatgcgcttccagtgtctgatttaatgggactaggttgcagcctgagcatcagagttttaaaagctccctaggtggttctaatgtgaagcccaggctgagaacctttgctcatgaaggttgggaaggtgagacacacacatgaaatccagaaacaatcagcatgtgatacagtaccaaaagcttcatgaatacttgtggagcaaatcagtgaactgctgaacagacgcataaggttagaggaagtccggtaggatgagggaagacttcatggtgaagtggaacttaatcaggacggggcataagtggagaattcagaggacgggaaagggccctctaagccaataaagaagggctcagagattgtgtggccatactggggaggaggggaagaactgaacttggggacagctgaggagtgaagatggataaaacttttcataataaactggctctatccctgtgcttagacgagtggatctttcaaacacctgaaccagctctaagtccctgcaaattgccaagagcaattttcagcaaaaagccaattccccagaaggcacttggcatctctcagataagcaaaagagggggaggctggagaggcttcagaatatagtatcgatgggtataaaagtaagcagtccttgtcatggttcatgtcactttgcctgactgcacttcagctggccttagattccccagtcgagagcccagccaggtgctagaaaataccagaaatgacccgggaaagggtaaaatggaaatctcaagcctacataccaaagcgaatgcacttgactcagcaggtccctagagtaatcatgcaacacctctttattcttattttatacacaagtctaataagcttgagtatctgtttccaagcccgtagcaaattaaaaagaacaaattaagtggcagcaggagagctgcatcagacaggatcagtgacaacagtgagaagtgacaggtgccagacaccctgacggtaggcggggagacagaaagctataaaaagtaacttggggcactcacctaacatgaggaagccaccctagcgaggcacaggggctccattgtaaaggtggagaaagagctttaagatactcaagtccaagttctaaatgccttggagaacatctctttgccttttcctgttattaattagtccaacatacacacaggggagaggggcagtgtgctgctgcaggctgccactatgggaggggcagctggctaatcatcttattgcaggaaataccccctgccaaaaacacagctcccctctcaaagcctgctttctcaccttgtagcactggccactgccatcacagggtatgcagagcaaaggacaggctgctcccgagccgctcagtccatcggatcaatcaggtttaacaaggaggcatccgaggatcaggagaaacacctcctacattattaccacagcaccatcactttgcatgagacaggtctggctgggaacgccacctccagcatggacagaaactgcgtgtccttgacccagttgtttcatttcttgtgctgagcacgcccacccattgacccccaatccagagagctagtgttgaagagctcattaacaaaacacaaaacactcagctgacgcaccgccaccatgcaaatgcgtaataactggatctctcttcccccacagctaacctcaagcatctcttcttggccagctgcattgccttggctctctgtgtggttcagagccagagagggcaggctgggcagccacttccatgccaacatcccaggaggcagtgcttggagcaggaagatgagagaagatgatctctcccactacacagagcccaggtcccggccccagactcagaggccctgacgcctgctatgcctggtccacaaaagcagcagggaagggcatggatgctggcaatgcactgccccctcaggagccagcactcaatcatgttctctctaaagaatgccagtgtcccattttcatccaaatgtgaaagttgaaaaagagaagtcaggcaagggagagaggcttttaagatttcccctactcaggggaggagctggcagcgtgagcctaaaaccaggcaggcaggtaacgggagggggccctaattgctgctaaagatcacggggtaaccctgatgacacctgaaagtcttccgtggatcctcaggcacaaaacataaatcatctccctctcacttcttactgatcgcgtttgcttgctgtgtcagctgaattcccaaattggcctgggtttaaattgggacttttttttcccttcctggcctggcttttcctccactctctctctccaacctcctcccaccccatgggaagtgatgacagaggaatctgcctgcggactccaaaatgcaggtttgtggcttcactttgtggggtgggagggaagaggcagagagcagggaagagggcatttgggggcttacttcggggacaggacctgagggatcaggagggagaaagtggccatctggacccacttgccgacttttggtgtcctgtcctccttccaagtaaaccccttctcagtccccagggcagccaggagagtctgcaacagacatgctccattcagtaggggcgggactcaggaagtgcaacagggaaggtcagagccggataacgggtctgtagttggccctgctgttctggggagcagatattcacctgggctctgtggtgggccaggagacaaggctttctttctttcacttcttttgtttccacgggtccccaagcacctccataacacaggatgggtcagagcccattgaggaattaacccagaggccttgaccctaaatagctccatgagaaggctgaaccttactaaccctccaggaggctgatgtgaggctacacacaatgccaccagctctgatgggcccgcccaacacaactccaggaaatgtcccaagaaagctttccaaagaccccttttcctagactatgggggactccccccagtgacttcatcactcaaaccacaaccaaaacgatatgcagcccccttagcctttgtgaggcagaggagaaggctggtgcgcagcctccaccactgtcaccaaccagccctcacaggcccagagccagggggcagtgggcaggtggcctcccactgggtggcagaacaggatggccacacaaccaacacggcttgctggtgtcacagtgtccctgttacatggacctggcagtgcaccaggtgacatggaggccacacactacagggtagtgattaagaatggactcccaagtaagactgcttgattggcatcctaatgagcaatatgatcatgttatttaactttcccatgttttgtcccctgttaaagggggtgatagtaacagcgccacctcataggggtatagagattgagataattcatgtaaagttcttagaacagtgccaagctggtgtaggttgtgattattattctgatgcctactactactattattatccctgtggcccaggagaccagaaggtatagagggtggaaagacgaagcttcagggggagtactgcacagggtggggtactactgccttcctgtcaccccagtgttcccactggcttccccagggctggtcctccttgttgtgaaggatctgagtctgacgttctactttaaaataacatcaaggggatccattgtttcagcaaaataataagagagggcagctgagggtatgtgtgtgtgtgtatgtgtgtgtgtgtgtgtgtgcatgtatgcatgtgtgtgtgtgttggacacattctcttctgagggatgtatgttttctactccatagctctcagaagcagtttgctgaaacatggtactcccagcttggctgaaatcgggaggcagggcagtggagcctgggccttggtgattaaaagtctgggtttgaaatgggctaccgcaatgccgagttttgggttccttgtacactgatgaggcaggactaggctgtgcctacagctgctcttacttaggaaatcctaggaactgtgattccatacctgctacattggactcaccacgagatgctgagccagccatccccttttctctctgatctcactcttccttggttcaacttccctggtcttcaagaaaaacagtcagaggagcaggggccacaggaaatggagagtcctggttactgccagccttggaaagatgggtgacagctctcggtcctcccaggggaggaggtgtcggcttagcaggcctcctcaatctggagcccaggctgcaaagccagggacgctgggctgagtggatgccccacaggtcccacagcccatcacttgcagagccaggtggtatttctggttttcactacacatacccatgtggcacaaaacatacattgtgaggatgtgcagagagcatctggattccttagacttcaggttccccatcctttagggcagttttaaaaattgtttcgctggaggcctacccaggaaatcttactcacattgaaaaccaggatgaaacccaggaaaacaagtcttccccttgctacctgtaatgcactcagatatttttctttcttactctattccatttaaaagaaggttggccacagcccactacattgacttaaagccatacgatgagtttgtggccccctggcttggaaagcaccatttgagcagcagggcagtgacaatgactcaatgtggcctcagtgcaggcagaaatcccattttgcaaagggacagactgcctgacaaagtcagagtccaagtgtctccaggcttacactgcagggttaaaagaacttttcagatccatgaacctcttcacagagaaggatttctgcatccttccaatgactaattctcagcccagacagaagttggctcatttgaaagggatagcatgccctcctgccacacaatggtctgagtattttttccgtggcccataaatgaagctgacattagataagtcactcacgcacttcaagaacttcttcaaaattggagtcagttactcagctactccaattgtggcttatttcctcacttctgagatttttaggaattgagtaaactagagcgcgttctaactcacctgttgttcacctttaactctcccatctttggatgctatgggaaacccaggagcctcctgaccacatgaatgaaaagaatagggcttctcctttggcctcctagcttcagagcatctgctccctcctagccaagtatcacttacttaggcatatctgatttttatcatgtctcaaatttataaaaccaaaaaaaaagaaaagaaaaggtccagggtttacctcatccagccttctgtttcacaggttaaaagagcatgacccaggggcatttacgactcacctggaaccacacaggttgttaagagtgagggctagaatttgggtgacctgtctcccaggagccacgcaacctctctgtgaatgaaggtaagaagggccaagttcaaatctcgaatgtccttgtgcttccccaactctgcatttgcagagaaggttgagtgggcaccgagagaatcaaaatagagtaggtgttcattttgaggggaaaactcaactttctaggcctcatttaccccttttctaatgataaggaaaacaagcccaaacgggatttccactttcataagaacccttcatctcccaagtcctcatctgccttatggagtctgggatagaagggcattctagtaatagctacactgatggccctgactgatgcacctgcaaagacagatattgacgctctcatttattctggtagtcctgcctgacagactgccctaaaatgagcaggagctcattatctcagctggccttctccttaagcaaggcggaaatggcccaaccctttctgggacaccccacccctgggactcggaggccctctgaacagcagggatgagatggactgatgtggatcatcatagtagccaaatgaggccctctggtgattttcacagagaggtgtgtggcacccattttctagtgtgagaagtttctagtgtgagaagtgtgtttttgagtccattgatccggcactctggatttcctccagggatgtagatgcatcctacatgcatgcacacatgcacatgcacacaaacatgcacatacaccaacacacaaatacacacatgcacacacacttgcacacacacatgtgcacacaaattggctgctcaggtcctgcatcccagcatgccccctggaaaccaacctactttgttttatttttattcctgggactacgtcaatacatctctcctggtgtggagggtgggcatcagtttgaggggcttgtcctagtcagttgggctaaatggggccaattcttttgctttccagggtggatgcagggctttgttgaattgtgaagaatgttaaatgaaactgtttattcatatcacaatctctgctatgccacagaacatgaacttagaacacacagattttatacatcggaaacaagaaatgtctaccacattagcaaagacttaataaaatttcatagctttctagtgggaacataaattggaacaatacttttggaaaacaatttagtaacagatagccaatctttaatgtgttcataccctctggcctagaaataccgcttctgggactctagccaaaggaaatagtctgaaatacagggatttaaaaaaaaaaagacctttatgcacaataattttcatatcagcattatttataatttaaaaatgagaactaacttaaatataaaacagtaggagagtgggtaagtaaactacaatgtatttgcataatagaatattaagcagatgtttaaaattatatttatgaagagtttacaaaaagtggggaagttagttgagttacaaggttcactgaataggcaggaaaaaatgagacatagagtataatcttatctatggaaaatgattaacataaaacatcgaaaggaaatattaatgatagctgcaggcggtggcattctgggggtgcagtttttacatttcttatagatttctaaatgttttaaataaacaagtatttttcaattcttttttagctttgaacacaaaaacactttatttatttatttatttatttatttatttttgagagagagtctcactctgtcacccaggctggagtgcagtggtgcaatcttggctcactgcaaactctaccacccgggttcaagtgattcttctgcctcagcctcatgagtagctgggactacaggcacgtgccaccacatctggctaatttttttctatttttagtagagatggggtttcgccatgctggccaggctggtctcgaactcctgacctcaagtgatccaccagcctcaaactcccaaagtgctgggattacaagcatgagccactgcacctggctaaaaacacattatttataaaaggaggtccagtcacatctctcccattacctctgcagatgactgcagagaagtgccctctctgcctgcctccctcccgccccccaccccatgtcatcttctctaagaggaatgcgttggatcacatgatctctaaaacccactctgctctcacattctgtgtcttgaaatatcatccccctgtgtttgagactgagaatgggatctcaaaaaggggtccaagcagcgaaactatgctacaagtaaaacactgtaatcatcctaacaagacatggacttggatggtcttctagaagatgcagctgttcttttacagtcttcagagaaaaatgctgacttgatgtccttgggattgaacatctggagccaaacatccaaattaatggggtcgcgggcagctgccctgtgaagccagaaatccaggttagggaggtgggggctcagctctgtgcctccatccaggccctagctggagctgaccttccagggtactgcagtagatggcttggtggcccacacaggcacagcaggacagatcccatgtcctataaccccctatggcagctccagccccgagacgtcttcccttgaccaaactccatgggattctttttgtccgttatgagcatggggcaccttcttacaaatcatctgatggtctcatggtttccagttccatttcctcaaggacattgtctgtcaccccttgaaagtctgtccctccttcgatcatcccagagtggttgagtggttcacaggggaggggaaatgagaatccacacattgaaccagctccccaccctggatgagggggttaattggatttttcactctttcaaggtggaattccatgatttgataattacatgggactgtatctctcccctggactttggccatctttcccaccgttcagagaaaatacgacttgtttctagacctgatattcatccagcatgcaccaggatggatggaagataaaatactgaaatgtttccacactggttggtaaattaccgtcacctgcggatacctcccctgtagtcccaacaggctggctcgtcctccgggagatcccccagtgacctccctaagatgtgtcacctaaagggttaatgcctggcccggcagggggcccccagactcttcacccagcattaagtctttgtgcccttgaagtttaaatattttgaatctcacctctccctgctccctctttggaattgagtcccttgggttgagagaagctgactgtagttgcctgggataaccacgatggctgaaatgtaataaggaggaatttaggcttggatcctcacactctccctcctgcttctaggggtgaaagttgggggatggcaacagttttgggcaaacaggtaggaaagggaaactgtgcccacctccccgtgcccccctcccccagcccatgctattctcagcattcacagttcctctttacagacaggactgagaccctctgagccagcactgtagaatcccagaagcagcacagtgccttccatctgagcttctgaagtacatttcacacatagcaccttcagaaggaacaggaaggagagacacttttcctgacttcgcccatgaggagaaggaagcacagagatgtgaagctgccttgtcactcgcacagctgagacagacccaagcctagccttcccccctccacagggataaccgttagaactgccaactctgtcccaacgggcagtgaggagatctgacaggattacgtcatgtgctctgtaactgggagacacatttatgagctgacaaccagagaggctggtgtcatagaggaaggagggttaccaagtgctgccttttgataataaaggtttcgtctgtctaggctgcctgtctccaagcactctggccaaaaacagacatgcaatcactcccctccccaaggcgctggtggggaagactgctatcgtttatgcttttactcatctccatcaggaggtgtggaaggtgccacaaacctgcctcgactccagctagttccccttctgacggtgcacccacccatctgtccattccccacagcaggctagcatccattctaggtggaaactccactggaagcccaaacctcagacgtgagccccaggagataccagcctgtacagcaagccccagtcctcagtagcatcttttagaaaaagttctggtgctttggccatcatcccgattacgtttgcccatgacatgatccggctgtcatggaataaagaaacatgagggtttcaatgcaaggaatgtttagaaatagagaacgaaaagaatgtgcttgatctcatgttttcactttaatgtattcagagctggcagagaaagggggacatttaacttctaattaatgagttgctccatgtgtccaaacaactctcccatctcttccctcactgcagatgaaagcccaagttctcttggagctgggtgattctctgtgcaggttacatttccccagactctgaacgggtatcttccaccaatcagattgggctctggcacctcgccacctgttcgggcttcaccctggaatccctcatcagcagccacttctgatgcgtaattgacaagaccatagctgatgaagggtatgttacgggcttggctctcaccatcaaatctattttcagttgaaactgctttgaatttactgacaccaaagagcccagaaggtaagaatgggctgtcattgccattgttacgattgtggctgtttttggaaacctgggtcttttcaacttatcacaaggcttcagctaggccctgatttcaacttctgccaccatctgagcacgagccttctgagtccaaattccctgtatatgttgatatcatctcagtaaacattgaggaacaaaggacatgaagaaatgagtgtcagtccgtgtgagggagaagaaaaggcccagaaattctggcatccccagttcaaattccactcttcaccaacttcaccttgcatttccacaccacagacttcccaggagcttggtctctcattcacatcgatatttatgcttggaatgtgaaggatcccaaattctacgtccaatcacatgttcacatccctgaatgctctgaccaccccagacatttctgaaatggcttagctcctgcctgcccctccaaacttgaccaatgccctctgcctcccttcatgaaggtctgtccacagggagcctttctcaggccctcaaaggtgccgagtttgttctccacttcacaacccccaggtaggactgtgtcctcgacttagaacactcttcccctcacctcagctcctcacattctttaggtctcagagcaaacattccagccttccattctgagtagacccccaaaacttgattatcctctatttcaaaaccctacttatttatttcaaagccctgataactgtttattattttatttatttgtttggtttttggcatatctccccctccagacctcagctccatctgttgaatgaatgaatgaagttgctagatgaaatggtatgcctactatgctccaagcatgcttcccatgctgacgatacaacagtcaagaagtcaggtgcattgccctcatggagccgatcaccttgcagacagcgacctgcaggaaactgaaatcataggagacttgggcaaagacgaagggagcaggaaagaggcagaaggaagggaacagcatctcgtgagctgacaacgaaatcctgtataaatatcacacaaaaatctattagtgttaccagcatagagggcaattgctttttaatataataagatcttccttggaggcgattatgaggcagtgataaggatcaggtgacatgttgaggtttggcacagatggattaatttctgtttacatctagttgttggcagcatgggggagttcttcgttttcagggaggaggtgggaaagaggacctctggggaaagcagccaagacacaattcttgtaggtgttattccagagagctcactgcttgctgtggatcccagagtgaactggagagaaaaccagggcctggagcaccggggagggacctccatgcaggacacgctggccaagctttggagggacgacccctctcctttcctcctaaaccttggggtgccatgacagaggtaaactattgctgatgtggagggattagtgactaggaaacaaagatctgaggtctttagaaacaaagtcacttgatagatggggggtggagagagaaggaaggaggaaaatggaaaagaaggcatgctgttcttatacagttcattcccgacactgtctcaagcattaacactctcattactagatactattcttccctgagtgttacacagaggtaaactgaggcctgggcaagtccaggacagacccaatcgtactggaacagagtctgcctccggactcgctgcacaggcacacagcaaagcctggaagcaactctgaagatttcctcgatggggtctttccttccttccctggagcagcccaggggtttgcttcactggctgggcctcctgtctccagtaactcctggagtgaacaccaaagtcccccagcatcaagacaggggcacacaaccaggacaactctgaccctggagccagggggctgtttattccaccatgtggctgctttttccaacatgtgacagatgtcacgattattctgccaccaaagaggcaccctctgccactcccctaaagcaccaaccccaacagacatggcctcaacctaaacccaactcagagcaaaacacaatggaaaacacacctaagcaattcaatggtgccttacaaatggagttactccacggttctggttgcctgaaactgctggtttatgtgtgtggcccaggcaaaatattagcaatgccctcttttactttttaaaactcttccagtttggaaaataaattccagggtcttcctacttgtgatgtacctggaaacccatatattatggaatctacatagagatgatgctattttagagtatatacacccatgaccactatacactcctcactcccaaccccatatcaaccatccagtaaacaaaactctcaacaccccattcacaacatgtagccatcaagctgtgctcacaaaaaaaggtatgcactccgccaccagtcatactcttacactgctagtcactacacaagtctcccaatcatggcagatagagctatctctcttccactattcgggcctagacacgactacacatatctcataatttgggggagcactgggacatatgcacccacttggacatccatccaaatcagccttcagggattttaaatggaaaagccccggttgctgtaatggctacaaccttgtaaggacatgagtccaagttcattaagaagctgggtacagatgaaccctgttgctgttgtgattaataatcataatagacagtcagctggagggcttgccagctgtgccttccaggtcctggttctgggatcccctctcatccaccagtgagtaatggtttggtttattggaaactctcttttcattttttatggcttcaattaagcgatggggagaatccatcatgtaacctttttgctgcactgctaaagacttccggaggggaaaatatttatcaaaccccaaaccatcagaggagagactgcggtaaacctaacaggagactggggtggcagagaggtgaccgagatggtagggaggggagaaaaaaatatccacacagaggtttgatgcttggacaagagccatactctctgtaaaatatctgcttatttcacaaatatcaggctactcctcacctcacatcccataaccacagaaagtactccactgattatgagggtggctaattaatcagcccccagtccccagtcatgtggattcctatagcccaacaggttcaaggtggcaagaagaacagagacactggcaagaggcgtacgtatcatgagaggcataggatgtgctatgagttccatggaaacatggcacccacacgaaaacctcccacacacctcatggaacccgcaatccctatattgataagaatgccaaaggatccatttcctagttgtaactacaaattctttccaacgccaaggacaacaaatcctctcccaaatcaatccattggaatccacaacctcctatccttggccctacacaggcccctaccctttccccgacctctaccaggcagccctgctggtaagcagagccgtctcttattctgcccttcaaagtattcacaccctaatcttggccactggcattaatctttcatttgctatttagacatctgattcctggggcaggattgagagatgtcccttgggagatcaagttggccagaggggaggtccgaagggagttggcggcctgcagagcaacaagggcctgcctggaattaatggggtcatcgccctgctccccatcgcccaaaggaggaggagccacagccagaagacacagatgtctgaagaaatgagattgcaggtctgtctgctttataagacgtgtgtgtgtgcacgggtatgttcacatgtatgtgtgtgcgagaccagggatatggcctctcagcttgtgtcagtgtagctgctgttaggagatttgtatctgctctggtgcagggaacagaggtatcaggagagctgggcaaacagataagactcaaataaaaatgatacacatgtgggccctgggagacggtattgtctccatatgctaactagtaatactacaggttagatagtcagcctgcaaaacataactctaataggagatagatggtggaaatacacttccctttctccctctttctcctcctcactctcagctaacctttatcaacacaaagttccagggactgtgccaagtgttctttattaattattttcatcaatacagcaaacccacaaggtaggactatcagtacctgtattttacaggtgaggaaactgaggtctggataggttaagtaaactgcccaaggttctgcagctagtaagtggtcaaggagaattccagccaaagaagtttcactacagataccaaatttaaccaatgatttaggaagaaatgaacagataagtttgatatagactagagagcactggggaaagaatagattatagctatgctgtctgataaccagctactcgtggttctttaaaattaaattaaatttaagttaggtaaaatttaaaatctagttccttagtcatactagccacatttcaagtgctcagtagtcccatgtggctggtggccaccagaatgactagtgcagatatgaatattgccatttttactgaaaattcactaggtaacactggttagaggataaggctagatgatggcaaatagaaacacttttcaggataaccagctggaggaaggatggcattaacatgtgagttcttcccatctagaaaggacaagaaaagggtgaagagcaaagaggagaacctagggcagcatgacatggatcaattggttgctgttattaacaagtgagacttcaagaaatgccacagaaggaaggggccttggagattagcatattcaacctcttttcatacattacaataaggccagtgacaactggggaggccaatggcccaggtcacatagccagttatgtcgaaggctcttcccatcccacccagcctgtcattctgggtttttcccatcatcctcatccttgatcccttctgagatgtgcacagaaaatatcagagtactcagaggtgatttccaacacgtcttcacactattatgactcctgacaggtaaatcactagctgtattgctgcatcttcctttcttataatggcacagggctgtccaagaatgagacattgaacatttgtaaaatagcagcaattgaaaagataaatggcaaacctggagtttgggaagcagcccagtaggactgtcttcctattcagtctcagtaaatacttcttgaataaaccaatggatgtttggctggatggaagagtggatggatgacacctaacagttcttcaaccactttatggactagtgccccattctcccacccccatactgttcatcacaaactcacagttgcttctctacaagctactaaaatggaaaacatctcagcatgtggaaaaattcaactgcatttcagattctagttaaaaaaaaaaagtgactatatcctgccatgcctatataagtcctgcaacggaatgttgctgaatgccttcttgtctgcactagaaattcacactctcttaagctaagtgtatgcccactctacagggactcccgcttccccctggcctcaaagatcattacctacctctttgcgtgaggccaatccatcctcttgacagctcacttaccacggaccagggctgtgggggagcctctgacagccagagatgaaatggcagaaagggctccttgtctggacattcttgggcatctcctacccgccacattattgtcaccatggccaagtgtgatccctgtgtcatgaggcctgcgcttaggattggggctgcctcctctgcttcttcctagacccttgcttcgtggttgttccctcaaactacatattcagtcacttaaatgacgcaattgttttgagactcagtgaaaaatctcaggatatagactttgtccagtagataaggaatgaggtaatgctttagttcacaaattccttgagggcagagattttatttctgtatcttttaaatctgaattcccagtgtacagaaaaatgccttgcacaaaataaataagcaatacaatagattaatgaatgaatgtatatatgtgtgtgagggagagagagaaggagagagagaaaaagactgaaaaggagagagagagagaaagggggagaggtgggggaggaggggagagggagagacggagggagagagaaggagcaggagatcaacaaatgcccaatctgttactctggtttctgcctgggctgctgttatttcatcccaggaaagctggtttactctttggtccgtgggtctctgttctctttctctctgggccccctatctacctccttagttttgtggggaaattgctttctctgcaaccacctggtcctctaaagactctcttcttaggtcactttggtttatttggacaaaacgcttctaattcattattcctcctgtggaagactttttgagtttatttagaactagcattctgggcactgagtcttaatgaccatccacagacaagcacctagccaaccaaccccagctctttgctgagtccttctagactcttctgcagctctggcacaagcactgcccttcttgttgctgctgtatgttttatcttattttttaaaagaatgattacaccccttttccaggctctaaagtgacctgaactcaggaaaggttctcctctccatccatcaaagttcattcatccctcccccaagtttctccatgatttctactccagtccctcagactccagtggcaaattcacctcaaatttttggagttgtgattgctcctgttttccaccataatatcaggattgaaactttctgctgaacatagttccttggcctcccaaaactttccagatcaagatggatccagcccagcttagctctcaagtcctagaatcccctgctcagacaaagcatatcacatcctaatgctctgtgtggagggatgcctattgttaatgtctttgagaacatgaagcttggctaagaactggttcacaaactcactgcttgaaattcaacaggcatcctgggcaccgcctggagaaaggaagaggaaagcagggagctctgctcagattccatctctaagaccaaggcagaggctttgtagaaatcaatggttttccttccattgcaaagggggcaactggcagtgacgagcagaagggtggagcagggggtgtgggaagaagaacaaagagtaagcaggaggggaagaagtgagaggcagagggtgtaaccatgctcccatcctctacagattcttccccttcacttcctccaggcctggattcactttcttttttaatggctggggccagtgatttgttcccatcgatcactattgatgtttttcaattgtatccgtgacacttttggcaatatgtttgtaaacacagagccttctgggatctcacttcttgtcaccacgtacaggcaccgtctccttgtcactgagtattagctgtcaatcaaagggttgggaagggagctctgtgtccttggtcctgggacttgcttctttttgtctttctgcctggaagtgaacattcctcattcattcccagagggaaaatggaaaccttcctctttaagtgggagaaaattgggcgagaacaaggaaaggtttctacctggggccaggcatcgtgtcctgggcagaggaaaccacagttcttctggggagaaaaatgcagcagagaatcttgtacccaccagtttagcttggatctgggctgcaggagcagagaactgctcccttgaccacaggtagctgagcagcctgcatccaaatttcatcccagataactgggtgaacaactagaaatttcctgggttcacctagacaaggagctttccaacttttttgatcaagacccataagtaagataaataattcagctcatgactgagaatacacatacatgcttaattgaaataaaagttaaaggaaataagaaaatatttaaggagaaacacagccttacaacaagtgatacactctgatagtttctgtccattcttctgtttttcttttttgaattctggtcatgttccattaagttgattcatgactgcctgctgtgacccacagtttgaaaaaatactggactagaccaagggtcagcaaacttttctgtaaaggccagataagaaatattctcagctttgcaggccatatggtctctgtcacaaccactcaacatttccgttgcagcatgacagctgccacagacaatacataaacaaatgaatgtggctgtgttccaacacaactttacttatgtacagtaaaattcaaacttcatgtcactttcatgggctatgacatagccttcttttttttttaaatcattaaatacggaaaaaaaatccttagcttatgggctgtacaaaatcagaggtgatctggatttggcctgggagccagagtttgtcaccctctagaccacaccacatcaaccaacgcttgcagcatgttgccagtccttctcttcaaggcttctggcatctacaaataggtgggagtgaggggatccccaccaacctcttccacacctgcccacgagtcaaggtcaagtccacattgctcctgtgcctctgtattagagcatgaattctaatgtatttaattgatggtctctgttcccctgaactgtgtcctccaagaggatgcacttcttgtatcacacgtttctcactctgccttgaaatgtctctttgcttgtctacccatgggactgtgatccagtagattcctgagctgctggtccaggggacagcaagagagcctctgccctttctaatacttttcttggctcatgcatagaatctatggctgggctcatcctctggtgctccttggtacctagcctcaggctccagcctccacagcctcctcagctaactaaagccacagggctcccacctgccccacaggtgcctctgcacaacaaaaagttctttgcctttaagcacctgaataggaagaagaacactcagttcttttcaaatttacattttaacaatttttttaagtgtagagttaagtggtgttaagaacattcccattgttgtgcaaccatcaccactgatatggtttggctgtgtccccactcaaatctcatcttgaattcccatgttttgtgggagggacccagtgtgaggtaattgcatcatgggggcaagtctttcctctgctgttctcgtgacagtgaatgagtctcacgagatctgatggttttaaaaacaggagtttccctgcatgcactctcttctcttctcttgtctgccaccatgtgagatgtgcctttcaccttccttccaccatgattttgaggtctccccagccatgtggaactgtaagtccaataaacctctttcttttgtaaattgcccagtctcaggtatgtctttatcagcagtgtgaaaatggactaacacaactgccatccatcttcagaactttttcatcttcccaaactaaaactctgtccctgctaaactctatgatcctattcccctgtcccccagctcttggcaactaccattttactttctgtctttatgaatttgactactccaggtactttatgtaggtggaatcatacagcatttgtccttttgtgtctggcttatttcacttaaacctcatgttttcgaggttcatctacattgtagcatgtgtcagaatgtccttctttttaaaggctaaataagagaacactcacttttaaaaggtggttcccaaattgccctagaatgtaagaggagttttaacatatgacattgacaacaaactctcttcatctcttccccaacaataccaaggatggatctcactccatcttcttatcatcactctgcccctagaaaattcccccgttctgctcaccctctctgtcttctctactatggtgtcagggcaaccgagtgggctttatttatggctgacatccctgaatttaaatcttagctgcttctttactttattgctaaagttttttttttttaccacagcttcagttacaaaacaaaaataactaccttctatataatgactgttgtgaagaagaaataagatgaaagatacaaaatatcaaacacaaaacttacaacttagtgctcaaaatggtaattattattattatcccaattaataatgttttccagggtcacagtctggtcctagtatcccaaataaaccctagagatccccaagagcatcccagaacctcttttttgagacaccaatttagttaccaagagtatcgcagtgggaaccccagcttagaactgagatgtcaaatacatcactgcttcgctgcaaccctgggcaagccaatgtctttctgtattcttcaccctccttggctgtgaaatagatcaaatgatgcttctaaaattctcccaacaatgaggtaatgtcttcaaagtgccctgagcctttcacagggaagtcgttgtcaaatagacacctgtagtcacagaaaaacggttatactctgggaatgatttgctcagttggttaccgaatggtctgagtctatgccttatgcaagccccaccctaggagctggaaaacaagggtgaacatgtgagcccagcaccctccttcaccctgtatggctctgcatggatgggatgcaaagaatctgacttcctgcagaacaatgggtgccttacccagacagaactgatctctcacctcagagagcaagaggggagaagatgaacatctatttgggatctactgggtccctccagattttctacagccacaacggcatttaattcttcccatgtatgtgcacacacagagaagcacggaaggatatgcaacttacccaaagtcacacagctggtgcatcattaaagctgagatcaaaagtacggctgccgacttccaaaatccatgaatgtgccacccttccaagcagccatgctaataggggccatcgtaattgtccagcagtaattcatccagagacagattcgtgttggccatatctaatggcctggctctcggtccccttctgtctcctttatgactcaagctaattcacgatgtgcttagtcagatgtccagttgccagtttattgtctattaggtttgcagagggaagggaagtaacatttgctgagcactttccaaggcccaggccctgttccaggagctcctggccatacataatctctcttaatcctcataatatccctataaagggggtattattaccccactgggcagaggatcataaagattaagtaactctggataaccccagaagatggacaaacgtgctggcctagcacctcgggaaacctctgaaagcgagatctgccaagcaaagcctcccacagccgagggagccaggcttctccacctcatcagaggcagagagtcaagggagagcagaatggatggtgtggcaggttctgattaagaacattcatcatccctgccccgctagccccttggggtggcatggaattcgttacacgactcctgaaccgtgttcatcctctccagcctcctcctgtgcgaacaccgtggaattagccaggaggggtagcaaagaaatcagatctgccctgcggaggctctgcattcccagcactgtgctgggtactttgcattgctcatctttcacttttacatcaatcagatttagtccatatttctattttgcacaattcatgttattatttcatttaacttttcccaacctgccaaagcttacgtagtgaagggacgctcccaagtccactcagctgggaagtggaaagctaggatctaggccctgttctgtcctccctcagggctccaaacaatctgtcacactgcagcagagagaatgaaggggtttccctcttcccattttgctgatggataaactgagtctgagagcaggaagttgcagagagctgcagagatttggggccagaatatcagtcacatgtatgcccatccagcttttctagagatggtcatgaagccaaagaggggaagtgacatccttaataaaagctcatttcagcaaaaaagctgaggaatctgtttaattgatcatcactcctcccttccacaacagcacagggttttaaatgggactgggctccctgtctggaattctactcctccctgaaatgatccgataacaacagagctgattgtgactggtcctccctccccttctctctcctgcagaatgtttttcttcatccctgttttgtgtcttcgtaattgcgttactcacatagcaacacatggggatggccacactacagccaccaccatcggggccacaaggagaaagcaacagcattctaggagaacgcaccactccccatcaggcccccttgaaccaggcggggctgcatggaggtcaatgcctctcagggctgccctcccctctggatcagctcccagaacatgccctttgcctctaaccacgagcaggggtcacctgaggcccttgattctagccccactttagctttcccacagagaaggctgagacgttgaaaggcatgagcccacgcctcctcctcgccagggtctcagtgactccccagccccaggaagaggagcagggagcccctcacccaacatcaggcccatgtcttggaaacgcaggggttgtggattcacatgctggtgctgctggtctgccccccgctccctggcctgggttttgctccatctctgagcaacttttggaaaagaggcagatctaggaaatccataccaagtcccaatatactctatggctgaaggggctgaggagggagctcagctggagagccctggcccaggcccacaagacagtagagggggcactgctccttgtggacgtccaaccaggctgatgtcgtcttcatccttctgtagggaccaaaatcttggtggaacccccacccttcctggcaagtcaggaggtcagtagaaccccccaggccagcattcctttcccagcctcattcctgcccagggctccctgtgacctgcccctcccccatgtgaggacactatacaccctggatactgtcccctttccattccatttgtaattgtccctggcagaaacagcctccctcaaatggtgaattctcacataaatgtttggggtgatgcatatcccagttacccagatctgatggttacacattacatacatgtaccaaaacatcacattatataatcaataacaattttatacataaataaataggaaaaaaacgaggttctgctagcgtgtggtttggcagctgtcaaatcttgtgctagagccgagtcctgaccatggtgtgccctccacgcatcgtccagctcacccatcctcccaggaaggccacccctctgctgggtgtcagcatcacggcacctgggtgggtgagccgctcactgccccgccctaccccagctgccctctctagccccactgtgccacgtccccttggcaaggccactgtctggagtctggaacacagaaaaccattcctggaccctccgcactgccaagtctgtaaaagagcaggcgcctagcctctctccttggaggctcaggccatgtcaatctcttctacgtctccctagtgccaagataataagggggaaagtttttttctcctccttccagagtgcagaccaattagcattttttaaattaccattggagaaatacacctaattagccactttaaaggaaagctttaaaaaaaaaagtcataaatttctaactggccacagcttggagacacttttaaagctaattgtgtgtttctggcactgacaggggaattggtgaaagtaagagaccgattttatgaccttggtgggaaaggggaggggaaggctgaatgacgtccttaggccaagaaagggttaatgtctgtctcccggaaccccaggcccctcctggctcctcctccccttcctcaccctccctcatcagatccccacctctccccaccttgagccctgccttaccccagtcaggggtacctgccttagaagaggcagacaggaaggcagacaggcaggcaggcagacagggccacacactcagccagaaaatcatacaaggaggaagaaaagggcagaggacaaagagagaggagaaggacaggggaaacagagaagaaagaaacatttgaggaaactgagagaaaggaaccaaagccaaattccagaaggctgtttctcatttgtgcttcctattaaactctccatcgaggtgggggcgggagctgggggctctggcctgctcttgaacatggtgcctccctcagacagttccagtggaggcagacaggggcttctgcagccctcgggcctcctgcccaggctccctgaccctgctcagtggccccaactccctgtccctgaaactgagaaaactcttcataaagtgcaggcacaggactctggggtgcctcatttaggaggaaggtggcacagggcagtttctggttgctcccagcctctgccactgctgtggattcattcctgcctcagaaaaggggaaagagggcctctcccagggggagatcagtgtacaactggaggagtgtcaagaagtgcggccaagcaagagaagatgcccagagcaactgcacagggcctccatcatcctgcagagcccaccgccatggctcatcagcccttcaatggcccccggtgatgacccagtagagcggctaaggtgatgggggtgggggtcctctccctcaggaacacccctccactggctgggttgccgggcaggagttagggtaggaacaggacagtatagatgtattgtctccacctctgtctgaggcacacagtgtgaccagcgctgtcatgtctgcccaaccctagctcagtgtcatgcccacctgacactaggtgtggcctccctgttggttgaaggggcagcagcaggtgtttgcattctatacatggaaacttagaggcccagaaacactgaggcaaatttgctctagtagcagatttagtaccatctaaagtcctgggaggcacattcttcattcactgagaccctcctttctatagcttaagtgagagtctggagaaattacagacagtttcaaaacatatagtcttctggaaagcccagaacatgcattctcaatgggtacaagagtgctccccagagggtgaaaattagagggcaaaagaaaaaaaaatcttagatataatgatttgtggccctccaaaggtcaacattactcaataaattcacatgtcgtctcattaaagagaatttaaattaaatttaacttgtctctaagggggaaaaggtgatttttaaaaagctgagaaatgctgacctagggcagtagcccctagagtcctagagtcccacaggccagagctggatccactcacctgtacccccttgggaccaagctcagcatatgaaacaagaaatggggcccaggaggggattcttccccagaactagtcagtgactcctactgaagacactcacaaactttaaaagtggtgggagacttgagcaacctagcagggcaactgggtaagacactgcaatgctgtctcttctgccagggcagagggaagagcttctgggagacaaaagaccttggggcctcttcctgctcctcaccccagaccttaaagccttcagagaaatggcgcactggacgtctgagctccaggaggttgactgagggcaggattggagtgcagggctggaaggattcatgaccttaaaaacagccaggggagctggggtgccccaagtagaagactagggtctacagcgccccatcagagcccctcacactcttccttttttcctcccctctctggttccagaggctgggaaagagggaagagaaataactacacagcagaatggacaggcccccacccacccagtcataaactcatgggtgacaattgtgggggccctcacctccacccctaaaagaattgaacctgggctagctcctctaagcgagtagtacagctttcagcctaacaagtatccatctttactggcagcttcaggggctggtggaaagagctctggggtcagacctgctgggctttgcacaccagcaagtcatggtctgactgtccctgtgatcttggagagtctggttcttgggaaggggctctgacttaccctattctcctgcccgatgccttctctagaacccatcatgcactacgtgcttcatacatgcttgcagaatccaatgtgatccttcctttgcaaatgtttttgcaaaaggaaaatggaagtgaccatctccccgcctcagggggttgttgggaatgttaaagagatggtgcggacatgcagggagaacgtgtgcataacaggcaaggtgggcatcccctccacatcccctctcctctccccttgctagaaaacccatatgcttctgcaaagcaggtgagacgaggcatgggggaggggaggacatcggcacagacagggaaaccaagggacactgcaggaaagcctccaggtgacatgggaggccccatgtaccccaagtgccctgcatgagctgccttctgcctgcccccaccagagaaccctgcagtgaagggacaaattcctaatagcggggacgtcccaggagggtccctttcctggggctctggcccaaagagccagcacctttgatgctttcccaaagatctcatagcagggaccccattctacccactcaggctgaaatcagtgggaagtccctatgctctccccatctggctctccctagctttctgggggtgatggatggctcaagagttgcaatttttgttctgttaagaaagcacaaacaatccgatgccaggaggcgaggaccttgctccctgttggcgcctggtgcaatccccagggagctctaccagtgtcagcagagaaagggaaaacagctgggtctctagggcccgagagcaggcgggagatttattattttggggtgattaaaccgaagcttccaacacctcagtgagtgtttccttcttgctacccctgctactcagacacaggaaccgtatggggcagcctggctcccggtggtcccctctgtcccggtccttgagaccactgccaagacactgcctccatcagacggccaagctctggccagcctccaggtcctcgcctacctcccactccattccctgtctgcaattgtttccaatcagtttaggaaacagctctgagaacaattagaaaagataacgaggaagaattacataattacagttctcctagatctcaggcacttcaggggaaaagaaaaaggctgaactgagtccaaacagggaccaatgtgaggaaaagatggtacttctggaaagctttcggggtgcaagggcttagaccctgaaggagagtgggaaggacaaaggcactcctatgtctgcctgctggtcagctgggggctgcctccagctcagggcctcaaaggacggctcagaaagtcctcatgcaatgcagacctctctgtggaatagccatgtagactacagaaccacgtcccccttcaagatcatgcagcccaaacttctcattgtcaagatgagaaagaccaagagagaaaaggtcttgccccaagccaacagaactcaggactccaagccccaggccaacactttgtccatgtgcaggctccttaacttctgtctttggtccctgggttacaattcactggtcccacccactggacagctgggaaattctaccttcttgaccaaaatggatgggtataggaagaactttgccctctagagtaaagatgggcaaacttttcccaggaagggtcagataaatagtttaagttttatgggccatgcaatctctgtagcaacaactcaactttgccatcacaccacgaaagcaggcacagacaatatataaacaggtaagcatggctgtgttctagcaaaactgtatttgcagacactgtaacttgaatttcatattattttcacatgccatgatatattgttcttttgatttttttcaaccatttcaaaacataaaaatcattcttcacttgtgagctataaaaacaagtggcaaacaagatccagtccatgggttggagtttgccgactgttgctctaggatgttgctagaagactttgtgcttctctgattattccacacccagagtttaaccattccttgactccataaacccagcatggtatttagaacaaggcttgatggtcagtcttttctaggtcacattgccgtggtaggccaggctattaccaactatgcaagccctcaggaaatcatcctacgaggtttactcaagacacctctgacgtctgtgagaacccagtccccaggagcagagtgggcagctggatgacagctttccctagatgggcaaacaatccctccccagaagaatatggaagaggaattgcgtctcaatctgcccctctctatgcagagggtatttgtggcatatgaggtaataagagaccaacatcctgagtttctatgcagcacaacctaacttaccactgtcttctcctactgcctctccgtttagcaacagggagtaccaagtatcttcattcattcaaaaccagcatattgagtgaatgcctattctggcatcatgccagaggaaaatcaggcacaggatatcagacacatacagacatcaagtctctatgcggttagtaccctgacagcagggacattactcctcttctgcacccagcacccagcaccgcatgaggcacacaggagaagctcaggaaatgctgagtgaattagtaaatcaatgtgcaagatggaaatggttaagtagcacaaggcagatcaaatcctatgcaagcagagaggagggagaattaggtccagctgaggaagccaagaaagggccaatgacagagggggcagttgagctaagcctgacaagatgagtcggattagggtatgcacagttggggcacagagaaagaggagagaaaaattccagccagaaagaacaactagcaaggcatgatggtgtctataagaacatgcatagctgaggttgcagtcttcatgcctcttgaggagtaatagcttgagtgctaacaacccagagttaagctgtttctagattgttgagggccaagaaagtcaggcaaaagagtttaaacatctgtaggtggtaggaggcattgaatcttctgagcaaagatggttgggtggcaatgagattaggaaagtgaacatggtggcagagtacataaggactggataagcaaggagtctctttaaagaaaccctaaactaggacaggagcagcagcctcggccacaccgctgggtgaagcggaagagtggctgtgggccagcgggaggaggtgggacttgtaaagtgattcatggttatgagtgtagacccgggaatcagataaactgggctcaagtccaactccagcacttactccctgtaaatgatcagtcctttctagaacccagtttccctatctgtaaaaccgaggcaataaaatggagtcatcatctcacagggtccatgtgaagctgagatgtggttaaacatgtgaagtgcttaccctcgtgccctgcatggagcagattctcaatagaaatttgctaatcttggtcaaattctgtccattggccaggagtcccagtcaggccagagaagcttgtttttgccagagaggtggaagggtagttgaccacagtccacaatcactccccacctcccctctccccctcccaatcctgggtggtaaggcacacaccacatcctcaggaagctgacatacaccctcctcgtcactcctcagccagctagtgaaaaccaacaaccagaaatgtgcagtcccatgtggggacctttgtcaggcaagtcaatgtgctcaacagaaaactcatagccccaacactgtgagagggaaggaggaagggagggggaagacgtgactcagaagttaaatgccttctttcttagaacacaggagtgtcacagcattcaagccaagacctctgacctgcaagacatctgacctgcaagagggctcacttttgggaaccctcatgctcacgatttaggcctctgacctgctaggaacatgatcagcatcttggcagagagagcacaggccctgcatccaggcagccatgagctctggtcttggcctcagcgctccctggccatgtgactacgtaaataaggacatcagttaaataagggtacgtgagataatgtgtgttcagcacagaccgtagcccagtgctacagaggaatctggaatttggagacacggttgctcacacctgagacgaggataggacctcgcctctcataatcaatgcctgcctgagaccttggtttctgcttaggtggaagtggttttaaccaggctcagaccctcctcatactgcctactggtggcctctgtcatgagctctcccccacacctttttagatggctcctctgtcttcctttgcgtggaggttctgtgtttctccacaatagtagtctcttctcttccctggtccaattacagcccaccctcctcactccaagaagctgggtatcccatccctgcatctaacggggtaccagaactggtgacggacgactcaccagtcactcgtggcattctctaagaagcctttagttagtcctctctgcaactcccttcgaatcccgtttatgagtgaccagtctcccaaaagcaagaatgccagtccaagaaagcaggaatggggatttgagaaaaagaagaaaataaatgtgtttctgtgctcagggaagctctccacacaacacagctcaacttcctactcctgcattgccatctggttgctactggcaaccaggcaatcatatttttctagtcccagatataatcatcataatcaatatagggtatttatcccactccttggttccaaggaactcaaagattttcacatctattattcttccttcactaacgtgagggagagaaggggaggaggtctgcttgttgatggggtgtggggaaggactatttcacagatggaaaaactgagggaatgggtaagaaggaggctgtgggaacatctcttaagaaaacagtattgctaaaagcagtttgcatttggatagtgcgttcacttttgaataaaagtgaaaaaaatctcatctaatttttacaacatccctctaaagtaggttcatttatcgtatagacaaagcccccaaaagtaaaggatctttccagaaacacaccactagaaatgacattgcctaaactcctaggcctttcgagtcccttttagcatttttttcccgcagcatctctgcaaacaagtacagtacattgttggagctatcatgtctcttgtatgcattaccaccccaccattgtaagtgtttctcattatacttacattgtgcattacagtggctcttacacataggaggtttctgtctagttccggttgatacacacaccaaatgggcaacagggccaacaaaaatgactagactaaagcacttgactgcgttggaaaacttaggagccatatttaatttcctaaattctataaatgttcctttactagagtaaaacttggggggaaaaatcaatagttttgactctgagatcactcaccgcttttgacaactctgtgatgttaccttttcctacagccactggtttgatgtcaccttttgtcacagtaacaaagcaataccaaaaacatgctttgggggtccctgaagtggacaggaagccttctaccctacatacccagcaaaggcttcagtgccacccttgctcattagtgccaaacacaggtggctggaggtaaaaagacactcaatgaaacacaactgcaagagaaaacatgtggccacggccacagcagaactgttctaagatagggcgtctttctgaggtttgtgctcagcattcatttccctttggagacagtagaaacaccactgaaaggaagagagtagctggcttgtgcatgaagcttcctctctgttctcagaaaagagaaccagctggacaccatcttatcttttatcatttcctacttagagagctgcacaatttaccccttagaaggagaggccccaaacagaagacctgacctgtgatacctgtgatatccgcgacctcctgagcaaggagataaaaggactcaggtcagccctgacttcctaacctcatctggcacctcttcggattctagaaagaatcaccatattggaaaattccctccataccctcattccattcagttgagtaggcagaggggggaaattagaaacaaaagtgcctgacatgctaacaccaggctaaggattcacagaaggaaaagttgatgatcccagtccctagagatggatgaaccagtgtcagcccatcaatgaaagcatgttcagcacctactaggtgccattactatgcaactattccaagctgggtcttgaaaccaggctggtctgcccaccactgcgcagccttgcctgactccaaggacgcttcccgcctttggttgcccttcctttccgttcctatttcctcagtttctgacactttgcttttgtctctccttctctctccccagtgccctcactggcatcagatttggcactccggtgctggctttccaagctctcttttggccacagtgtgcacccagctcccggttccatggttttctggccaccgtagtgtacccacattgctgtccctggggcccagctcaccttatccatcttggttggcatctctgccatgcctgtcccagctgcccagggtgggaggcaaggagggcagagaggtaggtgaacactctgtgcatgctatcctgtctctccctgatgtttagcaaaattcagacttagaagttcagattccctcaagacacaaaccagtttgtggcttttcttaagtcatgctgtttcaagtctatcttaaagtagattcctgactacaactattgctttctttgtataatacttgcttctttccaaggagcttgccatctgctatctctttttagccacataacatctttgggatgaaacgtagtcagatgaaagaacatgaaccccatcttgcctcatttggggacaccaaggcacacagaccatgaatgatgttatcctaagtgtggaacggtgagctccactttgctctgaccaccttcagctgcataagctggcacagccttgacgggtacagatgtagagagttagaggattagtctcttgtgtggatgaaacactagccttgccagggatttaccaaagtccccactctaatttttcacccaggatgaggaacccaagtccagaggctcaacacctctttccaggtctctgctctggggccaccctgggaagagacacagggctgagatccaagttcccagtctgttccatctctccccagcccttctttatgcataaaggacacttgttggggagtcagtctgcgcttctggcatctggacacatcagcctatatctctaggactcgagcaggaagtatgtttgcctcgcctcgggcttcctggccacacagacccacgtcctcatttagaatggtggcatcatggagccggctgagatctgcagtcttcagtgtcagctgcgggtccacaaactcctactgaacacgtacccatagccccaggggaaaaaacaagggaggaaagaaaataaccaaggtggggaggggggagagattctggaatctagacaacatcaagagccctgtttccatgacaaccactacttaatacagttgctcagactgcagcctgttctaatcggccccgtggatggagcctgcagacccagaaatggcctccagccacggggctcccaagcagcctggaggaccaccaccatcctccaaccaccccaatctcctacaaagagaacagagggcaaaggaggggtgaggctcacaggggaggtgagaaagaacaatgaggagtgttgaagaaagtggaaagtgaaaggaaggagtcagagatacagccggacatccggggggttgtctgtggatgtttgctggggccacctgtgttcggcaacacttgtctttgtgttggtgagcctgtgagcacccatgagacgcatgacaggctgtagccagcgtgagtgtgaccatccacagcacgtccactgagcccatctcccttccccttcctacacattggagtacccgcttcctctcttctctcttcccctacaaagctctaagctttgtagtccaaggataacccctgtgaggcaaaggccagggtcagcagccagccagtaggtaccagcagcttccaacaatttctcagcaaattgttgggatagaaagaacaatagtactaatattctctaaattagaggtttctggcttaggggcacccccgaaccctgctcctcacagacttctccagttcccagaaaatgatgggtgacttctaggttttcttccaatccacatatgagacctcagaggctggcaacttgtcaaagtcacctgctgggtcaggtgtcagcctggagactctgtccctggaaagccacacatctccctgcatactccaggctgcactctccttcttcctgtattcatctggcaatcacccaaacacgctgcaaatcagatgacatatgacatgctgcacactccgtccaactctgaagggagtccgtctatggggacaatgggtctggtttatattttaagcagctagagtgaaaaacggggagtgatgaggtaaggccatggcaacgaacaccatgccactatccaggataattacttcgcccagccatcctggagccaggcggcggaagccttgccccatagattatgagcaatgagacagggccagccagcttaggaattcccttcctccacctgcaccttcactgcaaatggaaacacagcagaaggaaccaatgcagtgggagatcccaatcaaagcaagatgacctgtccctcaatttccaatcgttggagaaatgcaaagaaaagtccctatgcatacccctcctccaagttgctacatggaaaatcagagctctgaatttcggtgatggctgctgagccaagagacaaggaagacccaaaatcagcataggacagagatagtgaaaaggtcagtgagcgagagagaggaaaggagaagctgaaagatgtttgccgcaagctaggaatgacctattaaaatccccagccactccctcaagctgggatgcggtccctgttggtggcttcacagctgctataccccactcaatgcaggctgcttcagggctccaggacacttgtactattggccagctcagatgccacccctgcaggagcatgtggaaccatctgacttggatatgactgggctttcctgctgcaatgccctacagatgctccatcgccatatacacatgccttgctcagggatcatgcccatgttgaccttggccccaaaacacggatgggaaggagcatgcccagggagcagccttatattttcttttcctttgttccctgagtcctcagatgaaaatggctacaagctgatgctctggagaagagaatccaattcagtggccacaccaactaatacagggcatccactttgctcttcaaagacaatcagaagtgcaatagtcagaacatggcgcataggaagatcctgaaaagtccaggcctgtgccagctgcctcccttcgtggtcctaagtgcaaccccttaaagtatccgaagaaattgactcctgaggggcagaaatctagcaaggagggatgtgaccacacgtgtgtgtgcatgtttgcatgcaagcacgtgcacagacacacacattcttacaaatgaaactgcaatcactggtgatgtgtgggtgtatgtgtgagagttagggggttgtgcatgtgactatgtgaagctcgggatcacaaatggaaggagagctgcatctgaggaaaaaaaagaaaaaaaaaaaaaaaacagaaaaagccaccagccctgtaccctccgcaccaagagatccttagcttgttgcactctcattggcctcttcagcctctcctattttcagtgaaactctcctttgtttctcccaccccaggttggccccagaccactaaatacacaccacctgaagatacagcaaaacccagaagtggtgaccacagcaacatgagtacacacactgcagactgtcagcagcaggagggtcatgtgattgcagagggcagcctgacaagcccatgtgattccctccacattaagtggaaaacactgtctccactgagaaagagaggtgaagaggtgggaggagtgaaaagtgaaattaacttgagccaagattacgcccatgggttctgtggaggccaggccggaaggaaagtcaagaggaggggcaggaactgcatccagcgtgtggttgtgtacggttgtggttctgggaggatggagcttttgagaagtgtgtctctggtacaccctatgcaggaaaacctcagcacgacttacaggtgtataagcatgtgtgtgggtttgcacgcagcatgccaaaagcatatttataaattgggttaaaggttggttaggaccacagattctggttaaaataccagctttagagtatatgaccacttagagcttcagtgtcctcatctatgaggtgtagataacagtaagtaactatcatagggttgctttgatgacataatccatgataaagcacgggacatagggcctggcatgtagtaagtgctcaataaatactaatttggtttattattatttgatgttccccatgatctcaggtctaaaatgacatagcaaaaatagggtaggtagatacataacattattatttgcaagaaagccacagttcatattacccagttaaacagggaatggctaacttctcaaccacacactgaatatcaagataggatgataattctaactggataatctcagtattagtctaacatatatttaaaagtatcccatagtgtcattgtaaagcaaggactttgatattagactatgggagtattctatttttgccacttgctggtaattaggctggcttagcctaatgccctgcacatattaacacctcaatagctgtttttaaaaattacagctctgtggagttttagatgtgcttaatattgacaattctgttcttggtctaatagctttttttttcaatcatccttatagctgattgtcaacatatcaaaacaaaaagatttattccatatcaactgcccactgctagacagtaagtcatcgatggactttcacaggtttatatgaaacatatggatgtattaattcttcaacccacattgagatgaactgtcacgtcccttttaaactccatcacaggcagcaagtattaacctgcaattattaccgtgtataacgtgctttacaattggcaagaacgtcaacagtccctggttcattcagcagccctggtatcattcacaaactgcagttctcttttttttcctcaggcctggagggaattgagaagcagaaaataatctcaggcagatccagctgccctgacacttgcagtgcagctggcaggtgccggagcttcagacacgtggcccacaggtgcaacaaacccaccttgcttgggctctgcaaccatagagtcccgccccggccaatgaagccatccctgggggtctctgaaaattctccaggctatctgcaaactggtctctcagaatgtgtggccagctacactttagaatacatgaacaagcaatttacttggtgattcacattgtacatacatgtatacacacaggtacacatggatatacaaatacacaatatatccatacatacatgtgcatgcatatacacacatatgcatatatatacatacgcatacacacatacacatacaatgtgtatatccatgcatagctacccttcccagtcaccttgggtgacacattttgctggggatctttgtgggagaaggaggggcattttctgctgctcaaatagcttttggaaccaaaacatttgcaaaccacttgtttagggggcaagacctgaactcaaggagcaagacctgaactcagaggttcgcacaacaggtgaccaaccaaagtttgcggtcctaattatttctactctcttttccctttccctaaaggccctaggacagtttcctctgcacccatggtcctctaggccctgctgagtagggcactactagagagagaagcacctggttcctgacctcaaaaattcccagtggtgaatgagcagtgtggcactttgtaaagctttatggaattaggataaatgcttctggctattggaaaaccttatttcacatgtgcacacatgtgtgcatgtgcatgtgtgagtgtgtgtgtgtgtgtatgtgtgtgtgtgtgatctgtgtgggcttgtgccatgctgccataaaacacaaatttatcttcataatagggtcaattacattctccgatttccccacaagtgaggcaacaaaaacaaattttgagcttcaacctgcaggagaatgccaggatctctgtgttgaaaaagggagccttggtttaccctccccctgccttgcacagacatatgttgcacagacaaacacctggaaggtgcttctcaattctttgaggttgctgcctctcacatgcagctgtcaaatcacaccccatcaacatgacacagcaaataacactacgacacgcaaccagcaacttttgaaagtatactctccccacacccagccccgtctgccttctccagcgtgggctgctgtcttcaaactaaccatcctgaaactgctttaaagagcctgacaggtaatttattctgtggcagaggatagcaatttcattgtccagaggcaagagatccaactatatcagaaaatccgtactctcaaggaacacaggtttaatatgataacgattctaagggtgtgtgttcataattcttcctgttctttcctccccttccctaaagctgctagtgaatgcttttgcagttttttttaagggccctccaaagaactgacataaaataaatcaaatattttaccacgaaaggtgattatcaaacacttatttgtgaaaagagtcaaccagaaggggtcaaggcctagctgctgttatgggatttttgcccacaagtaaaatgtttttaaaaattgcatctgactctcttggcagaaaacctgctgggatctataaggtttcacttgggcacctggtagagaaggggatgaagagcaaaaaaggttggtgaacaggacaacatccgcttctagaagcaaagtcaaggccgctatgcacttatttttccaaaataatatgatagttattttcacattttatttgctaaaatccatgcaaagtaagtattattatttccattttacatatgaaaaaaccaaggcttaggatattgaagactcagcttcctcaaatataatataggaacagtagaccctgggtccctcccaatggtaaatcacaactttgcatggtgagctcccatcagaaatagaactagaactgaagtctcctaactcttagtctctgcctgctagctcccaccccatgtgactgcatcagatctgcattgcaacaaaaggtaaattcgatgggtaggtgatttttaaactcgcctttgtcaacgaacttgtcataagatcttggacaagatgcttccctttttagtattttggaagattgaccagtaaggggaggctgatagctcctcagatcatcgtgagttctttctgggtggcagtgtccagcacagtgcctggagtacaatatatcctccataaatgctcactgcattgaattgagaataacaacaaaattctcttaacccccactgatgttccctagctaggagcacgttgcgctccgaagcacaggacattgcccacagatcccaaggctataggacttagcatttccatgggctcattgcactaagctcagtgtttttaggtagtaatgaatggaattcttttttaaaccctgcattcggagtctatttcatgcctttttacatttcacattatatttatatttttaaaaatcattacctattttacattacacattttaaaaacctattcagtcaaataataatcctattccttggctgccagtcagggaaatgaaggtctcacaaacagtgatttgcccaaggccagcaaagactgaatatcagagaaggatgatcccaaaggtagactcagcttaatgaggccagaggtctgttggggcttcactttggagaagtccttcagggtaaggagtgccaactgctttgtgaagtggcatgccaccaatgctcggtcaaaatcacatgcaagagtgacactcctgacctcaaatcaccagttgatcagagtcaggggcaagacaagggcacagatcttctgaggctggagaaccacgtgctcaccctatctgggaggagccccaagcccttaatgatctcacgtggccttcagggacacccaggcactccagagacaaaaagagaagacagatccagatctgaaagagcagagaatgagttgtcagtcagggacaaagagtgggagattaagggaacatgctaagtgtcactagcctggattcttgtgtcagggccacagaggtccctgatgccaaaagctgggataagcctgtgggttgcatataagttgcgtatgaagttactgcttgatgccagcaagcactgaaacaagaaagagaagcctgtaaagatggaaatgaggcaactcccaacccccatcccactttcagaagttttaacagatgtcctttccactcccttttttcttgggaatgcctcaagattcttacttttctcgaacgggcaactttccccaccacctacgtgttctttctagattccaatctgctgcttctccatggggttctttctgttctttttcttttttcttttgctgacctttgtcctcccaaatgttatcactcagagaagtccccctccgcaaacttccccacttaagtgtgctctgtgcccaggccctgggctaagcacgagatgtggaaaactgaccaagacaaaaaacagtcccaggccaacctgacctcacagtgtcaggcattaagcaagtaaccaagctgcccgcatcagcaataccttctggcccctgatttttctgtctctgcgatttaccttgccctgatctagcagacttaaagggatcagtttttggggctggcacggcctgagaggtcaaaccccgggacacagtgcccaaggctggctggcgtttgatgggatggcaccagtagggtcctattggttgctgacaaatagagtcggctctgcttacccagcccgtgctgcaccagcttccatctgaacacccctcctgctggttttatcacgaaggagaccaaccaaccgaagcctgagatcatggtacagccatgcagatagtcagacctctccatgcttttcccactcctgtgtcttcaggggcctagctccctcagattctcttggggaacaagaagctttgcccaactgagggatgttcctttgctgatgtttggaggttttccttcctttttgtggccatgttcctacagccaaggcaaatccaatcagcagtaccatccttgttgcaccccgtcctctgtgggggaactttcccggcttctgggctgttctccatctggttccaaaatcccaagccttcagagagagcagtcgcactgcctgaagtttaaatcaactaggcaatttgctttctagaactcaagtctgccgatactctgtacagtttttctttcctcagtgcaaacgagaaactgatggtttcatgactgtgatctctctgccctctcctcccagatgtttctagagtcaattccagctgccaccgggcctgttgtccatttcctggcacgtgctcagtcaatacaaataaagacgatgagccgacactgcgcgtggtcgtgaccatgttcccctggattgccctggacttggtcttcctttagacacttccctcttcattaacctcacgtctgcatcctttctttattacacataagtgaaaatattgctattgaaggattcagcagagaaaatttccaaagaccaacatgtggcatctccagggttccccttcattttctaaattggtacttcactcaaaacatttctggcataacttcttttcaaaaaatgtgtgcttccattccaagcaacataataatagaccaatcccatcagtgagcagaggagggccatggattcctttggctcccctgctgccattcagtgctaaaacactgtccaacaaagccacatccacctcagtgaactgggtgggatccccctgcctttgttctttctctgcaaatgcctggcttagaaactaagcctgattgaaaacctgcagaccaacttaagaacattgtcttgctgaatttcagccttgattaatacccttttctagaatctgaaagtcctttgtcttgaaactctagtccacacttactcctgtccttcaaatttggaaattaaaccagatactcaccttctcatcattttaatgatgccctttggctcaggtgttgttgtcagaaagtaactcttctctttctttttttgagaagaagtctctctcttgtctcccaggctggagcgcaatggcgccctcttggctcactgcaaccacctcctcctgggttcaagcgattctcctccctcagcctcccgagtagctgggatgacaggcatgtgccaccatgcccagctaatttttttactcttagtagagatggggtttcaccacaatggccaggctgatctcgaactcttgacctcccaaagtgctgggattacagatgtgagtcactgtgcctggctgaatgtaactactttattgacaaagaggacccagttctgtcctttgagtatcttgaatggcaggtgtcatctaatgaacatgtaaagggacctaagttccagtaaccccaggcagcctggtgcacatctgtgttaaggtgtgtgtgttggtgtgggagggtgtgtggggtttgtgtgaagctgtgccaacctgtgggtgtgcaaccatgcaccctctccactttccccacacctgagtggtctgctggtcaccgtcagtagaccatgcatgcaaaatcattcttctggacgtgcaggagaaactgaaaaccagcactgtcaggtgtgttaaaacccttaagattggttctcggctgggcgcggtggctcactcctgtaatcccaacactttgggaggccgaggcgggcggatcatgaggtcaggagatccagaccatggtgaaaccctgtctctacttaaaaaatacaaaaaaattagccgggcacagtggcaggcaccctgtagtcccagctactcgggaggctgaggcaggagaatggtgtgaacccaggaggcggagcttgcagtgagccgagattgcaccactgcactccagcctgggtgacagagcaagactccatctcaggaaaaaaaaaaaaaaaaaaaaaaaaaaaatttgttctcatgaacttcctggcttagccaaccacatccacccttccatgtgtaggttaatattcccaatctgccacctgctcctccttctatgtgatttctcgagcagatgcaaagagacttgtctggggcaactcacaccccacaccatcttgatttttgtctctggggtcttcaaagccctctccttgccacagccgagtgagcgcccctgccttggcatccactcatctgaccatcatcagtgcccctgtgggtcttccccctgaaagcatctcacacaacacatctagttgcctactgccatggggtacagtagataagagacttgtctccatagtgtgaaccagaatttattgcatctgagcaaatcatggtcacagctatgtagctttgacattcacttctagatagataatggcatttttcacgccaaaattctttgaaagcaaatatatgatctggcttcattccacaaccagaccagttgaaacacctcacttccctgtacagaaaaataaaagtgagaaatacaaaaaagcagtcctagaaatgccactgaccccaccctgtggatggaaggcagggtgggatgggaccgaagggtgccaggaagctcttctctctgggggctctgctcagccctcactgtgtcccccctcagggattccagctcctcacacagcctctcaggctcacgtgataaggtgggaaaatgaaggtcaaagttaaagagcaaaaactcccgagaccttgatgaaggaggttgtttgctgtgccctgaaagttgagctgatgtctccctggtaggcttaggtcagctctgctccaagttaacacaagcccaggagccccgatggaggaagggaaggcccaaggcggggcaagactaagacagccaggtgtggtcttgagcacaagaggtagactgacccccaacctccctgagctacacgtggataacagtgcaaaccctttaccgttgttgatggttaaacaagaaattgcatgtagcgtgcttagaccagaggctgcacttcatccccactagtaaaggttaggtaatattaataacaacatacgaacaacaacaaataccccattatacttctttttgtcacctcacagcccaacaaactaggcacaggcactgtcaccatcccattatgcaagaggaagtccagcccgtgtgccattaactatctgccccaagtctcactgctaaaagaggaattgaaaggggaatttgaaaagggtggaactcatggattccactggaggagcccagagaagaaacctggtaaaggttttcaaatggcccagctgcccagacaatgcatgaaatctgaactctgactctatctctcttagcctttgaactgcctcctcgaagagaagtgaaacttaactttataaaccagacactaagatgcatcttttaaacaagaacatagagtagctcttcccctatatcaagcatcaactatccaggtaactatgttacctcattgtatcctcacaaaaaccccaccctatccgaattcccaagggttccattttacagaggaggaaatagagagtcaacaagctaaggtaatgagtctgaggccatataactagtaagcggtagatctgggattccagcctagagctagctggtctttggcaccattcccctttgcagcaggcctgcagcagacacacacacctttgaattcctcgacaggcctgtgcctggaccttccatcctcccttcctctccccacccgcccacatccataatgcgcattttcattaggcatctttgcccagtgatctgctgatttgttatattagaattgcaaacaaatgctctcatttcatcctcctatcccctctcttgccctcctgacatctgaaattcagcattgatttttctggccccgctccactgcctaactgacatttccggttgatttcaccttagaggcttgcagttggctcaccaggctcccactagagcccagaatggaatagcgcatcacctggataagcagaattggacctcatcccctacttcctgctctcagtgctctcactgtgtcagaactcagtgccctctagactctgtccccattaaccgattgatggatatgcatacctcagtccttcaagattctcaatgggaagggaaggaggggaaaactgtggaaaatgtcctgggaggtgggaccaggtgaattttgatctcctaagtactgatgttttcagccatagctggggtaattggacctcttgtggaggagaaaggggattatgaggaagaccaaatggactgagagatagaggtgggaaggggactgggataccatgttacaaacagaggatctctcatatcttaatccatcagaagactcatagaatgatcacttatctaaaatgggacttaataatccccagaggtcatctaagtcagtcttctgtccacaccacacagcacatcttaggaaggtgagcatctctcctaagtttaagaactcaagctgggtgcagtggctcatgcttgtaatgccaacactttgggaggccgagttgggcagatcacttgagtacagaagtttaagaccagcctggacaacatggtgaagcccacctgtacttaaaaaaaaaaaaagattaaaacactttttaaaaaaattagccaggtgtggtggtgtgtgcctctggtcccagctacttaggaggctgaggtaggaggattgcttaaacccaggagacagaggttgcagtgagccaagatgatggcgctgcactccagcctggacaacagatggagatcttgtcttaaaaaacaacaacaacagaaaacacctcaaacaaaaaaaacgtatagcatctctcacaccttctagcttctgtctctgataagtacattggactactaggttccaaacagagctacgttttcctcccaggacttcccattcccagtgggtactgaccagtgggtatccaagttggttttttatggaagcttccattttgtcaataaggaataggcccagtgtcctgtgaagtggtcagtggtgaccagctccacaaggagaagacaactcacagaggtacactagagtggccattgccagctcacaatagctggttgttacatttttaggaagtttgtgatccagttgttaaactattggtagtttgcgaacaccagggtagaagtatttacaccatagaaattggcatctgctataaattagggcttcttttttctgcagagccaagagtttcatgaagagggtgcccagtcatgtggtcaacatagaaagagggagaggcatagaaagggtggggtgaggaggacgaggtggaggcaagtcagggaaaccacattctttagtatcctcggaaaagcaaactctaaacaatcacctttccttccttcctaactaggaaacatcttattccctctgcagctatatgttatttcttctctaaggaaagcagttattgtttcttgttctcagacctaaagtggagaaaactagagacagaactttggatcctatcatttctcagaagccatgagtcagagaaggaagaaccaacaaagggctctgaactatagactgaattctatatgcacatttatacatagcccagttctagttgtctctagagatttcttatgtagaaatatctatacaagacaacagctaactgtagagctcatcaaaatcagggattgtacctttcatttcttatataaccatggttgtacctggtaagatattaatgttacaacaggtaatgaataaaattttggtttattaattgaatcactttgaattgaattggattggtggcaaaccactggtttatgatcagatgtcaagacttttcaaatcccttttctaagaggtaaaaattagctggttggctggctggctagaccaatagacactgattaggcatacacatgaccttataagttatcttgagctcacacccctggctctactcattcctgtattgtccagttggatggctttgcttctttctccacagttctcctggcctcttactcagatccatgtgctttgggcttttggttcttagtaagctggtaacttggcccctgactacattcaactgtgcaccttgaacaacccaaattaaaacaatccaaagcctagtcaggtcaagacaatgaagctggtgccaccatgtccacattcagaagtggactcagaaggcaggaggaaccatgttctccaaacccccaactcaatcagtgtttcccactgcagatgatccatttcagggaaaccatgcccaaagagatgaacggacagatcctggtcacatggcaccagctctactcccataaaggggtgaggaggcagaggtaccttatttagaaacctgtccttttctggatcctctgtcacacatgactgccactgtcacacatgactgccaccattggtcatgcttctctctttcctgacagcttcctccagaaccagaggcaaagcaccttcagtgccctgtacaaaagcccaggtttgctgggctggggcactgcctcaacagagaggcccatcctccccaacctagtggcagaagtccagactacttccaccctaatctggcaatgggtgttcgccttgggggaaccaagacctctctgagaatcttctcaaatattttggaaaatgctcatgcatccattgttttacagacaaacttacagagctcagcggctgtgacagtccccctgggggccctgggctaatggcctctgatgaaatgcctctcccagtcacactgtccatttccttcctggacaccagctcctgtttttcatttctcgagtcccctctgtcctccaggaaggaagatgactgctctatggtacacctccacatacaggtgagcacactgatatccacagaggccatgcaacttgctcaggctcgcacagaagttactaggagagatgggatcgggatgtaggtccaggaggctgtggctctttctagaatttaatgcagccacacagtgctgtgtttgtggatctcagaagcaaccacatcaaaaccctggcctctactcttcctcagctatgaaggaggtatgaaacctcatacatgaagtttcaaaatgggagggagtgctcctccaaggaagcaggtaggtctttgctcagaggtaggcgggacacgtgattagctctgtgtgtactggggtgatgtcttcagaaccaataccgtaaatgcctctgacacaccgtttccactgttaatgagaaagctctaagagccattaatctcattactgttctatcagcagccagtgatcatgttcatttcactcctcctctccaactccttggtcactcagctactgagaagggtggactgggaaggctggaaaggccaggaccctgccctcaactgaagtcaacggtggcatcactccagaattcttggagcagaggaacctgctcagcctgctataggaacaatggccaaggaggcagctgtgtccccaggactcctagcccccttagtgggcctcttcagccctctttctctctgagattctggagtatttctgtatgtccatgagggagcactctgtcccactatggcctggagctccctgagcaagtcggaggcccaggaggcccacatggatgagtcagtccctagtcctcttgttttatggctcaaggtcctctgcaggggtggaatctttgacccaaggctaaggagcccagaaagatgattcaagtcagagaataattccaggtcaccctctcttctgtagccacaccttcaaggtgtagattatacaaacccagaagtcctagttactcactaacccccagccacttttgtgaaaatggcacttgactgctatgccttatggaagaccgtgtctaaggaaggagcgtgaggccaggtgtggtaagtctagaccacgagggactcagggcccacccttcacagctgaggcctcatccacgctggtccagaagtcttcccatcataagcatctcatcttaaggagcggctgggttatattccagtccttctggctgatgtctgcaccctgggcctcctctttgctgcatccttgccctgaggcttcttgaggttatcacaggaaaagggttagaggcagcagcggctgctgacgtcacatcagtatccccttcaccaccaagagccaatgtgctgagcagcttagagggtatttgaggaagcatgtccacaagggcagatgggcctggtactcgggaagttgggaaaatacaattagacagaagcctggtcccaaatcaaaatttcagtaagggcttgcctgcactgatgtccagcaaggaaaggctatttcctttgtggggtctcctgtactctgttgtcagccctgcctgatgggcccagtgggtaaagggcagtgagctgagctgtcattgaaatatccctgcatgtagagagtctttctagaaggaagcaagagcttggtccacggactcccatgagactccaaaaagagaaggcagtgccggcccctggaagagaccaagctcacactcctaagctaccccagtggcccaggagtgattggcacagggatgggatggggctgtgtgggaagggcaagttcattggtaggcagggccctcctggccctgacagccaacgattcccatctttcttcaatcaataaaacttctgctcccttcagtctgtctggaagctcttcccaaaaggaggctcaaagtatcagacaccaaaatattacatcacactccctgcccacttccttccccaagagtcctctcttattccaaaaagggatgctggaaggacacacaagagtttcttgcccttttcttttggttttatttttgtctcaagtctggcttagccatgggagtcagagtagagaaagaagatgttttcctcccctgctttggccaggaggataattccaaaggaaatcaaaaacctttatctgtcatcatctcccccagcaaggcatcccagcaccatgcatttaatagaaagagaaatcgttccagcatggagagatggaagagacagcaataaaaggccaggcttctgcctcccacattagcgtcccacccatcaggaagcatgccaagtcacttcagacccagggagcctgtggcatgcccatctctaccaagtacatgttagcagagctcagaaggccaggaaaagaagaagtaatgtgtccaacacaaggaaagcgatggtggccatgacgtcttgggaaatccaaaaaaacatggcacacagtgtttctagtctcgcatctctccctgcaaggctcattagtgagccctcacacactgcaagatatggtctgaaaggtgtaagggtccagctcccagctccctgggggcctgatactctaccctctcgcttctgtggggagagatgcaaagaaaggcaatatggccatctcttcatgggcaactctcttccaacccaagctctctgatcttcaaaggggagagatggggttggacatgagcatcagtgcaagggctcagagaaatgtatcagctgcaagacagctcccaagatggtcagaaatgcaggtcctaattacatccctccattggctatgaccttgggtcaccacacaccaattatttactctggcaaagtgattagggaattggaaccagggaatggatatgtgttggggtagaggcgggaacctgggggttcagaagatgaggatggcagtggcaaagatgctccttctgcatctgcctcctcctaattggggtcactgcaggcaacagttagggagccacgcaccacgttctagtttttggtcatggggaattatgtagaggccccaaaatgacaagagaagtggaggaaaaggaggagagaaggataagggccaaaaaaacagttgcccatgaacaaatgcaaatcctatgtcaattagggagaggatggaagcaggtcaacaaacctgcccttctcccaagaagagagagaagtcagatcaggcaggtgggagagcagcaaagatgggcaaggctggagagaaaggtgacacagaccccacacagggactcagactgcagggccatggttctccaattatgaccctaggactagctacagctgcatcactcagcccttgtgagaaatacccctttttggatcccaccctagctctattgactcagaaactatagaggtgtgttttaacaagctccccaggtgatcccgattaaccttcaggtctgagaacagtccccagaaggaaaaggaattccagtttcccattgcatcctttgcccacagtgagggttttttttttttcttccagacagtctcagtgtcaccaggctggagagcagtggcgcaatctcggctcactgcaacctccaactccctggttcaagcaattatcctgcctcagcctcccgagtagctgggattacaggcacgtgccaccatgcccagctaatttttgtatttttagtagagatggggtttcaccatgttggccaggaaggtctctatctcctgactttgtgacctgctcaccttggcctcccaaagtgctgggattataggcgtgagccaccgcgcccagccaatgagtgcttttaaactccaaattccccttcaagacctcatatcactttcagtgactataataatcatttctctccagagatgtagtctttgacccaccgtcagcagaaaggacatcagagtgtggtctattttgaaagagcagaatgaggtttgcaccacatgctgagcacacccttgtccctgctctctggtgtgggcaacagcctagcagcccactgggtttagtgtgtctgtcatcaccacactttcctgtgcaggaatggcagcagcaacaatgctgtcaatgaaagtaaaggaagcaagtaagctttgagcacccatgttgggcactgtcctgagcatttgatatgccttctttcatccaatcttcacaacagccccatcgtatagacaaaacatgttcagaggggtgaagccatttcatcaaggccacgtgactcttaagcctcatctcaaagttcttgttcctgcttctgcattgccttcttaagaacaacaacaagaagcctctccattttctttgcagttaatttgcaaaccacaaagccaaaagctgacttatcacccttgcaagaaaaggggcttgggttctgtgaggggcatttcttggctttaacaagaagctgcctgggaaatggccctacaaaaggaggccaagtagagtagggcatagaaaggacgttgttctgagctgaagtgcgcccccccaaccatgtcactgcctttccacaaattcatatgttgaagtcccaacccccagtacctctgaatgtgactgtatttggagatagggtctttaaagaggtcattcagttaaaatgagatcactagggtggaccttaatgcaaactgactggtgtccttataagaagaggaaatttggacaccagtaggtacagaggaaaggccatgtgaagacacaaggagaagacagccaaagagagaagcctgaggagaagccagccctgcctataccttgatcttgggcatccagccaccaggagagcgaaggaataaatgtgggagccacccagtctgtggtactgtgctatggcagccttagcaaactcatccagatctcttcctgtcctacggtgggctgtccaccttcccacagctccttcagcatcctcgatggggccaatgctggccaagagaagcaggttctgtgtatccctgcactgggtggcagcctgaggctgtagaagtaccaccctgactgaggaggttgggagacgtctgggaaacaggcagccccggctgtcagcctgcagcctcgcctggacgctgtttgcactcacacacactggcaggtatctgtggtcatcacggtggctgttccgctgtttgcctccctcctggcaggtgcctgaaaataaagcatgaagcccagacagcccaaggatggaaaatcatggagctgagacaaaacacgtatttgcagagaacaggttcaacttcaggggtggggaggggcgcctggctctcaggatggtgcagagggaatgacagagaggaaggtatcaggtgtgcagcaaagcagaacatgagaaggaggagagggccaggccacattcaagtgtgcccaagtatatgacacacacacacacacgcagagtgagggccgctcgaattgacacttggagacatgccaaaccccaatgcactcactcacacatatgcctgcatgcagaccctgggtgacacacacaagcacagtcttcctgtctgttgggagcccgcgcagtatgtttgctgagtgaaaatgctccttggagaatcctccgtttgcattctccacacacaccctttctttctgggcttcgaaattgtgcatcaagcgtgcagctgtgaaaagaatgatacaagcagagaagcctgccaggatgctccatgtggcctagcggaggggtgggggagtggggcccagatggtcctcagccagtctgagggtgtgggtgcctggctcccagtgacctgacttacagtctcagtccctctcctcccctgcccagacctgaccatcaacccctctgcccacctctggaggcctgggaggaagatgtggggcatgcaaagttgtcaggagaatgcaggtgaggccagccttctgcagctcacaggatggacgagagaaggtgcccctcccttgtctctggccctgatgggcctgacagggcgccggtgggagggcaggagggagacaaaaccatttatatgtatttctggtggacatgtttgggggtccctcttcgcatctcctctgttcttttttttttttttttttggagatggagtctcactctgtcacccaggttggagtgcagtggcacaatctcagctcactgcaatttccatctcccaggtcaagcgattctcctgcctcagcctcccgagtagctgggactacaggtgcccaccaccatgcctggctaattttttatattttagtagagacaggggtttcactgtgttgcccaggctggtctcgaacttctgagctcaggcaatccacctgcctcggcctcccaaagtgctaggattacaggtgtgagccactgcacccagcctctgttctctttttataaggccaagagcgtgctctgaacttccatctcaaccaatttcctagaagaggctggaggtacagaactaagccaaaacaaccagagggactaatcaaccgggtctggacagtgataggattaaagtcagtgacaaattttattatggagctctaaccatgcccagataagtgtgtgacgagaagataacgactcagctgcgaaccggcagccactggggagcccttaacagactgagcccaggatgggccaggaagagaagagggcagtggaggggaggggaggggaggagggctggggaggagttgacgaatcaatcagaaaggctgagggcagggctccctctccattcatgcccaaagaccaccctcagcccagcccacctgggagaccttggatggaactggttcctacatccccatagagataaccgacaccatctgatttgtctcacattccccagtttccatttacactttaatggttctgtattttttttaacctcatcattacctttcagatctaaactcattctgccaacactgaaccctgtctcccatgtcacacagacataaggtatttggagctttttctctggtacctaagtgagtacctgtattctttttaactttctattttaaaacaattttagatttatagcacaattgcaaagttaacccaaagattcctgtttatcccacacccagcttccccttgtgttaacatgttacgtgtaaccatggtacaattattgaaacaaaattaacattgtactgttaaccaaactgtagccttatatttggaattcatcagtttttccactaatgtccttttgctgttccaggatccaatccaagatcccacactgcactgatatttttcttcctatccatttcagattattcattactgctgaaagtaaacaacaatttgatgaaacacatcttaagtcatctctcctttaagcacatgtcccccattgcatccatcaaccttccctcacaatgtaataagaatcacagagaggagctaaacaactgggcagcttgtggtgccatttatgatgtttcatgaaggtaggttctgaggatgacatggtgaaagtggagagaaaatacctccctgtgtggttggccagataatagtcctcaaagacacccatgtcctaatcccttatacattaccttctagagcaagagactttgcatatgtgattgagttgaggaccttgagatggaggagattaccctaaattatctggtaggtcctaaatgcaattgcaagtattcttttaagagagacacttacagaggatagagggagactttactacactgagagggaggcagtgtgaagacagaggaaagagatttaaagatgctatgccgttggctttgaagatgcaaaaggagccatgagccaaggaatgcagccccagaggctggaaaaggcaaggcaatgaattctcctctggaggctccagcaggaatgtggccttgtgcgcaccttggtttcaggccagtgaatcctattttggacttctgatccccagagctgtaagagaatacatttgtgtcgtttgaagccaccaaatttggggtaatttgttacagcagccataggaaaccaacacatcgtgtcatttagaatagtgggcactcgagacatactcattgggcgaatatacccaggtgtatctccttccagaacccactacaccatgcagtctgaaaacgacaatgtaccccattcctgctattttctggtgaggatattaaccagcctactagaaccaaaaagttctttagaattatctagtatatgcttggcagggtctaccaaagcggtacacatgccatgacctagcaatttcactcctaggtatatttccaacagaaatgtgaatatatatggtcaccagaagacctgcatgagagtatcaagggcagcactgttcatagaaggcaaaaactgaaagttattcaaatgttcatcaacaataacatggaaaagtcaatgttggtgtacccacacaacggaatgctacacagcaataagaatgaacaaactacagctgcatagagtgagctgggtatctctctcacaaacttaagtagagcaaaagaaaggagacacaagagagtatggactgcaggattccaggcacatcaagcagaaagcaggcaaagcacatctgtgccatgagaggtcaggatggtggctgtccctggtgggagggaacagaaggggacttctggggcatgggaatgttctatttattggtttcagtacaggcaacatggaggagtttagcacgtgaaaactcaccaagatgtacacttaggacatacgcacattcctgcctgaatatgacagtgcaataaaaagttacccaagaaaccccagtttggaaacagtccctctgccaagcccatccactcccaagctgtgtgcagtggagagctgggcgaaatgcctaacgggacaagcactgcaaatgaggtttgcctattaccataattacatctctgggaatgtgcaaagccctcattttcccttcatgtctataatattgtggggacacaggatgcaattacagcctgaaatatgcagcttaggaagtataaatacacacatctacgtagacctaggtaaaccgtgtgcctttacagagcacgaccgaaccagagcccgcgctcttcctcctgccacccagccgtggagcatttggaccctttgggctgctgtctgatctaagacggcagctctgaggatcaattcccctgagcagacagttttctgaaccagaacccctaatttaaaaattgcctgaagaagcagaaagtaagaactggaggaacagtaatagttatcactgctaattttaacaccaacaagatcttacattcggggaaacgatctcccaccccttttcttatttgaaatatagccttcttgatcataatctgtcattcaagaggagctggatgcaagtggattggcagtaggagaggaaccccagggaaagaccaaagagcaatgagcaggctacagtcaatttgattttgtggattcttccagggccagcacttgcggaggttagagatgccggaaggggtccaggtcttgggtttgtgtgtggtttatttccctcgggcattttcaattcatattcctgctcccctagatattcaggcccatgggcagcattttagcaaatctgggcttgtttcaacaccagcccaagcaggcacagaccagaagagaaatctgttggtggtggggatgctgggggcagcgagcctgatctgaagtggggaggctccctcgatcctaatatacaatatcccaaaacaaagtgaaaataaagtttaaattaccttccggtttcgatgatctaaatcacacctcccttccagaagtgtagataattggagttgactaaattgtgaaaatatctgattttttaaattcattgtgtacaagagtgcccccaccccgccccttctcttccccatgcccctcctataattaacctacacatcagcatataataccagtacccaatgcagtcacgatggcaaccgatagcaagaatacttatggctgtgtacaattcagatacaactgtttaaattccatttggctgagtactgtggctcactccggtaatcccagcactttgggaggccgagttgaggggatcgcttgagcccaggagtttgagaccagcctaggcaatataatgagaccctgcctctgccaaaagttttttaaaaacttaggcaggcacagtggtacacacctggagtcccagctactttgggaggctgaggtgggaggatcccttgagcccgggaagtcgaggctgcagtgagccatgatgatgccactgccactgcactccagcctgggtgacagactgagacactgtctcaaaaaaagaaaaaaaaaaaaacctcaaattgtaatttctctaaatattttcaaaaatagctgcatggaaaaaattagctctgtgcccacccttctctcctgtggctctgtggggtccacttctcaagtgacagcttcataggcttcccagaggttcaggtggcaaagaaccttgggtgatgttttgccagctggaaaccaaatcaagtcaggacaactggagatcaggccaccagctgagaagtgtgggactggaaaagtcaaacctagcaggcaatatttaaattcaaaattgagtatatgtggtcacagcctctctaagcctcagtttctccctgtctttcctttactaagaatgaatcctaccctctgctaatcccacacatcacccaccacaaggatgattttggtttttcagtaaaacaaaagcagaggggggatgggagcagatcctaaacgtttcagaatggtgttcacactattctctcttagactcatggtacctctgcacacagcctctctttgtaaggctgaacaaacagaagcaagcaaccaagcaagcagaaagatattgcagccccaaaaagtaaaaaataaaaaagatgaggataatcacaagaaatattttcctatgagatagatttaccaaaaggaaaaaagaaagaaaatgtctgggaaatgtcgtttttcagtaagattcaagaggacttttttctgaaaaaaatcaaagtaaacagcatctcaaaagcaggggtcagcaaacttttccattaaaaggctagggaagaaatatgcttggctttgaggccacatggtctctgtacaacaaggcttccctaaatagaaacaatatgtaaatgagggagtgggactgaatctggcctcttcctctgatccagagggaaggagctgccctcaggtaaggttgcatgaatggctgaagttaaaacctcactataagaagcaggaagtataatgcaaaaaagaaagtgacagacgcacttgaaaagctttctcagaaataagatgacagtgaggaaaacaaaataagatctggaccacaaaaccagacaccccagtatgtacatacaaggagccctccaaagagaaaacatcacagagcagacatcttgatgagaatgataataataatagtgataataaaagcctttcctgcattgaaaactggaggctatagattaaaagaacatatttaaatccaagggaaaagaaatcaagtcaacacacatccatatcctaataaatgtttctgatgtgtggagaaaattctataaaccttcagacaaagtaaatgaagagattacctacaaaggaatcaaaatccaacgggcctcaggctcccctcctgtattcattgctctaagacagcggagtcatttcaacaactttgagggaaagaaaaatactcagtcaagtctccatttacatttaaggttgacataataacagtctcaggtatccaagggcttaaatattattcccttcatgggggaaaaacaaagtcttaatggcaaatgccgatctactaggggacaaatcaaaattaagaaaccacaggtggaaaatttacaatgttgcagatctatgagcaatgaaaagctattaaagttgtccaaatacttagtataatttcaattataacatagtagaaacgtcaaaaacagtgtttgaaagggatgaatccatgttgaaattatcataatgtaaaaataatacaggtcttaaaacctagatcatattaataaaaattggaagtagggggaggagaaggactaaaatcatactgtttaattcttaacttcgatgctttagggaatgtgggtttaaatgtgctttcaaaaacttaagggtaaccactattaggttaaaataggatgaatactttccaaatcaccaaaagggaggaaagcagagaaagtccaacccacatagcataattaacaagtgataaaaaggaaataggaagtaaatgcatcaaaaagaaaaccaggaagcttaaagacaaaaaacagaaaaacaaggattgtgctatgaaatattaggctgccactaaaaaccatgtttgaagggtacttaatcacacaggggaatgttcacaataaaaagtagagatgaaaacataatatgtacatatatatactctcaactttgtctgtatttaaggttcatagagaaaaaggcatagggatatactcaagtatcttcttttatttaaaaaaaaataattattattattttgtacagacagggtctcactatgttgcccaggctggcctctaattcctggcctcaggtgatcctcccacctcaacctcccaagtctttggtattcacaggcatgagccaccacgcccagcattaataattttttgaagatgatagaatttcaggttattttttttcttgtttattcttgttttatattttccacaaataacacacatttctataattttttttttttttttttttttttgtgagggggaccgagttttgctctttccacccaggctggagtacaatggtgcaatcttggctcactgcaacctctgcctgtcaggttcaagtgattctcctgcctcagcctcccgagtagctgagattacaggcacacaacaccgtgcccagctaacttctatatttttagtagaaacggggtttcaccatgttggccaggttggtctctaacttctgacctcaagtgatccaccccccttcagcctctcaaagtgctaggattacaggcgtgagccatcgcgcccagcctgtaataattcttaaaaacaatcaacattataaaaaataaaaattgtagggtaccatgaaaccaagctgattgttcttcccaggggaggaggaagggccagagaggatttggaaggtattatccagcacaggttaggtttgatcagtcagtggatgctgctgggttggaaactggattttccatctaccagtgcacactcagccctcagtattcttagagcacatgaggaaaaaaaatcactattaagctttaatttccagagcccttactgtgtgctttgtgcaatgtactttattctcacaacaacccagagatgtaagtatttttagcccatttgacagatgaggaaattgatgccagagaggataagagacttgcttaaggttacatagatgggaaggcaagctgccagggttagaaaccagcccgtttgttgaatccctaataataatgtgtccccttccttctggaagttaggcagaacttgtgtggacttcactgctattattttttaatctgctcattcttccctctggcttacggggacacaccatgagggccactgtctcttactttcagctggactatgaatccacatgcccctgattctttcacaaagatgctgcaagccacccctcacaagggcttcctgagcagacatcttattccttccagtccagcatcagtggataaaacagaactaaattcatcgctattccacccaccccaacttccttccttcataaactagccacagagcagaggcccaggagcctgtccaatacatctcagggtcccaagtacttctccccacaccagcctaggaaaccagggctggctgtcagcaaaatgaataaaattcctatgtttgcctaaaaggcaggggaggggagtggagagcttacctctgaattgcaatgttactaggacacagtttgctgtaataataccaattaacatttctccccacttaatagtttctagtacaggataaaaatagcaatacacgtggtgctgagatgcgaaaaataacaatggaaatctgctctggaagagtcctgctctgtctcaccagggaagggtgaggaggtaagtgggaatattaggggagattcaggagggagctgcagagaacctgctagaaattaagagtctgccattgtcttacttctcttctgtcctcagtcaccagctataccaccagaaggcccctgtggcatggcgagatgccgtccggcttggaatgagaagagttgattgctgggtctccactctggcactaaccagttttgtgaccttgcctgagtcagggaacctctttaacctgattccttatctgtaaagtaagactctcagcacctgcatctcaggtgggtgtgcatcgaaatacagtgaaagggctttgcaaaatatgtggaatatgtgaaaaatgtgtcaaaatgctttgcaaaatatgtgaaagggctttgcaaaatgtaacccgagattcacatgtgagggtaggtccctaagaatctgtagtagtgatgcaggtggcacttgccaatacaacaacctttattgatcaacaaaacgaaaattaccaggagttagtccctcccctcagcaggactaaaggatgccagtggtgtaggcattctatggcgcaagctcagcggacctacccttcaaggaccagcacctgtctacaaaaagattcctcagatggaaacagctcttcctaaggacgagtgtggcctggccagaagcccattttcctcaaagctctgatatatttggctaggagagaggatgcccagtcatgctggagaaatttcctggaggctggcttctcttcaatggctgtcactcagagcctgacccagccccggggagcccaggtgccatctatggggagggtgaatgatgaggcactggaagtttccctccctcctttcattccctccaccacttgcatcccccactccccagacctcaccccaacaactggacacacagcccatagatagggtgatttcacgattcagtctagacccccccaccaggcagtgtggaggctggggcctctagttgtgctgcattgggtcccctgagctcccccgaggtgtcctaggagtctttggggaacactgggaaaactgagagggaagctctgaaaccacttcgtacccaccaacatacaccctcaacctgaaatgatttttaccagtttaatgtttggcttccacataagattttatacaaagaaaaggttctgtctctaaactctaaaaagttttacaatctttgttcctggggcttataagaatccagggaaaggggaccttaccttggtccttggattggagtgaagtcacctaaggacccatccaaataacgaccatgttttattcctagtgggaaaatgtagtccaacagtaacaccatccaaaatctctctgggcatgtggctaccacacctaagtacaaggaattttctgtttcttggaaaaagcccttcgtcctctcccatgtgctgtcatcccaggatcatggggcctgggaatgtcagttcgggccagatgagttcaagtgagcaatgtgttatcacaaacttggaaggggagacaggaagcaggtttggtgggaaggaaagaaagcagaaagacccagaggagaccacttttcctgcagagctggaggagagagggactggaagagcccacagagacccatctgtgtttttcaaaacgcatttttagaaaaagaggaggctagggaaacagagacacctgcttagagccagagaacattcccttcgaagggattcaaaagcacatgggcaacacaagccactgtgccaggtacccacgcaggtcaggggcctggtctcaacttgggaaacatcaagaggccagcaagctgaagcccctcagctcagcttctcccctcagagacgaagaagctggaagccatcagccagctaggcagaaaggggtcatctatcattgcttggctctgaaagatcttagagcaagaaggatccaagagagagggccagtgtgaaagggggaaatatgcaggagggacaatgtctgacattttttggaggctgtaggtctcgggcaggagttgtggctgaccacactcagctcagcctgagcccaacagggcatgatgaggacccgtatgggctctggagccaggagtcaggccctgcattcaaatcctgcctccagagcctgagacatgtggccttgggttagctctttatcctgtccggacctcagtttccttgagcgtccttagcaacgataagcatatctactttgtagggctgttctgagggttgaaagagttagcagatgtaaatcacgcagagcagcatccacacttggtaagcctgcagtcagtgttggctggagctgctgtggggaaacccccttcacgctgagccccattgggtccagccctcccaagatgcaaggatggaggtgggtggatgaagttcccctggtggcagtgggatgtgaacagcacccccacagcaattctctttatgtgtaaccccctccctcgggggcagtctctccacttccatcttttctttttctcttctctctccattttcctccttttttaactttttaatcactttctaagttctccccctgtgttcttttagcagatttgcagagccatctatcaagaagcttaaataatgaaggaccatagttgcaattgcctgttcacaggctcttgggctttctgggtgattagaggagactcctgctgggggaagctgcctgactagaatgttttctaacctcttagagaagctcccatggctgctatgccttagctgccctccatgatcattagcgactccctaagcagcccggtcaggtaaactgcacactacttgctccacacatggaaaagcctcagagggactgagaagtcactggtgggatggggactgagagtccacagcccctgaggctgcctgtctcccaattcatcaagtcacaaaataagatgaggagctcctagcccacctctctggggtcatctccacagctctgcagagtggctggtcttggggccaaaagaggtgcgagggtaattgacctatattggggggtgagtttgcattatttttccagagctgagtccgtcacagtccctcacagccaaggtgacccattaggcaagagctcagggttccgcctgagaccgtgggccagaggtatttgctgtccccctgcaggggacccgtgaaagaccttggccttgttactatactgcttcatacaacttgatcgtcccatcctaggctctgaaaactggtctgctcaccaatggtactcaccaaaaacttctttgaagatcccacctctcagctgggcatcatgtcccagtgcatgtcctaagcacatcctgtgccaagcacattttctggtcttcagttcaaaggtgggaaattaacacacagagagagggcaaagtaactgccaaagatcacaaaattaaaagacgttgaacctagggacccagactcccagcctattcccatgatggcccaagagaatattcccataggtggtatgggagtaagttgtttcggtctttctaatacttcaaataacctcattattcaggatggtggtgtccaagtggtgaaacagaccatccctggatggcagcactaccgaggaacacacttcttggctgtgggatccttttgctggctcactttggaatgccaacatgttccaaatctctccaacttaatgaaacacctgtcccctctaatgccatcagcagtaactgcacatggctctcacacttgcacacacatgcacacagctccagctggctcactgggtggttccttgggtacatctggctgcactcctcaatccatcctggtgtgaccgagttggaataaaccccccagtccttagctctctggaataagagaaagttttacaaaaaaaccctgtaatctggtatcaactgggcctaagataagcctcaagtaattacaacagagatagacaaatcgtacattcaaactgccaaggctttaaatgacacacacacacatacacacaaacacacatacacacacagacagatggtattgttgaaaacttaaaatataattcatatttacaggacatgatttagaaattgtccccagttactattttgtaaattggtgcttatacatatgccgtatgtattctatatcaataatttttcctaataatgttattaccttgcacactcaatcccagtgaaccctgaaggaaaaaattctcatctcaagaatccaaagagctgaggtcaggtggggaagtcttagccttatggtgaaaaactagaacaggcagtcgaaggggcaggcaatgcttctatcgtccctttttagaacactgctctgtggccctctcactcttcctgcagatgtaggagtagaatgagatgaggagaaagagagaagaatgctttgaaataagttatccaaaatggcagacaggtcctcctccacttttccaggaacacctccctcccttcaacacacacaatatgcacacgcacacacacacacacacacacaatacacacacacaatatttatgcacgactgttacatacacacatttgaggagagaaggaattatgtaacacatcagctgttcattttcacaggcccacttgaaatggagctcaatcttataagtatagaagtctggggtgagcgtctaggaatttcaacaggcactgagaaaatgcccactctgaagcacagaacatggcctgtggaatgctcgaaagcttccagcctggagggcgacctgagatgttagtaccaagggcttcctctccagagcctcagtctccacatatccctcagactaacccctacagagctgggtatctcgtagggaaactaaattgagctcggaaatgcacaccaaccaaaaaaaaaaaaaaaaaaaagaaagaaagaaagaaaaaaaaaagaaaaaagtattttagatccaaaagggagcagtggcacaatgtcacgatgtaatacaagggcatgggttttggagtctgtggatgaagaaatgccttacctccctaagtttctttagggtaaattggagcaaaaatcctcaccttgcagggttgctgtgagggccttagaccatacatgtgtaaagcattgatagcacaaagttcaccatggagtagttgctcactgttttctcattttccattccctctcttcctctccccagccctgactgattggaagtcatttccgctttttcagcagacccagcctcagctgatgattcacctggttgctggaagtgagttctgtttctcaaccctgggattgaagactgactttcaataatttgattgtggagttcttagccttcctgaaacagggctccatttggatgctttgcaaagccaagcagagaacatgtccttccagtgagaaagtagcccatgggtcttcattccaatatacctctgtggtttctcaatgcattcgtccattctaatttttctgtctacctaaaatctccaagaatagaaagaccactttttccttatttgatcatcacatactgcctaaaatcacatcttgctcaacagtaactgttaagcggaagatggcagtagtgccaggaaattatcagaggaaaacagaaacaaaacacaacataagcctggtcagtcacagtttcccttgatcagtaaacaaccaaggtcggtggtgactcccctttgggagagaggacaccatttgccactgtcacaactggccctgtatactgtcgggttcagtggcagatcttctcattgggttctaatagctgctccacatgccagagccaccaaaagcctctctgccttgtccagttaagacaaagatgaacttctcaaaagttttttatgcccaaagctcttccaaaaccaaggggaagaaactctgtatataatgaaacctcaaataaagtcaatgacactgagaagtttacagagggctcctctcaataaatatccaagagggagagctgacagttgtcttgaccagtagagttcactgggctcagaaacaagggggggcctgtcctcaccccatctggcttggatcagaggacctgaagtgctctagttgggaatgatggcaaagtttggtgggattgtcagtctttgtaaaaactttctcaccttctctttggatgtgggcctctcagtagacctatctggtcccaaaatgccatcccccaaacttcacacctatccccaatcagttttgcagatgttttagaggaatctccacttgtataggtagaatcatgccccctccccaaagatgtccacatcctaatcctcagaacttgcgaataggttacctaacatggcaaaagggacttggaagatatcatgaagttaagaaccttgaaaaagagagatgagcctggactatccaggtaggcacactcatatcacatgagtccttaaaagcagagaacttttcccagccttggtcagagggagggagacttgactatgaaagaaaggccaaaaacatgtatcactgctggctttgaagacggaggaagagaactgtagctgaggaatgtgggtggcctttagaagctgaaaaagacaggaaatagattatctcctagaacctccaaaaagggatgagctcctggaaaggcatgaagacctgccagtgcctggattagcccagtgagacccatgtcagatttttgacctatagaactgtgacatagcttggatatgagtccccgcccaaatctcaagttgaattgtaatcctcagtattggaggtggggccttggggggtgtgattaaatcatggggtggatttctcattaatggtttagtaccatccgcttggtgcggtttttgtgatagtgagagagttctctcgagattttgttgtttaaaggtgtgtggcacctcccccatctcttgctgctgccttatctatgtgacgtgcctgctctcgattcgccttctgccatgactgtaagcttcctgaggcgtgcccagagccaagcagatatacaccctgtaggaccatgagccaattacacctcttttctttataaagtatccagcctcaggtatttctttatagcaatgcaagaacggtgtaatacaaatagaccgttgtgtgtgttgtgtgaagttggtaaatttgtggtcatttgtgacaacagcattaggaatggaatacactgcccgttcctggtgaggtgcccctcttccttcatcccttcatggcccaacttctctgaaagtgctgctggctgagtcctcccatgggggcacctcacctgttactcccagcgatcaccttggccctgctcctcatcagtctccttgccaggacagcagcagcagcctgttctctcctctctccagtttcaaatggccctggttccttaaagggccttctagatcttgtttctaatccctgggaccgtttgagttccaaacatcacttgtcagaaggatagaccacagatgccttggagtgggaggaggaggaggggcgctctttcaaactctggttcccccttcacccacttccccacatatggacttgtaaaacaccagccacctcgctttccataccaaacaacagtacacgcaagaacaaacaagcagggccacggcctttcttactggaaccaggtatgctttctggcttgtttgttttctcagaatttaaaaatacatcgagtgtgctttattgaactgcccaaaaagggacacacctgcagcacctcataaacttgtttgatcaaacaaacaaaagccaaaacacttttctgatggagtatttctcggaacttgtactctgcagaaaacactctgtaaagtttgcttgtaaccacgctccattatcgtctacaagcctcagaagtctgaggaatctgagcccaccctgacctttctttccgattcaatctgcatacttgctttttgatcatgaaaataaaaaaattttgccctgatacttttttccccatatcttcatttatttttcttggggcctagcaaggtcttttggcaagaaaatccagatcttttctcgctcagaaatattttccttattggatttggcttgtttcttaacttgctctggtcagttgcacaagagcatcaattatctatattttgctggattcttcatatctaccatggcttcccttatgattatcatatttttaattccctccttgggcacaaatgcaaatctttagaacaaggaaactgggagctgaaaagagagaggtaagaatttcagaggaagaaggaagcctctctcaacagacagcagcaggggcaatggcaggagccagggcagtgcacgggacacacccccagccgaccgcctcccaagcctgctggggctatggaacccaattccaggctgtcagcagagacaaatttagcaccgatgatctcatcttgcagaacagccccagggctcagggaaacatcactggaaaagctgggaagtggacgtcactgctagtcccataatgtaggtgaaaggcacagggcccctctctcagctcactaaaagggagcaccaagaccacaaggagcaggtacaggtgatggtgagggcgtggccagcggggaacaggctggggggtctggggcattactagcctgctctcctcagagtccccacaaccccaagcacagtgagctgaagttccaggacaggtccacagatacggacacacttcgtttgagatgagtgacaaacagtactaaacattatcattgtggagttacagcttctcctgtcaggcccacatcaggatgttacgtggcagagtatttacaaatgcagcagcaggcagaaggtagagagagtgggggcacattccctcttatttactgaaaataagaccaaatccctgcaaaggggggcaaggatcccttgtctcttgcagtgagtcagtggcagaaaaagatgagaacttgtcaccaggtgcaaaccccaaatcttgccactggctcaagctacctctgcatggctctgaagttggtttttctggcttccttagccggacacttttgctggtcagtttccctgcagtttcttagtgtgtctggtggtcagattctccctcctgttcctggagcaaagaggcctcagcggctcccccagtgtttcccaaaagcagtcccaggagggcagtggcggcaggtcctttgctgggatggggacccctgtctcctgcttctgtagctaatggacagcatcccatgaacctttgtgaagaaggaaggtatgaaaataactaagaaaagcagacttgacacctctcacaaagaaataaatacatttctaaatgtcaaataaacataggtacttacagaaggcaagaccctccaaaaagagtggttcgtatcacactgctaatggggatggatagtgatggcaaataaatattgtcacgttaaaaaggccaggtttatattcaagcacaccagggccactcctgtgtcagtttcagtcatattagagaagatcagctccctgagaacaagggctaggaagctaataaattccatactgggaagtgccatgggaacgtaatgaggggttatcagagaaattagaatgtgcaagactccgtctcaaacaagaaaaaaaaaaagaaattaaaatgtactgagaatttggggtggccaccaaaataaaacctctcccacccaagacagcatgaacattattgtggttaaaggaaagaaagttcaacaagcaacttagaacagaactgacagcatctcttcaagtgaagacttcagagaaagctgcaaacagaaatgacaaaaaacaaaacaaaacaaaacaaaacaaaaaaaaacagggcaataaacacctagaaggcggcattagggctgtgcagcagagcccaaatgcaaaggcagcattagcagtggaagcaaagaatccttacggggtcagacccacagggctgagccaagatcagatctctctgtctcacacacacacacacacacacacacacacacacacacacacacatgcacacaccagctgcagcactagggcgtttgggaaagacacaaaattagtttagattgtaaaacatttatcctgtagaggcaacgtgagatttttttctgtagttcttttaattaaaagtgagctcataaatcaaagcccctgtttccagcctgcaggaggtagtaggagtgaacctaagccttgcagagctgagcctgccccgcccatcctgctttccatcacccaggttattcaccccaattacaacaccgcacatgttacagggactcagtgagtagccaagggtggctctgatgaattacatctcactttcttcactggggtctccgaagttctcccaaagagatattgagcacatgtacacacacacacacacgcgcgcgcacgcacacacacacaattaaatcctatcagaactggttagtgcatctatttggagcatctgctgtttcccctgcagagccccacctctggagaccttcccctcctctgcatttctaccttgcctgggctcacatggctgtttgcatttgtgagtctgaagactcttcttagaagttttttaaacacagaaagtcttatggatccttgccatcttcttaatttgttttaattttttcctcctgggtgaattaaagaatgttctacagacatgaagtctcactaccctcagctcattcataagagagatggagggagggtgcatacattaatatgctcattactccaaaggtgacatacgtgtggataaagaatttgtcccaaaccagaagtgcagccagaaacaaagttaagatttcctggatgtcggttccaagattttaagccacacccaggcctggctcttaacaatttagagggatggctggccccagacacagaccagggcagacacctgggcatgaagattgcaggagtcctaggagcagtagtgggaggcagcagggtggcccacagtagctcccgttgcccctcccagccctccttgggattgacagaatggttgccgtgaccagcggaggaagcacattgatttcccattttcaagctgccccccagctccaagcatcttagagctctttatgtgcccatactcacatgtgttcacagttttagtgggaaatgaggacaaagaaacggaaccccctctaagagagaaaatgttagagatagagatgaacttcatttcagcttcctgcccggtatctacccttgatgccaggaaccgctctgtcactgcatcccccaatcccactgcttccttctgcccctgcccccgcacagaacaagaatccagacaaaagcacaggtcaagggagaaataaaggtcccccttcccctgacccaactccctcagaaacaatcagattcaaggcagagagattaaattatcactaagctaattatgggactcacacttaggctggctgccgggaagcgaggtcagcaagcaagagacattaacatgcaaattgaaggcagatgcaaggagcacttaaaaaaaagcaaccgggagactgattccccccacacccagaggagaaagaagccactctggtggttgaggcactgtccatctgggcaatggtcagggcatttgacagctaaatagctctactctgtcatcatcctgaagccaaagtgggcgagtcagaggtaaactgattaggtggtgtgccgctaatctcccagagagaacatgagggaggtggatgcaaggcagagcccagcgggagcagccccaggcttgagtgcagagaaggctctgccggttcctatgcttgcatgtgtgggtgcctccctgtgcgtgggtgaacacaggtgtgtgtgtcagctgggtgtttgtgcatgtttatgactatggatgtgtgtatggagaggggatacagaatcaggcatgtgtgagtatatcttatccacctgaaaatagaaggtgaagagcttagacagaatcaaagtgcccctcctagcataatagccaccgggcaactccttaagagctttctgagattgttaaggcccctgcaattgctgtcaccagctcagccatgaaaatacatattatggtacccagttatggatgactgatgcttccccaggcatcatcaatatgatgcgagtttaagacatgttggccaaaaacttggcagtctacaaaatgactttgagagataaaaatcaatgtttttcaatgcaatctgcaggatagcttcctccactcaggattctgactctgcaagtctcttgccttttccagagaggagcaggttggcagggaaccctgatacggaggcatgtgagcttgttttaagtcagtagacagctttgggttccttgtcctgagaaatggaatttaatgggcaatatcctgcctgtgtccagagtgaatttttggaacccatggttggcaaggggggttcagaggggaagtgggggaatctctggagcttaaattacttagggaaaattaatttggaaactttatttaattataggtaaaagaaatgcttccataaatttgggtaatttaattatccaagagacatctgctgaacacaatctaatcattgtatttaagtagaaaagtgccctcactcttaacaaaactaattttggggagatacaaacattcagagcctgactaatgaaagaaaaggaataatttcagtttcagttttaggaggaaaaaagtaaatcacaggaaaatcatctgagagaggatttagttttttaaaaatcttcaacattatatctggggttgatgatataaaatcagccatatcctatattttttgcacatcttctccaatactaagcaaagaagagatcacaagctctttaagtcaagaagtgcctagcgcattttagatgaccaagaagatagttcttgactgaatgttgatgttcacaaaaataaaccttatgataaactgtatggacagaattatccacaaaatattcattgcccttctctcccacctccctgcatacatacacaccagccccctccccaggctccaggcagggttatattttccacaccattcactttggctgggccaaaaaaatgggagtgggccaccaccaagcagtagctttaacaaccacggcacggttctgccatctctcttttcctttggccatgagatcaacatgtcccagacaggggctgcccttccaagtctcccagataaataacatggagcagggctgcagccagcccagggtgcacatgaacgtgagttgaaaatagccttcgttattgttgttgtaagccacctaaacttgggggtcatttgttactgcaacataatgtagtctaagctagctgatacacacacacatgcacacaggcactagaagaccctaagccccagtggtccatcttcaaatacatttttttattcagcatttgttaccttcgggcagtactgtgggggcaccttcagtttaattggaagaaggtataaacacactggggaaatagatccagctatattaatgaactgtattttctatgtgaagaaaatgaacaaattcctttcagaaaaacatctcagctacaatgttgaaagcttctattgcctataattttggggtaatcaaaatgtggctaaataaaaaccaaatttataaaatggatacattatgaggctattaattttagaaaataattctccattttagaaagagattcattagtttcctacaatgaatccacatttcctacccaaaaagagataaagaagcccacagcctggttgaggcagggaagccatcagtactatcagcatccctccagccatggcccttcctaggtcacagagcctctagggtccccagctgccacactagctctacttaaggtcaacattgtacaagttcaggcccacctagggcataagccaacactgcctaactaaacctccctggatctaagaaagactcattctctaagtgaggtttaagatgtatctttctctcccaagtctggtgtgtctgggaaaagacccagaacaactttgatcataaagatgaaataaaataaaatattccaggtatgctaacctgatgcattgaaaatatggttataattacatgcaacatttaaaaaaatatgtttactcatcacaagtgatacttgtagtagaggaatcctgtctgagacagaaaatcatggataagttttatgctctgtgggggaaggaagaacaaaagggacagagctgaattatcactggaggaaatgttggtctgttgcagaaagaccaatgtaaagaatgtattgacttatagatttttaaaggtagactgaagatatctaatcattttcattattataaaaaaccacgatgtatataaggcacccatatatgatcttaggtagaatcctgcctagaggccaaaatggcaatttgtatctgagactcccatgggaatacctggaacacagtaggattttgtttaagttttggatgcaatgatgagggcaggtcgtcaggtggcttcaacatcattctggcctctcaggtccaacaatacctgggaacactcagatttagccacctccagccccagaatactcatatcttggtggggaggtaaaagtggttaagcagaaagacaacccatctctttccttccaacctccttgccaccaaagcctcagaagccttctccagcaggggagaaactttttggaaggcagctcaaaaaagtctcatggccagacatggtagctcatacctgtaatctcagaattttgggaggccgaggtgggaggattgcttgaggtcaggagtttaagaccagcctggacaacgtagcaagaccccatctctataaaaaatgttaaaaattagtggagcatggtgacacatacctgtagtcccaggtacttcggcgactgagacaggtggatcgctagaacccagaagtttgaggctgtcatgagttaggatagcaccacttcactttggcctgggtgacagagcaagaccctatctctttgggaaaaaaaaaaaaaaattcccaaaaggaaaactgggactaggtgaggcactgggagtgtcagagggcagccccaaggaagggagagcctgtgaggtggggtaaaaccccaaaccaacacccatttctcacagatgcaacccttggagagcctttcctaaaaggactcaaaagggaaacccaggaagccaacaaaatagagctgggtccccatgcagctgtgccataacacagggcaaggggaatacggccttccacccgcaccttagtgagcccgggaccccacaatgagcaagggagagaatgccgcccggcagtgggtgtccaggagtggttttggggggaagaggattgctctttgtagattctttgcattcttttattaaccatttttttgggatagggtctcactctgttgcccaggctggggtgcaatggcacgatctcggctcactgcaacctctgcctcctgggttcaagcgattctcctgcctcagcctctggagtagctgggactacaggcatgtaccatcattcccagctaattttgtttatttttatattttagtagagacagggttttgccatgttgcccaggctggtctgaaatccctggcctcaagtgatccaccctcctcggcctcccaaagtactgagattacaggcatgagccactgcgcctggcctctttgcatttttttaaaaagaggtttgactatataaagaactatgtacacttctgaagtagtctccctaacctcccattcaatcatactattaccccaagtccccatatctataaagaaatagcaaagccaacacggcctcaggccttcctaactccacatcatcctgagcaaattaattggtcaagataacatttgtgagcacaccttcactaagttaaaagtacaatactacagagcgacaggaaggaaaaggtaagaatggagggggtgaaagtgaggaaagtaggcaaaggattgtgagaagagccgagaagctcaggtttgggggatagacactcagaaggaaaaagaaggttggatgtgctggtggtgacaagtgctccaggtgactgggagtcacaaggagactggctaattaggccctccattccagagcacttgcaaagcaataatgacccgtgattaggaagaagctgtcatcctccaaatgggtcaagacagggaccgtggataacccgtcacaggaaaaatcacccagaaccacagcacacagtcccacaggctctaggagggacaattccggtgagaaaccaagacaaagatgggcccagtctgtcacaggaaaaatcacccagaaccacagcacacagtcccacaggctctaggagggacaattccggtgagaaaccaagacaaagatgggcccagtctgtcccaggcagcaggccaggggtaagtggaaaagcacagctcggctgcctcctggaaaacctcctcccctccctgtggccacctcccactcggccacgggatccaagctccagcataattgctctcagaaggaaattgcccgtggaggcaggttggtgatgtgagagcagccatggaggcaggagtcccgtcgtttctaaggtgggagcctcttccttggtatttaaatttagccagggcccttgaggactcgaaatgtgaaggccgaggcagccagctgaggctgaatggctgagccagggacctgagtcctcagcatgtcaggtccacttccatgcaagcaaagctacaggcaaggggctgcagaagggtggatgagacaagtccagttttgtttttcttggtgacaagggtgagaggattagaactgctttaggaagctgaatctgccatctaggatccatccaaactgattttcctgtccctaaagtgctcccctctttaatccatcccaggaagatggattaaagaggggaaaatcagtttcaaccgccctagcatggacatcagggcctgagacagggcagagacagaacagagggaatgaaaggagggttctgagcaacaggctccagggtaggtaccagaggtccagccaccacctcctccctccatcagggaggtgacctaccctacagcccaggagccaggccttaggtagagtctgtgatattactcgatacgggtcccaggacaacctcggattagaccgtgtgacctctggggagttacccaaccccttttctcctgggtaaaatggaaggtgtaacatttaccccacccccaaaaaaaaacattgaggattacatgtgacaatcaatgtaagtaacatgtgaaaacatctagaacaatcctggtgcctacacggtgttcaaagctcagtagttccctctgcaccacctcttttctgccagccccaaacactaaggaaacgaccccttcctaagatgctgggtgcctccccacagaggccaaaggcagaagatatggattctccatggccacacagagttctcggcagctactgattcaaaatctaagcatctcttgtccatcatcgagcactgccctctctccagatgaacggagcacctgggactgcctgctgagcccccaggcctccttgttgaggaagtttcctcacccctggtcctgtgggtgtggcgactgcttcacagcctcctgtttatcctctggattctctactgtgtttgcacaatcaaagccacaagccaaaagacaggattcagtgcctgggccactggtgttcctgaggaaggccgtgtccttttccacactactaaaaatgaacttgaagtttgaaagtatgggttcaagtcccctcaatggctgagaaacaaagccctcatgtagaaggcagcctccaacatagcccccagtgatccccacctctgggtattcatgacctacagagtcccttcctggagtgtgagctggacccactagctggcttctaagacataatacagcaaaggggatggggtgtcacttctgaaaccaggtttcaaaaagacaatggcttgcaccttgctcagcctctttctcgcccccatctctcagacatcgttctagagaagcctgctgctgcactccttgttgtgcacgtggcctcatggaggggcccacatggcaatgtagggatctctcaagtgaggacctgaggcttgccaacaaacccgggagtgacattggaggtagactcttccccattctggtctttagcagtgggatgactgcagccccagccaataccatgaccctaagccggaggacccagctgagccatgcccagattccagaaccacagaaactgtatgtatgataataagtgttgttcaaagcctctaagttctggagtagttcacggcaatcgataactaatacacctgtgtctcctgggccaggagagaaggtatggagtgagtgtgggagcttcgagaaactttttttttttttttgagatggagtctcactctattgcccaggctggagtgcaatggtgcgatctcagctcactgcaacctccgcctcctgggttcaagagattctcctgcctcagcgtcctgagtagctgggattacaggtgtgcaccatcatgcccggctaatttttgtatttttagtaaaggcagggttttaccacgttggtcatgctggtcttgaactcctgacctcatgatctgtgtgcctcagcctcccaaagtgctgggattacaggggtgagccaccgcgcccggccgagagacctcttttaaaaagtcaccatggatgcttctatgagaagccagaactgctgcgaaaagcagcaccatgacatcatcaataagcaagcccagtggacacattcccaggaagttccctaagaacaagtatggactttcagcagaccccaaatcagaacatcaactcatgggctgtgaattggtccaactgccactgccttccccatcagagtggctgaggaaatcatagcaattgccggtaacaaagacctcccctggctctaccctcgctaggagtcttcactggtattgacatcaagattctattctcctatccagagtctagcaggtgtgagcccagcagtaaaaggaccacttatggttgggggctcattccctcttcttgcctctgcctcctccctcttcctctgtacatcatgtctttcatcctttcccatctttgttgtcttggttacatggccagactcctaatatgctgctagttttcattttaatgatatgtttttgtaaagcacaatattttacttcaattgcatgtgtcactggataaattcctctagtgcgtctgacatttgtgtatcagctgactgaatgcgctctatgatttggggtgtttgtgcagcactttcttcaattttaatgtgtttgcattttaatttatgatcaggatctttctataccaatgtgtgtatatatacacacatatgattcaaaaaagtggcacacgtatcaataaatcttgaattggcaaagctcatttaagactatctctttaaatcatgtgcactagcaatgatcacttggaaaacagaatgacaagtgttcctgagaaactctttgctgggatttcaatgtgtgtttcaggaggaagtcaggaggagaatgcaacaatgcctagctattggctgcagtagaaatttcacgatgagaacacctccccgggtttattcaggtcagcaaggagggaccacttgagatcccccagggatgtgcagggaaggtgggtgggcccaagggcagaatagtgagaaatggaaaaagataagaaaagagggccagtgtggccacacttacatcaaaagggtgattgagtgagggcttaatagtgttcaagaatataaaatatgtccaagaggatatcaaccagcttagttgctcttttagtcaactgagtaaaacttgggaagaaagcttaaaacatagcagaagagattgaaacaaggtgggaggaaggcccatgagaagtggatacattggtctgaggcaagatcagtctgaagggccagtcttagaattcccaggctggaaagactaacgacagaatgccgtctgtctgtggttgaacgtgaaatcagaggagggagggtggcacgctggcacacctgtgggatcttctgcctggagcccttcaacctcagcctccccttcacacaacccacagggtaaggtctatgcaggtttaatatttgcaaaaccagggatggaaaatgcagacacaatatagcaaatagagggtcttttcctgtcatggaaatcggtcagccctgatgcttctgcatttctttccctttgtgcttgtgatcaatcacacatgaacccatggcagcttgggctggagaaacatatagcacaacagaactacctgaccgaaccctgtatcaaatacatatgccctctgccctaaccacatgttcctagtctatttggtgttccaacattgtatctccatttgatttcctgacacttccatccatctgcagggctttctgtgctatgaatatttatttttagttaaagtggattcaaatttccagagtaattttaggaagaattcccaggtacatttaggaagcaacaaagcagaggctggactctctgatctgatattgctttgtgacttgagcactgaagatacacacacagcatctgttcctgagaagcaatgttcgccccaggtgggtctccctccactccaatccactcctgggtgattcccccttgtggacctgtgccgaaggactagggaacaaaagcaaattaattttaaaacaggcttgagaaaaaaaaattaggaagattaaattaatctacatgacaattcccaataagaatggtttttgtactatatactcctattgcctcttcatgggaatgtgcacccagtacctattcagagaggctggtatggattagtctgtgcacagacacatggatgcatgtcccgcaacaggctaatagcagggccagccagagttccgcttaaccaacatccatacagcgctccacccccttaggtgtgaacagtttaacctagcaaaaacatccagggaagacgcaatcaccagcgagaggagcaatcacacctcaagtggaagtttatgatgttttggttcacaatgaacattagtctctcccactaatgtcaggcagtaattcaccactgaacagcagccataaaaatgatcgcttagtgaaaggaaagcaagaggcagagaaagcaagagagggaaaagattccagcagaaatattcaagcaaagaaatctcgtgcttctgagacaacactgagctgattgtcccaactcaagccaaagatttaggtttgcttggccctaaagccagtcaagatggcatttgccttatgatttttacctatagtggaaatgttaacagtctgtaggttattgctaagttcctagacacctgcttatgactgtagtatttataggtcatatttcttaacacacatacccttaaagctcaccacaggaagaggctgccaataccatctgcaacacacacacatcagaaaacatcaaagacatctaaattggcactttcctcacctcctttccccccgcttcatgtgacgtgtgcactaaaggagtgaaattacggtcgtcaaagacaaggttgcaaatgattgggactcatgcctttcaagcaaaataaaaagtaattttgagagcagcccacggatagctcggtctagctcctggacccctgaaacccacagcaaacacccttactcttagcatccccccaagctctctcctgcccacctacccccatttccagtctcttgtcataccgtaaagaactctgaaaggtccttgatacacacaggagattattacagggctcagagaaaccaactctgtaattatggctacagtatgatttccattattctcacgccctggcctcagtcacttgcaaaacttccagcaaaatcctcctgcagctccacaacttgtcacggctgggcctctgcccaaaaggtgactgtggtcctgataacctctgggaaaagcaagtcagaattattacaaggaaaggggagtggtgcttagtgagtgagtgggggtggggaattctattgttcaagaaaaaataaataaatgggccacttttgctttttattatttcaaacaacagactcggcagcccagccttcctttcccaactcagactgttcccctgggccagctgtgctgagtctgcaggcacgggagccgggcttgagcaaaaccattaaaaggctgccactccaagcctgcagagcagaaagtttggccgccccagtggcctggctttccccgggaggaccgaaggctcattccccccaactgacccttgcgctcttacctttcaaatgtttatgcctcaccagccccaccactgctctggaaattagatagaatatcccaggtggctgaaacagaactgttcttatatcaacctaccaaagtaaaagatgggaatgccggccgcggtttatgaagccccagcctcttggtggggtattgcctgtgtcacctgtcactgcctgcctgaccgactgctggactctgtccttacctgcctcaggagggttgtctctgagcgccttgctggcccaggctcctgggggtgtcctgatcccaaactcatggtgctgcacttgacctccctgtcggggaacagatttggacaggcttccacaggcaagagagtaccagtcaccaaatgcctcaacccacccttggacaaacagcacaaaaatgcaagttgactatcttgggtttacaatgcagccatggtcaggaaacaccttcctttttccaagagaaaataactgttttgttatgtgcactgaactctcaatgttcatttcattgataacattcactgcccaaccagctcagacaatcacacacacacacaaatcctcatccagggtctactccatcctgccagctagtaaatggtcctctggcagctggtaggaaattcagcgggtaagactcttttagggcaaggcaggaagttacttctacattgcactgagattgagctcaccggagaaaagagttaaagcatcccccatactgcttgctgacttatttactcttaatggtgctcattcacccattgcagcaggtgaagcaggtctcagtgcatgaattgtacacagtaatgcccccggtatttagaattcacttttccagcagaccaaatttgccaaatcctactgaagaatcgagccatctgattcacctgcccaaaagctcatgtacttctctcctcagtgtggactgacgcgtgtcagacacaatttcagagtttggctatctggtttcctagcccaccaaagctggaagctgcagaatgagggaggaggaaaggtgctgaagtcaaccaggattcctggcagcaactggaagtgatgagtggccaagtgcatgagaggaagacccgggaaggcagcaaaaatcagacacaggagctgtgtggggataacatgcccatgtctcacagcgtcttccctgggcatccacaaaactcagttcaatatgtgaacaaaaatcacgaggagtctgaggcagcaaggaaagattccattgcgcttaccattttcttcacagaacggaggtatgaaatacaattctttgcagggaattatgaaatacaattcttaaaaatgtgtacacaatgattttgctgttttttagttgtgacactgaaggcggtccactcaaattaggcagttacttcctcctgggcagcacctgctgtgtggtacatcatggacaccattcttgcagagtaccatggtgtttccccagtgctcattgttttctttcccagtcattacccatagaattactccacacacaagttcccaagtcacaaacacactctggggtgcccgcctcttgtcctccacatgctcccattccagacacaccacctgtccgcagagatgccaacagaaatgattgctgggctgttacattgttggatggtaaaataggcatagtcctctaaatatgcccagaacatttcctcttgaccatccagagctagcagccagaaatacagcaaagggaaatggagggattaaggcttagtctcaatctttactcaatctgaatcacacaatgtccagagaaccccaaaagaagccaaaataaagcaagcaagagctccacatggaatcatcaatatttcctgggaaaggactaaaatgcaattattggccaacaggaaacaggacctcctgcctaccaccttagaaggacttttaacccaatcaagaagggcatgcactatagggccagttccaactcatgagatgagaagcctgaacacaaaacatccctgggcggatgactgctcccaacacagctgatgagccaagatcgcccaggactccagaacctgccagcttccggaagatgcaggggaaaggtcaggtccccagatcataccatctgacctcaccagagcaattttcatgttcccattgcacccgtggttttctcagcccacaacttggctctgggccccatttgcaactttaataggtctgcactttcctccatctgttccctgaatgcattccagatgatgcagcagccagaagggctggagcaaggggaacaggcatgtcccttccccctgcccaccttccccaattgctcagacctaataaagcctttgccttaagggcacaagcccaaattgaacacagcatacaccatttagaacaacactgcaaggctggtctgacacctctcatgtgcacaccagctctagggaggaggtgaatccacacactcaccccacaacctcagcacagaggcagagaaaggacaagatgatcatcatgacctcaacagcagcgtatctccttagctcaaatctgtatcacctgcccacacgcccaagttagcaaaaagatgtaagataacatccagcccaggagggacagactgtcttcacagtaaccaaaagtactgcacctcattcctaccttcttcagcttgccacttttggtgcccacaaaggccagagagtggttcttgtagacatatgcgatgacagacgtcatgcggtccctgtcctccgtgaagacgggaattccacgcaccatgtcggacactcccaggggagcattcatgtccaggccacagaagttatcgtcaatggttaagagctgcaaattttaaaaagagaaaaattagaagggagcgtcaaggaaattggcagagatattaagtcaggaaactatggaggtagaagaatccttagagatgaaacatctggtaacaatccctcttttttacatgaaaaacgtcactccagagaaactaggtgacctgtgaagagtcacctgagtgggcaggtgcagggacatggcagaaaacacaggtccgcaggtctcctttctccataatctgtgtgtctctgcccctcatccaacccctcccagcgccatcttgggagctttgtccatcattattatcatcatcatcctcacgtggaaaagcctcacgtggaaaagccctgggtcagcccagatgagcaggggctccaggccgctctgctcaggcacaagagggatgtggtctccgtatctatacacaaagaggaatgtggtcttcgtatctatacagaagagggatgtggtctccatatctggagcagacacacacatgaggactcaaaagtgtagactagggaactgaaaacattagcatgtaagtagcactatcacaacagaggcatgtgcaggcaatcagctggggaaaggagcaatgggggaaggaatgtgctgattcaactcaatgtgccacagctggtgctttatgagctccgacctcaggctccctgtgtcttttagagcattgtgaagaagggcagccctggccctgccatgcctacaccagcacttcccaaagtgccatccatggaaacccaggtccccgatatgctctacagataaaagggctctgcaggcaaatttctaggaagccttttaacaccatctaagagattcataacgattagttacatgaaaggtctgaaaagtatttttaagaaaaagtatgtttaaccttatctcagcctctcctaaacattttattcactgaaccttttcttccttttttttttttttttttttgagacagggtctcactctgtcacccaggctggagtgcagtgacatgataatggctcactgcagccttgacttaccaggctcaagcgatcctccaacctcagcctcccaagtagctgggaccacaagcatgtgccaccatgcctggctaaatttttgtattttttgtagagacagtatttcatcatgttacccaggctggtgtcaaacccctgagctcaagcaaccaccaccctcagcctcccgaagtgctagcattacgggtgtgagcccttgcacccagctgctaaaccattttgactgcaacacctactagtgttccttaaagagaatattctccagatatcctgtgagatactgaccctgactcgcttgctcctgactccaggaagtataatttcagaagtcaggaagctttggggccagttcccccactgtatttccagtggaatctctcttttttataccaggccatcaggtcccccttgaaacagagggtctcagctgggctctggggtgctggggagtggtgaagaccctggtagtagctggtgaaaagccctcggcactccccacaagcagcttgggtctcacacacacacccctctggggtgaattttccaccgtgtcttggaagggctatgtggtctcagaagagttactccgttttcctgtgcttttattttctgctctataaagatgacggaaacaatccccgctctttgatgggctaccataaagcctattgcactcgtgcctgtaaatgtctttggactttgcagagaaaggggtgaaataaaatacaaggtgtcacttttttaaaggcttcaatccagccaaaggaaagggcatctggagaacagcaggcaggctcttgccagggagtgtgtgaaaccaggccacaggcgttcacctggccccagcaggctcctccactccctcccagaagaggtgcgggcaggcactgtccctccagagaaggtgacctgctcagcatctgaagcctctctgatggctccccttcttcctacagagtagggacagtcagagcgaaaacggggagagcgtgggcaagcctgagcaggccacgtgtagagcagacatccactccaggcctttgatagcctctggcctctcttgcgtggcctggtccaccagcccaggccaaacacagctctctccccttcccttaaaagaaaaaaaaaaagaaaaattattgaccaggcatggtgactcatgcctgtaatcccgccagaggcaggcagatcatctgaggtcaggagttcgagaccaacactgtctctactaaaaaaacaaacaaaaaattataggagtcaaatttacaagggagtgttcaagatttagtctgatctttaccatttttccctaaataaggagatggggaaggagacaggaggcagagggttaaagggaggagtagaagaaaggaaggacaaatccaggcaaaggggagaagatgccctgtgcctgctggatatgaccatggcaacctgccaggccttccaagggcagcctggggtgctaggggtcctcgtggcccttgaatgttcctgcttctggttcacaaggagttcgcatccccaaatttctcaggcctaaactgtgctgcagggacctctggcgtcgcaaactctgtacatcacccattatgatccattttctgagtagatgtggctgaatgattgttcacactgcacagggtggggacactgaggcagggacaaagggagtccttgtttcacagttccccaccacctctgccacaaacataggcctcattagcctgaggaggcttcaggcctctcagctcccaaaattgcatttctgaggggtcaggattactgaatacgattcttccccttggctgggcacgacagaaggacatcaacagccacgtacaaaaagagagtatacatttggctggttacatcattcactaaccagaaagtcagggacctgtgactctcttcctctgcagaacctcttgaagcaagaagcccaggcaagatctgggacaatgacagatttctccctaagtttccccgtggcttggcttctctctctctgaatggggccccaagtgataaaggtgccattgagtcctttgaccaagcaccgtccaggtcttcatgattgctgaggtccccagctgtggcaggaggtggccctgctctttgtttccttgaatctggggtgatgggggagggatttttaagattgaaacagtggaaaaatcacaggacttgggttcaaatggcagctcagctgcttcccaattgcacaacttgctcctactgttctgtaacctgactttccttggctatagagcgggtaagcttattggagcgatggcacctggtgagctgggaagcacttcaatgtaagatatttcatgttgattttttgtgtatagaaatcctgcctggaacaggggtagaatggctgcagggtgtggccctagcatgcctcttgaccacagcatgcactgcaaacacagtatgcattgctgggtctgagctgaaaccaccagctaattacagtacctgaagcagggggagggagggtcccccagggcctgtagacctgggaggtggacatgtagagaacagatgccagggctgcctgggcccgggaaggtgaggctaattggtgaaagccttcaacaggtgagggttgatgtggcttcctgagcacctgggtgatgggggaagagaatgtttgctccagccctggctgagccttcccctgggccccattaacagtgagattagagccacagccagaggagccaggtctggactctgctattatcaggagcccagccatgccctaggcctggggctggcctcctgtcactccacaaatacacaaaatgtttggccatggttatgataacccttgtttattagagagcaactctactctcacaaggaaaggaaataagcacccattaaatgagaatttatatggagcccatttggacaaccctgtggacagacctagaagccctgagagggccacactctctgggtccctatccagaggactctggatcttttttcactggctcaaatgtcctcatagaatgcatggggtacaaattaagatggctgatccactgtgctccaaggactatgagctcaaggacaggggccacgttttatgcatctttgtacccctagcttagtgcctggcttataataggctaatacaatggatggatagatggatggatggataggtggatggatggatggatgggtggatgggtggatgggtggatgggtggatggatggatggatggatggatggatggatggatggatggatggttcgttggacagatagataaataaaagcctgagcttcacagtggctaacagtactgaaccagaaccaaagtgcttaggtttgaatcccaactctgccacttaatcctgtgtgaccttgagaaagtcacttaacctccctgtgccttaatttgttacctgtagaatggggattattacaatagtacatactttgttgtactgtggtgaggattaaataatttaaaacatatagaacaatgtttggcacttagttctatgggagtgttcactcttgttgtttgttgtcattagatgggtcagatgacctctgcggttctcagcatctttgaggaaattcatggtatctatctcagaggtatcatgaaaattaaaggggctaatgttgtgaagatgaaatagcaaaggtagttcttcccaaatatcttccagaatccgatagacatttggtcacaaagctgactgaaggagcaggggaatggtctcagatccaggagactgagcgctattcattagaaatgcaaattcttgagctccaccccagacatattggattaaaaagtcttgggtgggggctcagacatcttcatcttcacacctctccaggtgattccaaccccctcttgctaaggtttgagaagcactggcctggatcaccatggagggcccttcctagctgagggcactacagaacacagcatgtgcctagcatcccgactcgggagcaggaccctgagctggacctggatgcagagagccctcacagcagcctccccaggggcctgccacgcagtgtggtggtggtggaggtggtgtggggagctggagctgacactccgaattacaatctaatagcttatggcgcttccctcgtgcaccgcagcaaaggttaccgtgcaattacgtgtcgccacatacaaatgacagagcagttacggttactttaccaattacagggaaattgctcccactctgcagagagattggcactctgaaaagctctatcatctccatgaaaaggggattttaaatgcagacggtttccttcctccagcagttccccaggctcaggggcagagctgcaaagccactgccactgcccaaggaccccagaagtgcctggtagtctctgtggagactccctgggaagggctggaggaggaggtagacctggggaacagtggggggatctccccaagaactctagacatcacccccaaccctaggcctcaatgacacactcttaaggaaccaactatcacccactctgacagccacatcaatccatcttgaaggcagcaggtgatgaggcggggtgggcccctgatccccaaatcctcccctgaccccagcctgcacagcccctggtgtgagtcctgattgcacctcctctgccaagcaaagctgttttagccccggccctggcttgccccacctttgcagaaacctcacattgagtccttattacagaaaggtcagaaccaagccagagctcaatggcccaaatgcagtgctaatgaggtgaaggtcagcaggtccatccccctgtgggccaattagcttagctctgggacacagtctcttccatagccacaggctgccctcttactgcaggcatccactgtttacaaacatcctaagctgatcctgaagaggcagaccaggtgaccagcagggatgtgccatgcagccaactcctccagccacctatgtacctgccctgctgctctggggcagcagcagccatctgagccccaggatggaagacaaaatcagatctggtcttcccattgctctgtgggcaactcctgtggtccaggagagagaggatttctcccatctgggagaaaaccagctctcctgcccttcctgaatggaaaagtatcatctagcctcatactcctccacagctgggaagtccccactcctgtccgttgcatagggtaagaagacatcagagattttcccaagctcacccatggtggggccaactggatctttagaccaaccttttcccaccaaacctttggttccttgggctattggaactccctgcgttcagcaagggaaataggcactagatgaagacaaggctatttacttttcctcacttactaatttgcttaagagcatttatgaaaaacctactaagccccaagcactaggtgagcccctaagaatagaaagatgaaaaagtctcagttcctgccccaaagaactgcctctttcccagtgtggggatggacagacctgggccatgactagacaaagccatctgggccctgcttcagttatgtgcctgggggagtccagagaatggaccaccaactgccttggggagcaggcatgactttgaggaagaggcgaggtctgggctcacgtccaagttctctggcttatgaaacagtattctgcccctctttcacacatcatatttcagatgcggaaaataactcaggatcataaaatccaacagccccattttacagaaggggccactggggcctggagagtgaggtgcctcccctagttacctatcaagttgctgagaaaataggtaccaaaaccccaaattcctggtgacagaaaaaacaaaacaaaacaaaacaaaaaagcctgattttttttttagatggagtcctgctctgttaccagggtggaatgcagtggcacaatcttggctcactgcaacctccacccgccaggttcaagcaattctcctgcctcagcctcttgagtagctgggattacaggcacctgccactacacccagctaatttttttatttttagtagagacggggtttcactatgttggccaggctggtcttgaactcctgcccttgtgatccgtccaccttggcctcccaaaatgctgagattataggcatgagctaccacacctggctaaaaaactgatcttaagcacgggtttcctctggggttgttagagggtggtcccaaagacaatctattccaggatcagaggaaggcaggggactgctggggaagagactatgtgtccagtccctttcccagcaccagggatgagtgctctgccatctccagaaactggaagcaaccaactctcccctcccaaggaggcccctgaccactcacttaagctgggcttcttcctttcctgggtctgtgcatcccaaaggaaagtgagaaatgacgttttgaaaagaaattcaagttaggagaaaaagggaagggaagcccatgagctgcctattgatacagaaaagaaaaggtctttatattcttcatgttgagcagccctaaatttcttcccattaattacacttatgcacacttgtgcacgcacgcacacacacacacacacacacatacacatatcctggttgctgaccatagcacacctccactggaaatggggaatcagtgaattacacatgtgggatttctttttaaagggagatattgatcagataaactgtaatagctcatgtctaaatgcaggctccagttgtaaagctctgcagtacagggagataatgatcacccacttattgggaaccgtatctcaaatatgacggctgacccctaaggtgttcataaatacacaaaatgcatccaccccttgagatgacatcgtgtttactccacaatacctcctcaggggtagaggtaagtggagagtgtccacagggaggtagaaatatctctgggagtctctagtaggcttaggtttagctcctcagaaagcctattattctataagatatttccatgtgcttgagtgatgattctgtaacaaagaaatcaaaaagacctgactatccaatcctctgattgctttcctgtaatgcctaaactttctcttttatgactcctagccctccccagaaggtctgccttcagacacgtgacattgagacacaggacccacgctggccctatgagattgaagtctcttgaaagcaagccagagaagtcctataataggtgaaagttgacccctgcaccctggttgtgagcacaggccatggaaacaatgctggagtgagggctcatacactcagttactaatgcttcatctcagaatgattctttcgggtgtctttttcaatgagattgtagggaaaacgaatgtgtaacagaaagagggagagccagcaagccacagtcacaacaacccagttagacaaacacatcattgcaggggcttagagaaaagtgtattggggttggaaaaacaacccaacaaattatagtagttcccctgatccttggcttcactttccatggtttcagttaccgcagcttcagatcaaccactgcccaaaaatagaagagtagagcacaataagggatttttgagagacagaggagacaatgttcacataatttttattatagtatactgtcataactgttctattttatgattattattactgttaatcttttactgtgcctaactgataaattaaagtttattataggtatgtatgtatattagtccatttgctgataaagacatactggagacttggaagaaaaagtttgatggacttacatttccacgtggctggggaggcctcacaatcatggcagaaggcaaggaggaggaagacaggtcttacacggatggcagcaggcaaaaagagagagtgtgtgcagggaaacacccccttataatatcctcagatctcataagacttattcactatcacgaaaacagcacaggaaagtcctgcccccatgattcaattacctcccaccaggtccctcccacaacatgtgggacttcaagatgagatctggatggggacatagccaaaccatgagagtatgcatgggaaaaaacacggtatatatggggtttgggactatctgtggtttcaggcatccactgggggacttggaaagcatctcccaaggataagtggggactatcatatggccccagttctcaagaaccaagagctttgcttctgggcatctcaaaaaggaggagagcagaccagaaaacaggatagaaagtcattgtgttttaggaggtggggctggggattttgatgcaaatattcattaaatgaatgcatttaactacctatggaatgatgaaagccatttgctaaaagcaacacttcttttaatactcattttgaagtttctatgtgtgttttgggaccatctgtggcccaagcccaccagatatctaagtggtctttcactcatcatgaaaacaagctatccttctaatagggaactaatgtcactaaattgagcagttttccctggagaagggcattaagccaagcacacattctgcaggccaggctgtaaccaatagcgagctttagcagtgcaccccttctaggggttgctgagcatagcagccaaagacaagcttcagctcagaatcctaggggttgaacccatgaccttctcctcattagcttagctgccaagagcctcgtgttcctccctctgagaagcagacagggccatgccctgggaatagtctggacaggccagagctctaggccagcctaccaagagaattgaaattctgcagatggcattatccctgggggctggtttagcaaccaacaccagacccatgggaaatcccagggaagtttctcagcattgcgaatggtaacaaccaaaacctactggggtgccacctctctccttttgtactttagctccagagaaccccagtggctacctgtcaggggcagataaatcccatgccaccagtccatcaatcccaaatcccactgtccctcctggagtctatggcaggcagactcagcagccacaagggctgtcattgaagtgagaaataccatgatgattaagtttgtgtgttttctggtgggtgctgggaagcagtggccctgctccccaggctgagttatggggtaggtcattccctcattagtggaaataaattttattagccccactctcacggcaatgtatcttcctctcttgctcctcgggtctaggtgtgggtctgggtaatgttgcctgcgtgtgggataaatcagccgaacaaatcccattatattttggaacactgacggagacacagtaatggcacagagaccagggaagggagtgggctgcttctctcccactgaccccgtttcctgcccatagggccacacacactagggaaaacatgtaaattgagaggccagatggagaagagctctctcagttgtctctttctccttctctccactgactttcttgataaaagaaacaagcctggtgtggtgatgtgcagtccttcccttataccttacaaaaactaagggacatgtgaaggtaacagcagcaagcactggcccaaaatgtgtcttgtcacccaaatgcattatcttatcattcataacctgtgctatatagaaaggaaggcaattggagggaggccgaggtgggtggatcacctgtcaggagtttgaaaccagcttggccagcgtgatgaaaccctgtctgtactaaaaatacaaaaattagctggtcgtggtggcgcatgcctgtaatcccagctactcaggaggctgaggcaggagaatcgcttgaacccgggaagcatgggttgcagtgagccaagatcgcgccattgcactccaccctgggcaacaagagtgaaacactgtctcaaaagaagaaggagaaggagaagaagaaggagggggaggggaaggggaaggggaaataataataataaaggcagctggagcacatcctagggcctgagataccaaacaccacacctgcattaagcacagcccaaatctctcaaaagcaggtattggtgaaggaaaaaaaattctaagcatgaaatcactgcaatattattacgcccctttctgtccccttgggtggttattataactaaaggaggagacacaggatgatgctatgaagatgtttgagtgtcctatgaatataaggggctgtgtgtctatcgttattaacatctgtatatttctctttccttaggagcttccggactctttattaaaaggatacttttttatcatctccttcttgaagataaaatgtgtgattcaaagcaaaagggaaactgcttgcccagtgatatctcacaagctgggactggctgagacccaaagatcctgactcctagaccagtaacccggccaagacgccaccctgtgaggacgaaaggaattgaagggaaggcccagaagtccagatctggattgttaagtagggctggtctatgtgcccattgaacaagaggtctggcttcccattttggcagggttatctcacactgcatgaggcgtgtgtgtgtgagagagagaaatctcattgtacttgctgctgagcagagtgtgtgggggtgagggagaacaagtcacagaaatagggagacagagaaaggctaagagaggaccgtgcaccaagagtgtgagtgagtgagcaagaggagagaaacagagaaagcaacagacagcaacgaggaggacagacatcaaggacagaaagaatgggtgtgtgcacatgggtgtgctatgggtgtgtacgccactgtgctcgggctcatgacatgcagtccatgtctcagtattgtgagagcacacatcctcaaacctgactttgtgctaagctctcctggcagcagtctgcgttaaaattcagcctgtgtgactcctgggtcccgcctcactccctgctgacccgatggcctccagggtgggcatcctgggagagtacatccagcctaggaagccagcctcaactttgctcctgccaaacccaacacatcgcccagggctcagctacctgtcacacaaagcaccatgcacactagtctgggatgggacttttactgcaaaccctgctggccaaaaagagggaggtgggcgggcctttcacctaaatacctgagacaggtgccatctccgagagagtgggaagacttgattctataaagattggggctgtgatatgtcaggcacccagtgctaaataagaaatctggagtacagggtcatgggccatgagaggtgggcactcagaccaatgtgttagatttttgatgtgtgcatttattgggacatgagtgtggcatgggccatggtgtgtatggcaagtgtagtggagatgagagaggaaggatggtgcggggaagaggaggagttccaggtctagagaggacaagagctgagcagaaaaagcaagcctcgtctaatgccataaacaacaggatacaaccccatcaagtctgagccctgtgcttcctgctgacagggaaaagaaaacaccccaagaagacctgcagaagccaggccccagagcctgggatgcctgcctggccattccggatgctcactttcgtggagtttcaggatctcaggcgccagaccaacctgagtaaccacccagactggaatgtgaggccagcccaagtccaagggggtgaccctgtctcctgctcaggactgccatgcctaggaaaccagtgagtcaaaggaacggcacgtggaaggggacctccatcgccacccagtcatgcacacagcagggcaggaaggggagctttgggttaaaaagaaacagctccatctcctgtgcctgtgtggcccttgtgggactacacagggctggtgggtaaactccagagtcaggtgggagctgggtctagcaatggttctcaacgagaggcttctggaaatgtgagaggttttctagtcttgtagtggctgggaacttccactggtgctcagcactgtagggccccggatcacaaacgccctacaatatcaggcagtccctgcaccaagaactgcccaccccagacactgctagcacactcttgtgaaacaccacgggaagagcaccaagctgagaattaggatacagaacagccttcagtttactaattacatgaccttgagtgaaacacttgagttttgtgttcctccattccctcaactgcagaggatgcctgcccttccattatcctacagtattgttgggagaagaaaagttgtgagaaagcccttgttaaccatcaggtaccatgcaaactccagtgtgttatttccagacagccgggaggtctctgccctctgctcccactactggggtttgacaggtgtcagttggtgatgctggataatagtttctgctccaaggacccaaattttctagttgagggacactcaggtcaaggcttgacagggagattgagaagctgatttctgcaccttctgcatgccacctttctccacaccgcctaatcagtactatggccgagactatctgactcccatacccatggctcaatcagttccaaagtcagggaagactgaagtggagtgaatgacagtcactcccatgaccacagccattgttcccatcacccaggccataatgacctgctggtgtgcatctctctcctccactgtgtgggctcctggagacagatgccattccacaatgcttggtatccaccaggagggagtgcattgccaagcccttccctagggctccatatatgtttcaccattcattagtttattaagaggtgctagttcgttagtgttggatgaggttgccccaggaaggtgaagaaaggagagaaggtatagataaccctatgcctggggaattctgggatgccaggtgcttggtcaaacccagcatcttctccagccagctgcccactccaagtcaggagtgtcaggtcccccccagagaaggacagacagccatcaccttctcctgcataaggtcctggcacatgacagaggccacaggtgtgggctccccagccttactgtctgtcacatgctctgcagacagggggcctcagggagcctggatggcagccttcaaaaggggctggggatagagatgcaccagtgataagccacagaaactgagaaatgaaatcactgccattccccacatgagtgctcattagcaaatcagtctcagcttgacctctagtcccctgagtcccaagacaattggggctctgacagaccctctaggaccccccctcatacccatgtcctcatgagatcctcagagttactttcagatactaacccacttgttctgggagacctctttccacccaggctggagaaagccaggacaggggtaaagcatggctcagagggtgaaggcggaagctgctgttcccaccctccactgacaccagaaagccccagctgcttccctagcctccacacttggtgcccactcaggaatgtacatttgtgacaggttcgtttatgtccacagcaacacattcccatgaggaggccactcctggccaaccagccctcatctccaatgggagcacagccggccttccctgattcacctgaagttgaggtacagctgagctctctgggggctgcaggtcagcaggttctaccccaacggcccaagacttttccctctgtgcggtcctcaggctctggcctgcccagtgctctgtggatgctccctggcacaaggggccttgtagtaggggttcttcttcccattccttcctatcccccaaatgaacacagccaaagcaggtgctgggaccttgtgaaggaggcaggtggcccaggagttttgcggatcccggctctgagttctggaggtgtgagttcagggggaagaatgtgggtctcaggatgtggaaagggctagaaaagcctgaagagccccatgggaggagcattctaatttagagagctggtacagcctggagcacagttgacattcattgctactcaaatcccttcttcaagcttttagagttgtaactatgataaaacccacaggggaccccttaccctacaaaatacaagtcctaaaagccaacctcctgggccttgccctgccctctgtcatcttcctacaacagaaacaccacaggacagaggtcatctgggactgagttctcaattcacagggctcaagggagtgtcagactccgtgacaagagagatctccagagttcatcttgttcatcctccacctctaggcaggaagggaacaagaaaaccaacccaacagccttgtaaatgagttgaggaagagctgggtttgcaaatggtgccatcggggcaacacagagcctggcctggccgatgtcgcacgaaacacgtgtggtctgagccgactccaaaggaatcgtaacaggagggtgggagcaaaggaactcgggtatctgccaaatcaaaggaaactgatactgtgcattaaacaccagcctggcctttttcagactggctggagagacagccccaggcctgtgcagagtttctggcctcctcctttctactctcggccctgaacttgcctgtaacttgaaagggctaattaaagccaaaagaaaaatcaaaagcttgttatcttgctccattactccccgtcccggcattagcctgtcttgcaaagctgttttccctctattctctccaaggctaccacacggtgttaggacctgcagctctgcagacttccatgatgaacttggctttttgtattgtggcaggaagcaacggcagcacgaacacttgcccatgggcagccagacggacgcctgcagctgatttttctcccaagagcatcgcccaaaaagtcagggttttaagaaagttttctacaggaaactgtcagagattgccaactcctctggtctcaaaagaacttgttgttgtttagtaagtgcacagtataaacttgccgtcttctaacataggcctgcatatgtgtgcatgctcgtggggaatttattacatgtatgcatgtatgggtgtcctgcaggcaagggggattctcttcaattggtggctctgttactcactcctaagatgtgtgaccttgggcaattcattcagcttgctgagtcttgagatactcaatgcaaaatgaatttttaggccaaggctctctaaaggccttctcaacaccaacattctaatacatctcaccacagacccatgtttgagtgtctaatagacatgtccagaacagcctctgtcattagctgccttcgtttggaagcagtccatacccccgtaagttcacagacctgtctcatggactctcttaagtggctccactactgccccaaacaaagggctccaggggcattcccaaaggttgtcacctgctaggaagactcagtagataaagtggagtcccctccattctccagtctggctctgatttgtcaactttttgctgccctgcttggtccatagcacctctcctatttcctttgtgacatcagggaactcctggattttcaagacctccaagaagagacgacatctcttagtttcagctggcccagtgcctggaagacttgacagtggaaaacagcttaagcctaatgccagggcaccatctttctcctccctcttccctatctccaacccaaatcccaaagaccagagtgatggcctctccacactctggctggggagggtgccagtccccactgagatctgcctggcacatagttatactttatgaaaggaaatttacacttttttaaacaaccaaaatacatttcctaatatggaactccaccaaagtttaaggagtcaagaatcacatcagtatggatgcgtacttctgtccaatggatacattttcctttcttcttctccccaaattaaaattagagaattgatgttctcagactaggttcataatctttaaaatgcacagttataaaaggaaaaggacaagaacactgaagatgctgatagctgagccttccaagtcacccaaagaatgatagtgaaaaagcaggaccattgtgaagaggaacagagtcaagccacaagaagggggatgcttttcatggtggggcacacgtgagctaggctgtgacaggcaggagtctgtgtcccctgcttcacctggggtaacccagcaaggccatacccaccagccatgcgaagacccctaagccaacccttctcctgctctccctctggctccccacagctctcccatcatcccatgctgctctccggctgcttcctgactttctcacatgtctcttccaaggcactgtgcacacagaagatgctcaataaacacaatttgtcccttcccatcccttttctaagttagctttgctttctctatgtgttcactgcactcttacctgactgtgctctcattttagcatttcctaaagacatacaaagggctaaaaacacacctctcctgaaattccatatctatcccaaatgtaggatgactcctcacattctcctctccttctaccatatggtttttattctaagctcccaggaaagttatttgcaggcttggtgagtacaaagggcatgtacgtgtcttgcactacagcacactgtgatctagactccagccatgcccggtccctacgacatccatttgacacaattcctacctatttccagcactccccgtcataactagtgagccaatatgaggcagagaaaagtacactgatgggaatttatgtttcagctcccactctgactcttatacattcaatgtcatagttgcagaatatttggtgacactctgggtccaatgagactcagagatgggatgggatatactcacttcatctgcaaaaggggaaggatgatacacatcccatgggggctacaggctggggttctcatcctacactcccaaccatcccagcgcgcagccctccctgtactcaccgcactgctgcaggggatgtccttcaccttgagccaggccaggtccagcgtgccctcgccccggtaacaagactgcagccgctccttaatgcggtcatttatctgcttcaagatgaagatgcacagggccgactcatccagggatttcattttccgcttctggcccttggagaagacggtgaagagcaggtcatcatctggatggactccaagggtcctgccaagcacggcccccgctttggacaggtaggcagcctgcagcaggcggtactccaccccactgcgctcacagccaatgggcacctctacataggagttgaaggctgtgtcctccttgcaaagcctcacgagcttggatgtatacacctgctccttggtggtggagcctggtggagacaccatctcaggttggagggtcaaaaagtagacaaagttgccactgctaaaaccatagacatagtagatatcaaagtcagggatgatggtgaaggtgtccgaagggatcttaatcatcgaggccacgaactcatcatggaagacgtacgcgaacatgccatccgcctcagagttcttggtcagtttccggctggagatggtgggaaaatactcgggcttcccatccactgccgtggcaatgaacagcttgtcatccaggttgctgtaggagacgatcactccaaagactgagccgctctcgttgacacctgacagatagtgctccttcttatgataaggctcccccagcttgaagaggtcctccagcctcagcagcttgcagatgccttggtacaggctcccacaggcaatcagcctgttctccttgtagtctatgaggagcatcttgttgacattgttggtggtggtcaggggctcattgcaggtctggacgatgcggggtgggtaacacttggggttgtcctcgtccggccctgtctcatgcgtcaccaagaccttcaggtcgctggagagcttgtaaatccgattgacggcccccaagtaaatgtgtcctgtcctctcatccaccaccaggtgattgaaaccctcggcgggctctcctcggaatgtgacaaatgaccgctgcttctgggacagcggggctggctgccgggtgagcaaagtggaggagcccatgcccaccatgaggaggtgggagagaaggcaggtccagttccagggcatggctttcatggcagaggcgggtcccagtggcacagcagcactcaggcacagtcgtcccctcagagggccaggactcagcaatgcagtctcccctactggagaaagggaagacaatgagctggataacaatgccagtggcttcatttcaccccacagcttgtctgcctggactttcaaaatgttctgcacacactgagcagaactgcactggggggtgctggaggctgactgagtcaacccccaccacgggcatgtgacacagtcagagccgggtggcagcagccccaggaggacacatcagtaacgataatggtggtgatgataatgacatgataatagcagtgatgatgatgatgatcatgattaacagccattatctactgagtgcctgaatttgtgtcagacactgtccagcactgtcacccgggtcaggtgccaccagcaggcagcatccgcaaagactggctggaggagaagagggagggagggagggagggagggaggaagggcaggaggcggggctgcctgcactggctgcaagctttgtccggtgttccccacagcaggcctctgcacacagtttctccgtctccaggctctgtgaaccacctcctgctggaccccatctggccgtagaggtggtaacagagacctcactattactatccacccatactacattgccccttaaagagccacacttttatgaatagcccctttattaaccttttctcaaaggaccaaatttgtatgtgctgtctattacctgctgggaccctgattggtagacctccgaagtacatcctattgtagccacattttatagctaaggaaagcaagcttagggaagtcatgtaacttgcatagctataagtggtagaggtagctccaaatatgagtagtgtaaatgtgcacaggttcgcaatcttaactgctaaaccatctcagttcaccccaaccttgcacagttggggctgtaccgtggtccctgtcccatgcagcagaagaattaaggttgatcccttctcggggctgtccattacagccactacctccagttctctgtgtctgtacctactactgcaggagaaactttcctctgtgcctcctctgctggatgaagaggccaaattaaaaacccacatcctcaatctcgtcacactgcagctgcaaccaggtcctctgggttcactgcccaaccctgagccctaatgttattttaacaaggcagatcttggcttcctcccctagcagggcctcctctgagaggttttcattaaagggagagaaaaaatgctttaagaagcagtcaagcaaataaataaacaaataaatacaaaactccccgaggaacaagatcactccccatcctgagggtctctttctattcaaggtgcttcctgcatgtgttcccattggacagctttatgtttcttccagttcgagagaattcagggcaggaattgccaacatcctatctgggggcatctcagctctgtggaatttttctcattcacccccaaacacctcaaaagtagagaatgagaagaggtagatcactaagcaatggaaaattccccagcagggagcaaacgctaggtcagatggaaaccaagagaagaaggaagaaaaccaaataaagactttgcattgtcagccagcatcctaatgaaaagcacaggccttctccagtcaatatcagaggaggaagactggttagtggaacacaccacaaccaagagcagtgctgaaagccaagggccttcattcattcacccatgtggcaaatgtttgctcagaacacacacaaaatgtgcaagacactgtggggcccaaggagcagatcctcaacgaatgcgtagtcaaatcaggccgataccaccagaacctgaactgatacgcacgacaaaaagtcacatggcatacaagagagtgctttgaaagttcctaggaggaggaagacttctaacttagggtgagagagggcaaggagcaggctgcaggaggccttggggagggcatggaatttgggctgagctgtgaacttcaagaagacagtcagagcacgaagggaaagaccttctaggggaggggtctacatagcagaagcatgggcatatcacatgagggtgtgtacaaggaagagtacgtctggagaacatagttcatgaatgaatcaggtggaagatgaggctgaaaagagagagcttcagccttgccaggatgtcactgggaagttgagactgaaatgcacagtgttgaagacagaaatgaaattgtagaggaaaagagcaaaggcccccagagaggagcctctccctttccatttagccttagcctttgcagaaggagagtttggagctgagggtctgtgaactccacagggcagggctgggtctgtcttgctcgtcaacacattcacagctgcacatatagaggaggctcaacaactgtttcttgactggcagaaagaggggctggaagcatagacgaataccaatatctgtggagtatttactgcaccccagagcccatgcaaatactttcacatagcttggctcacataatcctcaccactgttccctgggatcagaattgtcttattcctatttcaggtgaggaaactttagctctgcaaggacactggttaagatgtagcagaactgggtttgaagtccaggtttcaatcaatgcaaaatccatacttttctagaaatgcacatttccagagcccagaagatagagcacttagaagcccttgttaactcatgtaagccccaaacagaaatcctgggatatcacctaccagtatcatgagaaaaacaaagtcctctctgaccttcaggggctaagctggtagataacaccgatcaggtgagttctgtggtttacctctgaaagtattaatgactgtaaagcagcagctgcacagagcctctgcctagcacagttaagtgcttaggaaatgatagttgctgtcgttgttatcgttagcaagattaaaataggattagaaagattaggattatgataatgagatggttcctggtggtacatctcaagatgagtgatgaagagtcaagatggttcaccttgaattgcttgtgcaaattcaaatatcaaagaagaatctataagtttttgatctaaaagagataatccagcttagtgattcccaatccctgattttagagacaaggaagttgaaatccaagaggtcagatgaaattgcaagaggtcacacattgagttgaagacagtgtaagactgggtctcacactgtccatcccatgctctttccaccaccccggcctctcttctgactttatgtgaattcactccagcagctgcttccagcctttgtctgaaagagactgctctttgggcaccatatgctctgccggctaacagggccctcaaaacgtctctgccaacaaccaaattccagcagggctgataatcccccttccagacaggcaggtgcaggtcggggctccgccaccaacttttctgaggagagaacttcgcacagtctctgtatcacaacctgccgtatgctggggaatgtgtgcctaccccacgacctgccttactgtacatacacatggatccatggccaatcagcagctctctagtctgcaagaggtgagatgaagaatcctataattacgaatttactgagcagaaaggtgccatggctcattctgcatcttctattaggcactgaaaggagacacagttatgcatctcaaacacttatcaccctcatctggggatggtgagattactacacccagagaggaggggggcccacagaaacaataacatgtactgggaataaccagcctttcattttacacactaagaaagggactgattaggaaacaaataagagagaaatggaagagaaaaggggaaaataaggatgtgagctccagcttgcctcaccaaagaccccaccaggaaccaccacagaggtgacaccccgccgagcttgggacccacagatatgcagagccaccagccccctgtctccctgagctgtctaaggctgctccaatctggcaaagcaagagtttccaggggggtttcccttccaggatgtcaattcttgtaagcggtaaccccaacctaggaaacccccaccccaatatcagagcctacccaccatttcgctctcaagtcaccatttagctagtttcaaaaccaagtattagaaattacattcagcccaactctgattcttaaaggcaagtaatgggaccaaataaccttcacgattgccccaaaggattcatcgaactacgtagagtgggtaagaaggcaggagaactgaaagaccccgtaacccaactcaaacatgctacagttttcccttctttgaaatcagattttaattttgagtagtctcaggggagatgggactcatttatagaagctgatcatcattttgattaaagaaattggggttgtctttgttttaggcagcaagtttcaaagaactgaaactaattttcatgaaatagcaccatcctctcagattcctgagtggtagagaggaaagttattatagagtcgtttaaaatagcaattaccctgtgaaattactttagagtttacaaagtgttttcatggatattaccttgttctgaatttcttgttcatgacaaccctgttaggtagatgaggtatttataagtatgccttctttaaagataaggaaaccaaggcatgaacaggtacagctcttggctaaggtcacacatagtcacgttgggcattggagagctgagctcttcaggcctcactcagttattcacaatatattccctggccccttggacagagtcctggtcctcagaccttttattatggggtaataggattctcagaaaatgtgccctaagatggcatttcaaaattcacgtcacaacacaccatgaattaggtgagtcacaggtgttttttgttttagtttttgttttgttttgttttgttttgtttttgagatggagtcaccatctgtcacccaggctagagtgcagtggcacaatctaggctcactgcaacttccacctcccaggggttcaagtgattctcctgcctcagcctcccaagtagctaggattacaggtgcccaccaccatgcctggctaatttttgtacttttagtagagatggggtttcaccatgttgggtcaggctagtcttgaagtcctgacttcaagtgatctgcctgcctcagcctcccaaagtgctgggattatgggcatgagccactgtacctggccaggtactcttcttaatgaaataaaatagaagggaaaatactagtatgtcacatagaaaagataagcactgtttggtgagactttttttttttttgagacagagtctcactctgttgcccaggctagagtgcagtggtgtgatctcagctcactgcaagctctgcctcctgggttcatgccattctcctacctcagcctccccagtagctaggactacaggcgcccgccaccatgcttggctaattttttgtatttttagtagagacggggtttcaccatgttagccaggatggtctcgatctcctgacctcatgatccgcccgcctcggcctcccaaagtgctgggattacaggcatgagccactgtgcctggccggtgagacttttgttttacccactatatagcaaactacatattgaatgtgatgtaaatatgtgtgatgtaactgggtccctgggatggttaattttatttgtcaacttggctgggccacggtgcccagatagttggtcaaacattattctggaagtttctgggagggtgtcttgggataagattaacatttaaatcagtctgctttgagtaaagcagactgccctctataatgtgggtgggcctcatgtaatcagttgaaggtcatgaatagaacaaaagactggcctcctctgagcaagagggaactccaccagcagatggcctttggacttgggtacaatattggctcttctctaagtctcccatctacaagcctaccctacaggttttgaacttggtgcctccaaaattgtgtgagccaattccttaaatcaatctctgtgtctctatgcacacacacacacacacacacacacatcctcttggttctgttttctttgaagaagcccaactaatatagtcatggtcaaaaaaatttgaaacacactttcagagacggtgcatacctgttgtttttgctgtcattcatttatcctctgggcatctgtgcctttgcccaaacacttctgctggaattgactccacctctggttcaaagcctgagccactcagcacagaacgggggtcgggagggcatagtgattggatcaggaatgagaaactggttaaatcaggtctccgacaagcaacaggctttggatagggatactaggggagaaagttctagctcttccaccagatgtaaccttggagaggcaagggcctaagaaccgctagtgccatcttgtaatcacaggggtgagagcaggggacaggagcctggaagaatgaagccaaagtactgagaagagcagaactaagccaaaggatagagagtactgggtcccaggcctggcgacatcctataaatgtctcaattgtgtccactgaagccagctctatgcctgtactttccggttacgcaagtcaaaaaaaatttttccccttttgcagaagccagtttgggttcggttttctggcacttgctgatgtaaggatcctaacctatacacagaaaaatcccaaagagtacagtgtctcccaccacaacctctctaatacactatttttccatgggatcaagtgagcaagccaaacagatctgtgccttccactgcccacagagataaactatggttttacagatagcgaggcacaatcccaggtgatgttcgaacgtgtgtgcacgtgtatgtaccaactttcagaatcaaacacaacacttccctatctgctgagcatttgccttaggagctgcaccagcagagctcttgggaagtcttcaccaattcatgcttccgggccctgagttagactcattgttcaaatgaaaccttctctgatcaagccactggtctaagatgcccctactatatattagtgcaggaaccagtgccaccagagtctcacattttacaaactctgttatatttgtccattgatgctgtctcctagcataaaaatatgagctccttgaggacaaggattatatattgcccctcttttctccagttccaagctcagagcctgaaacacagtaggtgtataatagatgtttggaaacacgtgaatgaatgaatgaatgaatgctccatagcagagtatatgagatggcagtgggtatcatgtacagctgaagtacaaagtaaatcttggtgcttcaagtaaatctttgagccagtcaattcaaacagggaccaacctaaaaaactggttgtaccctgttctaaaccagggtttataaatacttaaaatactccattttgtccttttatttatttatttatttatttatttatttatttatttatttgtatttaaaggtaaagctcttttttaatttttattaggacatgagttcaaatgcatcagagaaactacgtctttcgtatatgatttacatggagaccaaccggtccaccagctggaatatcataaaaagctgtcttgtgttagcaaattggactttgagaaccaccatcctatgcagcaaaggaaatcagtatggacctggttgaacagaagaagctgagcctgaaaataaaattgcagcatggaaaacagacaacaacagaaaacagccacaatgcaggagatgccagttgctagaagtcagcatgcactcctgtattcagccaacgactattgatggagcacataccacatgatgagttctgggctgggtgcaaaggatagatacattccagagcaaaaaacagtgtccctgccaggagtggtgactcatgcctgtaatcctagcactttggaaggccgaggcaggtggatcacttgaggtcaggagtttgagaccagcctagccaatatagtgaaaccctgtctctactaaaaaacaattagctgggcatggtggcacatgcctgtagtcccagctactcgggaggctgaggcaggagaatcacttgagctcaggaggcagaggttgcagcggtgagccgagattgtgccactgcactccaacctgggtgacagagcaagactctacctcaaacaaacaaacaaacaaaaccagtgtccctgctctccaggggctgagggtcttctagaggcccctctagctgtcccactggcaagctctgcagatcctccccttcccagcctctattagaaacccagaacttcctacaacactgtacaacaggtcatttaatctcaattgtgcaggtggattgggaagaggaagctaacttttcacaaataacatgcgcttccctatgcgtgaggctgctggtatgaagtcagtgagaggtggccatcagcgatggatgacatttcccagcctctccatttccacatggtatccaggtgtgactgtgtgaatagcaaggtcatggtgacatttccatgccaaagcagggaagaaataagtgtgttttctctacggtttctttcaccacccagctggataaagaggaccctgaggccctataggatggtggagcctcaagatgaaagattcgtgcacccaccaggaacatcagacaagaaagaaacctttactgtgataatactgaaactgtggatttgtgtgtgacaacagttaacctcaccctaactcacaggcagaaacacagcaagctcactgcatctcagagctgggattcaaacgtaatgctggggggctccaggcctctgttctttgtggtgcatcaggctctggccctaggaagagttctctttagatgtcagcagccccctcccttgtttccaaagccagattgcaagtgggtaagcccagagatagaggagatggccaagctaacatatacaggatagagaaatcttcctgctcaatggccatttccaagtttggggctcagggaggtaagtgtgtgtgcagctgagggcagtgagggagttggggagcagcaacaggcctcatttccatttcatctaagaaacttcaaacacttattgatccatgcaaacaaaatggacacatgctatttgtagatttctactccaatttgtaatccgtgcattcaacatagcgtcttcagtaaggtcagtattttttcatgtctgtattttttttactttaaactcttggtttctagaagtgggagccatgaattattttacaactttccctggagaattctatttacacccatctagggcccaatcatgcagctcgctacagtctggggcccatgacagacaactgaccccatgtacttggccacctcactgcagctccattcgtcccggccttcactgtccccttgccccttgttgctagctatctcagaaatgagtgtcacattcatcaaaggaaagagccagagggtagggttgacacagcaaaacccatcactaccactagggggaaaagtcaagtcaaagcaactgtcttcccaagagaaggtcactgctggctttgggcagtctcagtgtgggtggggcctggtggggtcagctcagccacaacacagccttagtccagaaagcagcagtccagcaggggccatgggagccctccttccggtgtgcttccctctgcctctgcttctcttctgagagatgggaactgtgaaattgatgactggtgggagggctggagaaaagtataaaagatggggaagagggagcgatggagggccaggcactgatgtagagtcttggcgccaccaggcaaccagcccggtcccagggaaatccagcaccaagctcagctacgcggggctcccttcatccttacttcctagtttattaaaaggggatgaggagaagtgattaccatggacagagcctttggacccagcctggaagaagcctctgcaggaggctgagcctgtgagcctctccattcagagatcatgtcccagccggacctctgagatgtttatacatggtttccacgccctccttcctttccctcccccaggcctccttgtccttggcctggagggtgttccctcagggtacaaaaccacgtctccctggccaagtctgccgttcccagtagagtcgagcaggagctccagccgaggcccaggcagccccatgtgaaactctccattaccacgtggagatcgccttgagattccaggcactgtgccttgggacagtcactaggcaatggctttctttactccaagtgtggcagcaaggctttaaaaacacagcactctcaataggatcctggcttggggaggatagaatcctaaacttctttccagcatctcacttaaagaaacaggccagccaggaatttggagtcagatgccccagctggagttggtgtcaagacctgctctgcaaaatggcacaggctggcacctatgtggccactgtctcctacccagtccatgaggaacactctatccagggtctgtccaggggtactggctcctggtcttcaaaggggacccaatggcctctgagtgcacagaaatggggggacaccatgggaagttgctaagctgtagcaaagggagacttgctgtcacgtctgctgccccaagacctgagtggaccttgggaaccacagaaaaggggcttgggggtcaccacaggctggggatagtcacctctccagtaatccctgtctcgtgcatgtggcctgaggcttgtccagctgacattttcaccaggagaggaggctcactgcatccctgcctgccactctaacctacactccctgtagcctctctagctgctctggcctggccccagtaggcaaagccacattcagtggtcttcacccaaatgagctccttgctctcctttcatggtaaagggaagaagtgggatgtttttggctcacagccagtcatgcatcagccagtgtcacccataaaagcctcctctcagaattgccatggccaaggatactattggcatcaggtcattctaaccagacacgtcctgctaagtgacagcctttctttcttgttgcctcagtttccccatctgtaaaatggcgtttctggaaataggatggggaagagagatcacccagtttcttcttgtgctaaatccagaagtgagagtgaaatgttgtaggcttcacagaacacaggctatcattgaggttgggaagtttccacaaacagcctttgtggaggtgcagggcagagccacgtgatgtgatgattacaacacccaggggtggtgttcactgggtgacaaaaagctggtgctgaagtttctctccaaagactctttgcatctttgcttaagttgcctttttagctgcctgaatctagattgtggagagcctcaggaatgcctgccagggttgaattccacagtctgccctcagagaactcaggatactcatctgttaagtggatgtaagtcacactctttggagtctattttctcccttagataaaaaggaccaagcacattcttaacagctcaggtgttggtccatttcactgagcctgacaagcaagttgatctttctgggaaaggcctttgcttcttccggcctctgaggacctgggtccgcagcaggaggccagcaggaggcctccaagcattgaaactgccccacccacccaagggcttaatttagacccctcgacaggttgactctgccagcatgatctgacccatttcatttcctacatgtagcaagtaagaaaaagaaatggaaatattcccttctgcagactggtgtgaaatctctagctagacttttctaactgtaaaaacagtcagtgggcctagaaatgataatacatgcaaggttttggaaaaaccaagccgagagtccatacactcagatccttggacctcagcatctgtccggccgcccctccactcctaaaagcctgaccacccccaccagcccctgtcacagctgccccaacagctcagccacccaccttctggccccacagagtcttcactcgaggaagcccataatcccaccaaacattggcactgtgggggagcaggctatttggggctcactcagccaaatggcagggcttctgttgtcaccaacatctagtgggagtgcctcactccaggccccttttgtccctctaccccctctcttctttctcaattccccgaaaaatcaggaagtgaacagttgtctcccttgctggtctatattcatgtaattagtgctatttaattccacgatgagccaaagctcataaaatacaaaacatatttcagctgtgtgctgaaaatcttggcagaaatctccactgcagccggaagctgaacggagatatatttgctccttgaaaaaaaaaaaaaaaaaaaaaaaattcagaatgacggcaacaaagttttggggccaggcactactacctgagaatatgtaagggggtagcagaatagaggattttaggacataaagtttggaaataatctctatcaccatgacaacactaaatttaagaaatatttagtatagatcaagtaacaagtgtaatatatagtgtacatgccagaagaacatgtcatacatcataaggaggttgttttggtcccactcattccttactcccaagaattaacacgtgctttaaggatttgggtcccagtctccgagtcatcctgcctttcccattgggcacacacctgcaagtcaaatggccaagaagatgtgcagtttctggcaatgattccaaattaactaacacatcctcatctcccagctctttttcccctgacccctggactgtgatgaaacctcaccctatctctgtgtttgtgccagcaacacctgggcaaggaacaggaagtctcatccccttcctccccaacttcacaaaaccgggcacagaagggtgaagcaccggggactccatcctctcaggtgcccatgactgtaaagtagatgtgtcctcaacaagccgacctctacctctgaaatcaacaccaggtcctaacttgccagggctgctgacataacagattccctcccctggcacccctatgacttggtcatgccctcttcctttttcaggtgacaggaatacagaaaggagcatgttggtagagggcccagggcagggcctggcagaggggagattcatgttggatgctactgacatccccctttcaggacctgctcagaagctgtgtccatggggaaagagaggccatgaggtggactggggtgtgataaagggtcagatccactgcaagacccaggaggcctttcagtagactcagcagctcttctgaatccactctgtggatcagttccacggacacagacacagcatgctccatgcagaggggacaacacctgccagctcccactgccctcctactcttatgccacccaaaactccatcataaacacaaccatcaccacctctcattggtggaatgctttgccttctctaagctccttcataggcaataagccactcatggctccaaacatatatgaccaccccaacccaacccattaggattattgctgaggcatgactttggatgtcagagaatctcattaactttcccaaagtcatgcctttcctctctctatgcctcagatcttcagttgatccaatactttcctaataaactccaaagctggctgggtgtgttgactcacgcctgtaatcccagcactttaggatgccaaggcaggcagactgctgcttgagcccaggagttcgagattagcctgggcaatttggtgaagccccatttctacaaaaaatacaaaaattagccaggcatggtggcacatacctgcatttccagctactcaggaggctaaggcaggaagatcacttgtgcctaggaggcagaggttgcagcaagctgagattgtgccactgcactccagcctgggtggcagaggaagactctggctcaaaataaataaataaacaaaccccaaagccactcaccagagtcatcactggggattgtatagcaaaagtgggaagggaaatttgtctagaaggcccatgataaatgcacagatgttaactgggaagagagaaaagccttctgacttgttctggcctgtcaccttgataggccttgaaaacttgtgcacaatggagctcaaggaggtggcaccattgggcaagctctcgggggccaagggcttgtcagaagaaactaaccagcaggcagggaagatggcccatgtcttcatgcattcgttcaccaacacttattcagctccctagactctacaccgggaacctacattctgggggtgcagcaatgagtaagacaacaaggtttttggtctcacagagtttacatttaatagggaggatacacaataaacaagaaaaataactattttcagatagtgttaagacctaaaagaaaaaagaagcaaagtcatttgctacaagataactgttgcaagcgtgacctcagagagaccaaccctggcttctctagttggaatagccatggtttgtatctctgaggtgacacttgcagggggactgaatggccagggggagccagccatgcaaagatttgggagaggagctttctaggccaaaggaaatgtaaatgcaaagacactgaagcagacttggcaaggaaaaggcagaaggccgacgggctggaaggcccagaagagcacggaaggatgggtgatggggtgggagagaagagagacagcagatgccggagggtatattccaaatggcaggaaaagccatgaaaaacttctaagcaagggaatgacatggtcagggtctatggctagcaagctcagtctggctgctgtgtagagaatggtttttgggtggaagaggagttcactgaggagtgacagcagcctgactcaggtgacagtgtcagaaagcgagactggttgctccagcaggggttgctggtgatgtggaaacaaggggggcggaagagagggacttagtcacacctccttgatttttggattgaggatctgggtgggtgctggtaccatttaactgatatggggaaatcagggcagtggagcagagaaggcaagagttctttttaggatgtcaaaggtgaggttgtctagagggcccacctggcccaggttgatgctcaagagaacaatcaagggaggtgactcacagagaaccacactgtgtgttctgcggaaggcatctcatgtaaatgctcctaggaggatgctaatgtcatccttattctctggaagacaagctgattctcaataactacaacgaagtgaggctaagatatcaacctaaccctgcaaaaagccccatagagatgggggccttgtaactgtgacggcccctgggtagatgcagagattgtaccaagggtccttggctggaagaacgggatgtcaatgaaagaattttacttaggaacctagaatttgatgcttatttttttgtgaaggaagaactaccacagcaaaacttgattttaccaaagggaaattactgatgcttatgcagtacaggctactttataaacttcacaaattcccaaccaaagttaataacattaaaggattgaaaatggaaaaggggaaacagcattgatcatatacttcttagcaaggagccctctcttctctcaagtcataaagagtgccctgggttccccattatataaaacagtgaagggctaaaggccagcctgaaggaaattaggctgaaatcaaaataactcacactaagagcaagacttttttttgttgttgttgagatggagtctcactctgtcacccaggctggagtgcagtggcatgatctcggctcactacaacctctgcctcccgggttcatgccattctcctgcctcagcctcctgagtagctcggtgcccatcaccacgcccagctaattttttatatttttagtagagacggggtttcactgtgttagccaggatggtatcgatctcctgacctcgtgatccacccgcctcggcctcccaaagtcctgggattacaggcatgagccattgtgcctggcaagacttttttcaaaaaaaacatattaacatgtttaaaactcgtgataaaatatacattacataaaagttacaatcttcacaacttttaagcgtacagttcagtgacattaagtatacccatgtcatggtgcaaccatcactgccatccagagccatttcatctgcccaaactgaaaccctgtacccatcaaataccaactctccatcccctcaccccctgcccctgacaacctccattctacattctatgtctatgaatttaactatcctaggtatctcatatgagtgggatcatttagtatttttcctttgtgtctagctgctttcacctagcttaatgtcctcaaggttcattcatgtggtaacatgtagacaacatggtgtctttttgttttgtttttgagagactcggtctcgctgtcaccgaggctggcatgcagtggcataatcacggctcactgcagcctctaacacttggactcaaacaatcctcccacctcagccttctgggtagctgggacagcatgcacaggctgctacaccaggctaatttttaaaatttttgtagagttgattctcagtatattgcccaggctggtctcaaattcctggactccaacaatcctcccacctcagtctcacaaaatgctgggattacaggcatgaaagatggtttttaataaagatccattttgtggggggcaccagaaacttctgggttttaagtaactctggtttacagttgccagttcatggacacaggtgagaaagggaagacctagagaaaacttgtgaacaaatgcctgtcaagcctttttgggtgaaaacatgtccctttcaccaacctgcatctccagacccacaggattataataatatagcactgagaagaacaccagtccctcccaaggctctgccctgaaagggtcccctattaagcaagtatgagcaacactgcatcaccctcctggggagccatgatgcatgtcagctcactaaaagtcctcagaggtggtgctttgataagcaaacccatggaaggtttgtgaaacagggtttctcaaacttgtttgaccaaggaagtttttcttgcttaaaccctattatgacctctgggaacactgttccatggtacacaccttgggaaatgctggcatgttggtttccattcctcaaggcactttcacatctattttctcactgagtctttataaaaaccctgtcaagtaaattgagaaacttagagcaatttgcttcacttattgaaaagaaaacccaagctctcaagatttagtactggaaggaaaatctctaggtgaggagaagcaacgggtgcgagtggtatagactgcactccttgatattcccttcccaccaaaggctcatgcatggaacacattgcatcctccatcaccatggccccatggagacatagcagccctcccgttaatctcctggcagatgcctgcacgcctgtgacaactgccttctcctgatcctcttagcacagatgagagaggtcacaattttctcagattataagaaatctgacaggaaaacaaatgtagagaaaggaggaaggataaaatgagtctatcggaacaaagtgtaggtttcagtttcatcccctcctagctcattcccagactcaaaggccccgccaacccacacacccaaattgctgatttgacttctaaggtgccctgcctgaatggttcacttccttgctgcctgtagtgcatgtactcctggcgcccctgttggggctgctgttttatttggggataatgactcttctgtcctgccctatggggtaaggctatgcttgtgagggttggacatggcttctcaagaaggaggtgaacatttatggtggcagtcatccaggtggctctcaaataggtcactaggactgatggcacaccttcacaggtaggacagggccctcccatccctctttggtgcatagtcttcatgcctaaactttaaggggtcttgagggtctggctagtggtcaaagacagaccctgccccacggtggcacaatgggtgttaaacagggccactctacaagagacactgatgaagcaaaataaaccataacttggaaaccccattgacttgttatagtaactgtctctatttatttcacttttatcacccccaggccccgggttaaatcctgttaaatgtccagccttatgttagccatgctcttagaagttaatggacagttgtaaatccaaacttaggatgtagattattgggaagatgcattccgttctctggacccaatgtggccaaagctgcagttactggcagaagaaactgaaatctttagacaagagctgaggctgcaggacctcagcacctcctcaagtagacgttcttcctccattgccaagtctagagtctgagttttattttgctcagcaaggtaagagttaccttactgagaaaatcttgccatccacctctcaggagctactctcccagatacccaactgccttcaaaacttgtaggcattttaggcaggaattaccatccccattgagcagatgaggaaagtgaagtttaaagaggctaaatgcctttctccacgtcgtagagattttcccaggaaactacagtgagtaagggcagcacaatgtgtcacagtgtgaaacagactcaaaaaaaaaaaaaaaaaaaaaaagaattggaaagaaatgaagcaacctctagtgaacggactaacaagattcagtccaaagtgaaaaatcaatgacgcaaaggctcagcctgcaaaaatcgatgaggcaacggaccaataacctgtattcccagctgaattgacacccgactgcattacagtcatatttgtatttgcccagacctattccccatgccacctgccagcatactgcccacatgccagactcaacctccacgcacgtgcccacctgatccaatctgaagagcatcttccaacagccctgagaggtaactgatagagcctgcacacagaggcacgagaacagagcccctggaacaaggagataaggtgaccttctgagagttaatttagtaacaatcaagacatctgcatggaagcaccagatatctgcagaaaccaccttacaagggcaaggtgtccccaggtctccactgaaaaagcagggaagtgaagcccaatcagggtgacaaggtttcttccccaggacaagaatataacttaagaaggctataatctaaacagcttgaataaagaaggtattaaccaactcgggatggtcggctcggagaacagagtaagcagcatgagtgcttggtttttaatctcatgccagccagggagggagagttgtggttgactcaccaggaaggtgaactcccaggaggcgcagcagttggacacgaggcttctccatggtgcggactacattgttctcaagaacacccagcctcctagtcccgatccatgctcccccaaggagcagccaacccaccaatgtgtctttcttactggaatattcccaactgtattcaggagttcaccctccacacatggccgcaccccagaagcaggcagccatgattggaataagccaatgattcccagcatcaaccaacagctgtgattggattaagccagtcatgctggtctccttctccctgccagtgatgagtttaggaacagccatgccacccaagcctgatgaatgggactgaatgagaagcctgccaggggcttcaggaatataatttttttgctctttaaaagagactcatgtgagggagcacctctcttccttacttgtccacctgtttacaatgcctggaactgtggcagacttcttgtgcccatgagagaggcaccactgatgtgcctgcaatggctgaacagagagaagggaagtgccaggagtaggatgatgcaggggagctgctgaatgaccagttttagagccgcccaacttgggtcttcttgtgtgaggccaccattcacttatggttcacactattactgggtcctaccagaaggcgaaagcatctcactgactcacccagtaatccctcaggctacagctgtgctcgctgatgatactttgctgccatgaagactatgaagggtgtctaggacagcaacagccattctttcattagctggataagagcagactccagcaatgaataagatggcattttatcttaaatatcaatatccttgggactagaatgagttagtcctgagaatctgttcatctctgggtacacacaccagcaaagccagccccagtccataataaccccaccctggaaggccctacctggcagccactggctgcctcccattgcaggttggtgtcaccttgtttaacagcaatcaaagggaataacagaaatagcagaaaacacctgctaccttctcatccccactctacctcatatctcctcaaatcctccctactctgcatacttattttcatgtctttagatgagctatatctttcttacccacctcgtggcattttggaaagaataaaattaaatcaatatcaaaaatacaaggtgttacagaaatcatggaatttgggacatgaaggctgtgttgaaaatcttttcaacttactatgcattggattcactgggaaagtttttttaaaaacacagatttcagcaccccacccccagtaactctggtctaaagggtctagggcagacatcaatattttttaaaagcttcccaaataggtattcttttttttttttttttgagacggagtcttgctccgtcgcccaggctggagtgcagtggtgcgatctcggctcactgcaagctccacctcctgggtccatgtcattctcctgcctcagcctcccaagtagctgggactacaggtgcctgccaccatgcccggctaattttttgtatttttagtagagacggggtttcaccatgttagccaggatggtctcgatctccagacctcgtgatccgcctgcctcggcctcccaaagtgctgggattacaggcgtgagccaccgcgcctggcccccctaatggatattcttatatgcagccagagtggatgagaaccactgataggcaaaccctgtcacgtgcagatgaggaagcagtcccagggttcaaaatcacgcatctgctggaaagaaagccagggcccttggggtctgatctcttgagccccagactgggtatcttttcatcatgcttctgtgtcaactccagggtatttagatcattattattaatagacagagagaggaagcacaggaggaagactcaccaagggccatgaggaaacttctagggatgatggatatgctcattaccttgattatagtgatggcttcacaggtcaaaacttattcaactgtctaaacatgcagtttatggaatatcaattatatctcaacaaaactgtatttaaaaatagacccaaaaggtaacaaacataaagagacaacatatttgcaaatcaactatctgataagagtctaatatccagaatatataaagaatttctacaactcaacaacaaacagataaaccagtttgaaaatgagcaaatgacttaaagagatgtttctccaaagaagatatataaatggtcaatctgcatttcattagccattagggaaatgcaaatcaaaactacaacaaaatacaatttcacatccactagaatggctataatcaagaaaacagaaagtaacaagtattggtgaagatgtggaaaaatgggaactcttggatactgctggtgaaagtgtaaaatggtttattcagctactgtggaaaactatttgatggttcctcaaaaagctaaacatagaattaccacatgatccagcaattccactcctaagtatattccaaaacagaaattcagacagatatttgtacaacaatgttcattgcagacaacgttcaagagttaaaagatagaaacaacccaagtgtccatcaacagatgaaccaagaaacaaaatgtgatatatccttacaatggaatattattcggccatataaagaatgaagttttgatatgtctaaatgaatgaaccttaaaaatattatgctaagtgaaataagccagacataaaaggacaaatattgtaagaatctacttatctgaatctcaagaataggcaaattcctacacagaaagtagaacagcggttacccagagctgggaggagaagagaatggggagttattaatggcaacagagtttcagttggggaagatgacaaagttctgcagatggatgacaactttagttacacaacatcatgagtgtaattaatgccactgaattttacgcttaaaatggttaaaatggaaaattttatgttttatgtactctaccaccacaagaatttttaaatacagacacactgtagtcctctgccatccaactctcacaattactgtctgtatttgtaaaacatgttacagattaattaataacaaggaaaaggcttatgaaactataatgcactaagaactctacatgaattacctattctatttctcttaatagtctataaggtagatattattatgatctttattttatagacaagaaaactgagtcacagagagcaggaaatctgtcccagaccacaaagttagtatgtaatagaatagtgtttttcatctggtaacttcctagaaatgcaaattctcagacttcactccagacctaaggaagctgtgtttagacaagactgccaggtgattctgaggcatggtcaagttttagaaccgctgtaatagagccaaaatcgagttcagttaagaacctgaactttcgagtgctgtgacaagcagcagtcattcttaacaaagagcagtggttctctcacttaacgatgcatcagaatcacctgagtgcattcttgcctggagtgattctcacctggagcccatcttgagtaggctgatttggtgggtcttgggaagggcttggtaatttgcattcttaacaagtttccaggtaacactcatagcccagggaggacactttgagaatcactaatatacagaatctcattattatccacattttacagatgcggtaactcaaaatccgacattgtaaatcctagaaccacaaaaggggttagttattggctgggcctagagcctcagtccaaagtttttttcactacagcataaagccatcaccccagtgttccagatgcttccaggtgtcaacttggcacaacctcccttaaagccaacacaggttgaagacataaaagacgtttttacccattccaacaaactggcattagagtgatctaaaaaactaactggcacttgtgccaaagaaacgcagtaagaagacagaaaaaggaagggacaataataactagagcctagtttgggggtcaggactctgtcacagtggaatctaaaacctgaccatgcttcagaatcacttggtggccttttataaacacaggttccacaggtctggagtgggacatgagagtttgcatttctagaaagtttccaggtacaaatgcgttgatgcagttgggaagaactagaatatgggtcacttcctctttattcttatgaaatcagttgcctcttatgtaagtgaaagaaaattttctttcctgccttgtttgaaaaaatatgacatcataccatcctttatgcacaatgcattatccttcatatgttttattaccatcacctgtaatgttctatacatctccagattctcctctttccaaaccatttgtcgtctctgatcatgctactctgctactcgagaatcttcgatggctccctattgcctacacagtgagggacagacttagcattgtattcaaagacctccatcatctgacttcatggtttccactctaatagaactactctctattgcccatgcatgtcctgtgctttcctgttgtcatgccttcacccagttgttccctttacctaagattcctttttcctccttccttccccatctctacacttacaaatgtgacctgagactaactatttattccctctaggcctcagttttcttaagcataaaacagagatgacagtaggatcttccttgtaggttgtgatgaggaataagtagagcaatcagtggaactggttgccaccaccacaaatccctcctaacttccaaaccgaagggatttctgtccttcctttaatttccagaataatagaacctgtatacacattatcattatcatgttctactttgcacttgccataatgtttatacctgtattccctttgcagctaaggaaaccccattaaggtgaagatatgcttcttattttcagttgcatgcacagtactcagcacagtataaacacccactcaaagtaggaggaacaaatgatcaggactgttttaccttaaattgcttcctagagctgcccttgcagtgctctgaggtcccatcataggtagccaaatccttgggtggaacataaactcaggaactggagaggtgcaaggcccccaacatgaaaagaattaacttgtctccagacatcacctgttcaaagggttccctggaatccacagaggccagccttagcccaattttccaacccaagcaccttctaataattcaaggattcccatccacatcaggactcccctgtgcttacttaaaacaaaaaaccttggctccacaagaaaaccatttttctctatttgatgctctgggcctctgttctccttttgctctgctagtctaagaaactgcagctgccctgcccacctcggggagctctgatcagtggaagccgggcttcttgagcacacagcctgcaggaccagagagctctgctctcccttctgtgcctgctgccagcacccagcccttcctcccttcaccgcccatcttggagccatcacctatcccacactaacccacctccttgaacaaggccacctcatcctctcatcttagaaccaagaactctggtttgggaccacttcccacagaaccagacccctgtggggttgctctaaaggacagaataaggatattactattattattattattattattactattattatgttaacaagtcaccaggcaacaaaggcaatgagattcaaagacattccttggtggctgagtgaaggctgaagaaagggaaataaaatggttgctttatgagaactcccaaggccagcaaagaggaagaaaagaaaaaaggccagtgaagaagaagccgcagcttgagtgtgtgtagtagtaaagaggagaggggaacaggaattcacactgaaacagaaagccggtcagcttcaacaaggagaggatacaagactacttggctggaacagggatacctggtgagaaatccaatcagcaattccagatcttccctgactctgctccaagtctccccaagtcaccagccccagggccaccgcccctactaactacttccaccattagaccccctcccctctgtgagagggcccatgaaacagcagcaacttccaagtgagaggagccaagtgagagacctgaggttccttccaccccagccctccctaccctggcgtccacatatctaagcctgatgcagagaccgagaatctggctccaggggccctgtccacgggtgcctgcccgtgagtgttgtgtgtgcatagattctgtagtggcggaatggggtgaggaggcacaaagagcctctagcctgagagcagccgggagctggagcaaataggatggacactgggttggctggcactcaaagccttttattttagtagtctccaaaagaagggctatggaaagaaaatactagaacttctatttaaatctatttgtacctcaaaagactgaaacataacagctctactaatatttgatatgaagaatgggcgccattactgggcgtgttgaggggcatggatcttacaggtgcctgagagcagatggcaccatgatgctgaggctgacacggcgcccccattccttaacctgccacagtatttagcaagatatgacagtatacctgagccaattcaggaaacttacgatttactgtgttatttcacttcaataatccagtgttttaaaaactaggcaagtggctttaaggccttcctatcaggagaatatggatagaaaataacacataaataatgcaggcactggtaatcaataagaaaatgaagatgtgatccttccacacctagtatagatcttcatcatccatattacaagctgcaggaccaacttatcagaccagaaatcaacccgtctccaaataaaaaagaaatcaaaactatgaagactattttgatatctggatttatgttcaccatcattaatgatgaacctcccaatgagcgctgatttacttacagacaatgcccaatggatgggggcacatgccaaaaacatcagagaccaaacgtcattccccaactttgttgagggttctcctggcttgcagaggcagaggaggggctgtggtctggttggtgggtttccatgggagaacagcaagagggggccacactcaggaacctcaagacccagcccttggtaacggccttttgtggctgaggccaatgagcgtatctcccctcctaccctcttcctcatatcagctgcagagttggggctccagaggaaaggaaaggggtcccttggtattcaggaccctgattcatctcatttacctcgatggcagccgccccatagcccacacctcactgtcccaccaattcactaagaaagccaaaaggaaagtgtgaccccgagagaatagaacccaggtccttttgttcccaggctcatgcattataccttggccaagatcccctctgcaggccacacaggcaggatcttttcccgatgattgaaaaatcaaggcatcttcccctgcaccaataggagctaattacagagaacttgccacaggccaggcacgtggctgaacacttgacccccatcatctccattaatccccaccacaaccctacaaggtaggtcttattacctattagacagagggaaaaactggggtttacagagagtagatcattttaaaggctgcagcccagactcaaagccaggctccagaatctctgctcccacctctctcctgcttcccacagcaattgggcatgccaaacttggagaaaaacttaccttcgtcttatgaccttggacgagttactctctgaacctcggaccctcgtgcataaaatggggttataataggacatactgcattgggcttttgtgaagattaaatgagttaataagtgtaaatgcttcaaacagtgctgcacacatagtagctgctgtattggtgtttgcggttattattgccatcatgactgtgttacattgttctccctagtaagttcagtttttcttcccgtcgttccctataagtgactaatttttatccttttatcctagtcttgatccttgcaacagaccaagggagaagttgtgcattacagaggacaaagactaaattcccctccctaagcctacctccacctctgcatgcaccccactgacacatagaggtctcaacaaatagaacgacgacctcagtggtgcagaaggaaggagaaggaggcttctgaacaaggcttccttcagcccctgcagggcccccatgtggcaccgccaagcttctcctctgagcaaacctgccagatataggctgatctaccagggctccagacacctggagattaattagaaggccagtccttgggcaaatcagcccagaggaccagccacaaggagctgcagagagaggctggtaggctgtaatcctagagccagccacggagctatgcctggtccagcagctatggcagtggcagcaactcatacaccacccctaagcgaggaaatgctgccctaaacgtatggctgacttttacaagtcgaaggtcccaactccaggaagttagggcagaaagagacagtcatgaggaaagtatttctgaagaaaagcagattattttgagcacgaactgctgagtccccactctgtgtcagcctctgcttcttgccaaggagtgttgctaagctgatcttcctcccaggagcattaggctgatttaaaagatggcaaggaagcaagcaactagagaagtccgggaagccttgaagcgacaggttacgtataaactgcacttgggggctgctgcctggaggagcgagctttctttctggattcttccaaagggcagaagcagggcctgcaagtggaggtcagaagacagagatcttgatcctgtctgagaccacgccgtccacagggccagcctggcaatgggtcaagctaccccagacatatccaggcagcagccaggtgtccttttcgtgtgcaccagactcccctctaaggcaggaggttggagcaagcaatgcctaaaatgagctcttggctgtgtctggcacctaccaagcacgacaaatgaaaactttggtggaattaacaatctaatgataagatttggtggttcttttttggcctgacacaatgaaagtagcctcttaggaagaagccttaatcctctaagtccatacattgccctgaaggggccattttcagcacccaagttcctatttcaaaaaagttaagatgtgctttaagggctttagctaggattctctagttagagacaaacaccagaagcagaactgcagggtgtctcgggactgaggcacatgtgcctgaccagacccggaagagggtgggaggcatctactcaacatgctctactgtgctgcatggaagtgggagtgaggaaggccagacaggaagagagaagtgaagccaggccctctgagagtgaggtgtcaaattcacaatgacagcaaagcctctggtaagaatgggagctgggaaattcttaaaaaaagaaagtctttatctagatcaagcccttcctcaagccatgaccttctgttgtcaatttcatggagaagtgcacgggcagtgggggccaccacaacccgcacgctcagcctggacacacagcctgggatcatttatcaaaccagcagaggggaaaatcccccagcacagagcaactcctctgcaaaatgtagagcttcgctgatcctgcccgaccccaaacctgctcacatttcaagtcctccaagaaaaggatcagacaatcgctgtcctctcttgcttccccttctccagtcctcccaatgctgccacccacatggaggagaaatgtgtaccaggcttgcagacacagggtggcagtggagcccttgcctgcttccacgagcacctgcaccaccttcctctcatgagcccagagacatgtcagtgtccacacagcagcccagcaagagaggaaaggagtcctggtgctcccgaagcggagacactcgggccccatgaagttatatgatcagcacaaatgcaccggcaaggtcttaggcagaggcagtctgaagcctggagcatcaccagcttcacaggaagggaatacctgcttccaggcaaggtgaatggaactgaagtgtccccaccgtcaggaattcagacagagcaagcaccaagattgtaagtgagcattactgcaaaagcattaaagttgggggctatacctaaggctgccctggactccaggcctggctctgttatttgctcattgtgtaaacctttgaaatttctgaatctctcaaacttactttatctataaaatggatttcaaaaatagaatccatccctcacaactataaggtgtttagcatctgcccctgcacatgataagcagtgggtatcatattatggctggaagcaccttcaggccaggagagccaggatgctgtaggctgctgccgcaccccttgtccattatctcccggcttcccacactttgattccagctgctgccatcatgaccaaccagaggcagaccttgttcccctcctaacatcctgccctaagcacgagggaaagaaaatccctttccttggctcctctttgaccaagttgacattgtgaaaagcagagaatgaaaatctgatagtcacagaaaacacaaacacagtagaaataattaaagctcctgaatacaggtttcagatcctgtaataactcacatcttctatgactttttaacatcccagcccctgcctgtttccctgtgactgctgccaccctctcaccctccttgctcttctctctccctgctacaaggccccaggacctattgtgcctacttaggatcctgcctctccatcccagggctgtgggacacagggagtctcaagagattgacagtggagtacaacccaagtgagactctgtccctgccacaaagaccgtgccctgtccaaggccacgtagagccatacaatatcccttgatgagtgtgctgtgtgtacatggggagagggacagaccctccacctgtcttcccagagctcacaatacattccaaattaccggcagttacgaattggagggctccagtcagtggttctcaagttgcaattggtccccagagcagcaacacctgggaacttatcagaaatgtaaatctcaggcctgcttcagacctacaaaatcagaaactctgtagctgggttccagcaatctgatttttccaagccctccaggaagctctgaagcacactgaagtttgaaaagccactgacctgttatagtccggctagctgcacaaccttgagtaatacacttaagtctttccatctgtaaggtgggaccaaaaccagtttcatcatgtgttaagtgggaatgatgatggaacctatttcacagggttgttggttacaaagattaaataagaccctgcatagaatgtgcttagcaaattgtaagcactcataaatatttgctaatattgatcttcctaaaaacctaagagatgagttcttccacgatcactaggcaactatcaaggatctcagtgaaggcttagagagtttttgaaaggaatcgttcaaggtcactcagctatcaaagatatcttaatagccattccccagagaacagagcagtgttaactgaaggcaaggtgttaacaatgcctttccttctctctgacttgcaaaaggtctcctctggggccatttcccttccccgtgggcatctagaaatgtatggaggctttgtggttgactgagtgctcttggcttttaggatccagagggtcagggatgctcctcttgcactgtgtaagatggctctgcataatgaagaagcatcctacttacaatgccagtgacatctccactgagaaacactgatcaacccagagtttcggagctatccagagcatgcagcatgtctctgcctagagaatacgctaaacaatcacaacaattgctgtggagggctggacgtctcatgggacacgtctcctgctcaagtcctactgtggatgttgcgagggccagctctcactctagacatttcattgtcttatttaacatgcaattgcttcaaatctcatttaacatgcaattgcttcaattgccctagctccaatcaccccttcccaaacctgggctagatctccagctccgtgggcccaggcaaacattttccaacacggtgttagtaggaattccccaaatttccccaaagttcatacaggaaatggatgttggctcaagagagcagaaggtgtagtgtggaccgttctttttttttttttttttttttttttttttgagacggagtcttgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggtgtttcaccttgttagccaggatggtctcgatctcctgacctcatgatccacccgcctcggcctcccaaagtgctgggattacaggcgtgagccaccgcgcccggcctggaccgttcttaaaaactttgtgctatttattatttgttactcagaaagggagacggaggtaaggatgagaggagaatgttggtactgttcagaaacttaacaatcctggctgtcaaaaatgccaggagtgaatgtaatcagtagaatcaataaagatttatttcaaaggattcccaaggaaaaagtgccagacagagagccagaggggagaaaagtaacagcagcacacaaaagcatgcacgattcacaggtttcccgaagcactggatgaaatgtggcttggatgaagttggccatttcccctaacttaacacctctcttcccatacatagcccctttccctagagactcctacctagtgctttcaccagcttccccctccccataagagtagcaactgactgtgctaaaatgttccttgccccacaaaccattaagctgtcaagctgagttggtgaacaaacccagagagagccggtgctgctggaatgctaacggtgaaaaccgcaattattctttctgctctggacaattcctgcttcaactttactggccccaggtcatattttgtgatctttggatgctgatggaagagagacggcttgatagagaaaataaccagggagattatgtcttgatagagatggaagtaactagtagaggttttttcgttgttttccttttgacatccacataggtgtcatataatggcttctggttataaagccccctatccaaaggaaaaacaacttctccataaataccttgcccacgtcagtgaaatagctgtgttacacacttgagcaccattttcgaggacactttaaatagagcatgggttgctgctttcaatttaacgtgtgaacaggagctgctaaggcaggcagagatgataagttgtggggatgggctcagtttccattggtgcatctgctcagattctaacagatccgcaggcatttaaggcatctcagggacaagccaggtaagccacgtgagagactcactcaacaaatgaatgaacacctactatgcatgagtaaaaccagatgcgaatcacttcctctagatgaaatgggctttacatacaaattataacagttccaggaaaatctaatatatgtttagaagaagaggtgctttaaaaaaaatgaaataggtggtacatgacaggtaaaatactagacaagttcagaggagaggtgggtggtctctgtgttttcttgtgtaacaacctctactgagttttatgagaattaaaagaaataatacatgactggtgcccaggacagtgcctggaactaagtaagcacttgataatgatagcagtagtcaaacaagtaggattaatatggttgacattaagtttttactgataattttaattataaatccagttggaggtaaagacaggaggattatcagataaagcttggtaaataatgggtaacatctggacagatgaagatgagggcgtgggggaatagtataggccaaggtacagatgcaagaaaattaaagacttgctcaggaaataacaaatactacaatgtgtcttcaattttctatgtttgtactgtgacaggtctgaatgtagatttcttatttaacctgcttagagtttacagaccttcttgaatctctgtattgatattttctccttgttttagaaaattcatagccattacctcttcaaataatacttcttcattttttttctttctttgtagaaatccaattagatagataagactattctcactgtatcctcgatgtctcttacctaagttttctgtatttattatacttcattttggatgatttcatttgcccactgccctacttcattaattatctcttcagctatttctaaattatttaaaatacatccattgaattcttaatttcagttgctgtattttttcagttccaggatttctttttggttcttgtttgaaatctactatgtcatttttatagtttctagtttgctgccaaaacttgtaatcttgtcttatttctacttgaaaaatagtaagcatggttattttaaatccatggtctgataattgcactggaaattatccaggaaacctgtgagtctattatttctgctggttctcggtcatgttgacttatttccttgtgtgtcagcttatctttgattacatgctggacattgtattcaaagatttatttgtagaaataatacaatgactaggataaggtatcttcctccagatagtattgtttgcttctaccaggtaactgacttgcaacatagtgtaacattaatcccatttcagaaattgtcatttttcttagctactcaagggattcaaagcctgacttcacaacttgcaaaggctggtttacttgtagttccaacccaaaatgttcccatgcttaataggccctggactccagcttgtgtcctgtaatgccctgatgctgtcaaatgcattgcttagaccctcggctgcctctttagaagccagcaaaagtctaatccctctgattagttaacctcttgatttccagcttcttccaaaatttggccctatcaatatttaccaccttactagctttcatatgtcttcaagcatgcttttgaaaatatcttctccactttctgaatttttatcagtaggaaggtcagtcaattgaattagctagtctgcctttactagaagcaaaaacctcccagctggtatttgatttgactggaacattggatttacttttgggaggaaataaaagataaacccaaacaataggccagttccaaaacatggataaacttgaatgctaggctaaaaaggaaggatctttaataagcgatggggagccattgaagattctcaagcaaaggagttctccttgggagctatacttgaggaagatgaattggacacttacgtgccaaactgattagaggggcatgagaccaaaatcaggaaggagagttgactccttttatcaaactttcagagaagaaggcaaactatctgagctagggctatggtggtggcaacactaggaagacagagacagatgggaagtacagggttatttcatgagtgaggcacaccaactagaagatggtaacagaaatcagaatatggaaagaaaaccagatgaaggacagagggagaaaagtaaaatgatatgatttgcccattaactgagagtgggattgaaagagaaagaagaatcaaagatgatattgaggttttgaacatgggtagctcagacaagggaaagagattatgagggctaagccacaacccacccatcctctttttagtcatgagacagctcaaagaaaagatctgtttcaagtaagtgacagtggccactctccaacccaaaaccctcccagaggagagatgatttcatatgagaatagagaacctacccatggtgtcactacaatcaggcaggtgggacaacctcttggagagtcagagagcaacccattttgtgatattagagattctctaagtgaaattggctgacagcacaattcccgttttggggaaggagaaagctcccagagccacttgttagtaacagaggtcctggagcattggattacaagccaggaagttccatagaaaagaaggagcacacagaaatagacttaagtgtgcagagggtgaggggggcacaccctgtcactatgtgacaggtgatccatgggggcttctaggattctcactattggttctactgagtgatgaaaaggtgcccattagggttaacttcccaggtttttaggtagggtccgaatggagtggaaatgtaaacctttaaataattatggctttcttggcctagatgtctgtcatgcactacagatattttttcctcccttccatgtgtatgagtgaatatcaaaagtaggtacctgtaaaaaataaaaatagaaaactttcactttcattgcaaagatcttggagatgaaataaaataaaagtaaaatgtaacttgggaaagggctatataaatttcacaaataaatgactgaggttgacattgatctgaactggacctgtgctacaatagaggggactagtacagccacaccaggcaaagctctccacacaacctgtttgcttttcattttcttattgtctacaccaaatcaataagatctgcaaaaagcaaatgtagcaaatgtattttttttctccctattctgtaccaggactcctctccggcttcagacctggaatttaacaggatgaccacccctcccccagtgtcctctgtgctcctattgtctgccccaagaaagctcctactaattctctcaaaaggaccttacctcctgcagttacttcacatgctcctgtgggcagctttaatttatcccagtggaagtcaagatgtaggtttgtgtagaggcctgggaaacctatcaaaggagaatgaggttgaacaaaaacatcccagggatagactctcagctccctgtgggttgggccatgtttgccactcacactgaacccccagcacctggcacaatacctagctcataaaaaaacacactataaatacttgttgaattgttgaactgagagagctgggatgagaaaaacaagccaggcatcactttcttgtcaaataatccttgtacatttgccacccaaaggcagggcaatgggttgacccaaggtttttctttcatgaaacagccccaaagagaatcctccctataaatgtgctcattttttctctccaaatgcctttattccagaagaaagcaaaacagtgagtggatgactttcatttgttttttgcaggaaaagaaaaaaaaaatgaggattaagaaaatttggaactaaggtgttaagaagtgtaatagggtagaggaggctaagaaaaaccagtgttgctgtagtagggagaggtttgactgactgactgacaccatccaccacaaagtcatcaggcacctgcgggcctggaccctgcaggaggtggctgggtgtattcctgctgactgataggataactatgcacattcaaggctaagaagaggaccagcagttgccaaccaacccccaaaactgaccagtgctgagtagtcagtcacctttgataaccacaatcatcattagtgagtccaacaggggactggctttaacaccaacccaaatgctcagaagggtgcatttgactagcttgacctacatctggttcccctctgtgatgttttggccatcacccaagtacttgggatctttgtctctagctagagcttcaggaatagtagctcacctactcctaaaactaatcttcagaatgaaaaacaatggcagcactgcagaaaaagggctaggatgtggaaatgcaggaatagatgcttccaggaccacaaaaaatgcagcatctaagaaaggacaagtattagggatccctttcatatggtcttgatcttccctcctgctttgacagttttagtgggttaaatatgctaccctgttgggaggtaggaactgagagactaaaaatcccaatgcaccagtaaaatttttttaagtccagagaaagtagaactctggtgaaagccatttgtaagcatatctccagaatctaatatatctgtgtggccaaaaacagtgggcactgttaattcacaaccagacactcactgagactcaggaacagaagggggcaggtgctggtaatcccttgagtgctaagcttttttaataatacactggagagcagaggggagaagaaacagcattaatggaaatgattgaaacaaatgccccactagtggacagtgatcttgttttgggcttacaaaactgattgattatcagatccaccttaagcctcccttttgagaaggttctccatccccacccttgctcctaacacccttgtcgattctggttacatcagtctggaacaagggcagggactttgtaactttcaaaagttcctcaggtgaatctgaggacaaacaaggcttaggaatcatgggtccaacccatgagattcacaaaatgaaaatatgcaagtcaaatgccaaactggcccatctggtttcactattccaggaaagggagcccaaaaggatgctaatttgttacaagtggcctgaaaaatacatctatgttttaaatacttcctctcttgaaatagtaaactgaattacagcaagctagctccatggtgatattttccctgattccagttcacagagagaatttaaagtgaaaaatccttttcaaaaggaagatacaataggctgtgctcttcaatgatgcttgctctgggcccagtactgatgctgaccacttcacacacgtcatctcacgtaatctgtaaggaaggcatcatcacccccatcttacaaatgaagtcactgtctcagggagatttaagtacatttgcccaaactacaaactggtgggatgtgaattgaactttaatctgatttcggagtctttaccttgaagtctatacagtatgttgctttcttaaacccccccacacctacatctctgcttcagtttctaggtctttgtatgtcacttaacaagcatcccctccatgccaatgtggttgcacccatttcttcgctagggtgctcctgaatgcatgcaggcatgggtaagtgtatagtgagtagtaggagtcaagacaagaggctgggagctgtctggggctcctcctgggatctcctggtggggtgcagaactattccagggattccaactctggcctactgtacagaagaatcaagggacagacattccaacagccaggcaaaccagaaccacagagaaaacagggaggcagtcaaagccatcaggaccccacaaatatacccaccaggagaatcaaatcagggtctgcggaggcaacaagagagtttgttggtggcctagatttttactctttggaccactctgtatttcagcttcacgcagcagcttgcaaaagagccctggggatggcaagaaagcagaaagcacctctctttgtagccacaactacagatcccaagaccactatgaccaaattaggacagaaagccttcagtgacgcacacacaggccctggggagtctgaacacgagtagatctaatgctgttgaacaaaacgtgaaaccgaagaaaacacccagccacacagagccctttgaattggtggcttcactccagggctgcaagtggggagagagtgaaaagagacaaagcctggctttggaaagtctcaaaagagtttctaggaatgccacgtcccaaatcctgtggggtttgtgaggggtttggagagtcctgcttgttgaaaagcacttagttgtcatagtagaaagtggagttctagactcccctagccctcattacaaatcaatgagtagagtttaattctaattgtgagatgactgagaaaggatttttatgataagcagatgaggctagggcaatttcaagtgcaagtaaggtctttatttattggctttttaaaaaatgtcccaccattttgtatgtatttgggggttttgcttgtggagagagcccaggagtgggacatggaggtagacaacactgataacagtgagagacgctgccaggcagtctgagttctctgttcctagccctgggccaagagaaatgtgctctgacccaaggttaggcatgttctcacccaagaccaagaccaaggattctcctaaacattccaataaatacccaacgtagcttttaaaccttaatctgttatttcctagtttgcagagtaaaatataccctgtcagaagtgtttgaaccagagtgactccatcttgaataggggatgggtaaaatgaggctgagtcctactgggctacattcccagaaggttaggcattcttagtcacaggatgagatatgggttggcacaagatacaggtcataaagaccttgctgataaaacaggatgtggtgaagaagctggccaaaactcaccaaaaccaagacggtgatgaaagtgacctcgggtcgtccccactgctcattatatgctaattataatacagtatcatggtaaaagacactcaggccagcaccatgacagtttacaaatgccatggcaacatccacaagtttccctatatggtctaaaaaatggaggaaccctcagttctgggaaatctctgccccttttctggaaatctcatgaataatccacccctcgtttagcatataatccagaaacaactgtaagtatactccatcaagcagctcatcctgctgctctgcctatggagtagccatttttttactcctttactttcttaataaacttgcgtttgctttactttatggacttgccctgaattcttttcttgtgtgaggtccaagaaaactctgttggggtctggatcaggatgcttttctggtaaggcccctatcatcatcccacctaagaaaacaggaatcccagggaacctaatttcccctcgtacaaaatatttattaactactcacacccttgaggtgtcttggtaggaactgaaccacttagttcagacattggaagtgattccaaacttggctactcatgagaatcacctagggaacttaaaaaaaatcctgggtcccaaccctggtgatgctgacacatttgggccctcccaagatttttgaaagctggaaccatcaatgcaggaaaaaccttaaaagtgagtggaccctaaaatcttcctgggggcagatttccgtgcttctgggagggtcatttccctgagtcattaccctccttagtgttctggaaaatggcaaagtacatcaaatgcagggaggattcctcagcagtcatgacaattgctatttgggttaagttactgctacatctttaatattcccttggggtgagttgtttgtttgtttgtttgtttggggagcagcatgggggctaggatttttttcttaaaatgactttagaatgctcagcttatttttgtggatgggcagacaagttataattcaaaccacagtttgaacattaggtagagagaggtagagttatagtttgaaaattaggcagaagaagacagcacaggtgggtgagatcctcactttacaagaaggtggaggctgagcccaggatccagttgcagtttggagcaccaacccagactttggggttggaaccttgttctgctgtggctgttctgtgggttctataaggctagggctataccccacctgctgcccaagggtaaggtttaccctgaaggaagtgaacgttccctaggaagacaatgaaggctggaatgtgggtcttcattgcaactcagagtacccctgacccccacagcatggtggtgagcctgcccttcctctagggagcaggatgcccaggagtggggcatgaggcacccacaagtgaggacaggtctaagcctggagatgcctacagtggctaccttttgaagaagtgttaagttactctctgtgtttcctttattacccttgatccatcaaaaaaagttgtattcagacatacagcctgatctctttgtgctggaaggaatctggggaaggacctcttccaggctaggattaacagggagaatagcaatgagagggaggggtcagcatttcttcagctgcaggaggcaattagtagacacttaaagaggatctgagcacagctcagctaatttaaaaaatcagcataatttgagttttaaccaaaatatgactttattttgtatttgcaaggcaccaaggtctgctatacacaattaacctcccctgtcctcccctccctcaaggcttctgtctgacagactcagcgggaggaggaaaggaagagtccagctcctctgctgctgatgaccctaatagtcctcctaccccactgggctgcaatgaccacatctgcacctatagtccctcatccaatttgggacttattgcagtgcagaccttaatcctggtctctccctgacctcctggccactcacacacccagtatatctccatgctgtcccatagacacttcaaacccagctcctcaaaaacaagccccacctcttccttctcctgcattctctccctttgctagagcacaagcacccactcggtcctccgtgcccctcagctgcctcatctaattctcaccaagacccacttctgggcctctgccttcccttccacttagtacctcaggcccagtcctcatcatttctcccttggaccacagcagcagcctcctgacaattccccaacactcaaagtgcagtcctggcatgccgaacttggagacagcgagcttaggtgcacacccaggtccccagagcactcagcagctttcttcacacattttctcttcccttctctcttgaccagatacagaagagccagtgggaaattgagaagcccttaacaggatggtggagccacaacatggaaggaacctgggctcctgaatgactgtatggagcaaaatccccccacatactaacccatattgaactgtggtggtttgttacagaattaaccagccatgattaatagtgagcaactcaagaacaaaaagaacaaacctataatagaaaagcaatgcttttccattcacaaacctttcattacaaaatgccggtcgtgtcctacagccagagtagtgagtatacctcgctggaggctgcaagggccagccagtccccatacacaatcagagctctctgcaaaagacgtaataccaccagccctgtactgtactctctcaattgccctctagtttccccaccccaatattgcagtgtctatgatcactgaaggaaaatgaaatatgattctaggtgtcacctttcaaagggtgttagtgactgtcagctaaagtgatttaagccccggaaaaacctctgtgtccttttaacatccaaaactaatcctcttcacaccagacatcgatgttaaataaacagagatttccattaacctacacctctgtacatctatttttaaaaagcggtgtcactctcctttaaatgaacatactaattagtgtattaataaatagctgaatggaatcaatgagacatgtaatcaaggtctgaccaggagtcagggccaggttgaagggggtggggggaaggagaggagggaaaagaatcttattagcaggtttgctgaggagggacatgtaaaatcaatgctgcacatgcagccaagatgcagccgaagttgacagtagatggaaagctaagtgcttgctccgcctccttcctttgacaggaaagctcccggtgagagttaatgtgatgagcaaggaagacattaattggggcaggaaaagccattcagagatggtgtccaggatcacagctggcagagttacccagaacctcagtgctaaagccctgactcctagaccttgttttaaaacactaagaaagaacacacttacgagagttgatttagttctcagcaaacacttggtcaaaaagaagtcacagggggagttatttgtttggggctctttgttactcttaccccccttcaaaaattctggttcacaagcagtagctggaagtacctttgccccaagatgctaggcactgggaaatgaagggcctggattctctacaggcagccctgggggtgggaatggggcagcccgcttcttcatcagctcccaatttcctgtagcacaccccatagctagaaggctctggaaggtgagaataaaaagtccttctgcaagtgtgaggtttccagctgaagtggtatctgattacccgagccgctgctcactggatctcaaattagcactgatactccattttcttcatctggagacacaccccctttgggccacaaaacactggacagaagaaaagtggactttcatttccctaaagattaatatcaggagaaatgcctttctgtataaaatcaattaggtgcctgagaccctcaccccaaagccagctcagtgatgctagttgaagtagaagttgtgttaggataaaagaaactcaaaaaaaaaaatttgccttggggccagtactgcccattacaagccctcttaggggtgattctgccaggaggcaggggattggcttgttagcagttagaatgcttggctcaggattctggggtgctatgggctcccatgccatgaaactgaagttcttcctaattctggttgctggaaaagccagtatctctgggtggacctcacaggcagaaaacctgctgctctgaatgcctagctctggcacggcatccacacatggatgatctagaagccttgcagatgcgtcctgagatatgtttctgccagccccaggcatggcctgcaacctgctcaccctgaggtcagcatttcctggaatgacagggaggacacacataaaggaagtgtggggacatggcaggaggcagctctcagcagcccttaggctattttccacattactgcgaatggtattttgcccccaggaggttcataacagtcagaaggatctccaggttccccagacccatcagaaaagccaaggggtgatggtcatcagcccagggggagagcttcctgacagggtacatgaaaattaagtgcaaaagaggggccagagacagctgtcccccagctcaatctgaagcacaggcacctagagaatggccacacataggaccttcccatctggtttgagaggtcctagcaaagcacccctgcaccagtccatatcttactccctccattgacgtgctaaaagtctgccactggaacatggtttctttgggtcaagcatcatgctttctctttcaacaacctacaccttagtgtacctcctccatcacctctgtttttctgtggcccaaggataaacagaagagagtggagagggtgcaaacagcagggtccccactgatctacatggctatttgctgagaattagggagtgctgtcctctctggttgaccagaacttggtaaacagaaggcatcttgggggaagaaaagggcaactcttcctgagcaaagagatacaccaagccttggccaataaaacatgagcagaatttcagcccttatttgctcccagctcacaggtatacacactacagtgtatatcaccaaaagccctgtctaaagaaagaaagagagaaatagagaggagatacccaagtacttggggcaaaattcaactatttctcaattttgcccaaggatacccatttggagatagatatagatatagatacatgactattttcaaaccaaaaatatcaggacacacactcaagcaatggcacagaatatctgaaacacaggctgttctagtgaacacagggcctgtggtcactgtagaagggctgaagagtagaggatggcagtgacaaggaccctggggggacagtgtgacaatgaggtgccccttttcctttaggggacagagaagcaatggcaaatctccccatggtgtgctatgtggtggaaagaccacctccacaagaccagagccggactctctgctcacagatgtcccatcaccttcaaaatacactgacacactccgtttccagagtctccaagcttttgttccctctccacaggggcaaatcacctttctccacagtcaaccagtggttctttcctctctcagcccgagtgttgctgggaataatgcaatgtttccagcttaatcgtttgtcatcatgcagagatttcactgatttcaaagctaaggtgcctggaagaatcgagcacgctctgaaccagggtgcctcagggcagagggttctcactggctggctggctttacacaggagaatcccagaggcccttactcaccagtttaaggctatctttccaggaaaccagggcctggggctgaagacagctgagatgggcagtgttcataaatatcacctattggaggcaagtgaggacatccaagtatgcaaacaccatgtacactgaacacacctctctggtctctgatggaccacttcagctttctgacttcgttgcaggcaaacattagcagatgccccatcctgcaatgcttggcataattatcaggtaggctccaggcaataattactcactaatggttagccactgctttgagccaagagtctcctatctgctctccctacaccaaattcagagtcttgggtggtaaacctgaaggaaaaaaaaaaacaaaaaaaaaacagtaaccatcaccatggcctggcaaaaaaaccacattatctaagatatcactccaggtcctataaaaataacgtatgtttacatgtggatggctgatctgagcacagattgaatatataaacgtggctgttaattctagactctgagaaaattctgagtcttccaaaaataaaggaatccctacaaatatttttaaatctttttttaagaggtcatactctgacagagagccagaattaatgcaatgggaccagccacctgctcttcttcccttcccatttgcttatagaacctcaaggcagtagacttgttgaagcccagtgttagaaacagatgtgactatttataaaccaagaaaactgaagtgttttaatccaacacagggtggcaagaagcagaactgacaagctttaggaatctgaagaacaggcaacaattttcaataatattacctctccacttattgagcatttaatatgtgtcaagcagtgtgcaagctatttcccacgtattatgtcacttaattgttagagcagtcccttattttactcttttaatgataaggacactgaacctcagagaagacaggtaacatgctgacgccacacagctgagtagccaaggcttgatgatgtctgtaaattactttaaaatgcatcagcttaaacagagtggtataatgtaagttagttccaatccttacccaaggatggttagtcgacatctgaagtattgtaactaaccagggctggtgacttagcctttgaaagccttgcatcagagtctacactgtttgttaaaaaacataagagatgttggaaacaatttatcagcaggaaattaagcagtgtcgaatatgcataattggttagaaatgccatccaggcatctctgccctttgggcacaagaatctggcaagcctagagccctctgtggctccattcttggcctaggggtcctactagggtctatttcatctctcaaaggatgctgtcctctaatcccactagaaggtgagctgaaacctgcaaccacattgccacatctgcctcaaataaatcttccttgaaataaacttgtaagagttactaagtcagtgcctcccaaactttctcacttcctgacacttgcagaaagtgataatatttttaccacaccctggggccagagagggagcttctgctgctgcatgcccctcgtgccctctggctgtccacctgcagggttgaggtgacccgctatatcagcaaaccttgatacccttccccggcacactagttgaggcagacagcaggatccacactgagcttcaaaaacaggctgtatggctatttatgtgcctggttactaacaaatattggtaggtagggtagaattgagtctgcaacttgcttttgtaggaaggttgtggaggagaaggcccatagctctcacctgcctataatcactggaaatgagtccccacataatctgcccattgggcatggccaagttggcattaagttgggttgcagtgccagacctgtctgcctccaaagtctatcctgggtcctgggtgctcccctgcttctggagcctaaagaaagtgaatcaatggttatttgtcaaacccaaaagggaagctcttcagaaaatgccatgtcaaagggttccgtccttggcgctgtgctgtttcatacttttatccgtaagttgaatgaagactgagagtcacatttatcaaatttgcaacggacagattccaggacttgtgaaggtcaaatgagataatatgagagaagtcatttaatagtagagtaagactcaacccattgatgaggatgaaacaaagtttaagactatcttagcagcctgaaacagggtcaaaactggaaccccaaaaagaaattgaatgtgacaaacataaattcaaattttaggcttcaaaaaatattaatgaataaagtaccaggtggcagaagtttgtgtaagacacacatataatgagggtgggagaagcttagagacccactggttacgaaccagcagtgggatgggggctgcccagaaaccctgccacatgaatgaattttgacattgggctttgctatccacacctcctgcagatggtgacctgcacctgtgatcagtcacaaaattagatgtggagtcagacctacctgcaccatgagaagcaatgagctctccatcaatgtgcaaagcagttaaaagagaaggaaccctctatcacgtgctactgaagttgagttgttcccatcccctgcaaaggctcccaacttgccagcacagccaggatgtttggctcagagaaaagaggtggcaggagagtttatcaaaacctacaacttaagattttcttcacagaagatggaggaaatggcggcagggggggacgtaaagataggcaatcaattaccaaggagcccttgaataaaaatctctttatttccttgaattttcctttaatttatcttttttttaaaaaaaaaaaagttttcacctttgcaaaacctttggactttttgaccaaagacaacaggaagtcagccaagtttaatggagttttcattttgaaaaagatgttatctgcagctcctctgtgcctaccaagcaatatggtacgtctgtggtctagagaccaactcattaggtgctctgtttaccatcagctggtgaaaaatgataattgtatggaagaataatcaccaagacatggacatcactgcctgcagacttcgccaggaagctacttcccacttcctgtagatccgcagctgtttcaggatgtgtaatgccctctactgtcctaccattcaaatacttctcttttcaagctcagaaaaccaagtttaaggtagggagagagagagagagagagagacaatcaaacaaccttatgttgggtccagagggaactgcaaatgtgtctaagacaatgcctgctttcaagaagcttgcaattaagtgggaatatgagatgtaaatactgaaaatacaagccaataaatcatatattaccaggaaattcttggcaggctgagttttcagaaagtctctacgtgtactactgtctgcacacaaaaatgcccagacctggcatgtggctaagtctacttgtaaaatttgttacctggttaaatgctgttccatgcctaccaatatttttaagttttcaaatataagttttaggtgaaaatgccattctttcaaaacagtatgtgctggagaaatgacattttttcaaagcaaattttctatatttggtcatgtgatattctgtaagcttttttataaaggctctttagaacattccaaaaatgagcatcatcaaattaaaacaagagaacttctattacattgccacaaatcctagatgtaaataaaataccatttcactcaataatgattgccagaaatataaatacagtttagaaaaattatttaattagtttatttttaagtatttgccaagaaggcttcggtcttgctagtattaagtcctgggagaaggaacaaaggagagtgaaatgagctacagcaacttcatgcaattgggcctgggtttagcaaagctcactctctctcctccacacccccaacaatcggcctggggccaatgacagccaagattctttgtccaatttgacatcatgcacatggccagtaccccgcctctttcgcctttgcctgctttcttagatcttctcatccgagcataaagccagcagcccctttgaggacatctgataccccaggtcagtaagtagtctctaaaatgaaacataagaaggtggtacaagaaaaggggaaagtgtagggattccctacctttgttgcaggctctgagacagccttggagagggctcagctcaccaatcccaaaggccttacccgcagtggacaggggcatggtgaggggatgtaacaaggacacccccggtggcgtcaactgctctattccagtcctgaccacagatcactgtggttaggttactttccttcttagagccccaggccttgacctctgcctcctagtaaggaaacaatgtgccaccagataaacttggagaaactgctgaattccctgagaccaaaagtgcagctccgtaaatgtattacatgccgagaacagttgataaaatgtacaagggctgggaaaagaggcatgaggaggaatgaacagaaatcctgccacctctatggggtttttgaaaggttagagctcaaaaacacttaccctgccccctgtttctccccacaagacagcccaaagcacaagacaattttattagcagctctgagatacccagaagcaatccagagaagagggtagatccatcgtttcacttgatgttgtactgcaattttgcagctaaagacattctttgggcctgaactcccggggtccctcagtcttgaataactggtataaatgatgcccgggctagtcagaggccctgcactgtctggggcctctccccatccccaagtctcactaccttccgcagcagcacagagggttgaaagtgtctgggaagacttgaaggagttgagcatatctctctctctagcactctgctcaaaccaatggcctgttctctgcagttcctatgacatgaacactgtaatggaacacaggagcccatgtctacatctcctacaacaaatgaagaccactaaattataaagctctcctgcagaatgcaaagcatctgtcactaatatgctaacccattcattttttccccatgtattggaaagagagagaacagatactgcttgggttttactaagccctagactgtgtctgctattttaaaaataccttcatcatagatgtgtgaagcaaagatatgagaaacagggggtagaacctggagaggggctgccccacctaaaggcattcccatgataaaaatttttccttggcacttgacacgcctggaccaagccaaccctatctagtcgccaggtcctacctgcaggctttgattgtgcagactttgtcctacctcccagaatgtgggattagaccaacaggacattattcctaatgggcaaggtcaatattttaatcaccaatctcttagctcatggtggagttcatttccctagaccacactgttttgagcatgcgctcattgaagttggaggcacgcaccgaggaagggaacaagcagaacagaggcccaggtgcgctctgttccaagcttgctctatagcactctgggtgctactcaacctcccgggattgttctttttccactggaaagtagtgggactctcctaagggaaggtgaatacctgggatgctttcagaacaatttcaagtacattgtccaagacagtatgtttacgccgaaacatgaaccacttgaaaaatgcaagaatctctaggtggatcttcttgcttctttgtcaagtttctgccagatcccaaaaggaactcctaagtctgcaactgggtccagaagtaaacagcactaggtaagcatgaagttgaagctgccggggacacaagagccttgtatccgccggcctcctggtcacttccgcctgcaaatccacatatgccccaattcaccttgttcagaaaagaatgcagcactcctgccccaccactcccccgacagcctgcctcagtccagatttctccagctccactaatggcatcatctcccaccagctgcccaggcaagacacctgcaggacaaccccactgcccgttccttgctgcccaccaccttcaccgccatatccaccatcatctgtcagcgctaattcctacgatgcacttctcagatcagcccctttctctcctttgccaccccctttgatcagccccggctcaggatgctttgatttactgcaatagcctgcttccagttgttctccacgtggcccccgctgaaccttgctacagtacaaatctggtcttgttgattctcttccttggagatcgccaaggcctgactgctgcctgatggataaatcccttagctggatactgacactggtcctggtgcagcctctgccgtgttgccccttgccccacttcccacctctgccttgaactcctgcagaccccaagggctgtgctctcacctctctgtgctgcttcctccacgtgggacctctgcttatgagttcacaaagccaatctgagggatccttcaaaacatcctctaaaactcaactggatgcccctcttcctcctcctcctccttctcctcctctttctccttcttctcctcctcttcctcctcttcctcctcctcctcttcctctccctccttcttgtcctcctcctcctcttcctcctcctcctcttcctcctcctcctcttcctcctcctcctcttcctccccctccttcttgtcctcctccttcttgtcctcctcctccttcttctcctcctcctttctcctcccccacctcctcctcctccttctcctcctcctccttctcctcctccttctcctcctccttctcctcctcctttcccctcctcctcttcctccttctcttcctcctccttctcttcctcctcctcctcttcctcctcctccttctcctcctcttcctccttttcctcatcctcctccttctcctcctccttcacctcctcctactcttcctcctcctccttctcctcctcttcctcctcctcctccttcttctcctcctcctccttctcctccttctccccctcgtccttaacctcctcctccttatcctcctctttctcctccttcttctcctccgcctccttctcctcctcctccttatcctcctctttctcctcctccttctcctctgccttctccttctccttctcctccttatcctcctcctcatcctcctcctccttaccctcctctttctcctcctcctccttatcctcctccttatcctcctcttctttctctgcctcctcctcctactcctcctcctcctccttctcctcctcttcctcctcctctccctcctccttctcctcctcttcctcctcctctccctcctcctttctcctcctcctccttctctccttctcctcctccttctctccttctcctcctccttctctccttctcctcctcctctttctcctcctcctccttctcctcctcctccttctcctcctccttctcttcctctttctcctactcctccttctcctcctcctcctcttctttctctgcctccttctcctcctcctccttctcctccttctcctcttcctcctcttcctcctcctctctctcctcctccttcttctccttcctcctcctcctctgcctcctcctccttctcctcctccttctgctgctcctcctccttctcctccttctcctactccttttcctcttcatcctcctcctccttctcctcctcctcctttctcctcctccttctcttcctctttctcctcctcctccttctcctcctcttcctcctccttctcctctttctcctcctcctccttctcttcctcctttctcctcctccttgtcttcctctttctcctcctcctcctccttctcctcctcttcctcctccttctcctcctctttctcctcctcctcctccttctcttcctcctcctcctcctctcctccttttcctcctcctccttcacctcctcctccttttcctcgtcctcctccttctcctcctccttctcctcctcctccttctccttttcctccccctcttctttctccacctcctccttctcctcctccttctcctcctccttctcctcctccttctcttcctttctcctcctcctccttctcctcctcctcttctttctctgcctccttctccccctcctcctcctcttcctcctcctcctctccctcctcctctccctcctcctcctctccctcctcctcctctccctcctcctccttctcctcctcctcctccttctcctcctctttctcttcctctttctcctcctccttctcttctttctctgcctccttctcctcctcctcctccttctcctcctcctcttcttcctcctcctcctctccctcctcctccttctcctcctcctccttctcctcttcctccttctcctcctcctccttctcctcctccttctccttcctcctcctcctcttcctcctcctcctcctccttctcctcctctttctcctcctcctccttctcctactccttctcctcttcatcctcctcctccttctcctcctcctttctcttcctcctccttctcttcctccttctcctcctcctccttctcctcctctttctcctccttctcctcctcctcctccttctcctcctcctcctctttctcctcctcctcctctccctcctcctccttctccttcctcctcctcttcctcctcctcctccttctcctcctcctccttctgctgctcctcctcctccttctcctcctcctcctcctcctgctgctcctcctcctctttctcctcctcctccttctcctactccttctcctcttcatcctcctcctccttctcctcatcctttctcctcctccttctcttcctcctccttctcttcctccttctcctcctccttctcctcttcctcctccttctcctcctctttctcctcctcctcctccttctcctcctcctccttctcctcctcctcttcctcttcctcctcctctccctcctccttctcctccttttcctcttcctcctcctcttcctcctccttctcctcctccttctcctcctccttctcctcctccttctcctcctcctccttctgctgctcctcctcctcctctcctcttcctcctcctccttctgctgctcctcctcctccttctcctcctccttctcctccttttcctcgtcctcctcctcctccttttcctccccattctttctcctcctcctccttctcctcctcctccttctcctcctccttctcctcctccttctcctcctccttctcctccttttcctccccctctttctcctcctccttctcctcctcctccttctcttcctcctcctcctcctccttctcctcctcctcttctttctcctcctccttctcctcctcctccttctcctcctccttctcctcttcctcctgcccctcctctccctcctcttctcctcctccttctcctttctcctcctcctcctcttcctcctcctccttctgcttctcctcctcctctccttttcctcctcctcctccttctgctgctcctcctcctctccttttcctcctccttctccttctgctgctcctcctccttctcctctttctcctcctcctccttctcctcctcctcctcctccccctcttcttgctcctccccctccttctccaggagcccttcttcatgtcctgcttttcataactggatgggtgcccgtcttcctattcccagagcaccctcttcatgccccagtctcactctctgacacattgcatgtaaattctctattcccacgtatgttgtggccacactaagctgtgaactccctgctgacagaagtaggtctttcatctccacacaaattctcacatagtgcctagcacacagtaggcactcaataaatattgcttgaattgactgattgcttgatcaattgattaaatatttcataacatcatatcaacctctcttactaaaatatgcaaatatatgtgcatggcgcttggtgaaatgtaggcatcgaggaatcttacgaatccttttctttttctgcagtccccaattgaacctactactaccaggatggagatccccccggggacccaggcctctggactcctgcactgaccatcccctgccactgtctcctgccatccctgctgcattctcctttccgacctgccatccctgctgcattctcctttccgacctgccatccctgctgcattctcctttccgaccctctgcatgtggtttttatcccttacacctcctcaccagatcagcaaacacacgggagccggcaaggtgtgatgtgaggcctaagctcagttttcattctctttgtcttgattttctttcaccttgtgtgtaaatagactctttcttctgatgctcacccaaccctttaatatgcaaggccacattcatcctcacctcctgggctgcagacgcgaaacagcaagggcttattcctggctttaaagaggagaaactgaggcctagcccagagaggggacttgctgaaagacattcagtatacctaggattagaagctcggtctctgtattccctggccagtatataatacctcttcaattgctctgaaaatgaaaacctcaggattattttgcaggaggaaacaaaaataggcctggaaaaaccacagccacatttctgacaagctccattcagagggcaccataacttacataaatgatttcctattacaccgcaattgtcactgcaacacgacagtcttgcagcttccttgaagtgttctctttgttgttttttgtaaagatcctccagaaagaagaatcaaatatggtccaagcagggaaacaaagcacatgacatccgcagacccagattccccttccgcatgattctttctgaggaccaaagagaatgccatgaatagtcccccgtgggcctgagccctctcccacctgtcttcctcccaaagctctgctatatccttgcaaataggattcctttttttgaaaaaagaaaaaaaaatgaaagccaatggtttatgaagaagaaatgaagtggcaatttcccagcatggctgggaatcaatacaagctgttgtcagggttttcctttcaaagggtggctgccacacttctccaaagtcaagagcgacagagctccagtgcttgacttacaactgcttcatcatagcaagatatttttaatttaaaactcactgcagttgggttcgaactcagctgggacttgatttactgctaattcatttctctgattcctataattctaagctcagtcaccaaacagtttaatgctgatagaatcaccagtgcaatgctttatgaatgggcgtcaggggaattttgttagtgtgtgttagcaactgttattcactctggaaaggagcaccgtgcctgcaccaagcatgggggggctctataattgggcacgtgaattaccagtatccccaagtgattcaaacccaaataccactgagagggtacccccttttaccccaacccacatacacactcccacactctccctctctctctcacacacacacacatacaatcattacctatgtgagatgaatgccaggcagtgaaaacgctttccatgggaaatgcctaacttcactctccaggtcactacccagtggtggaaaccatggatttacagtctaattagaaatcctcagccttttcttggatggcaaagttttctcttcccaagagaaaatttgtttcaaccgtccaaagtttagggagatgtgtcttaataactcaagcttcctttgttaatttgataaagaacatttatctttgtcagttatattgaagcctcttattcaagcagttggagaaaaaaaaattgagaaggtgaatgtcattactcacatattttgcaaacatccatcttgatctgttatgtgcaaccaaaaagtgccacttgtgggaaacatgtccacaaacctgtcagagtggcattcacactttttgaatttgtttctttatgaaatatacacctgaaggcagatcacaaggccactgtcgctaaagttttgtgagaattcgcagtcatttctgggagtctcaaaagcaaatgacaaggacaagaggcaggcggtgcctctgaaagttggggtcacaagtccctacaagtccctattttatcagtacagtgaattcattcttctggttttttcacctctgaagtaaaccaaaacttgaaagcttccagttgaaggtcaccatctcccaaaatgcctttctatggaaccgtctttccaggagacatcaataggcttaaatactcccacacaaacggatccccatggcccaataacctgaaaagcagtgggcaaagaataaataggtttcccaacaacaggtcttcttcacctttaattcgcccttatgcatctcctgaagaggacaaaagagaggatgcttgcaaaacttacttggtcacagaatgctctttccatggaggattttatagactagtctttggaatgttctgctaaattcagcttggtctcccccccaccccccgccgcaatctatcagtgccaaaacccatagtgagttttacacagagagaaataatttaattccatgtgcatccatgtgcaagaccactgcacctacctgtccccaaccactatgacccaggatgctggagggtaactgaggggctcagcctgtacccatctggattcatctgaatcctctggaatagccagtcagtctgacttgatgtgatccctactctgtccctgctgcagagtaagaacccaccatattagtctggttcaccctagccttgatatttttaaggtcattcttctccaccttatcctactccatttattccttctatttttacagcaaatatttatcaattgcttccagtaagataggctctgggttgggcaatgagtatacaagaagtaagaaatgatccctctcaacctaaaacataaagaaatacatgattcccactgttttcattgccactgccagtagcagcttcttcaccattattaaaaagcatgaattgagttactgatgaaacaaaaaactgcttgaagcaggggctgaccctaccttctgggagctgcaactctcaggcagaaaccctaatgcaggcccacgtctctaggtcagtgatttgctcacatcaatcagtggttaggggcaagtgcatttagggaggaagatagggtcagtatctaatggacaagagagcagggaaagaggtcacaagcacagcatgaccattagtcctctccccagcctgaccctaaagggccttcaaagcacaagagtagtaaaaaacgttgatgaggggcaggactagctagaagcaatgacttacaggaaatattttatgcagaaatgtcccctgttgcattatatttcagtgctttcattatttcttaaaactgggagggtggcagaggtcattacgacctccccctgcttcccagcagccgtgccatccctgaaatagtcacacaccactatgcggaaggctggctgttgcttagtaagccccaaaacattagaaaagtcttcagaaatcggattggcacccattcttaatgtggtttctatttggggtttaaatgggataatagtgtagtcgactagtgttgacacagactcgtgaattctggggctcctaattggagtaccctgccctgtcttgccatctgactctgttctgaagaactttatgttctttgcatggaaaccattatcccagactcccaatttatgtatctgcccaaatctgctgagtcccacctgacatcacgccaccccaccccaattctgaactgcagccattttcctgttgaatccttgttatcattgccactgccaggagcagcttcttcaccattattaaaaagcaggaattgagctcttgattaaacaagacactgctggaagcagaggctgaccctaccctctaggagccgcaactctcaggcagatgccctaccgcagacccacgtctctaagtcagtgagttgctcacatcaatcagtggttaggggcaagcatatgtatttagggaggaaaacagagtcagtatctaatggacaagaggcccccagtgacgctttctgctgttcctctggccctaaagttcttgctgtcttttcttccttcagagtcaaaggctgggctcctgcaggggtaaccctgacataccttctgcagggagagccaaggaagccccagccccagggcctgacccacagaggctctagcttgacctggtattcccaaccccaaagtgaggggagttgactcatgcctcgtggggtgacttgtgaccagtgagctacagcagaccagaaggacctgtggattaactgctggctgtgcctcaccaccacagactattctgagacatactgttcacaccaggcttccctggatacctcctgagtgactgagccaccagctgcttttcactgggaaggcagggccagcttggtaatacactatttgttctccttccttccctacctctcctcctttgcttcatttttgcttccccgggatctcacccctcaataaagtcataacacatagcttcttccttgagctctactttctagggaacccaggctgtgactggagtgaaggacagacaggcaggggcacaaggcccaggccctccatagttttgacaagaatagtcctgcttgcatctgttctgtgcactggaattccatataaaatttcactggagcaaagattttcactgtatacatgttaaaatatgtttaatcaccgatctagactaacctcctcattttataaacaataaactgaaacataaaatgatttttcccaaaatgctttagttagagttatctacatctatttgtatccaaagcctagctttttccacaacagtggtttttaagcaaggggacatattggaatcatctaggaacctaagaaaatggacacgtgcctaagtagctgtctctttccttggaaagacaagggacaggataggctctgaagaaggctgagcaaatgctgaggccagaggtggactctgtacctatctggcacaattctgcttgagaatctattgctcacacaatcaccagaatccagtacttggtttacgtaatgcaaaggttcagtggaaattttcactgtagaagccacccctttattcacatttgacagtagtcatagcaaagtgcttgtcttagtccagtgtttctcagtggattccaggtccactacacagtttatatacttttgtgatttcacaatccatgtgagtgtattaaaggctctgagaagtcctgcagcaaggagtatctttagctttgctttacacccagggttttgcaaacttacttgactgcggaaacttttttgcatgtaatgcctattgactcccccgcagaatatactttgggaaactctagtctattttaagtattactttcaggaaagcaggcctgagatggagaggaagaaaacgaactccaactgactctagcaacattagctgacattccaggcaggctgcttcagttgcacatcctgacgtctgctactgtctcctctctcactctctaaccccgccacaagaacggaagcaatccaccagctatgccttgcttacttctttcctcttggcctctgggtcaaagccaaggaatgattggttcaccttctagtttgagcctccacactaccaaaagggaaatccagctgtgctcattcgagaagagttcagtgagtatgtcagataaggaactgatcttgagcgaagaccaggaaagcctttcaactgccatggttttcctgtcctaaatttccagcgacctcttcctccactgcttctctcctcatacttcataatgaaaatactctaccctgtaagacctcgggaattgattcagcgaggctgtgttcagcgcattgactgcggagactatcctcttagctagtgatctgttttgtgttggagtgacaaaacatcccaaaatccaatttgctgttgcgaatcctggttcatggaggaaacaccatagagggggaggggaagatccaagcttagaaggaaaagagaggatgcctgagatctctccaacacctgttggtttcagtttgcacaggactttacctcccaatgttttatccactcattcctactgctgcctcagaggggaggtgatgaaattccacgtgcaccccttctagccacctcaagttggacagaacttttactcacctcacagtgtagagaagtcaaagaaataatgcatggaataaaagtttgtcttttggagaaaaagaaaaaaaaaaaggcaagtaaccaaagtgcctcacttgtggctttttcctaaaatgttcagaccagagggactgaggttagccctggctttggagtgggacagaacccaaccaggcccatgggctccttcagggattcacacccacacctttttgcatcaggatgtaattcctaatgccttgccttagcctgcaccatctcaggtctgaattattttcttcatgcaaatggggacctatcaaaattcctctaagtgctacaggatggctatcccctgacatggtccgttggcaccaacatgcgatgagtctctgctgcaaccaccataggatccaggcacccagcaccgcatgatgtccctaggcactgatttcttccctgcttctggatcctgaagtcagaaactctaggagtaataaatgaatgaatgaacaagtgtcaagtacctaccgtgagtggtgtaatggtaagaatctttgcccaagagtgaaaaaaccatccatcccttagcaacctggcgccttggacatctcacctaaactctcttctcagccttagcttctatgctatcaaaatgggaataaacaatacctaccttgcacagctattttaaagatgaaatgaggaagtgttgtttccacaatactagcaatttgaagcagtcaccagggagaattagactcctatcagaattggagcctcatagagtctaaagtaaagatgggaacttcactcattcattcatttactcattttttcctgggagaaaatgggaattgccaaatgaggtgacagtcaccctcaggacctgagcattctgctagaatgatccatgcaattttataacctaccaacagccaaggagaagactcatcccccttgatgaatggggaaatcgaggctcagtgaataaatacatttgcctggcatcacagaggtagtgcaagagactagggaccagatattctaaacttcctcccaagcactcacccataaacctcccaagggggcagcagtacagtgagcacatatattctaaggaggaaaccagcacagtgatgaggagaaaggtcagattgctcacaagtgagacttggctccatcactaagtggctgtgtgatctgggacaaagtctttaacctcctgcatctcagtttcctcctggaggaaatagggaccgtaatagcctatctgggttgttatgaggcaaactacttaaatggtatctaaaccaaatgagtgctcaataaatattggccaccatcatcattaattatcatcttccattccattgtttttacaagaactgaagccagtactaacatcctcacagcctcttcctttgggaggctgatgccacaggaccggacaagtgtgtgggggcatacacagactcacatagggactcaggaaactcttcttccaggctgctccatgccatgcagggaagcagcctcctccttcaggaacaaggcctgggctcttgttccaggggaatcaggacccctgcctgcctttcgttttaaaatccatctcttaccactcagcagcagagcccccttcagtctccctgtgggctccaccttcctaccgcaacttgaatggtacagcctgggcagtgaggacaacatgaaagaagaaagaaaaagtctgtgcagctagaggggatcaggtgggagtctggggagggagcagtggagcttgcagcttttaaagagacagtgtcctgtccacagggccctgtgtggaccaagcatagctcgatagagcctataggccaattaccctaatcatgtgcatctcccaaacagccatttattagtgagacgtctttttaaaatgccgcttttaaatataaataacacttaatcatccagctgtcgttaaattcatgttatattgatttcttggagtgccgcaaatttgagggcgaatgggctggcggatgtgcgcacaaagccaagaggtagattagcaagtggtgggggcagagaagtgggggttggaggaaaaggaagggaggtgtcaagggagggaaatgaacctactcaatagcccagggtctgagccagtttcacattgggtagcactggacacaaataagaagagaggagacgctggcacatctgttgcatagtctaatgagagccaagatcatggtcgtgttttctgtattgctgccgcccccttgtaacccaccacagagccgctccaacaggtctctgatgtgcattgtctgcgtatgccttctctaggtgaggatggggagaagcagctaagaaatgccccctagctggctaggaggagagagatccacagcgatttctctgcatcaaagcctgatgataactatgaatcaagagtggttaatgacccagcccctttagctctctcccacttcgggactgctgccatcctagaaagcccccacttcattcccagcagccctcattgtgatgaaaaggatcccgaggccaagtgtatgtaggcagactctgccgtgcagatttccctgtctgcagggagtagcagcagcaggcgacaggaaggcacagagaaggagaaaggaaacaagttgactgccttggagtcctccagaaatgtctgcagtgtcccagtgggcatccaggaggaagtcctgggaggacagatgagagcccggggaggcgtgattgggtaagaaggagcagcttgtaggtgacccatgcctagtgctcacaggagagctgccttaagcaccgtctaccaggcagcgagggtctgctgaaaagaagcattcatggctggggtttttctagtgtgactcccttcccagtgagaaagacctcagagaacttaaaaggaagggcacagaagagtggcagagagggtgaatgacagcgtggcatgctccagggctgggcaagagagccaggaaaacgtaatgtatactccgctttacagagatgttaattaatgcctgccttgtcctagaaaccaaattggtacctaatgctaagtgcagaaagtgcagagattttctgaacccagatgtttagcttataaccagcataatgatactagctttgcattaaaatgatggatcctgaggctgcgaatacatgagaaaggaaagagggtagggaggaaagcagagaaaggagtggaggtctacagggaagacacagacatttcaggaagatcctgtaccctatccctttgcctcttccaggtcccatgagggactgtttacctgggaggcacccactgttgctggagctcattatttcttttgcaaaccatgtgctgctgtacgcgtaggtgggatctgcctgtccacgccctcaaggggcatgtggggagaaatgttccatttcttccacagcccggaagacagaggtggaccccattgtcacacatggcgggggcggggagctgaccacatttagccagactctgagaacgcatgtgtgtatatatattgggtgtgtgtgtgcacacgcccaccattcttaaaaagcaaataaggtttcttccccctactggggtctctccattgtgagagatttgctttattccatctatgcttttcaatcaatcaaagggcagctcacacagcacacagcgggaatacaatctccctcccggggtgtctgcgcttctccccagcctagccagagacctttgcaggagctgaaaaaagtttggaaatagcggagtcagggtgctgaaaaagccctttcattcagcccctatcttcaggatttacaaaaacaacccaaattctgagcctagcactgaggcctccttgttcaaaagaatgtttgctcctcttccatcatgttctgtaaggctcctaacatattttttccactggtgggtctgtgggatactctgaacacatgatcttggacagagggtacaagcttattcagttttgtgggaaaatgatatgatcatgttgcctagaaagctacctcaaagtgacagcaccagaaacacaggagcttgtacatatatattcaattccgaatttgatttggatctcatgttcttctccctatgacaactgagaccctaaattagttgctcttagaccccaagaagggaactatggaaaagcctcttagaaccccagccacttcctacctcctccagaaaaagttaaaatgagcagcctgtgaaattccagccagagagaacaagaatgaaaatgctttcgggaaataggaccttaaagcacgggcgtctggggagtgattctacaatcggagcaggcttgggctctgggggacgctggcagacccacgaatgccttgccttctccggtgggcagtgccgccacggtcgtgagggaggggagcctcctcttttggaggactatatccctcgtgcttcccccttctagttctctttctcagacacacaccacgaaaggcatgtgacaggtgttcgccagccggaggcaccggggaaggcagccccatgtgcccagggagggtagggaggtgagaggggacccaagtcctgtgtctccaagtcctgtctgcttgctgctaagcaggcactgaggctgtgaataaggtcttaccttttaaggaggatctgacccccgtaccttccctagacaagcaacatacgcggcgatgctttaagccgctttctgcctgaaatctcggcgcattcccggggaagcagtgccacgcttcagaaaggcgtttgtgctgcctcttactggggaaacgcagtgtctgtttcatatgcgccgccctacagaactgcagccccaaccgcctatctggcctcctccccgggcgctgggccaccactctctccaaatatgcgtccgaatatctgtgggtctgtctcccgttgaaatcccagggtgtccaaaggccacggggccgcgatgacactgggtaggtctccggaaacctctcaggacttctcccattttaaagcccagctagggacgaaaggggctgggagctgaaaaattgctccctcaacctccccgggtgggaggcagagccgggaatacacagaatcccaccccgaaagtcccgggaaagagaagtctgagtccaggagcgtgagaggagaacacacccgggaaatccctgctccggccgctgcacctccgcgggcgtccaggtgggacgtgggcaggtgcgcgagcgccgtgtgtgccggtgtggatctgtgtgtgtgcctgcgtgtgtgcgtgtgcgtgtgccgcgggctggctccgggacactgaggactcccgggtcggcccaggtctgtccgaccttgctgccctcgccgcccgcccggccccactccccggcgggccggctccttacctggacgcgccgcgtttccctccttcagcgggagcgccgcattgacactgcagatggagcctatgccgctgcctctcgccctcctctgaacgtgtgcgtgtgcgcgcgtgtggctgcctcctccagccccagccccgaacgca

SEQ ID NO: 161 - DNA, 11857 bp, Homo sapiens
ataaagactcatcaaggtctcagttcaagtttaatacaaactacaaaagattaatgggttgctctactaatacatcatacaaaccagtagcctgcccacaacgccaactcaggccattcctaccaaaggaagaaaggctggtctctccaccccctgtaggaaaggcctgccttgtaagacaccacaattcggctgaatctgaagtcttgtgttttactaatggaaaaaaaaaatacagaagaggttttgttctcatggctgcccaccgcagcctggcactaaaacagcccagcgctcacttctgcttggagaaatattctttgctcttttggacatcaggcttgatggtatcactgccaggtttccagccagctgggcacactgcaagagaaaggcaccactaattaataaccttctcaatggtatgcaccaccattctcctatggacaaaaccagttctgcacctgaacactcagataccaggaaacctacccctgcaatcagtcttagatcattcacccttttagtatgagctaaccattttacaaacatataatcatcaccacagccttaagatactatcatgcctaatttattcatgtagcacttgaaatttaaattttccacaaaaaaaggcaaagtttaaataatttgccaacactctctaatccttaaggggaaaaaaaagctaaataaacgacacacataggactatgtaaacccttaacactaaactgtttctgacagcccttcagagctctgaagacagcaaactcagtctgccttctcagcattcttctaactctaccaaactggatagcctgaaccttataaaggatcaagaacttaacagaagcccccgcttgtttcattaagtaactgccatctaccccttggtaagcaaaaggcagagtttgaaatttttcatagatttatacagaaagcacagccttcaaccttttcctgacaatgcctaagaatgtgcctcaggctagcctgaagaaaatgaggcaaggggactaatctcttatttttctttttttttttttttttttttttttttgagatggagtctccctctgttgcccaggctggagtacggtggcgcaatctccacctccgtctcactgcaacctcggtctcccgggttcaagcgattctcctgcatcagcctcccaaatagctaggattacaggcgcccaccaccacacctggctaatttttgagacagtctcacattgtcgcccaggctggagtgcagtggcgcgatctcagctcactgcaagctccacctccggggttcatgccattctcctgcctcagcctcccgagtagctgggactatacaaaaatagtggggcgtggtggtggacccctgtagtcctagctactcaggaggctgaggcaagagaatcacttgaacccaggaggtggaggctgcagtgagctgagatcacaccactgcactccagtctgggcgacaaaacaagactctgtctcaaaaaaaaaaagtgtttggcattcattggctcttaaatggtacctatttaagaggctgtacatgttccagtgggatgggaagcagcagagaccaacagagtctgaagaagcaagcttctgagttatgaaagcctgggttcaggagactaacctatatgtaggttcctaggaaagtccagttaaagggcctactttgccactgctgcctccttcttaatgctgaacctcatctcccacaagggggcagtctcagcaggtgtcagctgagccatgtgtcatctgtccaggctaactgcccacacatccttctgcaaagggtacctcttggttatcagtgctcactgatccctatataatcagactctaatccctgtaaaaagattacttggtgctagccaagctagcacctttgggtcttcccaaacatacaccactaatccagactctaataacttcatttcctttaaattacaagatcagagctgaaataggccttagaaagctagtctgggctgggcgcaatggctcaggggaggcggaggttgcagtgagccaagactgcgccactgcactccagcctgggcaacagagcaagactccatcttgcaaaaaataaataaataaataaaaatatgaactatatggattaacctcttctctcaataaagttatttaaaaaatggcatgctttatctctagaggtgattcccaaccattttgttttgccctaatacatctgtgagatcatcctacattcagtaagttagatctttgggagtgactgattctaaatgagcaggacagaagagaggagtatgtatactttgaataaaaagcctttatattctccttcccaagcttttccattaccctcaccctcacaacacactgtaatccaggggcttcaatttatgaagagagatacccattttcttatttggtagcttctgttcctactatctttcccattctaccactgtggggaaaagagagatcagattgttactgtctctgtgtagaaagaagtagacagaggagactccattttgttctgtactaagaaaaattcttctgccttgagatgctgttaatctgtaaccttatccccaaccctgtgctccctgaaacatgtgctgtgtcaactcagggttaaatggattaagggctgtgcaagatatgctttgttaaaacaaatgcttgaaggcagcatgctcgttttaagagtcatcaccactccctaatctcaagtatccggggacacaaacactgcggaaggccacagggacctctgcctaggaaacccaggtattgtccaaggtttctccccatgtgatagtctgaaatatggcctcgtgggaagggaaagacctgaccggggtcccccagcctgacaccctgtgctaaggaggattagtaaaagaggaaggaacgcctctttgcagttgagacaagaggaaggcatctgtctccagccagtccctgggcaatggaatgtctcagtgtaaaacccaattgtatgttccatctactgagacaggggaaaaccgcctcaggggtggaggtgggacatgcgggcagcaatactgctctttaaggcattgagatgtttatgtgtatgcacatctaaagcacagcacttaattctttaccttgttcatgatgcagagacctttgttcacgtgtttatctgctgaccttctctccactattatcctatgaccctgccacatccccctctccgagaaacacccaagaatgatcaataaatactaagggaactcagaggccggcgggatcctctgtatgctgaacactggtcccctgggcccccttatttctttctctatactttgtctacgtgtctttttccaagtctctcattccacctaacgagaaacacccacaggtgtgaaggggcaacccaccccttcataccaccactctgttgtcctgttatcagacagatggcttaccttccccatgtttgtcagtgaactggaaggcctgaactagtctcaaagtctcatccacagagcggccaacagggaggtcatttacagtgatctgccgaagaatacccttatcatcaatgataaaaaggcccctgggaaaagagatgaaaggaaaagcaatacaggtttagagatgtgctttgttagaatacagaggcttgaagcctgaaggaaatggactggtctccacactcctactggcctggccttagtgaggaggcccctgcataaaggaatgaaatgacaaggagtctctacagatcagggctctagatctctccaaataaaaggctttcagccaactggatacttgtcctgatgacatacctgaacgagatgccttcatcagcctttaagaccccataatcctgagcaatggtgcgcttcgggtctgataccaaaggaatgttcatgggtcccagtcctccttgtttcttaggtgtattgaccctatggcaaaaggcaaacatacagttacattcaaactcttgacttgactgtacgcattcctctttcccctttcccatattcctaatctaactttccaaaaagactgttttttttccgttttccagcaataaagtgaatgctgagaacagttaaggtaggtcactagggtacactcaactgcaattgaagctgcttcttctctgctgccaggtcatgagagcaataagagaaagtcagactttgcactcccttcaatgagaaggcaatacttgaaagtctattgccaaagcttcccagttgctgttttaaaagttcacatgccagccaggtgcagtggctcacacctgtaatcccagcactttgggaggctgaggtgggcagatcacgaggtcaggagatcaagaacatcctgactaacacggtgaaacaccgtctctactgaaaatacaaaaaattagccaggtatggtggcaggcgcctgtagtcccagctactcaggaggctgaggcaggagaatggcgtgaaactgggaggcagagcttgaagtgagcggagatcacaccactgcactccagcctgggcgacaaagcaagactccatctcaaaaaaaaaaaaaaaaaaaaaaaagttcacatgccaaatagaccaagagatttaccatgctagatgacagaagtgagaatccacagaagcaccaatcacttggcagttgagtttcttaaattcttctgccctatcactgaaagcaatgatctccgtggggcacacaaaggtgaagtcaagagggtaaaagaagaacacaacatattttcctggggggaaaatcggagtcatggttagcatttgacacagacttccttgctttatattttcctatacaaaaagaagcaagttgatggctgacacaataaccactaactgccaagatgctcaatacagatgtctcctagaagctacttttagaacctggtgcattaggaatacctgaatgaaaaaaacttccaatcccatactttattctcctgcctccatgtcatagctaccaatacagagtaaacactgttcagtctaattttgatcttttctgagtggctaaaattaacataaacaccaagttctccaaagatagcaaaagcaaggatgcacttataagcatggcctaatgccaatgcttaacaatacccagagaaagctgaattgcagtactcctctgctgtagagataagacaccaataagaagtcacagcctttgcacttctcccgtgatgaaccatagtaatggaacaagcatggtttaagtgatcacatgtgttcctaacgtgcctgacaggacaggaaaaattttaagccaggcacagtggtgcgtgtctgtagtcccagctacttgggaggctgaggtgggaggatcccttgaccccaggagtttgaggccagcctgggcaacacagcaagactgtctcaaaacaacagaaatatatatatacatatacacagagagagagagagaaagagggagacagagagagacagaaaagacaaaagtactagtgagtaacagaacttctagctgcaattttaatgaagtcactgggattaaccactgaaataacagatcttcaaactggccaggcagccttctcgccacacccaccaggcttaaatactagaacaattccaaatattcactcatttccaggtagcagcaatgtttgaaaagtcaaacaggctgggtgtggtggcatggtggctgacgtctgtaatcccagcagtttgggaggcagtttgggaggccgaggcgggtggatcacctgaggtcaggagttcaagaccaggctgaccaacatggtaaaacatgtctctactaaaaatacaaaaattagctgggtgtgacagcgggggcctgaaatctcagctactggggaggctgagccaggagaatcacttgaaccggggagatggaggtcgcagtgacctgagatcatgccactgcactacagcctgtgcgacaagatcaaaattccacctcaaaaaaaaaaaaaaaaagccaaacaagcagccctttttgacatttaccactttgcagtatcactggaaactaactcatctaaacaacccttccagctttgcctaacaagcactttggggcctcagcaggtcaagctctggagggcagagaacagctcctcctagacctcctgcttatacccctgggcccaggtcacctccctatggtgcaacttaccttgtttgctgggagaagccccaagaacaaagtgtgattatgtcaggaaacctagtcaaatgttctaccaaaaactaactccagggactaatgctacaccactgagaaaaggacacttgacacctgagtttcaggttagcattctaaggaatctatatcctcaactgtcccaggagatcgagctgctctggaactacaaggtaaagaaaggaggagcctcaacagaacttgccaagtgtctgcatgaaactatgacaacagaggccgggcgcagtggctcacgcctgtaatcccagaactttgggaggccaaggcaggcggatcacaaggtcaggagatcgagaccatcctggcaaacatggtgaaaccccgtctctactaaaaatacaaaaaaattagccaagcatggttgcgggcgcctgtagtcccagctactcaagaggctgaggcctgagaatggcatgaacccagaaggcggagcttgcagtgagctgagatcgcaccactgcactctagcctgggcgacaaagcgagactccgtctcaaaaaaaaaaaaaaaaaaaaaaactatgacaacagaaaggagagttgttccatctgtaatatcaactctcctccggggtcaaaacaggcaagggaaagtgcctagccctcagcctaatattaacagctgtgatatatacgtgacccaaacaaactgaacgagcagtgtcacagctccagagatttgagtgagctctgagactttaaatgtagaatgtctcttataacaagagataatgagtatttctccaataataaaatagaggagggccagaggcagtggctcacacctgttatcccagcactttgaaaggctagggcaggcagagggcttgagcccaggagttggagaccagcctgggcaacatggcgcccagctctacaaaaagtacaaaaattaagccaggcgtggtggctcatgcctgtaatcccagcattttgggacgccgaggtgggcggatcatctgaggtcaggagttcgagaccagcctgaccaccatggagaaaccccgtctctactaaaaatacaaaaaaaaattagccaggcatgatggcgcatgcctgtaatcccagctactcgggaggctgaggcaggagaattgcttgaacctgggcagtggaggttgtggtgagccgagatcacgccattgcactctagcctgggcaacaagagcaaaactccatctcaaaaaaaaaaaaaaaaaaaaaaagtacaaaaattagccaggcatggcagcatgcccctacagtcccagctacttgggaggctgaggtaggaggaccacctgagcccagagaggtagaggctgcagtgagccatgactgcgccactgcactccagcctgggtgacagaatgagaccctgtctcaaaaataaaaataaagaaagaaaatagacgaggaatactgaaaagataattgagctagtatgtccagacataatgaagcatgtggtttctccagaagtggtttggtcctaggatatataccctgtaatcacttgataatcaccacttcaacatgaaggtaacaacctaaatacttcttcctaggagacaaaacattttacagtcaaacaacattgacacaaatctaacaagccacccctagaatataaaataactccatctcaatgagcccagtgttaattctctcacctttgtagtcagacaggctgatatctttaaactgaccatctggcataacagctgtggctttgaagttgggggcagggtgcccaattttagcatttcctgaagacatcttcctatcagctagaaataacagaaatgaattagaaacaagccttaattttctacataaccagcagccttcacctacttaaagagacttagctgtaaacaatcaaggcattgtccagtgtccctgaatacattaaatgttgttttagtaagaagctccagccagcagtcaagggtcacagtctgagctttccaacttttggaacgaaacaagtctctgaatctcagcctttgttttcatttaaaaacagcaaggcaatttctttatatactgagataacctctcattctttctgaaccataattagtgcagtggcatcttattcattatacagaagcagagagagaggcagatgaagactctcaaaccagaatccaaatgcacaatgccacaaacacttttgtttggctccccaaaagtcacgttgacctttcccatcactgtgcctccacctgccttcataacatcagaagcatatttgacttttctccaggtagctttgtccaagacagcacacaacctataactaattcaacttgttttatttgtttttgttttgttttgtttttttgacggagtttcgctcttggggcccaggctggaatgcaatggcattatctcggctcactgcaacctccacctctcaggttcaagggattctcctgcctcagcctccatagtagctgggattacaggcgcaggccaccacacccggctaatttttttgtacttctattagagacgggatttctccatgttggtcaggctagtctcaaactcctcacctcagatgattgcccaactcagtctcccaaaatgctgggattacaggcgtgagccaccgcgcccttccagtcagtccaacttttaagaggcaagaccactgggcgcagtgtctcacacctgtaatcccagcactttgagaggctcaggcgggcggatcaccgggtcaggagttcgagaccagtctggccaacatggtgaaaccccgtctctactagaaacacaaaaattagtcgggcgtggtggtgcatgcctgtaatcgcaactactcaggaggctgaagcaggagaatcacttgaacccgggaggcagaggttgcagtaagctgagatcgcgccactgcactccagcctgggcaacagagtgagactctgtctccaaaaaaaaaaaaaaaaaaaagaggcaagaccaagatattgattggcatctgcttaatttcaaatctttaggtattgtgtaagccctagaattcccttcaccatttgtgaaggtgggttcctgactttggggctaatatcccagggcgaaaacaagtataagaatcaatttactgctgaaaaggaaggttgcactggattcacccagatcaacaccaagattagtattgagatcttggccaagcgctgtggctcaagcctgtaatcccagcactttgggaggccgaggcaggcagatcacctgaggtcagaagttcgagaccagcctggccatcatagtgaaaccccgtctctaacaaaaatacaaaaaattagccgggggtggtggcacgcgcctgcagtcccagctactcgggaggctgaggcaggagaatggcgtgaacccgggaggcggaggctgcagtgagccgagatccagccactgcactccagcctgggcgacagagcgagactccgtctcaaaaaaaaaaaaaaaaaaaaaatacaaaaattagccggggcttggtggcacaagcctgtaatcccagctactcctaaggctgaggcagaagaattgcttgaattcgggagacaggggttgcagtaagccgagaccgcgccactgcactccagcctggccgacagagcgagactctagctcaaaaaacagagatttaacccactaagccgcggtctgaaagcttttccaagtcccaaagttcttagttcacaataccacaagcaaaagaaattttgtaagcatggatcttagcaaacttttaactgttttttaaaaagtccttaacacctttaacgacaaaaaacaaaaaccaaaaactaaggcatgctgcaacttggtgcccccaaatggccttctcgtccaatccttctttcccaagtggcccccaagtacaaaacccaaccaattcggggtaaaggctgctgggattcaggccgccaccgggccccttcaggggatctgcccagcgtagagggccacatccctaaaccccacttcaggtgccccctgtccctccccagcactggagaaagcaccagcagagagagtgcttcagcggggacatttgggctcatcgctaactccattccacgtacaggaaaataaagacggggaaagggtacccgaagctccgcagctagtcaaggctcaggacccggaacagccaaatacatagaggctgtcttctacagccacgagtctggatacaggtccattccagaagcttcccgaacccaccccgtccggcaggaggctagtctcggagacccccaccaccagcccgcccagacgccgcgccacgtgctcgagttgccgggggaagactcgactcgagtccacgcttgccttggggttcaaccaggttcccgcacctacgtggggggcccacgagaggggtgtgcgcagcgctcaagcagtctcggactccgggcctcccccggctgcctcacgcatcacagcacccccacccgagcgcgggcgggccccggacaggaggaggaagaggcaacaggcaagaagggcgcgccgcgcctcactccgcaggggccgcactgcccacactcaccagtcccaacacaagtcgcagaaactaaccaccgacaccaggcaagaacaagacgcgcaagagctctccggggcgctgcctttatagccagtagggatctcgcgagagtcggaacggacgggggtgccggaggaggagagagaggagggggatgtggcccgagccccgcccggcgcgccccgccggaatgactcggcgctttccctcgttggggcgggtgcggaaaaatactaataccccaccctgttgcggatggctgaggttggagtgaggcgcccttgtggccgctcccgaacccgaacgcttaggttaatcctagatctctgcggaaaaccaggattctctttacttccaggaccactacgcactgtgccctcaatgcccaaactggagtaagcgtcttagctgctgcccacggaggaccacgtctaaccacaccaagccatgagaactgtctatccaaatatttcttaagttcgcagccttaaccccagcgcagatcctcagtaaccctcatggcttagatagcttccttcattgttctctttaattacagggttgctgctttctgttgtaaaggaaaataaaatatcaggactcctaaacttacgccagagggaaagttcatcttgggaggctgattcagttacacgaccatcctctccccggatgaataatttgactttacaatcttgagtcaaaacattacacattagccagacccacacggtaaggcaaaaggcctcagacatttcctgatgactaccccccacaaacacacatacacaaaatcataattaattatttgctcccctggaaacctttaaagtatgtagcctcccataaaacaaggacgtgtcaattgcaactagatctacaatataaagtctagttcctaaaactaaagtttgttctattccacatttttttgagacggagtctcactcaccctgtcgcccaggctgtagtgcagtggcacggtgttggcttactgcaacctccacctcccgggctcaagcgattctcccgcctcacctccggagtgtctgggactacaagcac

SEQ ID NO: 162 - DNA, 10905 bp, Homo sapiens
ataaagactcatcaaggtctcagttcaagtttaatacaaactacaaaagattaatgggttgctctactaatacatcatacaaaccagtagcctgcccacaacgccaactcaggccattcctaccaaaggaagaaaggctggtctctccaccccctgtaggaaaggcctgccttgtaagacaccacaattcggctgaatctgaagtcttgtgttttactaatggaaaaaaaaaatacagaagaggttttgttctcatggctgcccaccgcagcctggcactaaaacagcccagcgctcacttctgcttggagaaatattctttgctcttttggacatcaggcttgatggtatcactgccaggtttccagccagctgggcacactgcaagagaaaggcaccactaattaataaccttctcaatggtatgcaccaccattctcctatggacaaaaccagttctgcacctgaacactcagataccaggaaacctacccctgcaatcagtcttagatcattcacccttttagtatgagctaaccattttacaaacatataatcatcaccacagccttaagatactatcatgcctaatttattcatgtagcacttgaaatttaaattttccacaaaaaaaggcaaagtttaaataatttgccaacactctctaatccttaaggggaaaaaaaagctaaataaacgacacacataggactatgtaaacccttaacactaaactgtttctgacagcccttcagagctctgaagacagcaaactcagtctgccttctcagcattcttctaactctaccaaactggatagcctgaaccttataaaggatcaagaacttaacagaagcccccgcttgtttcattaagtaactgccatctaccccttggtaagcaaaaggcagagtttgaaatttttcatagatttatacagaaagcacagccttcaaccttttcctgacaatgcctaagaatgtgcctcaggctagcctgaagaaaatgaggcaaggggactaatctcttatttttctttttttttttttttttttttttttttgagatggagtctccctctgttgcccaggctggagtacggtggcgcaatctccacctccgtctcactgcaacctcggtctcccgggttcaagcgattctcctgcatcagcctcccaaatagctaggattacaggcgcccaccaccacacctggctaatttttgagacagtctcacattgtcgcccaggctggagtgcagtggcgcgatctcagctcactgcaagctccacctccggggttcatgccattctcctgcctcagcctcccgagtagctgggactatacaaaaatagtggggcgtggtggtggacccctgtagtcctagctactcaggaggctgaggcaagagaatcacttgaacccaggaggtggaggctgcagtgagctgagatcacaccactgcactccagtctgggcgacaaaacaagactctgtctcaaaaaaaaaaagtgtttggcattcattggctcttaaatggtacctatttaagaggctgtacatgttccagtgggatgggaagcagcagagaccaacagagtctgaagaagcaagcttctgagttatgaaagcctgggttcaggagactaacctatatgtaggttcctaggaaagtccagttaaagggcctactttgccactgctgcctccttcttaatgctgaacctcatctcccacaagggggcagtctcagcaggtgtcagctgagccatgtgtcatctgtccaggctaactgcccacacatccttctgcaaagggtacctcttggttatcagtgctcactgatccctatataatcagactctaatccctgtaaaaagattacttggtgctagccaagctagcacctttgggtcttcccaaacatacaccactaatccagactctaataacttcatttcctttaaattacaagatcagagctgaaataggccttagaaagctagtctgggctgggcgcaatggctcaggggaggcggaggttgcagtgagccaagactgcgccactgcactccagcctgggcaacagagcaagactccatcttgcaaaaaataaataaataaataaaaatatgaactatatggattaacctcttctctcaataaagttatttaaaaaatggcatgctttatctctagaggtgattcccaaccattttgttttgccctaatacatctgtgagatcatcctacattcagtaagttagatctttgggagtgactgattctaaatgagcaggacagaagagaggagtatgtatactttgaataaaaagcctttatattctccttcccaagcttttccattaccctcaccctcacaacacactgtaatccaggggcttcaatttatgaagagagatacccattttcttatttggtagcttctgttcctactatctttcccattctaccactgtggggaaaagagagatcagattgttactgtctctgtgtagaaagaagtagacagaggagactccattttgttctgtactaagaaaaattcttctgccttgagatgctgttaatctgtaaccttatccccaaccctgtgctccctgaaacatgtgctgtgtcaactcagggttaaatggattaagggctgtgcaagatatgctttgttaaaacaaatgcttgaaggcagcatgctcgttttaagagtcatcaccactccctaatctcaagtatccggggacacaaacactgcggaaggccacagggacctctgcctaggaaacccaggtattgtccaaggtttctccccatgtgatagtctgaaatatggcctcgtgggaagggaaagacctgaccggggtcccccagcctgacaccctgtgctaaggaggattagtaaaagaggaaggaacgcctctttgcagttgagacaagaggaaggcatctgtctccagccagtccctgggcaatggaatgtctcagtgtaaaacccaattgtatgttccatctactgagacaggggaaaaccgcctcaggggtggaggtgggacatgcgggcagcaatactgctctttaaggcattgagatgtttatgtgtatgcacatctaaagcacagcacttaattctttaccttgttcatgatgcagagacctttgttcacgtgtttatctgctgaccttctctccactattatcctatgaccctgccacatccccctctccgagaaacacccaagaatgatcaataaatactaagggaactcagaggccggcgggatcctctgtatgctgaacactggtcccctgggcccccttatttctttctctatactttgtctacgtgtctttttccaagtctctcattccacctaacgagaaacacccacaggtgtgaaggggcaacccaccccttcataccaccactctgttgtcctgttatcagacagatggcttaccttccccatgtttgtcagtgaactggaaggcctgaactagtctcaaagtctcatccacagagcggccaacagggaggtcatttacagtgatctgccgaagaatacccttatcatcaatgataaaaaggcccctgggaaaagagatgaaaggaaaagcaatacaggtttagagatgtgctttgttagaatacagaggcttgaagcctgaaggaaatggactggtctccacactcctactggcctggccttagtgaggaggcccctgcataaaggaatgaaatgacaaggagtctctacagatcagggctctagatctctccaaataaaaggctttcagccaactggatacttgtcctgatgacatacctgaacgagatgccttcatcagcctttaagaccccataatcctgagcaatggtgcgcttcgggtctgataccaaaggaatgttcatgggtcccagtcctccttgtttcttaggtgtattgaccctatggcaaaaggcaaacatacagttacattcaaactcttgacttgactgtacgcattcctctttcccctttcccatattcctaatctaactttccaaaaagactgttttttttccgttttccagcaataaagtgaatgctgagaacagttaaggtaggtcactagggtacactcaactgcaattgaagctgcttcttctctgctgccaggtcatgagagcaataagagaaagtcagactttgcactcccttcaatgagaaggcaatacttgaaagtctattgccaaagcttcccagttgctgttttaaaagttcacatgccagccaggtgcagtggctcacacctgtaatcccagcactttgggaggctgaggtgggcagatcacgaggtcaggagatcaagaacatcctgactaacacggtgaaacaccgtctctactgaaaatacaaaaaattagccaggtatggtggcaggcgcctgtagtcccagctactcaggaggctgaggcaggagaatggcgtgaaactgggaggcagagcttgaagtgagcggagatcacaccactgcactccagcctgggcgacaaagcaagactccatctcaaaaaaaaaaaaaaaaaaaaaaaagttcacatgccaaatagaccaagagatttaccatgctagatgacagaagtgagaatccacagaagcaccaatcacttggcagttgagtttcttaaattcttctgccctatcactgaaagcaatgatctccgtggggcacacaaaggtgaagtcaagagggtaaaagaagaacacaacatattttcctggggggaaaatcggagtcatggttagcatttgacacagacttccttgctttatattttcctatacaaaaagaagcaagttgatggctgacacaataaccactaactgccaagatgctcaatacagatgtctcctagaagctacttttagaacctggtgcattaggaatacctgaatgaaaaaaacttccaatcccatactttattctcctgcctccatgtcatagctaccaatacagagtaaacactgttcagtctaattttgatcttttctgagtggctaaaattaacataaacaccaagttctccaaagatagcaaaagcaaggatgcacttataagcatggcctaatgccaatgcttaacaatacccagagaaagctgaattgcagtactcctctgctgtagagataagacaccaataagaagtcacagcctttgcacttctcccgtgatgaaccatagtaatggaacaagcatggtttaagtgatcacatgtgttcctaacgtgcctgacaggacaggaaaaattttaagccaggcacagtggtgcgtgtctgtagtcccagctacttgggaggctgaggtgggaggatcccttgaccccaggagtttgaggccagcctgggcaacacagcaagactgtctcaaaacaacagaaatatatatatacatatacacagagagagagagagaaagagggagacagagagagacagaaaagacaaaagtactagtgagtaacagaacttctagctgcaattttaatgaagtcactgggattaaccactgaaataacagatcttcaaactggccaggcagccttctcgccacacccaccaggcttaaatactagaacaattccaaatattcactcatttccaggtagcagcaatgtttgaaaagtcaaacaggctgggtgtggtggcatggtggctgacgtctgtaatcccagcagtttgggaggcagtttgggaggccgaggcgggtggatcacctgaggtcaggagttcaagaccaggctgaccaacatggtaaaacatgtctctactaaaaatacaaaaattagctgggtgtgacagcgggggcctgaaatctcagctactggggaggctgagccaggagaatcacttgaaccggggagatggaggtcgcagtgacctgagatcatgccactgcactacagcctgtgcgacaagatcaaaattccacctcaaaaaaaaaaaaaaaaagccaaacaagcagccctttttgacatttaccactttgcagtatcactggaaactaactcatctaaacaacccttccagctttgcctaacaagcactttggggcctcagcaggtcaagctctggagggcagagaacagctcctcctagacctcctgcttatacccctgggcccaggtcacctccctatggtgcaacttaccttgtttgctgggagaagccccaagaacaaagtgtgattatgtcaggaaacctagtcaaatgttctaccaaaaactaactccagggactaatgctacaccactgagaaaaggacacttgacacctgagtttcaggttagcattctaaggaatctatatcctcaactgtcccaggagatcgagctgctctggaactacaaggtaaagaaaggaggagcctcaacagaacttgccaagtgtctgcatgaaactatgacaacagaggccgggcgcagtggctcacgcctgtaatcccagaactttgggaggccaaggcaggcggatcacaaggtcaggagatcgagaccatcctggcaaacatggtgaaaccccgtctctactaaaaatacaaaaaaattagccaagcatggttgcgggcgcctgtagtcccagctactcaagaggctgaggcctgagaatggcatgaacccagaaggcggagcttgcagtgagctgagatcgcaccactgcactctagcctgggcgacaaagcgagactccgtctcaaaaaaaaaaaaaaaaaaaaaaactatgacaacagaaaggagagttgttccatctgtaatatcaactctcctccggggtcaaaacaggcaagggaaagtgcctagccctcagcctaatattaacagctgtgatatatacgtgacccaaacaaactgaacgagcagtgtcacagctccagagatttgagtgagctctgagactttaaatgtagaatgtctcttataacaagagataatgagtatttctccaataataaaatagaggagggccagaggcagtggctcacacctgttatcccagcactttgaaaggctagggcaggcagagggcttgagcccaggagttggagaccagcctgggcaacatggcgcccagctctacaaaaagtacaaaaattaagccaggcgtggtggctcatgcctgtaatcccagcattttgggacgccgaggtgggcggatcatctgaggtcaggagttcgagaccagcctgaccaccatggagaaaccccgtctctactaaaaatacaaaaaaaaattagccaggcatgatggcgcatgcctgtaatcccagctactcgggaggctgaggcaggagaattgcttgaacctgggcagtggaggttgtggtgagccgagatcacgccattgcactctagcctgggcaacaagagcaaaactccatctcaaaaaaaaaaaaaaaaaaaaaaagtacaaaaattagccaggcatggcagcatgcccctacagtcccagctacttgggaggctgaggtaggaggaccacctgagcccagagaggtagaggctgcagtgagccatgactgcgccactgcactccagcctgggtgacagaatgagaccctgtctcaaaaataaaaataaagaaagaaaatagacgaggaatactgaaaagataattgagctagtatgtccagacataatgaagcatgtggtttctccagaagtggtttggtcctaggatatataccctgtaatcacttgataatcaccacttcaacatgaaggtaacaacctaaatacttcttcctaggagacaaaacattttacagtcaaacaacattgacacaaatctaacaagccacccctagaatataaaataactccatctcaatgagcccagtgttaattctctcacctttgtagtcagacaggctgatatctttaaactgaccatctggcataacagctgtggctttgaagttgggggcagggtgcccaattttagcatttcctgaagacatcttcctatcagctagaaataacagaaatgaattagaaacaagccttaattttctacataaccagcagccttcacctacttaaagagacttagctgtaaacaatcaaggcattgtccagtgtccctgaatacattaaatgttgttttagtaagaagctccagccagcagtcaagggtcacagtctgagctttccaacttttggaacgaaacaagtctctgaatctcagcctttgttttcatttaaaaacagcaaggcaatttctttatatactgagataacctctcattctttctgaaccataattagtgcagtggcatcttattcattatacagaagcagagagagaggcagatgaagactctcaaaccagaatccaaatgcacaatgccacaaacacttttgtttggctccccaaaagtcacgttgacctttcccatcactgtgcctccacctgccttcataacatcagaagcatatttgacttttctccaggtagctttgtccaagacagcacacaacctataactaattcaacttgttttatttgtttttgttttgttttgtttttttgacggagtttcgctcttggggcccaggctggaatgcaatggcattatctcggctcactgcaacctccacctctcaggttcaagggattctcctgcctcagcctccatagtagctgggattacaggcgcaggccaccacacccggctaatttttttgtacttctattagagacgggatttctccatgttggtcaggctagtctcaaactcctcacctcagatgattgcccaactcagtctcccaaaatgctgggattacaggcgtgagccaccgcgcccttccagtcagtccaacttttaagaggcaagaccactgggcgcagtgtctcacacctgtaatcccagcactttgagaggctcaggcgggcggatcaccgggtcaggagttcgagaccagtctggccaacatggtgaaaccccgtctctactagaaacacaaaaattagtcgggcgtggtggtgcatgcctgtaatcgcaactactcaggaggctgaagcaggagaatcacttgaacccgggaggcagaggttgcagtaagctgagatcgcgccactgcactccagcctgggcaacagagtgagactctgtctccaaaaaaaaaaaaaaaaaaaagaggcaagaccaagatattgattggcatctgcttaatttcaaatctttaggtattgtgtaagccctagaattcccttcaccatttgtgaaggtgggttcctgactttggggctaatatcccagggcgaaaacaagtataagaatcaatttactgctgaaaaggaaggttgcactggattcacccagatcaacaccaagattagtattgagatcttggccaagcgctgtggctcaagcctgtaatcccagcactttgggaggccgaggcaggcagatcacctgaggtcagaagttcgagaccagcctggccatcatagtgaaaccccgtctctaacaaaaatacaaaaaattagccgggggtggtggcacgcgcctgcagtcccagctactcgggaggctgaggcaggagaatggcgtgaacccgggaggcggaggctgcagtgagccgagatccagccactgcactccagcctgggcgacagagcgagactccgtctcaaaaaaaaaaaaaaaaaaaaaatacaaaaattagccggggcttggtggcacaagcctgtaatcccagctactcctaaggctgaggcagaagaattgcttgaattcgggagacaggggttgcagtaagccgagaccgcgccactgcactccagcctggccgacagagcgagactctagctcaaaaaacagagatttaacccactaagccgcggtctgaaagcttttccaagtcccaaagttcttagttcacaataccacaagcaaaagaaattttgtaagcatggatcttagcaaacttttaactgttttttaaaaagtccttaacacctttaacgacaaaaaacaaaaaccaaaaactaaggcatgctgcaacttggtgcccccaaatggccttctcgtccaatccttctttcccaagtggcccccaagtacaaaacccaaccaattcggggtaaaggctgctgggattcaggccgccaccgggccccttcaggggatctgcccagcgtagagggccacatccctaaaccccacttcaggtgccccctgtccctccccagcactggagaaagcaccagcagagagagtgcttcagcggggacatttgggctcatcgctaactccattccacgtacaggaaaataaagacggggaaagggtacccgaagctccgcagctagtcaaggctcaggacccggaacagccaaatacatagaggctgtcttctacagccacgagtctggatacaggtccattccagaagcttcccgaacccaccccgtccggcaggaggctagtctcggagacccccaccaccagcccgcccagacgccgcgccacgtgctcgagttgccgggggaagactcgactcgagtccacgcttgccttggggttcaaccaggttcccgcacctacgtggggggcccacgagaggggtgtgcgcagcgctcaagcagtctcggactccgggcctcccccggctgcctcacgcatcacagcacccccacccgagcgcgggcgggccccggacaggaggaggaagaggcaacaggcaagaagggcgcgccgcgcctcactccgcaggggccgcactgcccacactcaccagtcccaacacaagtcgcagaaactaaccaccgacaccaggcaagaacaagacgcgcaagagctctccggggcgctgcctttatagccagtagggatctcgcgagagtc

SEQ ID NO: 163 - DNA, 10905 bp, Homo sapiens; identical to SEQ ID NO: 162

SEQ ID NO: 164 - DNA, 10905 bp, Homo sapiens; identical to SEQ ID NO: 162

SEQ ID NO: 165 - DNA, 43102 bp, Homo sapiens
catagaggcggggctgcggcggctgcggtgttcctccgacttccggacatctccctgggagtcgcgcagagtggagtcaaaggcaaccagtgctcgctgcggtctctggggatcgggaccgcggcggcggcccgcgagcgggatgttccggggcttgagcagttggttgggcttgcagcagccggtggcaggcggtgggcagcccaatggagatgctccacccgagcagccgtccgagacggtggctgagtctgcggaggaggagctgcagcaagcgggagaccaggagctcctccaccaggccaaagacttcggcagtgagtctaccctggctctgggaccgggaaggggggggcgcattcctcctctgggacggccctggggcgcgggcccgactggctgggggatgagggggccgaggtgggaggcaggggaggaagatgtgtctgtcggtcagtcctctccgggtcgggagagattggtgaggatctggacgaggccagagcttcatctagcagtcaggtcctgtccctgaagttcctggtgacaagtctacaaagtttgcagacattggaatcaggtatgcagtcaagcagtgtgacccgacgtcttcaggtttgacaaggaatcttttttgttcaactcgaaaaccttcatttacaccccccagatcggggatagttggcgagcttgaattggttgaaaaaataattttttgcccctaggtcagaacgtgttgtctgaagtaaactgacagttactgaatgtcaatgtctgccccggtcaaatgctttttaggtacagagacctttttccttaaggagggagagaaaatgccaactgtctgctatacgcaagttgcagtactagatgttttatgaaagatatcccatttcatctgttaaacacccccagtgagttgggggaacaagcccagagttattgggccaaagttatactgatagtgagtggtagaagtggaatttgagcttcgatctttctcattttaaagcccgtgctctttccaagtttacagtctacaggggttgggggacaggtgataatagacgtggagtaaacacatgctgtagtaattctcatttctggagagaccatggtgggcttcagtgatcacagaaagcatctttgaggccggatatggtggctcaggcctgtaatcccagcactttgagaggctgaggtgggcggatcatgaggtcagcagttcgagaccagcctggccaacacgatgtaaccccgtctctactaaaaatacaaaaaatagccgggcgtggtggcgggcacctgtaatcccagctactcaggaggctgaggcaggagaatcgcttgaactggggaggtggaagttgcagtgagctgagatcgcaccactgcactccagcctgggtgacagagcaagactccatctcaaaaaaacaaaacaaaacaaaacaaaaaagcatctttgaggaggtgagccctaaagcagcccagcactacaagtgagagaactgcaacaaaggtagatactaagttcagcaacatttgaagaatctactaaaagatgggggtggggggatgggggtggagacagggatgtgggaggagagcagcctgagagtagataaacacatatttgagtaagaaagggccgaacagtttttctggagacagggtctcactctgtcgcccaggctggagtgcagtggcacgatgttggctcactgcaacctccacctccagggttcaagtgatcttcctaccttatcctctccagtagcttggattacaggcatgccctaccacgcccagctaatttttgtatttttagtagagatggggtttcgcgatgttgggcaggctgggccctaacgtttaaaagtttactgtgggatgaaaggacagggaaaacagacataatctcaaaccatgacagtgtataatctcagcccaaggcccccagatagaatagtcttgctctgtcgcccaggctggagtgcaatggcacgatctcggctcattgcaacctccacctcctgggttcaagcaattctcctgcctcagcctcctgagtagctgggactacaggcacacgctgccacacctggctaattttttttttttttgtatttttaatggagacagtgtttcaccatgttggtcaggctggtctcaaactcctgatctcaagtgattcacccaccttggcctcaaagtggtgggattacaggcgtgagccaccgtgcctggcccctctgaatattttctaataactgcatttttcatatggatgtgtactttggagctaatgctgccatctttctgctcaccagattctcttttgatatttacggaagctgaggttagatggaagtacccacaaacacacacacattgtgaatttaaagcttcagaataaatgagaattctttcttttctgaaatttatgtgattttagaaagtcgtaaaggttctagttcatatacaaactgtgagagacaagagagatgatcagatattttttatttctacatattgatcctaagaagtatattgtctttaagaagacccatttatgttttgaaaactggaattaaacatctgtgagcctgactcccagagtagattcatttcttaagtcttttgaaatctacataaaatatcagccgggtgcggtggctcacgcctataatcccagcagctttgggaggccaaggcaggcagatcacgaggtcaggagatcgagaccagcctgaccaacgtggtgaaaccctgtccctactaaaaatacaaaaattagctgggcgtggtggtgcgcgcctataatcccagctactcaagaggctgaggcgggagaatcgcttgaacccgggaggcggaggttgcagtgagccgagatcgcgccactgcactccagtgtaggtgacaaagtgagactgcatctcacaaaaaaaaaaaaaaaaatctcctgggagccccatttgttctgcatatatttgttgagtgcctaccttcaagactggacactaaatacttcctggttcctggtgacctatttatacattcaggcaactcaccagttagtggtggacacccaggcctgcattccactccctcactcaaaaccaaacctcctggtctcctgattcttggccctccctcctgataaatttacaacctccgattgtcactgtctccaaaggaaggaacaatttataggagaactcacttaagagctcctccctacctccctcaaggccccatgccgttaagttggttagttggtttttgttaaagtcaaccaaattaaagctttgcctctactctttctgaaaaaaataaataaataaaaagaaaatctgtacttctgagaatgttaaatatctgaatcagtcacacagtttacatcagtgggaggatggccaaagatgagctttgtgatctttagctttttctaaaccgcccctaaaactattccatgcctaggaatggggaaagggccacctcctcctcctttgaaaagtgctattagtattgcagtggacctgtgttagactgtcctccttttcttctgtagggaaagtatatttcaagttccagctgcctaacttgcaaactaagaggactcctaaagttagagtgtacagaggtgactatgtacctgctttgatgtgggagtaaaatatctaattgagttctgataacacacccaggtttacaatgcacagtcaatagcttggatcctagggcttatgaacaatactttttaaaattggggatctcgatttgaagaagaaacttagggacattgcagaaaatctgaaaggtcttttgcagaaaagaagtcgtagatgttccttatgaggatagacctgaggctgtggggtagaaatgactagagaagtgagaagaattttctgattagagttgagtaacagtaattactggctgcccttctaagtcctgtgctccctacccctggaagtggggctacctggataggaaggtccattcccacactaagatgctgaaattctaaaattgtatgaaatatagtatctttgaaaaattaaccaactactttataagaatattaatttcctaagactttgccactgtatgcttattctcttcctattcttgcggcaggccttaaactctaccttgctctgtgtttactttaacaaatttatgttttttctgacctttgaagctcttcctactttactttattcttaccattcctttcagttcttcaagcccttgtcaacttgctcaactgacctgaggcagcgtgggattggagcatgagcttgggatttagaggcagatagcctgtgtttgagttccctacactacttactgtctttattgttatatcatttgcaaattacagaaagtccagtgatcagaggcttaatgaaagaaactttatttttgtgtcagggagtccccaagaaccatccccaggtttgatgattggctaggaagacttatgggactcagcatatagttgtattcatggccgtgatgtattgcaatgaaagagtacaagaataaaatcaggaaaggaaaaaggcacatggggtggaagtccaggggtaagcaggcacagtagagtcacacaggacgtgcttaattcctctagcaaggagttgtgacaacacgtgtgagatgctgtcttccagggaagctcattagagactcagtgcccaggacttttactggggactggtcgtataggtatcctctgcctaccacatatccaaattccagaccccacaaggaaagcgggagttcagcataaaccacaatgaggcattcttagcagtttaagaaatggtgggagccctcccgaaatctaagttcccggacacccagccagtggccaaccttgaaagcaagcctttccaaggacagcagtctcaggcctgccatgttaatgcttttctgcagagtctccaagaaatgtggggatgggagggaggtcccagggtcagttccatggctcaacgatatgatcagggaaccaatctcttccacgcttcctctccttcatccatagtgagttggtttccatcctcaggctgatcacttcaggctcacaagacagcaactgcagtagaaagggaggacgaggactctccccatagctccctttttattaagaaagaaaatgtttctggatgccgacttgcaggtgtccccttaaatttcttggggtggagctgtcacatggcttttctaagcttcacgggactctcagcaagtatgtggcagagatcctgacagaggtagtgccattaccttctttggtgtggacttgtcaagattcattctctggggctggccacatgggcacgcatcaaaattggggtggttttaacaaggcagaagagatgggctactggctgggcagccagcaagatctgcccctatcacataggacaaatcatttttcctctgtgagcctcagcttccctttttttgaactgggcagattattccttctccttgtcccaggaaggttatgagaataaaacatggcataattaaaatgaaggtaaaataactactttaaatgttagctgtcggcccccaccttccagcaggtcgctaagtcgtattcagatacatttgaatttgacttccttttctttggcgctacttcgtttcagaccctcactttatggactgaagtggacattgtactcctgttacttcctgttaactcctatcttagtttcagttttttcctagacagttcataaaaactgtctttggccaggtgcggtggcttacagttgtcatcccaaaactttgggaggccaaggcgggtgggttgcttgagcccaggagtttgagaccagcctggacaacatagtgagactccatctctataaaaaataaaaatcaaaataaaaactgtcttcaacgtggtgtcagctgatctctttgcaaaattaataaatcacttcttgtctttatggacttcttccctgaaaatctcttgtcatgctctccatctcactcccaggccactctaataactctctggagacagttctccctccatgctgccacatctgcttaatgaataatcttgttcctctttttgtctttgattctctatttatttgttttgctttagagatggacgttcctggagggcaagaacttgtgctttctcagatattcagtgtgttcagtaaactccatccatggagtcattaaaatctaaggaatgcaatgattatgctaaaataccagtttttaaatgacagttctcccttggaataaaaatcattgtttgaattcaaaatatgtttctgaggaagggataaaaggaatttatttccaaaagaaccctcttcttttggaactttagatttgtttctctgactgcaaagcatggttttgttcctggaccaaactgagggtcaggctgctatttctcgtggcccaataacaagatgcaggtcaactgggaaggaagagagtttttatttctgtaagtggctccagggagaaggcctggaaattatcaccagaccaacgcaaaattagaaagttttccagagcttatataccttctaagctatacgtctacgtgttaagtgtgcactcatctaaagacataagtgattaacttcttttaatctataactaaggtctgagtcctgaagaccttcctctggagcctcagtaaatttacttaatctaactgggtccaggtgctgaggtgattacccttatcttgtctcctgctaaatcatggaggtttggggagttccttcagacccccaatcaacttgtttgtggaggcctggggagtctcttcagaccccccagtaaaacttacttaatcgtgctttaaggttcaggaaagtcctaggcaaaactcttgggcttttgttacatcccagcctttgtataaggtcactggcttttaatatttaacttaaccactcagtcagtactgaaacagttgtgatggaagcctatgttagtgagtcctggcctgccgcaatccccactgtcaatttgcgcatgatttctatcatgcttgtatatttatttatcatgagaatcgtagggagatggggcatcataatctttctggctactttttgcttagaggggctcatcattatggggcactgaatgcagcactgaagtagaagaggtcaacttgttcccggtagcactctctgtttcagaggcttagaggcagcacctgctgaaacataatagtatgtaacagcaacacatataaataggttactgctgttttcttctgaagtttaagttgtctagtcttcagttcacagggctttaagaaagcacagcttaggtttcagtgatttccaaataggaaaaatggggaaaaaggaaaaggaaaaggaaaaattgaaaacattattttgaagacctgtggccagaaaaattagaatttaatccaaactgtggaaaaaaataaaaactgaaaaacatcaggcatagaatttaacaacaggtatactatagtttttgaaacaaaatttttctctctctagtttcctatttttattagaagacaaatcatggtaggaccaatttgctttattgtacttggccagattatttgtataaagtgcagcaagaaaaatcattttcttttaaaataaaatttttttatttaatatatattttaaaaattaaaaaaaaaaaaacaggctttgatggaactttgttccatagaaggaatctgagataagactttttttttttttttttttgagacagagttttgctcttgttgcccaggctggagtgcaatggcatgatctcggctcactgcaacctccgcctcccgggttcaagtgattcttctgcctcagcctcccaagtagctgggattacaggcatgcgccaccatgtgcagctaatttcgtatttttagtagagagggggtttctccatgttggtcaggctggtctcaaactcctgacctcaggtgatccacccacctcggcctcccgaagtgctgggattacagaagtgagccaccttacctggtaagataagacctttttaaagccaagcccagccatggatttgtaccatgaaatacctatgacttgggtgaattcctctcctcttgaggtcccaagataacttggggttcctggcctgtcagaaggtgacattctttacttaccacagatcagaaaccctgtacagggactgtacacaaaatatgagggcagttttccaagggttttcttggctccctaagtcaagtttgattcattaaaggaaaacacaccattccagttaaagccttggtaaaataacaagtttttccagttgtgtcctgttataaatgaaaacagattcttattgaacttatgcaaataactatattgccataattaagaatactcacaaatagtttccaaattctggagaaaattgggtagaaacaaatatgctccacattttgttcatgggagtatactaaattgttaaaagctgtcagtagctcagaagaaaagtttccttgactctgaaaagtaaaacaaaggattagcaatattttaagcaaaaactcaaaaagatcactccagtctcctattcagttcatgcagttaattactgtcctgcttgatattaatgaacatgttagctcttcaggagtcctgaacatttttcctctgttctgatgtcacaatctccaaagttatcagaaacctgcattcaagagcacttgttagagctttatagctgattataaaatcaacttctaaagaggaccaaaacagccgggcacagtggctcatgcctgtaatcccagcactttgggaggccaaggcaggtggatcacctgaggccaggagttcaagaccagcctggccaacatggtgaaacgccatctctacaaaaatacaaacaaaattaggcatgatggcgggtacctgtaatcccagctacttgggaggctgaggcaggagaatcacttgaacccgggaggcggagtttgcagtgagccaagatcatgccgttgcaccccagcctgggcaacagagtgagactccacctcaaaaaaaaaactaaataaagaggaccaaaacaagacaacaattgttcatggatgacaaaaggttttcgggtagccataaagacacagttgaggctgggcatggtggctcacgcctgtaatcctagcactttgggaggctgaggtgtgtggattgcctgagctcaggagtttgtgaccactccaggcaacacagtgaaagcccgtctctactaaaaatacaaaaatttagccaggcatggtggtgcacacctgtaatcccagctactcaggaggctgaggcaggagaattgcttcaacccgggaggcagaggttgcagtgagccgagatcacaccactgtgctttagcctgggcaacagagcgagcagctatctcgaaaaaaaaaaaagaaaaaaaaaaagacacaattgacaaaatctgttacctctgtggcacacaataatttaacataattataattattactgataacgtacactgatatatcagaattataggagtttcacatgattttggaacacataccaataacatatttacacatatatggcccaaagaaagtcaaaccccattttatatttggcaatgcttcctgtgtggtttttggtactaaataagccaaatttcacctttacgttagtgtactattaatgttaaaccaaattcttattaaaacctcatagacatattgacacaattttaatgtttgaccataaggtaagatttttatagatcttttataaccctttataattttcgttgaagagcaggttagtgctttcaaagaaacctgttatgcttttattttattgattttatcgatttttttttttttttttagagacagagtctcactttgtcacccaggctggagtgcagtgatgtgatctcggctcactgcaacctctgcctcctaggttcaagcaattctcctgtctcagcctcccaagtagctgggactacagacgtgccaccatgcccagctaatttttgtgtttttagtagagacggggtttcacaatgttggccaggctggtcttgaactcctgaccttgtgatctgcccaccttggcctcccaaagtgcagggattacaggcatgagccactgcgcccagcctatgtgcttttattttaatactcaatttacagaaaaactggatgatactcttttaactttagccagtatgtttacacacagaatttcctttacaatcaatcttccacaacttgcttaaaccttcatctttattttatccaacttaaaacaatcctttaaccttttaatctaggcaaaaatccacattttcatgcctccttataatctttttaccaaaagcatattttactttccttgtaaatatgctttttaccaaaagcatattttacttttccatgtaaaactttcttcaggccgggcacagtggctcacacctgtaatcccagaactttgagaggccaaggtgggtggatcatgaggtcaggagttcgagaccagcctgaccaacatggtaaaaccccgtctctactaaaaatacaaaaattaactgggcgtggtggcaggtgcctataatcccagctactcgggaggctgaggcaggagaatcgcttgaaaccagaaggtggaggttgcagtgagccaagatcgcaccattgcgctccagcctgggcgaaagagcgaaactctgtctcagaaaaagaaaaaacaaacaaacaaaaatctgtttcttcagtagtgttaaatacatgttacactgttaactcttagcaacctttacttttggtgaaaaccttggtaagtttgggattttatgtactaggtgtggagcctaagatgtagacagaagtgcagataaggtctgacttattccagcatctaactccatgtgtcccaggccttatctagctgtaaagcaggcaagttgtacagctgagagtcatagtggcattttataaagcatttaagagacctaatcacctttaaattgtacaatatttgttgcataaattccgtttcataaattctttcacaacttacacagacaagctatgacataccttgactttctgacttgtcctaagcatccctctttttaaacatccagttactttactttaggacaagaatttgccatacaaggtcctttcttatataaaatctcttttctctaataccttttgcatagctagggggcttggctaatttcacatgtctccaggccttttctagaatctaatgctacaaaataaatcaaacaatgtttaagtcaaagaagcagtttatgatgcaaagcatttagcaaacctaatatttgacctgcataatttagaccaaatgcttacattttgaagatattttattttaccagtaatctttaaaactgtctttatttttataactttctttatatctctcttatttcctggtttcttttaccatgttttatatataacctttaaataagctttgagttagacaaaaattagttaccctttaaaaaggacacaatgtttagaaagaatattttcctacaatatatttttattggaaaatacccaaataatgaaatatctgttatttaatataactttagattcaaaattatgacatttgttatgagtatcccattacatttatctaattatttattttaatcatttacctagattatttatgaaaactgcagtagtcatcattgaaagttatgagaccaccattgcaaaattatagctgagacagtgaaagtgatctgccgtaactgactccatcttgcttctaacctccaagctattcttgttcattaacttagtttatagtttagctttgaaacaaagatgataaccgtcctttcccagaacaaacttcctttatgtctgtggactagactgcctaaggccacaagatcagaggttagggtattttactaaataattcaagatgtagctatcttcattaaaccaatatcagtgttttatttattaaaaattacacaagcagccgggcacagtggctcacacctgtaatcccagcactttgggaggctgaggtgggcggaacatctgaggtcaggagttctagactagcctggccaacatggtgaaaccatgtctccactaaaaatataaaaattagctgggcatggtggcagacacctgtaatcccagccactccagaggctgaggcaggaaaatcacttgaactcaggaggcggaggttgcagtgagccaagattgtgccattgcactccagcctgggcaacaagagcaaaactctgtctcaaaaaaaaaaaaattacacagcaaagttcactctgttttgggctgagttatcgttttgtagcctctatgccaaattttgataccttatagtatttggcagagataagtatgaaattgcttgatcaataaatgtaaacaaaaatatatgctggcaactccgaagacatttctaatattactttaccagtaatttttaaagctagcttatttattaaagattttacttaagtcacataaacttgaaaaagcatttgactagtctttctttttttctgttaaagtatttaagcacttctatttttctgtgagccaactaattagaactctttcgtatattttcagtagtgaaatagtttggtcatgctttaaggttcaggaaaggcctaggcaaaaaactcttgagcttttgttacattccagcctttgcataaggtcactggctttttttttttttttttttgagacggagtctcgctctgtcacccaggcgcccagctaatgttttgtatttttagtagagacggggtttcaccatgttagccaggatggtctcgatctcctgacctcgtgatctgcccgcctcggcctcccaaagtgctgggattacaggcgtgagccaccgcgcccagcccggtcactggcttttaatatttaacttaaccactcagtcagtactgaaacagttgtgatgaaggcctatattagtgagacctggcctgcaacagttttataaactagtgtggctgtctacccattttatcataccactctgtacaagtagagtagtcataactaaagagaaatgagtgatttcactcaatcttagcatttgttctgtcactccccattcatccattcaacaagtacgtactggtcactggtcatccgctggggatacagtggggtatcagacagcccaggtccctgcactcatggggctcagcatgggctttcagtctggctgagaagacattcaccaagtaatcggtagagtgttttgaagattgttgatcaggcaacagtcttcaaaacacaggatgtgcggagggaacacatctcaggacatccatcgtagtcaagggaatatttcctaaggagaagggatatttaagtggagacccacagcatatggagagttagccagataaagagagagcagacaaaaatgtttcaaaccaaggaggcctccttggaggtagtgaagaatttccatgtgatcatatgactgtagactgggaagaaggagaaagatgagaactagaccagagataagtagcaagtagcttcctgtggtatgtcctaggggtgttttgttggggttgacagataaacactaccagacacaatgggaggaagtagatttttaaatgggaagctggtgaaaggatcattcagatggagtgataatattactggctcccagacacctatacagtctgctggtttcctggaagtaataccacccacagaatgaggatggaatctgttgtgcagagctctctttgccattcttatgggaccttctccacctgcctgccccttcaacaggtgtaagtaagagaggcaagaccgccctaatgtgccagctatttctcatgagaggaggatgtcaattgcctgggagcatcccccagcaggtccagcttcaagacctgcctcaagtctctttcagcagcctggattctgtaggatgtggactttgaaatgatatttgtctacaaattagccctttttttttttttttagacggagtctcgctctgttgcccaggctagagtgtagtggcgcaatctcggctcactgcagtctctgcctcccgggttcaagcaattctgctgcctcagcctcctgagtagctgggattacaggcgcacgccaccatgcccagctaagttttttgtatttttagtagagacggggtttcaccatgttggtcagactggtctcgaactcctgatctgcccgcctcggcctcccaaagtgctgggattacaacaaatgagcccttatagtgcaatagaaccttgacacatgtcttttcacatcttccagaaagctaattctgtggttttgttttgtaaaaactggaagttttatgggttccacttttaatcttgttctacttatttgctcattattattaagaatgatttctagtccaggcttggtggctcacgcctgtaatcccagcactttgggaggccgaagtgggtggatcacctgaggtcaggagtttgagaccagcctggccaacatggtgaaatcccatctctactaaaaatataaaaattagccgggtgtggtggcgggcgcctgtaatcccagctacttgcagggctgaggcatgagaatcacttaaacctgggaggtggaggttgcagtgaactgagatctgagatcacgccactgcactccagcctgggtgacagagtgagacttcatctcaaaaaaaaaaaaaaaaagatttctgtttctactagggcttgccaagatttctatttcttatttaaaattcccccagatttatcatgggacatgttaatttgagaaaggaggggcattttttctttgaacaggagggaaggaggagaaaataaagatggcatacatgagatctagaaaggaagaaaagtataaaggagccttgttcttcctggcaaagtaggagggtagattatttactgagataaattagaaccagagacttgagcaagaaaattttgaagcagctactgggaagagtatactaagggtctttgaaagagatgaatgaggccaggcccggtggctcacgcctgtaatcccagcactttgggaggctgaggcaggcagatcattcgaggccagaagttcgagaccaatctgaccaacatggtgaaactctgtctctactaaaaataccaaaaaaattagccgggcatggtggcaggcgtctgtagtcccaggtactcgagaggctgaggcagaagaatcgcttgatcataggaggcagagcttgcagtgagctgagatcacgccactgcactccagcctgggtgacagggcgagactgtctcaaaaaaaaaaaaaaaaaaaaaaaaaacaaaaaaagagatgaatgaaaggcccagtatgattggccagtccaccaagaaagtggtgcttttcatcactgtcagtgcttctcattacttgtttcaggtccttatgaacaaggaacatgccctaatgctttagattctcataagatctctttaagggaaaaatctcaaacataataaccacagattctttttattctttacagactatttatttaactttgcatctgctgccacaaaaaagataactgaatcagttgctgaaacagcacaaacaataaagaaatccgtagaagaaggaaaaatagatggcatcattgacaaggtatattcaattatcttttggaagtagaaatgtatgaaattcattgtttcctcttgatggtttcttcttcttatgaacattttttaacctaagtagaatatcatattctgataaaaatgttaattgttgagatttttggttttttcctctctttgaataacaagtaagtatcattaaattacagtacttgatttaaatagctgtttttattttaatatattacaatcaatacattgatacttgggggttatactaaacttttcatgttggttgtttgtttgtttgtttgtttgttttgagatggagtctcattctgtcacccaggctggagtgtggtggtgtgatctcagcttactgcaacctctgcctcctgggtttatgcaactctcctgcctcaacctcccaagtagctgggattacaggcatgcgctaccacacccagctaatttttgtatttttagtatagacggggtttcaccatgttggccaagctggtctcgaactcctggcctcaagtgatccacccgccttgccctcccaaagtgctgggattacaggcatgagccaccacgcctggccaacttttcatgttgtgagtttaactttataactgtttgaggatatatttatgcctttgcatcatgcgactaaggtcctagcccattaggaacaacccttttaagactctaaggagtgagtttgttttttgcagtgggcctatggcatttcatttatgttggtagatatttgaactaaggaagtcatcaattaaaccttagatacattgctatttaatttgactatgtattttttttaacagacaattataggagattttcagaaggaacagaaaaaatttgttgaagagcaacatacaaagaagtcaggtatggtataggtttgtcttaattaacctgccaggttttattgagcacctgttatgtgctagataccacactgagggtctgagaacacaaaaatgcatatgcaatggccccatcctttgggtagcacaaagactagtgagggagacaaacccataaacttccatgatttaaaggaagggactagattgtttctgggtgagggctgccagtgctggccccactggggagctggctgtgaaaggggcaagtaagctttcagttctgactttctcttttcttttcccccaccgagatggagtcttgctctgtcacccaggctggagtgcaatggcgtgatctcagctcactgcaacctctgcctcccagattcaagcaattctcctgcctcagcctcccgagtagctgggattacaggcacgagccaccacacccagctatttttgtgtgtgtgtatttttagtagaaacggggttttaccatgttggcaggctggtctcgaactcctgacctcgtgatccgcccgccttagcctcccaaagtgctgggattataggcatgagccactgcacctggcctcagttctgactttctaccacatgcccagcacagagcacagtatgcacatgaccggcatttagcaagtggtggctccgttcctgctgtcttcaggagaaaaaatggaagagcttccgagggaggcgagtgaccgcacctgcagtgacagagggccgtaaagagtctcgggtgtttggagaacatactcaatacattactgctgacacatgcctctgaagttataaggcctcagcatgcctactcttaccattttgtagcacccaaacacaaaaccagcctcgtgtctttagatttggcaaaagtagtataactgtaatcccaacactttggcaggccaaggcgcgaggatcacttgagcctgaacttcgagaccagcctgggcaacatagtgagaccctatctctacaaaaaaataaaaagaaattagccagatgggtgtggtggtgcacacctgtagtcccagctacttgggaggttgagacaggaggatcacttgagcttgggagtttgaggctgtagtgagctataatcatgccagtgtactccagcctggactacagagtgagaccctgtctcaaaaaaaaagtagtagaaaacaattcagttcgagttgtgccacagttaatcccatggtgaatttccatcaggcattcttgcacctaggtaaactcaaaagcatgagcaactcttttagacaagtgaggtatacaagttagcatcacttagtgattatttggaagcagcaaaagtgatcctggcttggggacttgctgtaggagctgatgcctctgagatacgaactgtgagggcgtgggggtggaaggtttggaggcaacttcagttttgaagtgagttagacatcccggagataggaacatgtagaaagacaggaaagagaacacaagtgctttatctggggaaaatttccttctttttttgcatcagccacgtttcaggtcctcgataactacatatggctaatggcttccgcactggacaatgcagatatagaacatttttgtcattgcagaaagttcgtttgctcagtgtggctctgaattaaataagcaggctcctgcagcagtttattcctgtttgaagcatgaagcagaattcaatctagtgatatagattattatcaagtcacataaaaaccatgagagtagatgagctcctctatggaaagtgtgtcaagcatgaagggagatgagcagaagctccacagtgtttagggaggggaagaggggaaggaattgacatcactgagtgcctgctgagcagcaggcattttatatataacatctcatttcaagacgcagtcagggccaggcgtggtagcttcatgcctgtaatccgagcactttgggaggctgaggtaggcagatcacttgaggccaggagtttgagaccagcctggccaacatggcgaaaccccatctctactaaaaatgcaaaaattagccaggcttggtggcacacacctgtaatcccagctgtctgggtggctgaggcgcaagaattgcttgaacctgggaggtggaggttgcagtgaaccgcgattgtgccgctacactccagcctgggtgacagagcgagactctgtctcaataaataaataataaagatgcagtcagcaagggtaagtaatttgcggaaggtcactcagctggtaagtgatgaaactgaaatttgccttcaaaaccaaatacaaaaattagctgggcctagtggcatgcgcctgtaatcccagctcctcgggaggctgaggcaggagaatcacttgaacctgggaggcagaggttacagcgagccaagatcataccactgcactccagcctgggcaacagagcaagactccatctcaaaaaaagaaaataaaaacagtgcccgtttacccaagagagtggacaactaggagagagaagtagcagaagcccagagaggggagagtttccaggagagcagtcagccatgggaggcagggccaagaggtccacttacaatgaccatgagaagggcaccttggaaatgtgttccatgcatttcttcacttcataatcacagtaactctataaagtacttactgttacctccgttttccagataaggaaactggcctagagagaagagaactaagaagtgtccttggggttggagaaccaagaggttttggtcactctaaaaagaataatttcaggaactcggggtggggagcatctcctcatacaagtatcttaggagggcctcattatctgagcataaatagcaccaggagagactacccaaggtgaagagacttggaatggagactaaagtgtgtgagaaaaaatgttttgggggctttaccctaattttttctttaaaatgtgcaaatatgtttagattatcttatcattaatagaatttggattataattgccaccatttgctgacttgggataagccaaagaatgaagcgtgtgctcatctgcctatccatccctgtgtccatccacacatgcatgtaacttttctctcagtgggctcgtgatatgatatgtcttccctctgactcagagcataatagtaaagggactatttctgccaaaatattccaggacagcaaagcatttgctctccaagggcctgccttaattgcccctttggttttcaaatcactctctctctcttttttttttttttttttttgaaacggagtctgtctgttgcccaggctggagtgcagtggcaccttctcagctcactgcaacctctgccccccgggttcaagcaattctcctgtttcggcctcccgagtagctgggaccaaatcattctcttttaaagcacttgctgggtcaccagccttgtgtttccttcaggcataggtgccctaactgccaggtcctccttattgtttgctttgtggtgatgcaggcagctatcccatgtcactttactttgactttgtgaagcaccgtgtgttttgcaagatttgccttttcactttgtgttgcaagaccagtagggctagaatctagtgttaaggcagcaggagtgattcagtggcttatgaattagtccacatttttgtgacttctgcttcccatcctaatcttgccgctgtgggttgctgaatgaggctattaagggccccctgcctgtgtgtcttctgtgccgatcacgcagatctgcagccttcactctgctctctagctgctccgtgctgcttacatgggagagatcttcagacgagcttgccattgtttttgtttccactctaaacacccccacccccatccaccactgacctcctcttcctagtccaagattgggctcctaggtcaccagaaaatcttgtagttctcacctctccagagggttgtcatttgtcacctggcacggcacttacagtgctggattctaatcacctctatcttgtgagccccagaaaaacatgggctagatcttggcattcccagcatttagcttctaacggcttattgaggatttgattccagccctattgtttactgcctccaacttgtgcatttctttttttttttttttttagctcctgaaaaccctcttcttattcctaatcacctgtcttacaacatcaccttttatcatgaatcaagtacagtaactttctttttttttcctccagaaatatacttacccatttttctttcatttttttaagtaactttctaaaaatttttctatttggaaaaaattttaatttacagaagagtcgcaagaataaaaatagtacagagaacacccatataccagtacctaaattgctctagctttattctgtttgccttattcacgccctctctccagctcttgctgtgtgtgtgccctttttttccttgtgtgtacacaaatgttcagtacacatttcctaagaattagggatattctctttcataatcatagtatagttaacggcattaggaaatttcaccttgatgcaatactttactgttcatcagttaattttgttagttgacccagtaatgtcctttataacatttgtccccctcgtataggatccagttgaggataaggtattgtattctttgtcatgtctctcagccttctttaatcaggaacattccaacatcctttctttgtcttttatgatattaatatttttgaagaatacttctcttccttttttttaatagattctttctcattcaggctttatctgatatttcctcataactagactcagattgtccatttttagccagcatactacataggtgatgatgtccttctcaagataccacatctggaaggccatgatgttcatctctccctcattgttgattttgatcacctgattaaggagttgtccagtttctccactgtatcatttaagtagagttttttgttttttgttttttttctgagacagggtctcaactctgtcacccaggctgaaatgcaatggcggaatcacagctcactacagccttgactcctgggttcaggtgatcctcccgcctcagcctcccaagtagctgggactacaggcacgcacaacgtctggctaacttttgtatttttttgtagagagagggttttgtcatgtggcccaagctggtctgcaactcctgggctcaagcaatccacccacctcggcctcccaaagtgctgggattacaggtgtgagccaccatgcctggcctcaagtagagttttttttttttttaccaaatgcatatgtgcatataactcataataataagtctggttattacggttaatgttcatatttggaacttattggtaaattgctacttttagtggtcatgcagaaactttcatgctttgaaaccatagactgcagtgtaaccatcatgacctatttttttctcttttcttctttgccattaaaaactgtatagaagcagctgtgcccccatgggttgacactaacgatgaagaaacaattcaacaacaaattttggccttatcagctgtaagtatcttgtggtaccccagatagaacatactttcttctgtcatgatatatctctgttgatgtgactttagtagaatttatttttctatacagtttttaaaatattttgagatgttaggaatgtacacattaacacatgatgtgtacattaacaaaatgtacacataaaatttattttttattttttttttgagatggagtcttgctctgtcacccaggctggagtgtagtggtgcaattttggctcactgcaacctccaccacccgggttcaaatgattctcctgcctcagcctcctgaatagctgggactacaggcatgcgccaccatgcccagctaatttttgtgtggttttttttttttttttttttttttttgagacaaagtctcgctctgtcacccagcctggagcgcagtggcacgatctcggctcactgcaaccttctcctcccaggttcaagcgattctcttgcctcagcctcccaagtagctggtattacaggtgcccgccaccacgccctgctaatttttgtattttgagtagagacggggtttcaccatgttggccagactggtctcgaactcctgatctcgtgatccaccctcacctcagcctcccaaagtgctgggattataggcgtgagctaccacactcagcctaatttttgtgttttcagtagagacagggtttcaccatgttggccaggctggtctcgagctcctgacctcaagcagtccatctgccttggcctcccaaagtgctgggattacaggtgtgagccaccatgcgctgccaaaatttttaatttaatttgttttgttttgttttgtttttgttttaagagacacagtctcaattggtcatccaggatagagtacagtggcataattatggctcactgcagccttgaactgggctcaagtgatcctccggccttagccttccaagtatctgggacgataggcgtaagccaccatgcccagctaatttttaaaattgtttttagagatgggttctcactatgtttcccaggctggtctcgaactcctggcctcaagcgatcctcttgcccaacttcccaaagtgctggattatagccatgagcgactacaccctgtccgcttctattttttttttttttttttttttttgagagtctcactgcactcctgctggtcaacatagcaagactgtctcaaaataaagaaagaatataatatttccccagtctatgataaattgttatgtagtaggccaggtgcagtggctcacacctgtaatcccagcactttgggaggccaaggtgggtggatcacttgaggtcaggagttcgagaccagcctggccaacatggcgaaaccccatctctagtaaaaatacaaaaattagccaggcgtgctagcacacacctgtaatcccagctactcgggaggctgaggcaggagaattgcttgaacccagggggcagaggttgcagtgagctgagattgcaccactgcattatagcctgggcgacagagcaagactccatctcaaaacaaaaataaaattaaaaaaaaagagtgggcgcattggctcacccctgtaatcccagcactttgggaagccgaggcaggtggatcacgaggtcaggagtttgagaccagcctggccaagatagtgaaaccccatctctactaaaaatacaaaaattagccaggcgcagtggcgggtgcctataatcccagctactcgggagactgaggcaggagaattgcttgaatccaggaggtggaggttgcagtgagccgagattgcaccactgcactctagcctgggtgacaacccgtctcaaaaaaaaaaaaaaattgttatctattaatcgcattttgtggaataccctgtgtttttttctttttttatcaaaggacaagaggaatttccttcgtgaccctccggctggcgtgcaatttaatttcgactttgatcagatgtaccccgtggccctggtcatgctccaggaggatgagctgctaagcaagatgagatttgccctcgttcctaaactgtaagcagagtgttctccagcgtttcctcatggcctccattatgtgctcagtatcagcacataatgatggaaggggccaaaagggtctctatctgttcataaaagcaggccccgcagccctttggcagctcccctggtcagggcactctggaatcaaaaccaaggtctgacttggcaggaaatacagggtagaggtgaaatgtgcttttctatcccagttacaaggtagaacacatttccctacagaaaccacaaacatgctgcatcaccctgaatcacattctggtctctgaggctcatcgggatcttttttccaagctgactgcattttccattcaggctctgccctccagtggcagtgttcctgctctctttgctaaggcttttcctccaacagctcttctgggctccacaaatcccagcttgtcctgtaggctccagtgcatgcatgatgcattctggaagcctgccttggtggtgcggccaacaggggccaccttccccgctgctgcttcccttgggtgttctgtctcaagctcttccgtgccttctccagtccagtcccttgtattgaagctgtcgcatgtttggagtcagcgttccttcttattctgtcattgttccctttctcttaaccttgtcatatgggtgcagtatcttactgttccctgagtacgttagttacagttctctcaaaagactcctttttcagctgggtgcggtggccaatgcctgtaatctcaacactttgggaggctgaggtgggaggatcacgtgaggttgagttcgagaccagcctgggcaacatagcaagaccaccatctttacaaagaaaccaagaattagccgggcgtggtggtgtgcacctttagtcccagctactcaggaagctgaggcgggaggatcatgtgaggccgagttcgagaccagcctgggcaacatagcaagaccaccatctttacaaagaaatcaagaattagccgggcgtagtggtgcgcacctttagtcctagctactcaggaagctgaggcgggaggaacacctgagcctgggaggtcgacgctgcagtgagccatgatcacgccactggcattccagcctgggcaacagagtgagaccctgtctcaaataaaagacagactcctttttctatgctgtttcctccctcgggactcttttgtttgtttggggatctgtcgtttatgtggcagactctccttacctgtcccttcgcattagcagtgccatactgaaagggtacatggccgctgaatgtggggacaagccttttggcctggagaggctcagtagctgtgggaaggtagcttatccccagaggactcctcggcctcctgcctggctgcaggcaggacaatgggaagagccagttgataggcagactatcccttgacccctgtggcttgaccttgatgtcacacccccagtctcaactgtgccaccggtccctgagtgtagagcagcttggctcccctccccacatgggcagagcagggcagggcaagatgggaggcccaggggctctctgggcttccacccttgctgcagacaactcagtacagttttctctggtcaacgaagtagactactgtttgcctaggccgggtgcagttgctcatgcctgtaattccaggactttgggaggccaaggcaggcagattgtctgagaccagcctgggcaaatagtgaaaccctgtttctacttaaaaaaaaaaaatacaaaaaattagagcctggtgtggtggcacatgcctgtaatctcagctactcgggaggctgaggcaggagaattgcttgaacccggcagacagaggttgcagtgcaccaagatcgtaccatttgcactccaacctgggcgacagagtgagactctgtctccaaaaaaaaaaaaaaaagattactgtctgcccttgacatttccacttgacagctttccacttgactgcccttgacagcgtccactgtcctctcctctctcattctctttgtccttgtgtttttatgtatgtaattccttttctgttactttcctggcatcttcagagggagcacagatgaacacatgtttgttttgctatgcttacccagccacatagcggttttaacaaatatttgctagccttttggttcacacagcagcacaggttttctgtctgtgaaaacaccactctggaagtgttcttccagactcagaataacagttatatggaatctttttttctttgtagtgaaactcttccctccataattattaacatattagtggtaaatttctagagccctccccaaccctcccataagaaaagtatgttttatggcaaaaaaaaaaaaaaaaaaaaatctcattagaaatttcatctttagactttgtcttttttctttctttttttttttttgagatggaatctcactctgtcgcccaggctggagtgcaatggcgtgatctcggctcactgcaacctccgcctcctgggttcaagtgattctgctgcctcagcttcccgagtagctgggattacaagcgcccgccaccacacccagctaatttttgtatttttagtagagatggggtttcaccaggttggccaggctggtctcgaactcctgacctcaggtgatccacctgcctcagcctcccaaagtgctgggattacaggcgtgagccactgcgcccagctagactttgtctaaaatagctgtggttaaggatatttttagttaaggtgatttgttttgttttggagacggagtttcgctcttgtcacccagggtggagtccaatggcttgatctcggctcatcgtaaccacctccccacctcccaggttcaagcgattctcctgtctcagcctcccgagtagctgggattacagacgcatgccaccacgcctggctattttttgtatttttagtagagacagggtttcgccatgttggccaggctggtcttgaactcctgacctcaggtgatctgtccgccttggcctcccagagtgctgagattacaggccaccgcacccagcctagttaaggatattttttaaatgtaccatctaatctatttttttactacatatgctcacaaaatcataggaattgacttttttattttaaaaagtattattttttagagacaggatctctggaatgcagtggcacagtagcttactgtagccttgacctcctggactcaagtgattttcctgtctcggcctcccaagtagctcagaggcctgtgctgctacgcctgcctaatactgtttttaacttttttagagatagggtcttgctgtgttgcgcaggctggttttgaactcctggcctgaagcagtcttcctgcctcagcctctcaagttgctgaggttatagacgagagccacccacgctcctggtagaattgaattttgaagagtttgtatatataatgtgtatgtgtatgtgcttgtgtgtgtgtgtttcaagctcttccctcagaatttgaggctgtgcctgttctgagtaactgactctgagggaagggtacccaagctccggggtgcagatgccctttacacttgcagcctgcatcaacttgaagaccttttgaatcaccctgagccatatgcttggctcctgctgtggctctcaagaccagcaagaggccctgagtggctggagcctgaggcctgtggcctggggtgctcatagcaggcatgtagctgtccacagttttggttctttacaattgtggaccgccccctctcactgttgacagtaattttagattttttgaaactgtctgagaattggtatttggcaattagtgtttctaatttgtcacagggcaacctgccaatcaaatatttcaatatgactccagtttcctcctactaattttgttgaggattacttagaaattatagtttttatttataagtccttatctgttagaaatgcttgctgaagtggagcgcaatggctcacgcctgtaatcccatcactttcggaggccgaggcgggcggatcacctgaggtcaggagttcgagaccagcctggccaacctggtgaaaccccgtgtctactaaaaatacaaaagttagctgggtgtggtggcgggcgcctgtaatcccagctactcgggaagctgaggcagcagaatcacttgaacccaggaggcggaggttgcagtgagccaagatcgtatcattgcactccagcctaggcaacaagagcgaaactccgtctcaaaaaaaaaaagaaaagaaaaagaaatgcttgctgaagtatttacaaatgaaagaatgtgatgtctctcattcgccttaaaatattccaacccattcccaaagaaaagcatgtgtgcaggggaggggaagatagatggaacgcaactggtgaaatgctgatactcacggtaggtaggtcacaggtacatggggttcattgttctagttgcttcacttctgttttgtcgaaaatttccataacagaacaaaaacaagctgtcagacacaaatatacggtttccagacttttcctgcctgacacacagaagcacaactttgctctttgaaacactttttctgaacagaagccatcattaactaggaacactttagaaaacaaaacacttgctctggatttcaaactgcatattagtagcttaacccttccctgtggtagtctaatgctgtgaccgagatagggtcctgctggtacatcacaagcaccctctgaggccctcattctgatgacagtagggaaatcacaagtcctttcctgccttggccttggcctgtgacatttgtccagtgtttcccggagggttttcacaggatacaatgccttaagatagtgcaggaaaacaaatagataagtgtttgagagttgctgtgctcaattaatttttttcttttttttttcttttttttttttgagacagagtctcgctctgtcactcaggctggaatgtagtggtgcgatctcggctcactgcaacctccacctcccgggttctagcgattctcctgtgcctcagcctcccaagtagctgggactacaggcgcacgccaccacacctagctaatttttgtatatttagtagagacagggtttcaccatgttggccaggatggtctcaatctcttgaccttgcaatctgcctgcctcagcctcccaaagtgctgggattacaggcgtgaacctccgtgcctggccgtgaattttttttctttttaagacaaggtatctctctgttgcccaggctggaatacagtggtgtgatcatggctcactgcagcctcaacctcccaggctcaagcaattctacctcagcctccctatgaatagctgggattacaggcacatgccaccatacccagctaattttttatttcttgtagagtcagggtctcactctgttgcccaagctggtgtcaaagtcctgagctcaagtgatcctcctgcctcagcctcccaaaatgctgggattacaggtgtgagccactaccgtgcccagcctggatttctttaccaaaggacttgacttctcagaacctttagtcgtcatctgtattgtgactcttccccagagggtgacacagactatttctgcagtgtgcctctatgaccgcacctctcatatcaagagggagagactatggaaaacaaagcagtccacatgtttgtttttattaatcaagacagcaaacagtgcccatgatctaccataggtacctagaatacctaagtctcattttgggcatttcacatagctcagacttaaaagtgaattcaggccaggcgcggtggctcacacctgtaatcccagcactttgggaagctgaggcaggtggatcacttgaggtcaggagttcgagaccatcctggctaacacagtgaaactccgtctctactaaaaatacaaaaattagccgggtggtggcgtgtgcctgtaatcccagctactcgggaggctgaggcagaatcacttgaacacaggaggcggaggttacagtgagccgagattgtgccactgcactccagcctgggtgacagagggagactccatctcaaaaaaaaaaaaaaaaaaagtgatttcaaagatatttaggcagcctactacctcatgggaaggctcatttcacttttgtttggctcgagtgttatggcttaagaccctggaacttatcaggacaaacaggcccagttcttagttcccctaaatgtcttagtccctataatccctcaccatccaggtgttttgccggtaaataccctttggtttgtcagtgtcatcgttaaagtgagtcctcaggagtgaatataatgcgttgtcttaattgcagaaagcacaccatagcatatcttgtatgtttttgatgcagccgaagatttcatgagctcttttagcagtggtagcatactgtggtttgctcagctaaactcgtggtcaactataatcccttatgaattgctatgaagcccaatatccctcttgccgaactaattccaagagacgttacaacagttgtgtggccacatgagtttgggaaatgctgcttggcatgtagtaagaacttaacaagtgagaggttattattcctgtgaccatctatgatggcagacaacttgtcttattcccccagcacccagcatagcgcctgatgcacatggcaccataattccaccggtaaatgttggtggcattaataaaagtggggctgtgtctggcagcaaattccatcttgttacctgtcctcgcttgtataggtaatcgtgcattttgcctctatcacttacatgctagcttccaggcctagcttctccattcacaggtgtgacaactgtgcattctgatgcctcatctaagataagctctgtccagattcacaagcctgagtctcattattttctgctagttctcactgattttttttttttttttttgagacagagtctcactctgtcacccaggctggagtgcgatggcgccatcttggctcattgcaacatctgcctccccagttcaagcgattctcctgcattagcctcccaggtagctgcgattacaggtgtgcaccaccacgcccggctaattttgtatttttagtagagacggggtttcaccatgttgcctaggctggtctcgaactcctgacctcaggtgatccgccctccttagcctcctaaagtgctggaattacaggcatgagccaccgcacctagcactgactgatcgtattctactctttcaaagtctttttctgtcaggctttcttctcgttttccccccattctaagaaccttgcatcccttctaaaaaaatgggatagactgggcatggtggctcacgcctgtaatcccagcactttgggaggccgaggcgggcagatcacgaggtcaggagatctagaccatcctggctaacacagtgaaaccccgtctctactaaaaatacaaaaaattagccaggcacggtagcacgtgcctgtagtcccagctactcgggaggctgaggcaggagaatcgcttgaacccaggagatggaggttgcagtgagccaagatcacgctattgcacaccagcctgggtgacagagcgagactctgtctcaaaaaaaaaaaaaaaagggataaagaggcattctcccacccttttgtcatttctacttgccaaaaaaaaaacaacaaaaaaaaattagaacataaaatgagccactcttccaggcaaaaacaaacaaaaataaaatttcacacaccctgcaggtcaccaaagccattccttgggtgtgtacatgtttgtgtgcatgtatatgtgcttttttaatgctttttttcttttctttttttttttttttgatacggagtttcgctattgttgcccaggctggagtgcaatggtacaatcttggctcactgcaacctccgcctcctgggttcaagcaattctcctgcctcagcctcctgcgtagccgggactacaagcatgcactatacccagctaatttttgtatttttcatagagacggggtttcaccatgttggccaggctggtcttgaactcctgacctcaggtgatctgcccaccttggcttcccaaagtgctgggattacaggcatgagccactgcacccggccttttttttttttttttttttttttgagacaaagtcttactctcgtccaggctggagtgcagtggtgcgatcttggctcaccgcagcctccacatgctgggttcaagcgattctcctgcctcagcctcccaagtagctgggactactggcacataccaccacatcggctaatttttgtattttttgcagagatgcgatttcaccatattccccaggctggtctcaaactcctgaccttgcattcctcctgccttggcctcccaaaggcactgggactacagacgtaggccaccatgcctgacccattttgcttttatttagttttgttttttgtattcaaccctcaagatttttatttaatttctctgaagcgagcacagttatcaatggattattattattattattattattattattattattattattttgaaacacaaacttatggaaaaattggaggtacaacataaagaacttttctccaaatcacttgagacctaatgttgcatcactcccaaatgccgtagtgttttacaagcattctcctacatgaccacagtgtgcccatccaaattaggaaatgatcatttacacgttattaccatctcactctcagaccccattgaggtttttccatttgtcccaataatgtcctttttagcaaaaaagcccagttcacactcacaggttacatttggttttcatgtctcatcaatctccttatgtctgttgcatgctgtcaggtggcacatgcagccatttgtcccattactgttcatacttgggtcatttgatgcaggtggtgtttgccaggtttcttgactgtaaagttactcttttcctctttgaatgtaattactattttgctgggatgtgctttgaaactgtgaatactctattcatcagactttccatgtatttatatttgtacagactcatgcaatggtctgtaattttgatgctcaaattattaccaatttgaggccaggcatggtggcttacacctgtaatcccagcactttgggaggcctagttgggaggatcacttgagcccaggagttcaagactagcctgggcaacatggtgaaacctcatctctacaaaaaattagccaggcatagctgggcatggtggtgggcgcctgtgatcccagctactcaggaggctgaggcaggagaattgcttgaacctgggaggcggaaattgcagtgagccaagatcgcgccactgcactccaacctgggtgacaaaagtgagactccgtctcaaaaaaaaaaaaaaaaaaaattagcaaggcatagtggcatgtgcctgtagtctcagccacccgggaggctgaggcagaagcatcacctgggctggtgagatcaaggctacagtgagccatgttcacaccactgcactccggcctggatgacagagtgagactttgtctcaaaaaaaaataataataattaccaatttggccaatgggagactattcaagctgacttgtgtctttctaactcatccccatcatttcttcacacgtttccttgctttctggcacaagatagtattcttcctctgctctaaccctggaatcagccatttccccagggagctctggatccttttagtggaaagtctaaatcttggtattttgcaagatctggatgctaggtgtgctcattgccattggggtgccactgctctgcatgctctcagtggacacagccagggaatgtgtgtgtgctcatttctgtgtggaatgaaaaccatgtgttcatggtgctacctcatgacggaggtcattttcattttttccctttccatgtttgtagctctcctctctgatggtgagaaacctggtttctactatctttaatatttttacttattccctgtgcatgtggctgatctgtcatttttgctgccactcactcctctgctcaaacacccttctctccctgcttggttctcactctccgttccaggccacccccctgtgtggacacttacctcacccacttgggcaccaacacatcacaccaggtgattctaataggtagccaggtttgagaaccaccaagagttttcaggttgaactgcacttcaatctttttatcaagcatttcccaccccattgctaactcttactggttactagttattagcaagctgccaaacattctctttcataaggaacaacagccacaatgcttgcttctcactgctggaaggcatttaatcctcttgagaaacagcaagtgattggtggagtcctggctctgcttctggtttcccaggttgattatgctagtttcacaacaatgccatgttttcttctaccgagagcagtattggtatcattaagataccaagaaatgctgaggtttcattggtattctgtaacttgtattttgctgctacggggaagatagctgttaggtttatcctgttgttagctttcaattctaaagtgaatatgggctgggtgcggtggctcacgcctgtaatcccagcactttgggaggccgaggcgggcagatcatgaggtcaggagtttgagaccagccaggccaacattgtgaaaccccgtctctactaaaaatacaaaaattagctgtgcatggtggcgggcacctataatcccagcaactcgggaggctgaggcaagagaattgctggaacccaggaggcggaggttgcagtcagctgagatcacaccactgcactccaacctgggcaacagagcaagactccgtgtcaaaaaaaaaaaattgttaaagccaatatgaaccccctctgaacctcactcagctttgaaagtgctcttgcaaatcatctactccagtcccctttacaacaaataacccctgcgtgcacttgtctgtgtgcgttctcaaatgtgttcttgtctgtctgctttttattgattttcaattttgcctttttccactgttctaatttgcctttctttaaaagtgtgaaggaagaagtgttctggaggaactacttttaccgcgtctccctgattaagcagtcagcccagctcacggccctggctgcccaacagcaggccgcagggaaggaggagaagagcaatggcagagagcaagatttgccgctggcaggtatattctgggtagaagacagcactctacagaaaaagttgttcttagagactcaaatgagcttgacctcttatacgtaccagaaatgtcattgccttagggaaaaattcttttcttcccagaggaaatcttcatttttctcttactgccttctctctgacccagctcacacatgtcttccccaagctttcctttactttgcttatctcctttctcattccttgttttcgtttttgtttttttttttagacacgggtctcactatgttgcccaggctgtcctcaaactcctagactcaagcgatcctcctgcctcagcttcccaagtagctgggacttacaggcatgagccactgtgcctggcgagtttttttttcgttttatttctctctcaaacatccgtcatcttccccccctctcatttttggcccttaaccatgtgattctttatacttctgtcctctaccctgattcagtccgcctcctttttgtttgtttcaacctgatgtttctccagtgtgtgtagtctgtagagcagaacaaagctccattccactcccaagttacaaggatctatctagttctgagctaggcactgatgaacattggactcattgtgacactaacttacccctggttgtgggaatgtgttttataataagggcagctgtttgaaatctgtaataattaaaataagaaacacattttgtgtcatagtttaaattcttagtgagtacctgctgtgtatagtaggtactcattacaactggacatttatcccacaagaagcggggtgatttaattcacggaattttaaatgattaagcaaaacagcatgtcctgaggtacaggttatacagaatactaggacaggatctgacactgctgttagtgtcagggaaatggagtgaagttgctctacacaggaaaatttgtcattttgtatatcagtgttaacatgcatcccaattgtctgttattctttagcatttatgttaattttgttggaaaatgccattttgccaaatactgccttgtttaacaaaatggatttatgacagtattccataaagactgcctttttctagcactcttatcagcaggcaaacttgataaatagcttaattctcattattctaaaaaagtacagaactattcttcaatgaattttgctaacactgtagttaaaaattatttcctgctggaaattttatgtaaggatatgtattgaatatgatgacatgttaaaaatatccccaggaggctgaggcaggaggatcacttgagcccagaagttcgagtccagcctgggcaacatagtgacaccccatgtctaaaaataaataaatggataggtagatagatagataaaaatatccccaaagtaagaggttgagatggtttcaccatggctgtttcttataacttaagaaaagctgaaagcataacataaaaattcatttctgaaaattatttagtatcataatacttgtggatattttactgtgattataatatgtattcagaactgaaccaagcaattattgtctctcttattctcacttcttagaggcagtacggcccaaaacgccacccgttgtaatcaaatctcagcttaaaactcaagaggtaatccagttttacattgtacctagtagttgatatctggaaataaagtaactgtgttaactctttctgataccatttaaaactatgtatgaatatgggtttggaagaagcagcatctggtacttgaatagtcaaggaactagggctgagacttgaggacgatttactggcatatgtaattctagatgtgttcatcagggattggagagaagggttggagtgattcaaactgtgaaggagaataatagcctcaggtggtaactcatgtagttaccaagcaactgcaagttagaaggttggagagcagtgctcattgtcttacagctcgcagagaaaagaaataaaaatagcacggcattaaattgtgagacaatagcaaaccagaataacacaaatgtcgcttagcaaaccatttcaagagctcatttgttgcatttcaggatgaggaagaaatttctactagcccaggtgtttctgagtttgtcagtgatgccttcgatgcctgtaacctaaatcaggaagatctaaggaaagaaatggagcaactagtgcttgacaaaaagcaagaggagacagccgtactggaaggtaaaaaacaaaacaaatcaaagcaaagaaactattcgtctccctaattccaaagctaattgtagaaaattgttattctgaagccagtgcacaaaaatgtgttgtaaattttgcatcaaaattgattcttgtcagaggcaatggctcacgcttgtaatcctagcactttgggaggccgaggcgggcagatcacgaggtcaggagatcgagaccatcctggctaacacggtgaaaccccgtctctactaaaaatacaaaaaaaaattagccgggcctggtggtgggtgcctgtagtcccagctattcggaaggctgaggcaggagaatggcatgaacctgggaggcggagcttgcagtgagccgagatcgcgtcactgcactccagcctgggtgacagagcgagactccgcctcaaaaataaataaataaataaataataagtttttggccctggtgcagtggctcacatctacaattccagctactcgggaggaagctgagatgggacaatcacttgaacccgggaggcggatgttgcagtgagccgagatcacaccactgcactccagcctgggtgacagagcaagacttcatctcaaaataataataataataataataaatttttaaaagctggcattctccttgactgtagacatgtacatggaagattcttttcccagctgctgcatgccaaaagagcattgcttctgggaaggagcaggctgcttttaaaaaccagttttctttttgagatagggtctcactctgtcacccaggctgaagtgcaatagtgccgtcatagctcactgcagcctcaaactcctaggctcacaccatccacccacctcaggctccaatgtagctgggactataggcgtgtgccaccacaccaggctaatttttttaattttttgtagagatggggtcttgccagattgcccaggctgatcttgaactcttgggctcaagcaatcttgccacctcagtgtctctaagtgctagtattataggtatgtgccaccatgcccagcccaacagtctttttttttttttgagatggagtctcaccctgtcgcccaggctggagtgcagtggtgcagtcacggctcactgcaacctccacctcctggattcaagcgattctcctgcctcagcctcccaggtagctgggactacaggcgtgcaccaccacacctggctaatttttgtatgttttgtatcgctatgttggcaggctggtctcgaactcctggcctcaagtgatctgtctgcctcggcctcccaaagtgctgggattacaggcatgagccaacatgcctggccccaatagtcttttatatattatatatcttggctccaggactaaattgtaagatccccaagggcagttacacattgtctttctgtccccctacagtacctaatgtggaacttagcactcagtaagcaccctaataaatatttgtgaaattggtggcttcctgcacaacacagggtgtcttttcctttgaggttgctgctgtagaacgattaaagcatttcatttttgttttctctatagctaagtttaaggtttatttttaaagacaggctgggcacggtggctcatgcctgtaatcccagcactttgggaggctgaggcgggcggatcacgaggtcaggagatcgagaccatcctggctaacatggtgaaaccccgtctctactaaaaatacaaaaaaaaaaaaaaattagcctggcgtggtggtgggtgcctgtagtcccagctacttgggaggctgaggcagcagaatggcctgaacccaggaagcggagcttgcagtgacctgagatcatgccactgcactgcagcctgggcaacagagcaagactccgtctcaaaaaaaaaaaaaaaatacaaaaattagccaggcgtggtggcaggcacctgtaatcccagctacttgggaggctgaggcaggagaatcgcttgaacccaggaggcagaggttgcagtgagccgagaccacaccattgcactccagcctgggcaacagagtgagactctgtctcaaaaaaaaaaaagagacaaaaatgaatcttagctttactttttaaatagccagtttgttttctcaccattttataacattacatagcagatgcattatcctacacacacagaggtatattgagtgtctgtgtagaaagttgcaggtctaaatctcaacgcggaagaccagtgtgagagctccagtcagaacaccatgagagagtccaggctgacttcagaccccggtgtctgtctccactcttaaggagacagctctttgtatagtggttaagcatagactgtggagcctgcagatgtggttccatccttatatctgtcgctgtcaaacggtgtgatcttgggcaagttgcttaacctctcctaagtctccatttccctatctataagatgtggcaaatagtaataccttgtccatggactgttccaagggtgaaaagcgtgatacatagaaagcagttgggccagtgcccagcccagtaagtgctcaataaacattagctgcttttgctaccatcatcatcattggtagtggtaaaaattaacttgcaaccaagtattaattatcatttacccatttaaataaaaggaaatgcagaggcatagggaaagcaaaataacacccaaaatatattgatgacatctgatacctttgcttctacattaacagatttatctttctaattgtgtttatccttggtcactgttaaaatttactgagtttttctgagcacacatagtagtgaagcctgagatactaaaaattacagcagctaggactttacgtaggtaattgagatggaccgaattgtgaacaccagcattatgaattcagagagaatctttttcttctcctttgtttcttttagaggattctgcagattgggaaaaagaactgcagcaggaacttcaagaatatgaagtggtgacagaatctgaaaaacgagatgaaaactgggataaggaaatagagaaaatgcttcaagaggaaaattagctgttcctgaaatagaagaataatccttaacagtctgcaaactgacattaaattctagatgttgacaattactgaatcagaaggcatgaaagagtataattttatgaaattcaaaattattcttttttcaagttgaaacttgcctcttctactttaaaaaagtatatagaacagttacttctaataatcagaaagagatgttttatagaacatttctttaatataaagttagagatgtcttcataggcagtatggctatctttgccacagaaacataagtaaaattttagagttctgttttccatgaggtcaaaaatataatttattcctcagtcatggttttctaaatatctgtactccacattccattttaattgatatgagggtgttaaagtacctacttaatgggttgattactatcaaaatgaccaaattataccaaagaacttaagaggaagcactttcagaactattcacttgccaggtattttctaaaattccacctgaaagccaaaagataaaataaataagttgattttaatgatataagcatcacacaattttacattaagaaatactgtgcaggccatgcgtggtggctcaggcctgtaatcccagcactttgggaggccgaggtgggcagatcaccggaggtcaggagttcgagaccagccttgccaacatagtgaaaccctgtctctactaaaaatacaaaaattagccgggcatggtggcaggcacctgtaatcccagctactagggaggcttttgaacccaggaggcagaggttgcagcgagctgagatcgcgccactgcactccagcctgggtgatagagtgagattcagtctcaaaaaaaaaaaaaaaaaaaagctgtgcgaaaatatttgtttttctctggggccttttctttcttttctttttaaactataccagaaattttacatcacagtttttatacaaagtgggaccttccatactttttgtattacaataaccttcagaagcccattccccttaaagtctgttgttcttgttttaatcatcaccacatataaatgttttagctttgtcttaaactgtgagtcttcataaaattgtgttcctccgagttcaccttctaggactttattgattaatccttctctttctgctataccagcagacacatattcatagaatatgattatttttaaagaacaaggtgaggaggctgaggcaggagaattgcttgaacctgggagatggaggttgcagtgagctgagatcacgccactgcactccagcctgggtgacagagtgagagactccgtctcaaaaatgaatgaatgaatgaatgaatgaatgaacgaacgaacaaggtggtttaatgtcagaaaacttcctaagcatttgctccccaaacctttcatgtttttcaagaagcctttattacataaaggggaatagaattaaaatgtttctttataagaaaaatatacatatttgtgttcttggccccattaaaactagtcagtagtcctttggcaaagatatagtcaacaagagaactgggtatgagtccaggcattactcctgttcatagttgtggatgcatgtgtctgagccagactgtctcaactggagtctcttgggttatagcagtaaacccgtgtattccatgaaaccactgggcccatcatcaaaaggtttccacttgtggtgccacagttgcttattactgagtttgggttccaagatgactggcaacttctgaaataatctcattgaaggaaagagtttcattttttttttaaaagagtttgctggaggaaaagaagcatgttaaatgtttttaagcagctaaaagtcctagatggaagcatatcaggatgtgtcggtgcttggctcttagtgaatgcactaaaattcttattgataaatgttgaataaacacacacaaaaaagtatcagagaaagagaaaaaccctacaatggcaatagaggtgtgtgacagttattgctatcaattttacataatatctcatttaaaaacaacctaattatgcattgcctgtgaaaataaaaggataaaataagattttgtacatactgtaagaatacagttgtgctgtatttttatggattcatcaaggagtaaaatgttctgctttagtaaattatataggtaactgaagtgttattcctttaaagagcaaaataatttatcaccatgtttggtggaaaatttctaagtatttattacatgcctaggggttagccaacaagatataccaagcatgaaaacctgtaaaacttaataaaatgctaaaatatgaacatcaca

SEQ ID NO: 166 - DNA, 43102 bp, Homo sapiens; identical to SEQ ID NO: 165

SEQ ID NO: 167 - DNA, 12639 bp, Homo sapiens
taccagtgctggcagcaccattatcagtgatgtatttaccccgggtgggcctctcgcatttagcatatgttctgaaactcccgcaagcatttccgggcttcttcaagaaactgcttgtgcaacctgttttgctgtaagatctgctgctgctggtctcggatcatctgactgtgccggtcgtcgtcggcgaggctggtgcccgatggggaagtggtgctgagctcagatcctctctccctttcctgggctctcgtggaggaggacttcagatgggccagtcgagctcttctttgctccctcctctctttttctagctcagctttgtagtggatttccaagctcatatctgggtgttccatttgttcaagcgattccagttgtttttgtcttctctgctccatctctgctttctgcctttgcctggatgccgtcgagcccactctgtctgcctggtcttgaaggtggagctgaagggagccctctgccagcgtgcccagtttgggggtctcttgtccagattcagtgctatacaataatgagtcctctttgttgataaatatacctgcctcgggagacaatgtttgacttccatttctaaacgtgggcttgaccgtgccctgatatttttggttctgggccttgcccatgaacgttttcaagtcggtcttggacgctgcctgctgcgcctcctcctctgctgggctcctgggttccccggcaggcagcatctctgggtctgccattttcttccctcttggggtcccagcgccacactcttgcatctctgagaaggcatgcccttccccaggtctctggtccatcctgggcttcagtgccaggtacaagcacaggtgttttttcagctttctgtttatattaaacaactcttcaaaggccaactccagctctttctgccacttgttcttctcccggagcgtgcactgagatgctggggacacggcttcccttctgcagctggaatcagctggccacagctgcccgaggtctctcagcttcccctccagactctgtccctgagagcgactggtcagggctggaacaaagcaaactgccccctttcccagttgcctcctccccgcccgagctgttcctttctctttttcctccacaagcccgatttctcccacagcagccacgagtgggtttgacctttctaggtccgcccctttgctcctccgaggatggatggcacagcggccacccccagacttggtcgaaggttctggccttccctttctcttctcaggcggggccaggtgagaattcatccgacccgtggcttttgtagtctgtggtttctctggactcgctgctgtcttccggggcctggagtgcctggggtgttgctggcccaactcttccctgcaactcctctcttcactaagggctgctctatgcttctccttggccctcgggggcctggctgatcttcgctggatgggcccctgcgagtcaggctcattttccctggcccgtcctcctccccagcccaacagacgtgctgactgcagcctgtccaggccaccgacgtgcaggtgctgtgcctcctgataccctctcctcaactcctcagccaagcgctggagctggtagtttttccacagcttggcatccgctcttctctgcagagcgagatcgcctttgccccgggcttgtagcaatttgtgctttttcctccaaagcaggtcttcgttatcaggacagaggctcagccacatggctccatccatgtttctgttcctgtctgcgaacccagcagatacagcttcccagggaaggtgcttggagccaagagtggagggttcaaggggcgcccccgggcctgaggagccacagaagccacaacgttccacagcaaacctacgaggaagggagcacaagtgcagctttccagatcgctcccaggagagtgagcaaagccctggagacaagcacacgggattctcactgtgaggacaggctgcaaaatgtgcccctccaagctctcttgacccgtgcccaccagggcccactctcagcctcccaatttctgtcctgtacacttttgacaagagcctgtagggcagctgttttgaacagagtgtggtgttgtttcccaggggacattggcaatgtctggaaacattttctattgtcacaaatgcagggaggaggtgctccgggcctgcagctgggtggaggcgagggaggctgctgaataccccacactgcacaggagggctgcccaagacagtgaataacctggccagagatgtcagtagtgccgagactgacaatcccacccaaagggcaagggttaggattcaggtagggatggaggggcacaaagggcagcccttggaaacaaatattgagaagagcaggtggaagtaaaagaggaagtctgggcctctggagggagaattgatcgtaaaggaaaggaggaagagacggggcagggaggagcctgccaagcatgtgtgtgtgcaggagtgtgtgcacgcgtgtgcaggggtgtgtgtgggtgtgtgcacatgcacatgtgtgtgcaggggtgtgtgtgcgtacatgtgtgtgcaggggtgtgtgtgcatacatgtgtgtgcaggggtgtgtgcaaggatgtgtgtgcatgtgtgtgcaggggtgtgtgtgcatgtgtgtgtaggagtgtgtgtgcaggggtgtgtgtgtaggggtgtgcgggcaagggtgtgtgtgcaggggtgtatgtgcaagggtgtgtgtgtctccatgcatgtgtgtgcaggggtgtgtgtgcaggggtgtgtaggagtgtgtgtgcaggggtgtgtatgcaggggtgtgtgtgcataggggtgtgtgtgcaggggtgtgtgcgtggggctgtgtgtgcaggggtgtgtgtgcatagcggtgtgtgtgcaggggtgtgtgcgcgcaggggtgtgtgcgtgtgcacatctgtttatgtttctgtgcacatgcctgcacatctgtgtgtacaggggggtgtacaggtgtgtgtatgtatgcatgtctgtgtgtgcctctgtgtgcatgtcggtgtgtgtatgtgtatgtgtccgtgtggggcatgcaggtatgtatgtgtgcatgcaagtctgatacttgaatccagtagaaaccagagaggaggagaagctggtgttagctctctcttcatgactcccagctctttccttttataatgatcagagaaggactcttccaggtctctttggcatcaggaagggacccatgctttggcaggccttcctaggaaaggaggggcatttacaccaaaacagtacgggattgtgtctgttgccacgggtagctgatgccagaaacagccagatctgtgagctgcaggaaaggctaagggacagccacagtcgatatggagtccccctccactgctccttcccttctttcatcttagtctatgtggaaccaggctaagcctttggagtcaaacgtagttgcagctgaagtcacatgtagttgcaggagtcagaaaatactgcatctacattacagctaacattaaccgtgcaggctcccctctgagcactgggcatgtatccgttcatcttttttacagtaatcctttgagatacgaagctcctaccccccccggttcacagacagggaaactgaggcaggcagagatgaagatgcttaacccagatcacacagctggtaagtggcagagacaggccctctgctgcttggacgaaccccagcacctttgaccaacctcaggtggtcacactgcagctggctttgacttaagtcttctagtgggaggtccttgcacctcttggtaaatcagatcacacaattagaatagtggttaatattatatttagccagatctgccaaccaccatgatgatcaagagagaaagggagagagaaagctgggcccttcaatgcaatgattgagatttttgacaaaggtgccacggcaatttaatgtggggaaagaatagtttttttgtttttcaacaaatgatgctggcacagttggatatccacaggcaaaaaatgggaattcacagccttatctcaccctatatacaaaaattaactcacaatggatcatagaccttcatctacaactataaacgcttagaagaaaacgtaggtgtatattcatgaccttgagtcaggcaaagatttcttagatacaacaccaaaagcacaaccaataaacaaagaaacggataagctgaacatcatcaaaattaaaagaaaaaaaaaacctttgtgcttcaaaaggtaccataagtaaagtgaaaatacaaggtacggactggaaggaaatatttgcaaatcatatatccaacagaagacttgaatccagaacatatgaacacctcttactacccagtaagatggcaaataatcccatttgaaaatcagcaaaagaaggacaggtgtggcagctcacacctgtaatcccagcacactgggaggctgaggcgggcggatcacttgaggtcaggagttcgaaagcagcctaaccaacatggtgaaaccccgtctctactaaaaatacaaaaattagccgggtgtggtggtacgcacctataatcccagctactcgggaagctaaggcaggagaattgcttgtatctgggaggcagaggttgcaatgagctgagattgcaccattgcactccagcctggatgacagagtgagattctgtctcaaaaataaataaataaaaataaaaatcagcaacagatttaaatagatatttcaccaaagaacatagatgtgtggctaatacagcacataaaaacatgttcaacggcagcggtctttagagaaatgcacactgaccctgcagtgtcctgccacctcacatccactccaacggctgtcgtcaaaaagacagacaatagcaactgtcagtgaggaaggagggggaggaattggaaccctgtgcacgctgctggtgggaatggaaaatggtgcagccactttggaaaacagtctggcagtttcttaaaaagggaaacacagacttaccctatgacccagagattccactcctaggtctataaccaagagaaggcctgagtccacaaaaagaaaccaaagctcagagaggttgaataactttcccagctcacatggaggagttggcctcagacaccaaagaccaccaggaacggccacagggatgtccaattaggtgtggtgaggtcggggctgctgtgaatgcccctctgtgtgtctcggaaggtgcctggaggccccaaggttcacagtctatttctgtgccaagagccgttggctcacaccccttgtcaaccaacaattagtaaaacctggacaagtcttccctgctctggaagtgcccccagcccgttcaatgacctcagtgcaccccgtgccagccccactggcgtgggcatcccaatgaagcagcgtcagttttcctggagacacgcaaacgggtaaaaacttaacacatttgggcagagatctttgggataagtctagaaaattgcagccagctccatccttcaggaatcgatccccgctctgacaccatcagatgcaacctcgtccccgctaccccagctctccttgctctcccctctgagaccctccccacttactaacttgaggcagagggcagggtctcacgtggacttgtgcaggcactggcagggaaagcaacagagccttagctgagcccaagatgaccaaggagaaacagccgttcacctgttgcacagcctgctgggatgcctgcctctgcctgtgatgcccaggctgatctccaggcagcccagtgtctctccagccctgccagacaggacgtcgggtgcccttggcaggacacttgccaatgaagacagccatggttccaatcagggccctcgctacagctcccctcccagaggcacctgccctctctggttgcttagaatattctagaaggggcaggggtcctggcgctcctctgtcctccacatcctctgagtgttctgagcatcctgggctgctttggtgttttctactcccctgctgccctctggtcctgccaccccgagctgacaagcctgccttctgctggctgccttcaaccactcagagaaaccacagctcccccctccgcagaagccgcgctcggagcagcagaaggaaggcgagtggacaccaatctggcctccggacggcaccagggcctcccacagagcggagtggacactgggcccattctcctctcttgctctctacagccccgtggccccagcgcaggagccagcccatggcagctccaccccagaccgatccgatcccagcacctgggcccaggaatgtgcttggccaccagattcccagcgattctcaccaaagtcaggcaacctctggcctacagcttgagaatgacgtccaagcagctcgcctttccctgggcggccgctcagacagcttttcagccaaggcagacctcacccagggaccctccacccaggcagcgtggaagtgccagggcccacagacagcacccccccgccccccgccggcctcctcaccccctccgaaggagactccaggcctgctgtgcactcctgtggcatcggggggcggggggcaagcatcacagtcatagggagtgtgaggcgcccagaatgggggctccacagtcaggcctgcaccccggctgcaggataccagatcctgtggttcactgtgagacctccgcctctctcgtctgcctcacgctgccccctcgcacccccaaggtatgacggcatttgaacaatgcacgtgcccatctagagccttggggtgggcctgtgagagagtggccgcccaccccagtccccaccaggtgcatagtcctgcggctaagtcagggcggttgtaacaaaggctcagaccctccaactaccaggctgtgttgtgacgaggctgctggagccccaggcaccatgacgggaatgggtgaatccacccacagtgggtgactctcaatgtgatactagcccggtacacttagacacccaaaaatcaacgcggcagacgttgtatccccaggagaaggacccccccgaacagacacgtgggacaatggcaagcatggccatccctgaggacaatggcaggacccagagtgcctctctcctcctcaaggcatgaactggcccctccagatacagggacaaccttttcttcccacctcggcctgtaacagacacgacacaggccatacccttggctagagtcactgcaacatgatccagagggtgactgtgaaaggagccagcggggctgctgtgtcggttttcctggagacacggaaatgggtacaaacttaaaacatctgggcagaggtctttgggataaagtccagaaaatcacagctggctccatcattcaggaattgatttcccccatgacaccatcggatgcaaccttgtccctgccgcctccagctctccttgatttcccctctgagctcacaaaaagaaacaaaagctcagagaggctgaataactttcccagcttacacggaggagctgggtttgaatccagacatcacactgatcagcacgcagacccgcagggtttcatactcttccggcatttcacgtacacctctctccatctcaccgcctcaccataggaggtgaggcctattcctatccgcacaatctgacagggaaattgagactcagagaggttaagtaacttgcctaaggccacatagctcgtaatcagggcagcagggattccgggccgagcaggcaggcccctgatccaggctcctagcctgctgcccagggaggtcagagctggaaaccacttccacagcacaaggagactctgcttggactgtgcttggcctcacgtgacctctgacctccctggccctcctgtgaccctgacaggtgtgctgagcttctgaagggtgggaaggcctgcaaggggcctgcgtgcattctgtgtgcatcgacccaggacaccacggttggtgcctctgagttcatcacgtcgatcatccccatcttctttctgctcaagtacttgatttgtcaacatgcacagaagggtgagacctggccatggtgctgcttgaatcttgttaacagttaggctctgattcaatagtctgggtggggcccaagactctgcatttctttttcttttcttttttcttttttgagacggagtcttgctctgttgcccaggctggagtgcagtggtgcaatctcagctcactgcaacctccccctcctgggttcatgcaattctcttgcctcagcctcccaagtagctgggactataggcacgcgccaccatgcctggctaatttttgtatttttagtagagatagggtttcaccatgccggccaggctggtctcaaactcctgacctcaagtgatctgcccgccttggcctcccaaagtgctgggattccaggcatgagcccccgcacccgccagactctgcatctctaaagtgctgggattccgggtgtgagcccccacgcccgccagactctgcatctctaaagcgctcccagggatgctgatgctgccatctgggggaccacgcttggagtactgcggccctggcaaaccatctcttccaggaagctgcatcttgctctgccttcctcccctgccagcagctcagccctgatcatctctcacctgaggcccttaaaagcctcccaatcagcctctctgcccccgacccccaggcctgcaccccgtcctctcccgcactgcagcccagcgctgtctaactgagagacctgggttacatttcagcatcccccatgtgattccctgctgtccacaccagcaagtctctgagtgcaacccgcagccacgtgcatcataatcagctgagctgctggtgaaggggtagattcctgggcctcacccctgacagatcctatcccagcccctgcgggaggggcccaggaatgcagccagttcaccagctgccctgccaaagcctggcaatctctgggcctagaggcttgagaacggtcaagcagctcgccctggctcccctgggagccaccctagcctggaacgctgcacaccagacaggggtggtagagctcctggccattcccaaatgccccacacccagcagcgcctggaatgtgctcatgcaggttcctcgtgacatggacacacccccttccccatcctacccgcatgtccccagcccaggcctcgttcccactcccccaggatgccccaaccctccaagggaacaaagagaatgctcttccctttctccagaagcccagcacccgggccacatagtcaagcgctttgtctttgaaacataaaaatagctatagaagggctccgttagctggcatcggccagagagagaacatttccatataattagagcttaccctttcatatggaaagttagacatttctctgtctaaggcgcctacgtagaatatgtaatttgaccttctttgggggaaattttggattgtctttgggatgataatataggaaatccctcgagggcttttaaaatgtaaagaacagaggtcccataaactaagtgaccccagaatgcaatttgggttttttaagtcgcctttttagagcttcctgtgtcctcccttccctggtcataactgtctgacagcagccacacaaacaagcttattaaaattgtggtttttttggccgggcgcggtggctcacgcctgtaatcccagcactttgggaggctgaggtggctggatcacctcacgacaggagttcgagaccagcctgaccaacgtggtgaaacctcgtctctactaaatacaaaaaattagccaggtgtggtggtatatgcctgtaatcccagctactcaggaggctgaggcaggagaatcacttgaacccaggaggcggaggttgcagtgagccaagatcgcaccactgtactctagcctaggcaacagagcaagactccatttcaaaaaaaaaaaaaaatgtgttttttaataaagtaagtagagtccgaggtggtggtgggctcttccacaggaccactgcctgagctttcacacctgaccttatcaattcaaagctgtgggcatccccggatacagataacccttgggggaggtggaaaattgttgctagactctagcctagaggtttttaacagcttgcacaactggccaaatcttacaagataaaaaaaggtaatgggaacacatctaaaacttatatgtgggtccctaaatccaactatgcaagtacagaggtgggtgtgtggagcagcacaggggacaaaagacgctgggccaccagaagggccaacgtgactgtcccctgagtgaacagaaacgcctctaacatgcgagcgaatggtgcagcccagccagcccgacctcacctggccatgctaggaggcagtgggcaagcggcaacgctgtggtgcccaggacgccggcaggcacagcgccacgtccacgggcaccgcccgttcccaccctgcaggacgccacagcatcagacgagacggcccgtgtgaagcgccgagaacagagtctggcttccgggagggctcaggaaatgccgagagctcggcagagacacccacgtggtgctggattccacgcacgaggaaccgacgggcagacgtggagctaaatgatggtcaacagctacgaagtgcctgtgctctagaaatggccaatttgatcatgtcacgggataaagtttcaaaatcaataaaaccgtgatgaaatgatcaggaataaacctgtccagaactgttcaagacctaaaggagatgcacgggctgaagaacaaggagcaaatctgaacgagggagaggtgtgtcttcctggacagttctcgggagaggaggagggcggtaaggacggggagaagaggccgcaggcttggagtccaggaggagaatgaactcctttggtcaggaggggcccactgaccaaaggtcctaggaagaaaagccaaaggaggtgaggtggggcaagggtgtttgcaaaggatagaaaagtctagaatggcagagtatggtgcttaagagtactatgtgacctaggccaagcgacttcactctgggtgcctcagtttgctctttaggatggggatgataacaacagcagcacccatctacagagatgccagtgcttgtcaccacgagaagcacctgaaatgcttggggaagaggggtggtacttactgtgtgtgtctccagatgactgagctagaccacccagaacacattacagggaggcagaagctgacaggagggcaggaagcactgtctccagggctgtcttgaaatcactgggctgactttgtaggtagtgagacgcccatcactggaggcatccgaaccaagcccagataaaacaaacatcagaaacatttttaactccgtttctctgagttctagcctctaaaaataccctccatgacacgctgtgtgctgccagaggcttggttttcgccctcttctccccaactcttagccacgtcccagtggtggcggggggacgggggtcccaagccactgcactgggttttggtttcactatgttgcccaggctggagtgcagtggtgcgatctcagcttactgcaacctccaccttccgggttcaagcaattctcctgtctcagccttcccaagtagctgggactacaggcgcacgccaccacacccagctaatttttgtatttttagtagagacggggattcaccatattggtcagactggttacaaactcctgacctcaggtgatccactcgcctcggcctcccaaagtgctgggattccaggcatgagccaccatgcccagcctgcactgggttttggactggctgtgttagcatcacctggggcaggggtgggtcacgttagaatgagtcctggctaggcccacagcaggcttttccacccgaatactggggccacagctcatgaatctgtgtgtatccatatcctgggctgggtcagctctccagggtggagatggttgggcaggcagcctctgggggcaagctcgggctcaggcctccccttgaccagcttcacagagacagacactgaggcagactgacctccaaactcccagctgagacgccagctccccacgtggggggcttacagctgatgcaaccggtggctcactaaacatacctcgacagcgtccattaccgcttccctgcaaacctcaagatcctaagcacccagcctaggtcaggggtccccaatcccagcaggtgttcctgcttcctgaagaccccccagcccaactcctccaacaaccatattcatctccaacccagtcccaccagcttccctcactctccttcccatcacactgcctgtggggagccccgtggtgcagggactttgccgctggccttgcgaacccacggcttggagcccctccttggcccactctccggggccctcttgggagcctcgctaaacagctgggcatggaaagaaccccaccctcaccacagatgggaacagacacagagagcctcagccccgcagtggtctcaggggcccactgaccaaaggtggccggaatcgcttccccgcctccacctgcagcccggcctctgccctggctggctactcatagcaggctgttgccat

SEQ ID NO: 168 - DNA, 12639 bp, Homo sapiens; identical to SEQ ID NO: 167
